United States Patent 8,781,750 (CELL-TYPE-SPECIFIC PATTERNS OF GENE EXPRESSION) - sequence listing, part 31

SEQ ID NO: 37043 - DNA, 104071 bp, Homo sapiens
gctcggtcgggcgctgtctccctcggctctgcgggtgtcagttcgtccggcttcctcacagcccctcactcccggcggctgacagcagcagcggcggcggcgggcggcgcctggcgtttcgaggctgagcggcaccggggttggggcgcggaggaggagcagcagcgggaggaggagccgtgtgccctggcactgagcggccgcggccatggcgtacgcctatctcttcaagtacatcataatcggcgacacaggtgagggccccgggcgcggccgggcgggtgtcggcggcctccggacccgggctgaggggcaaacggcgtctggcggtggcggggacgcggactccacccggcgcctccctcctggccgcgccgctccatttccgcagtgctggagctggtgacgtgggcactgcgagcggccgcggcctggccaggcccggtctgcggcccccgacccggccagtcttgcagctgagggccgtggcagccgtttgcgacgcccgattcaggaagtgtgtgacaggaggggaggcctagcgcagggccgccggggcccgactcacatgactgcaccccacccccagggccccttgcgttaggtctcttcgcggccccaggaaaaagaaggagggaaacctaggggagcagaaggtgttggggcccgggtcttggttcctgaccagtccaaccttcctccaccagcacgcatctatcaaggcctgggcaaggcgctttttggcgtgggacaggcagccgagaaagagaaaaggaaacctttaaaatatgtattttatatatatacatatatataaaatatgcttttttaacaccttcaactctcacgtcagaataagtcacatctcattacttgacggctggagaatccctttcggggttaggaaagcatgaacgagttctgtggacttttgccacgtgtgaactggggttatatagtaatgtaaagtcgttcagtgctctgggtgtgtacttaggtatgtgtatgttgaggacgctgatgttttagatatgtcaagtccggtgtcacaactgctaattttcaggtgagctcatgtccatgagctgaaagaaattcagttattctcacttaaaatgacgtcctagtatatttcacagaaaagtaaacagactcttcgtagatatttttaatacctgtgatttggcattactttgaatctaataataaacataaagattgtttagatgttgcaactattaatataccagagtctgatttcagtggttactcttgcacaactttggaccctttgcacaacttcggtcatgtaagcagcagtttgtagttgaactaatgatgtggcaggttctataagtaactaaagaagcatgttggccggacgcggtggctcacacctgtaatcccagcactttcggaggccgaggtgggggatcacctgagatcaggagttcgagacctgcttggccaacgtggtgaaaccccgtctctactaaaagtacaaaagttagccgggcgtcgtggcaggcgcctgtaatcccagccacttgggaggctgaggcgggaggatcacttgagcccggaaggtggagtttgcaaaaaaaaaaaaaaaaaaaaaaaaaaagcatatttattgctgcctgaaagaaaaaatttctgctagatacatgagttttcagcaaggttttctgatgcgtgcgtgcgtgtgtgtgtgtgtggaaattggatttgtaaactttaaaagaaaaatgctgtggtgtatttggaagaaggagaattctaaagtcttctggcaaaatttcatttaggctgtaaaaacaagattggagaggaatgccacattaactgtaatatgagtgggtttgagaaatagaagcttgtgactgtggcatttggctatctcattagtggtgaaaattcaaatcagactttgctggttgccttttttcagttttttatttgaggctgtactgtggataaataaagtattgtgcatggagtagtggggctacaaatcctaacaagttaatgctctgttctcttggaatttgctcttatccaaaagcagtccccacgcaattcaaagggaagacacttctttcttgtcattgctgctgatacgacctagttcaggaacagaattcttgacactgttatagtctgcagcagtacttctccctactccagttcagccagtgtagtttactgtcagtttagtcatcctgaagcatgaatgtcaaaaggctactcctgtttgctcacaatttttagtttgaccttcagtgaactctatattttagcccctatctacatttctcgccttctttcccgctattccccaccttgcttctgccattgagtcccagtgactgattttggtgtttttttcctgggcactgctagtctctattcttagagtgctttccggcacaatctctccctgtggaagatccatcagtccttcaaagtcttatctgagttttccgtaatgccttcacagtcaacatatattaagctcttattgtgtgaagattttcacagtatcctggctgaaagtgactactccgtttctgaatttatgtttctcactttgtgtcattcttctgatattgatcccagacttttctgttgtatagatacttgtataggcacctctattatgtaggtacctattatatacttcttgaagtcagaaaagatgttttgtatggctctgtatttctttcaggaagagcgtagtagaaggtaggccctgtatatttaactaataagagaggagccaaacaggctactatattcctgtttgtatatattaataacttaacagaagtggtgtcgttgttgttgttgttgttgcccagttctgccaccttcttgcttactaatttgggcaaaatcctttaccatatttctttaatgcagagtgtacccatagttgtaagatacactcagtgtggccctcccctagaaaagatgactttaaaatcagtaatgtgagatccactttgattttttaaaaagtcagggtcaaaaacatgcatcttagaatgaaggaaatcacctaatttttctgtttccctgtttccgtaacctataaccttctctcagtatgtgggataaaatgaggataaatgtgaaagtactttgatttctcaaaggaaaggaacaatgcacatttttccttttcagaattccctctttaatagaagaggttttaaaaacttttacatgatcatgatgatactattgagctgttttcttactgtaagactaaatgcagttaaaatgtagctttaaattttttccttgttcctgtcttgtttctgaatcatttagtaaaatgtgtcatttaaatctagatgtaaagtggaaagtggtttttaataagcagttaattatcaagcatggagagaaaaaatacgaatctatagtaatttttcttctgaaattctagcatctgccaaccattttaaccttatcactaaccctccctgctgctcaacgctcagcaaggtaaacaaaggcacaggtttggttgtgttcttatttctgctaatatctgaagcactccttcttgttcttccctatcaaaaaaagttatgtcaaaaatttttgtcacctggccaactcctttttatccattcttttgagagtttaacaaatcctaccactccctgttgcattttatgctggtcccctcctctcttccctcattctgtttcccttctcttcagtcccagtcccacttacattttattttttatttttcactcttatgtatatacccaccacttccattttattttattttacttatattatttatctatctattgagacatgatctctgttgcccaggcaggagtgcagtggcactatcacggctcactcactacagcttcagtctcctgggcctaagcaatcctcccacctaagtcttccaagtagctgggaacacaggcacatgccaccatgcctggctaatttttaaatttttgtagagatgggctctcactgtgttgctcaggctggtctcaaactcctgggcttaagccatcctcccacttcagcctcccaaagtgccagattacaagcacaagccacagctctcagccccacttgcattttaaattatctttttagttaggaaggtctttgcctttgtcttagatgccagggtacaccattgagtgtcagatttatttaatagttaagtggatggatccttgaggggaggcactaggtgatgtttcagctgaaattagaatgatgagtaggcaccgccagagtgggcatgggggaatgtctggtatgtagttgaaagtttatttctggctcaggagagagtaatctgggatagagacttgggagctaataacataaaatggagtccctattacctgagagttcattttctgagcttttgaaattacaaggttatgtagggaagaaaaattctcatgatatgaaaataattattaataagttatcaccttaaaaaattaactactcaagcttacttctaattcccatcctcctgattggcgtaggggcttgctgatcataatatagttcaaattagttgcaaagtgaaattatgtatcatgctaaaattgcaagcatttgtttcttttttttgagatggagttttgctcttgtcacccaggctggagtgcagtggcgccatctgggttcactgcaacctccacctcttaggttcaagcgattctcctgcctcagcctccccagtagctgggattacaggcgtctgcccccacgcccagctgatttttgtatttttagtagagatggagttttgccatgttggtctgactgggtctcgaactcctgacctcaggtggtccactcacctcggcctccttaagtgctgggattacaggtgtgagccaccgcggcaaggcagcatttgtttctttgatgcaagtgatttggagcattggttcacatgcaaaaccattgacaaatggggatctgacaaagttgtcctcctggaatgaagtaggtggtgattgttcattgaatgaattgacagatgaaagcttggatgtaatggtgggaaatactagtgttcatggggcacatggggaaagttatcagcatagtaggctaacaaggaataatcaaaagagcaagagagacctgggcagtacagtgtcatggaatctgcagagaaggcagatcccagagagggagtggttaccagtgtcatgtgcagtagaggtcagggactattggttgaaatggtaggaagacattagtgctttgacacagtgtttgattcagatgtcagtgagggggagaactaaggtgtattttcatttatgttgttaaaaaactgtggatttttatatatgtgtaaataaaaaaagtcccaagactacacacttaaccgttacttctggggaggagagtagaattatatgcttatattgattacactgaaagagttggtgttggtgaaatggggctttttatattgtagggtcctcctactttcttttttaaaaaaaaatttaaacaatatcacacatagtattggtggttttacaaaaagagttattgggaagttacaagtagaaccatgcatgggttattttattgaagaataaatgtgagtgtgtgtttgtattttaagataggagagacttgaggttgaaaggttaaatacaagagaaggggaggtaaggagcaaagttgtagaggatttggggaaggattggggaaggaaggggattagattctcaatagctctagagaaaaacagaaggaagacctcttcctgtgggagactcaaatttgagtttctttagattcttgtgaatcactggagtgtttgtttaaaaaaaaaaatattcagcagcccaacccctagagattttgattgactagatttgaggtggagctgaatgttgcaaaacctgcggccagaagtactagtcattttattttattatataagcagatttgttagaattaccttcaaaaaacaacctgggaagttcagaggtagaaaaattctattaaagcttttttattgagatgtagcatgcatataaaagaatatataaaatacatatacacagtttaatagttttaaagaataatgataaacacccatgcaaaaggactccacattctttttctttttttttttttcttgagacagtctcgctgtcacccaggctggagtgcagtggcgcaatctcagctcactgcaacttctgcctcctggattcacgccattctcctgcctcagcctcccgaatagctgggactacaggcgcccgccaccacgcccggctaattttttgtatttttagtgaagacgggctttcactgtgttagccaggattgtcttgatctcctgacctcgtgatccgcccgcctctgcctcccaaaatgctgggattacaggcatgagccaccacgcccggccaaggactccacattcttacatatgtctctttctcaaccagttttccactggcctgaattttatattaatcctcccctgcttttcttcatagttgtatcacttatggattcctaaactgtattatttagttttgcccatttttagatgtgcttagctgtttcatttatcaaatgagagctgaaacatatcttttaacatcatttacaatttagatgatatacttttgttaaccttcatttttttttttttttttgagacaagtctcgctttgtcgcccaggctagagtgcagtggcgcgatctcggctcactgcaagctccgtctcccgggttcacaccattctcctgcctcagcctcccaagtagctgggactacaggcgcccatgaccatgcctggctaattttttgtgtttttagtagagacggggtttcaccatgttagccaggatagtctcgatctcctgacctcgtgatccgcctgcctcggcctccaaatttttgctttatatatattattggtagtctttcaggatttttgactagctcttttctgtctgttttctaacccagtttatttactacttcctccccctaatatttataccgtgcctgagactttatagtgaatcatagaggctattgtccctgttgttctcattcctttttacctttcttaaactcctctggtgactctccctactcatcttctcaattggtgttctgtcctttctgtcccatgccattcctgtccagcatgaaagtttctcttttatctccccaactgcttccctccttcattttaattcttcagctctcctcctcttgcagtagccagtcagtttgatgttttatttgagcagaccctaattttgccatctcagctgtttttccctttccttctggcccagctgtgcttacttcatttgttattctctgctcactttagtctatgaggctgtgtcctttgctacaaaagatgcagccatatgcagacctctcttgtccctctcctaactttacattttctaaaagaaactgtcccatttgatttcattagccttgattatttgcaagttttaaaatactctagttttagctgttacttttcacttgtaagtaagagatccctggcaaaaaggttctagattctctctcctgtaatgcacacatagtagcccccttttaatttctgcagtgtttcttaactcaaactattaatatttggttctcatccatggaaatgctgttttagtcactctccggggagtcccagacatcagtatttttaaaaagtattgtttgtattgatggtagtactgtaacattccactgctggtaagccatgggccttttttgcttatttttctaaaattgattcttctttttctgctgccaagttttctgctttgggggattttatttaatccctaaggtgtagccagactgaatttgtatggaattctccatcacattagcttttggcattgtggtctgtatagcagattctcatgagtaatcctccacactttttatagttcctacaccatatcaaaagcttattatctgttaattcttcaacagatacatgagattactgttttacagatggagaaactgagttgtgtcatttggggcaaattatcttagtagatggttgatctggtttggctctgtgtcccactcgaatctcatctcaaattttaatttctgtagtccccacgtgttgagggagggatcccatggaaggtgattggatcatggggtcagtttcccccatgctgatctggtgatagtgagtgctcatgagatctgatggttttataagtgtttgacagttcctcattcatactctgtttttctcctgccgccacgtaatatgtgcctgcttccccttctgccatgattataagttttctgaggcctccccagccatgcagaactgtgagtcaattaagcctctttataaattacccagtctcgggtagtatctttatagcagtgtgaaaacgaacgaatacagtggtagaacaaagatctaggggtgtctgactccacgggccattctcttgattacagggtggtctggctccattcccctttgctctttctttccccatatcttctgagtttttacttttcatagccataatgtagctttaggtttctcccagttctcactttaaaatattctcattttcaggtatagctgagagtcactgtgtttttagccaaatctaagggagaaaatgaatattgatagcagcatgctgtagccagctccttaaaggaaggatggtgcctggtacagagttagagttagtgcttcagtaaataatgaatgtgtgctaggtaggttctgctgggtaggctgcatgcattgaccaatttattcctccttgtttcaaaacaggatttaagggcacttatatatatatattttttagtttttttaatgtaaatgagagaataaagatatatatatatgtctatatatgtatatatgtatatatatgtctatatgtctatatgtatatatgtctatatgtatatatgtgtgtgtgtacatatatatatatatatatatatatatatatatatataagttttctgttgctagcataacaaactaccagaaacttagcaactgaaacaacatgaatttatcttacggttctatagttcagaagtctaacgtgtcactgggatgaaatccaggtttcaacaggactgggttcccttctagctcattcagctacctggctcattcaggttgttggcagaatatacttccatgaaactgtagggctgagaccccgtttccttcctggctatcatctgagagcttttcccgacttctagagtccacccacctacccacatcccttggcccatggcccccttcctccatcttcacaaccaacaacagtgggtcacgtccttcttgtgtctcatctttcttgttgggccatcccaagtctctctgttttaggaaaggttttccacttttaaggactcatgtgattagattgggcttacctggataatacatgctaatctccccatctcaaggtctaatcttaatcaaatctacaaaatcccctttgccatgctagggtaaaatattcacaggttctggggattaggatgttaatatcttttggagggcatttttccgcttaccataaaggcctgcattagtccattctcacactgctataaagaactacctgaggccaggcatgatggttcacgcctgtaatcctagcactttggaggctgaggcgggtggattgcttgcgctgaggagttcgagaccagcctgggcaacacggtgaaaccccatctctactaaaatacaaaaaattagccaggcgtggcggcatgcgcctgtaatcccagctacttgggaggctgagatgagagcatcatttgaacccgggagggagaggttgcagtgagctgagatggcaccattgcactccagcctgggcgacagtgcgagactccatctcaaaaaaaaaaaaaaaaaaagaagtacttgggactggggaatttatgaagaaaaagaggtttaattaactcacaattccacaggctgtaaaggaagcatggctgggaggccttaggaaacttataatcatggcagaaggtgaaggggaagcaagcacatctagccatgtcagaccaggaaagagagagtgaagggggaagtgctacacacttttaagcaaccagatctcgtgagaactcactgtcactgagaacagcaaggggaggaatccacctctgtgacccaatcagctcccaccaggcccctcccccaacattggaaattacaatttgatgtgagatttgggtggagacacagagccagacaatttcaagggctaaggagcaaatggtagaaacagtaaaataagatcagaagaggtttaattgactcacagttctggagagctggagaggcctcaggaaaattacaatcatggcagaaggcaaaggggaagcaggcaccttcttcacaaggcggcaggagagggacaatggaggaagggccatgccttattaaacaaccagattggccactcccctagcatgtggggattacaattccagatgagattttcatggggacacagagccaaaccatatcaggacatttatactcaaagtctatgatatgaggtggtgtagacttctttgaagtggtcactgaatttagcactaaccagtgcaaaaagacaaccctgctcatttaccctaatcatagtatccattattttttttttgaagtatgttcatgtatatacttagtaactgctgacattgagaatcttgaaagaagctttgcttctgattcctcttaaaaataatacagtatagcgagtgtaaatatacaactgcttttatagggcattttctctagaggcataactcattgaatctatgaggaagacaccattttataggtgaggaaagggacactggttatcacatacagtctttttgtatacagctagtaactgaccaatatggaacatgaacccaggtttttcggactccaaagttcatgctctcttccccatattacagttcctgattcccataaatttcacatcagacctcttctgttggcttactgtttggtctgttaagtttctgtgagagtacatagccttcaattcccttaaataggtaggacctccattcatgcataatagtgcagaactatcctatataaaagtaggataaagtactttctctgctatttaccagccatgtgactatgggcaacccatttgatctttctgagtctttgtgtcgttatctataaaatgggaatgaataaatgatatcatatgtgtaacagtgacttgaataacaaatgattatatcttttttatcctgcttctttgaatgttacaataatttccccatatgcatttgaaaaattcacccaaatctgaccagtgctgtatagtgtctaatgctaataatagcaaaaacataattttttttgccctctgtgtgttctaatatgttgatcgtcccactgtcccccacttagcttgcttgtttttgaccagctgctacaagaataacaagcatgttatccttgattctaattgttttttttcctaccctgtgttggcgtttttatttgtttgcatcaagttgttttatggcaagtttcttatgttatcaagattccttttatttcagatatctatatttttggcagctttgcttaatttagagtgattggccatccaagtccacttatgatttatcttgtttaagagatgaggtctcactatgttgcctaggctggtctgtcaaactcctggcctcaagtgatcctcccgcctcagccccccgaaagtgctgggattacaggtgtgagttactgtgcttggctcctggtaatgatttaaaagactcggtaggattttgttctgtgaaggaacagaaacgcactccagctagctcaagaaaagagatttatgataagaatttaaagagggcttatagtaatccaagtaaaacagtgtaacagatcttgggcaattggctactctgaagtttttgttttcttctcatggcttctctcttgacccattaagcatgtttcttttttttttctttgtctttttcttcttttttaaaaaatcttttcattattgatttctgactttattacacttagagactgtaggctatatgtactgattcttcagtgtgtgagactaattttgtagccgagtacttgattggtttttgtacatgttccatatgtgcttgaaaatattcttgtgtgtgtagtgagttcaggtttccgtacatgtctgttagatcagacttgatattagcgtggattatatcttctatatagtcttttgtctacttcttttttgacctttggggagagatgttaaaatctcatattgtgacaatggatttttcttgttcttctgtcagattatttctcccctccccgcgtgaatttgggggctaatttgtaaggtatttatgacccatacatcttacggaggagttactccgttgtcattaggtttcccttcatttgtttcttagtatggttttttgaattcaggtatttgatattaattttgcatatttggttcatacttgctttgtttaggaagtaaacattacacttgactctgaaacttttttgctcattactttgggggtttatctatattaatacatttcattctattttattgatattaattgcttgattatgttctgttgtttgactatactgcagttttctccattctttcacttatggacatcttaaagttgtttattttgttgtaaaagatgatactccatagattattcttgtgcctgcctccttgagctgggtgctagagttttagaaataaatcttgcagcggatttgtgggtggaaggtgtatacatctttggctttaccagcatatctaaatctctctccaaagtaatcagttgactcattctggttctgtgtcaccttttttttgagacagggtcttgctctgtcacccaggctggagtgcaatagcattatcatgacttgcagcctctgcctcctgggctcaagggatcctcccagcgtaggctcccaagtagctgaggtcacaggcacatgccaccacacctggctaatttttttttcttttttttttttttttttgagagagagagagtctcgctctgtcacccaggctggagtgcagtgacacagtcttggctcactgcaacctctgcctcctggtttcaagccgttctgcctcagcctctcaagtagctgggattacaggcacacaccaacacacctggctactttttgtgtttttagcagagacagggtttcagcgcgttggccaggctagtttcaaactcctgacctcatgtgatctgcccacctcaacctctcaaagtgctgggattactaatgtgagcccccatgcctggctgctcctggctgatttttaaattttctgcagaaatgggtcttgccatgtttcccaggctggtctccaactcctgggctcaggtgatcctcccacctcggccttccaaagtgttggattacaatatgaaccaccatgcccagccctttatcaccttttttttaaaaaaggcctattttttaatgtagcccatttctatatttttaaaaatttcaatctaggagtctgtattttaacaggagaatttaatgtttttatatgtattgtaatcactgatggatttgggtttatttctactatcaagtaccaccctggttcagtcatatagacaaagatcaaggtgtagatcacaggcatgcccacttgtcatgggcttttgggtttagacgggcacatgtcttggcacaggaaacaatgtggtagattttccaagcatgtataggtcacctattccttgcaggccagtagagagattactgaagagaagatacctgccactaacttactagtgcacatgaacaattaatttaaattctgaaattttctgtttctaaaacaggtatagtacctgcctagtgcaccctatagggttattcaccaagactcagggttttgttttgtttttttcccctagctttacagctgtctttaaaatttaagtgtcagtcatgtgtttccttcatttatttacagttgatatatcagtgtcagtggtgtattcatgcttgctctgctgccccagcattattaaaattgatggatgacccttttgcatttgtccttctttagaaatagctactatgtagtcctcgctggttattttagcttagacaccactcttgaaaattttccgagagcctggtatttgtaattagcatatctcgattaatgtggtgtctgtactgtttacttgtgacctcagtaaagttcatacctcttcagttttagttttctcatctggaaaaaccaatagcaatgcctggattatctatacctcacaggatttttgtgagcttaaagtaaataatatgtgaaggtaaggtgccttgtaagctgcaaagtgctttattaatagtaataccttagagataatgtttcctatctgttgagcatcctaaaatttagtggggttggtcttgcctatagaaaaaagctgttcactgtgctgatcatgtgttaaccacaaaatggctctccttgattctattgtcctccatgactcaataaaagaaagttcttttccatctcagatgtcttcatagtccacttgagattgagaagaatatcaaggaggtactgtttttcactagtcttcagggaagagaagggaaggccagtagtcatcttctaccttgatttttttttttttttttttttaacacggattttcgctcttgttgcccaggctatactacaatggcgtgatcttggctcactgcaacctctgcctcctgggttcaagcgattctcctgccacaccctcccgagtagctgggattacaggcgcgcactgccacgcccaactaatttttttgtatttttagtagagacagggtttcaccatgttggtcaagctggcttcgaactcctgacctcaggtgatccactcgccttggcctcccaaagtgctgggattacaggcatgagccaccgtgcccagcctaccttgatttcttctacactcactcttagtattttgtggtaccacttgaatgatttcagtcaattttgaacccctttggaaagaggtggttttgtagctctatagaagtctttgatataaataaatctgttagtcagtggttatcttctttctttggataaagtattgttagttcagttttaactgtgtcaaagggaaagtaaaagtatatgtgtcccaaattatttatgctcaaggctttacttgacacaaaaattaataaatagctaaaaagtaataaattaaagcaataataatgtatgcccgatgaattgagtcaccagtcctctatgtaaaggtatttgttatacttgctcaggataaacttgggtgtgtgttgaagaaattctactggtttcatagctacgtggattttttttttccaagatgaagtcttgctctgttccccagggtggagtgcagtggcatagtctcagctcactgcaacctctgtctcccgggctcaagtgatcctcccacctcagcctcctgagtagctgggactacaagtgcatgccagcacagccggctatttttgtattttttgtagagacaaggtttcactttgttgcctaggctggtctcaaattcccgggctcaagcaatctgtccatcttggcctccccaagtgctgggattacatacatgagccactgcactcagccagctacatgaattttcaaccggtttaagaactgtatccataaaggactgccatgtaggcaagcgggaaggagcatgctgctatgtgcagtcctggatttttgacttctgatattagcaacaacttggacacagtccaatttggttgaaagagctaatatgtaatttggattttaactgacagaatccaaaatgaccttggtaggcagaatgattggccaaattttagcaaaattgtattacataaaaatgaagttaaaacccagtatttgcttgtaaaataaccgtacaaatactaaatggaggtcagctggttcaatatccacacatgtctaaaaacttagttttacattacttgattcatatgagtcagataagtaataaagcgaacaaaagaataaatgtgatgctagattagtgaaagtatagtgtatggataaggcaggttctaccctgtcagacctcaactgcaattcagttctgaaactcttgttttaaaggaatatctacaaacaggagcccgtgctcaggagaccagtaatgctgatatgaaggctataacattcatgacattttaggaatggttgagtatctgaaccattttaacctaaaaaagaagacttaaaggagaatataataatgactttcagatacttaggtgactgacatatgaaagagggactcataccaggaccgtgagtagaagacatacagttggactcttcataaaatggaaagagcttgttcactggtaagttaatttgtgctggagtaggaatttgattgacacatatgaaggcttggaagatggagtttatgcaaaggatagagatttgcagttgattttttttcttcctaaagaaatataagatactattgtgggccaggcatggtggcttacatctgtaatcccagcattttaggaggccaaggtgggtggatagcttgagatcaggagttcaagaccagcctggccaacatggcgaaattccatctctactaaaatacaaaaattagctgggcgtggtggtgggtgcctgtaatcccagctacccgggagactgaggcaggagaatcgcttgaaggcggaggttgcagtgagctgggatcgcaccactatactccagcctgggcgacagagcaagactctgtctcaaaaacaaaacaaaacaatagcaacaacaacaacaacaaaaagatactattgtgggcagtccctgtgctggagttcgaaaaatgaagactgtcccaccctacagagaagaccaatttgccacaataactataagaaaatgtaataaaaatatgtacgaagttctaaaggtgtgtggacagggtactttctaactggagtgaatggcttataacagatttcagattgtcagtaaacctttattgagcacctgcttactgtatgccagtactatgttgtgacattcatatatgttctcgcggtaatcttagtaggtagctgctaaccccgttttccaaatgaaaaatcagtaaccagatgtggtggaatgtgcctgtagtcctagctactaggaaggctgaggtaggaggattgcttgaggctaggaattcagggctgcagtgtaccatgatcactgatgcctgtgaatagccactgccctccagcctgggcagtgtagtaaaattctgtctctttaaaataaaacataaataacaaatgaaaaatcaggtgataggtacagacttggtataacttatttgaataattgtccacctaatcagtagaatcagtttctgcttttgccccatctttatattatgtgagaaatactgagttgggctgctaacacttattttgccaagaaggtttgatgactttataccaggagtgatgtacaaaatgtggcagtaaagggttttcatcagaactgggggaaagggagatgatgattaacactaaggaatcttgggaccacactgtgaagaccattgtgtgacatagtttaagggattgcttaaccctctggatatctgcattaaggagccttattcccttccccattctctaagtggggcagatttctacccttaactcagatatttgtacaataataagcctcattcaccatttaacctttttttttttcttgcttggcctttccccctatcctttctggcttaaagtttcatttcttggagaatttgtaggagaaatagaaaaatcatgttggacttaagtgtcactatgtgaattttcagccgtagccatgaataaatcttattaaaaagtactactgagtagtattcttaagagatttttagacacaggtaggagaaagaaatcaaaattgtctgtttcacagtgcattattttacttgcaggctttcttgtaattttcttatcagattgacatttaaagtagctatatttggtcacagtagaagttttgctggttatttaagtgcagtgtcactatggaggtagttgaatgaagtcaataaaagtactgcttacatagcattgatgaaagttcctctttacactttacatatgtaagcaagcatggtaaacagtggcttacgtatccttccagaaattttctgtacctctataagcctgtgtgtgtgtacatgtgtcccaattctaccagtaggattatacaatcactactgttctacaactttatttttttcatttgagggtaaatcttgagtgtctttctgtatcaccacatataaatctctcattttttaaaaactctcataactgaactaccatttgtcagcttctgattctgttagttgaggtctgtggtagcaaataacagaaaccaactctggttaatgtaaacagaagatttgattggaaatattggatggttcacagacaggaaagcagtaaaatcaagtttgaaaatgggcaaaatgaaggaaggcaaggcacagccaaattgctgttatcaatacggcctgcttgagaagatgctggatgcataccactggcctctactgctctctcatctccactgtagccaccatgtattgtctcttgatggtccttgatattgcagcactttttcaagattctaagttctagataggagtatctgattggctcagtctaggacacctgtctccctgccctagctgctagggagctcaaagaagagtgctctgatgctaggtagccagaaacagcaaatgtccacctactcctgctttgatgaatatcgttatagataatattgctgttagccttcttgtgcgtttgtgcaagaagtaaaattcctgggtcaactggtatttacattttgcattttgataggtactgccaaattaccatccattaaaagtatgaatttagaaagaatatttaattttgactttggtatatatttcaggtacttacaattcaacaggctaaccaacattaattgtgtatattaactgatgcctagtctatgggaatttagcagtttgattttgttactgttaatacattatttctttggctcttgttaatttaatctgtcaattgcacaagagtttttctgcttacagcctttgattttgatacaaaccatttgtattataatatacgacttagagatcatgtacagtaaatttattagataattatattttacatttacatccagtttgatatatactatcatgaaaaagttttctcttcaagcaactttattgaaatatatttctgaaatactgcagttcttatttggaatttttagttatgaaaggattagtaaaatggtcagattaaagtgtgttaagatacatgacttatctatgtgacctacttggaacactattatttgggataaactcagcatagtgcaaatagtattcttttaaaaacatttctctttattagatttctgcagtgtcaggatcatttcacttatagaatgttcctttcatccctagaattgctagttggaaagtgaggtaacattctttttggttagcaaatgtattgattacaaatggcagtatgtatctgagaaagaacaaattcaggaggttgagtggcgcagtgggggaagaaaatatgattcagaatcaaaaaacttgattttgagtttctgcctcttattatttatgttaaagtgccaacaaatgattcagtcagatttttcctttcatctctgtcctcgtaaatatcaattaaaagagaatagaagtgttccagattcttcccagtttatttattttaccatcattactagcaaaaatgtagatgagatcttttgttgtatatgagttggattagacactacacagtaatttctaggttttttataagccacagtataaggtatattttacattgcaatctaggattcatgtgtgtaaatgcatatatatctctaaaacaaaaatttctaagtgttcttattctaatcgtataaatattttgttataattttttttttggaaacagagttttgctcttgttgcctgggctggagtctaatggcgtgctctcagctcactgcaacctctgcctcccgggttcaagtgattctcgtgccccagcctcccaagtagctgggattagaggcatgtgctaccacgcccagctaattttgtgtttttagtagagatggggtttttcaccatgttggtcaggctggtctcaaacttgtaacctcaggtaatccacccgcctcgaccttccaaagtgcagggattacaggcgtgagccaccacacctcacccatctaattcttttgtaatgctagttccaatccactaaattggtttcatgacctaactagttatggcttactgtctaaaaaacatcacaccagaggacctctctagttccaacaaaaccgacatcctacaattctaagaggtatttataactgttttcttttttattttattttattttatttattttcaggtagagtctcactctgttgcccagtgggagtgcagtggctcactgcagccttgacctccctggctcaagcaatcctcctgcctcagcctcctgagtagttgggactgcaggtgcacacaaccatggctggctaatttttgattttttgtagagacaggatctcactaggtggccccaactggtgtcaaactcctggcctcaagcagtcctcccacctcagcctcccagtgctgggattacaagcatgagctaccatgcctggccgtatagcccagttttattcttcctgatttttcttaaacattctagccgttttccactattaagataaactagtgaggaaagttccatgagttgggaggaagaaaggaatagggatgccatttttgccgcattcttacttgctattagatttaatacctctgtaacttattccctaataaaattatcaaatgctgtattttccaactttttaagatttaaatcatatctagctttgtatttgcaaaaatactgcacttgaagacaaactatgtctttcctaagaaaatttaaattctacctatattcaaataccctcaactttaccaaattaaatttggcttatctaatgaaggatacgttattcatgctagttgtatcattgggagttcaattaggaaacataaactacacaggaatttgaacagagaaagtctaatgtaaacagtccttaactgtaacgtagaattagagtaatgggagaattggctaagaggtagaaagaactctgaagactgtggtaacagcagatagggtagtagtcactacctctaaggctatgcagagcatggaaggaaggacagatctgacattcaaacctcattggaggggcatggctgaggcctactggatgtcagagacattaactaaggggctgaaatgggctggacagctgccctctttgtgctcagcttctatggtgtgtgtgtggcctgagaactccatgaaaagcaacctgaaggagtgctgggggcagatggccatagaggggtgctgagtgctgatgaagctgtcatgccctgtgccctaccaaggtagaaaggtttcagtctcacttgaaggacagtgaagggtggatttggagcaagaaggcagtcaattgaaaactggcacatgagagtactcactaccttttgaaaggaaaataacacttaagtttggggcagataatgatacagatacaattctaatttaatgcagtcatattttcattctctagcgtcatttccccatctgaaaaatccactgttgaataaaattttgttttagaaattgatagtttttttttcttgagatgtaggctagagttgtttgatagaatagtctattactttgtgatctttccagtgagcatgagatgcattaattcattccctgagcatctgcttttaagccagtccactgtgcaaggtcgttttcaaaatacagaaaggcaaatgttactgctcctgaggagtaaagctagatatataaactgataataaaagtaccatgtgataagtgcttaatcaagtatgtacgtatagagtaatttggccttagcagataaagtgagcttgtcttcaggtactgggaaaggaaaaagaagtgatttttcctagatgcattatctcttttattacatattatctcttttatttctcacaatagccaatgaataaggtggtataattaccattacacaaataagcaaacaaggcctagaaacctgaagcaactttttcaatcagcatcatacacaggattcaaatctagcccagtaaatatttgttatctcttaaactggtcgtgtactttgaaatgaagaaggcataagttcaccaaatataaaacgtaggactaaatgcaattgtgaaggatttaaaaagtagatttgatgcatccttgcccttatgaggtttatagtctagctgtgcttgtagaatataataagggctctgactgaggaactggaagaaagtatggcattttgtaagagggggaatgcgtttttcctccttcttggaaaatcatagggtacaataacatttgaactggttctgacaagtagaaatggtaaaaaatcaaaatataaaaataggagtaaacaggaaggtagttgtctgctaagttccacaccttgtactgtccttgatatgaacggtccagtttaactttagtatggaccctgtgtcaggctgttatgagaaataaggctggaaagataaatccattaaacatggtggacctagggaggtacatgtgacaggttaaggtagagtttgaactctattttgtagacagtggaatgcattgaagtttttgaaagaaagagtatacaactagaattataattaactttaaaaccaaatacagtatatattcatattttaatatagtagcgtagacatactagatgttaaatgtaatccttttcttctgtctcatccattctctttttgtctttttctcatccattcctggtgcagtcatacgtagaatagattagaagggtacgggtatatagttagatggtaattaaaatgttccagagaagaggttcctagaggccttgtctaaggcagtggtaatgaaaataaaaggaggttacagatgagagctggaattatcagggtttagtgaaggatatcatagggagtgaaaagtgttaaaaatgaagatcattttcagacacttttccatttctgaaaagtgtatacttcaaatactgcctgcctgcctccctccctccctttcttctttttgagacagtctctctccgtcgctcaggctgaagtgcaatggcgcaatcttggctcactgcaacttctgcctcacaggtttaagcgattcccgtgcctcagcctctcaagtagctgggattacaggcatgtgccaccacgcctggctaattttgttacatttttagtagagttgggctttccccatgttggccaggctggcctggaacttctgacctcaagtgatctgcccaccttggccttccaaagtgctgggattacaagtgtgagccaccgtgcccagcccattttttttatataagagtaatgcctacacatggtaatgttaaaacaatatggaagggcagaagattggatatggtgatgagagatgacattatataagacacaatgggtaaaaagcttttccttatgtgaaaactctggggcagaagtcaactcttctagtgtgggctgtgcatagtaatttccttcccaagaatacagtatggaaaagagggggaaagttcctttccattggagaagcctgacagactaccttagccaggttatgaaggttaaagtcaacagtgatcagtcacattgatagtatgtacccttgatatgatgtgatgaaaatggtattctttctctgtcatcttccttccaaacacttataatcccagtctaatcatgaaaaaattagacaaatttcaacacagggcatgttacaaaatacctaatcagtactcaaaactgtcaagaacatcaaaaaaggaaagcatgagaaactgttacaaccaagaggaaccttaaagaaggcctgacaattaaatgtaatatggtttcttagatgtgatcctgagacaacaaaaggacatgaggtaaaaactaagggaaaaaattagaactttaagggagttaaaggtaaagagattttataaagagtgcaggataaagaataatcccagcactttgggaggcagtcagatcacctgaagtcaggagttccagatcagcctggccaacatgatgaaaccccatctctactaaaaatacaaaaattagccaggcgtggtggcaggcacctgtaatcccagctactcagcaggctgaggcaggagaagtgcttgaacccaggaggcagaggttgcagtgagctaagatcacactattgcactccagactgggcgacgagcacaactccattaaccattgtgtaaccagttaaggtgcttagtaagtagttgctgaatatatcatattattacagttcttcataagtctatttttaaggtctaggccttcagtgaggcctacttcatctagtggttgaaacacaggtctagatttggtttcctggagtccacgtcacacccaagctgagcgagataatcacagaaacttgtcagtgttctttctcttctagcattgacaacagaggctattgtgtttttcccctgaaaccagacagttaaataaattattttatacattcacaggcagaaaatgttcatctttgaaaaaatcaaatgtggcctggagcagcaccctcccctacctcaccaaaaataaaaatcaggaaaaaatttttaataaaaatcaggagaatacaaaggaagatacttctacctttgtaaagagaggtgtgtcttatggaaagcttcctagaggatatgacacttgagttaagtcttaaagatgagtagctgagtagacaaaagaagtcgctggttattagagaaagaacactgaataggctgggtgcagtggctcatgcctgtaatcccagcactttgggagaccaagtcaggcagatcacgaggtcaggagatcgagaccattgtggctaacacggtgaaaccccatctctactaaaaatacaaaaaattagccaggcgtggtggcatgtgcctgtagtcccagctacttgggagctgaggcaggagaatcgcttgaacctgggaggcagaggttgcagtgagtgtcgagatcgcgccactgtactcctgcctgacgacagagtgagaatccgtcaaaaaaaaaagaaagaacacttaataaatgtatgcagaggcccaatgtgtaagagatactgacatataggaacataggctttcagctgagtttatatctcatttactcatttttgtgattttggtctcatcccagaagtgttttaatattgggggtactttaatattgtaaaagaaagaaacagaaatagtagtagatgattgcatcaagggaaagagggtagagggttagttcttcatattgtccatttctttttttaattgattctttagcaactctcagctttgttagcgtacttttttctgcactttgcagtttccaggagaaagatcttttacattctgaaagccacatcctcttgggaactttatttttattaccaaacttgatgcctggaatatagtaggcatgcattcaattaatattctttgaataactatctcttctcttccctcctagctttcactgggcagccttctcaaataaatgctctgtattcccaattttcttttcccacaccactcaatatttcttgtgtttgagtaacttactgattgcactaggaattattatagacagaatcaacaagactgggaaactaacaacgtaagagtcttaagaggaatgaaagatgactcttgattagtgtattaggtttttagggccactgtgacagcttacgagcttggtggcttaaaatcacagaaagttgttctgtcacatttctggaggccagaagcctgatattaggtgtgttctctcagaaggctccagggagaatcctgccttacctcttccagcttgtggtggctccaagcgttcattggcttctggcagcagaactgtactctctatccctgtcttcattcacttaactgtactctctatccctgtcttcattcacttaactgtactctctatccctgtcttcattcactttgctttctcccctgtgtctttgtctccttctgcctttctcctaggacacttgtcattggatttaggccccaccctaaatccaggatccttaattacatctgcaaagatcctttttccaaataaagtcacattcatggttctagggtcaggacttggacatatcttttggggggccattatctattcaatttactacagtaaaccgccagagagtatgtagctgatgaaatggaggttattctcttggatgcaaggggataatgtacggcgaaccaacagcatgaaaacaattccgaaatcgttctatttagaaagagagtgatagctgggcacagtggctcatgcctgtaatcccagcactttgggaggctaaggcaggtggatcacctgaggtcaggagttcggttcaagaccagcttggccagtatggtgaaaccccgtctctactaaaaatacgaaaattagccagtcatgttggcgggtgcctgtaatcccagctactcaggaggctgaagcaggagaatcacttgaactcggtgggtggaggttgcagtgagccgagattgcgccactgcactccagcctgggtgacagagtgagactccgtctcaaaaaaaaaaaaaaaaaaaagtgataaattgcagatattttcaattctttttttttttttctcactgttgcccaggctgaagtgtagtggcgtgatctcggcttactgcagcctccgcctcctggattcaagctatttcggctaatttttatatttttagtagagacagggtttcaccatattggccaggctggtctcgaactccggacctcaagtgatctgcccacctcagcctcccaaagtgctaggattacaggcgtgagccaccacgccccagcccaattcattttttaaaatatatatttaagttttttaacttggtcaggtgagtttagttggagataatgctctcttagctgtattcatcttgaagaatcctcagtttaacgtttgtattaaaactttaaatttgcaaaatgctactacattttatcatttgagcctcatgacattcctctgaagtaggaatgctattttttttccctagtgccttttttttttttttttttttaaaatagagatggggtctcagtatgttgcccaggctggtctttaaactccttgcctcaagtgattctcccacctccacctcccaaagtgctgggattataggtgtgagcccctggcctgtattttcattttgcaattttatacatgtggaagtggagctcagtctccataactaacttgcttgaggtcacaggttatgaaattatccagatggatttgaacactggtgttaaaactgtaaagcctgttgtttattaattttctgtttgaaaagggcagactttattttttcatgtttcacggtttttcagtttgtaatgtaattacaaaatggctagtttttttgtatttttggtagagacagggtttcaccatattgcccaggctggttttgaactcctgagctcaagcagtccgcctgccacggcctcccaaggtactgggattacaggcgtgagccaccatgcctgacttgcgttttcacatattttaaattaaagctgtttggcttgtggttgtaaaaatagaatcatcactaatattgacgaatcctgcaattagtgggaagttggtttaggacaaggaaaatgaactccagtagaatacccagcacctactcgtatttcttgtgaaggactctttgccttaaaatgcaagaggacttaattagattcttgggccccacgaaagacgtgctaagtctctgggatggggcttcaggaatctgccttttttttaatttttatttttggagataaggtttcacactgtcacccaggctgtagtgcagtgggacgataacatctcagcctcctgaactcaggtgatcctccctcctcatcttccaagtagctgagactactgccatgcaccaccatacccagcttattttttgtagaggtgccatgttgcccaggctggtcacgaactcctgggctcaagcagtcactcctcctgccttggcttcccgaagcactgggttataggtgtgagccatcacacccggcaaggaatctgcatttttaatgggtactacttataattgttacctcattgacttggtatttaaatattcagctctcacaatggtgtcctactgagggacagtgactccgaccctgagtaaaggaagaaggtaaggtattggtagcaactctaatagcagcattaataagtgtagtgatttgtattaattacagagtggtaatgatctgtgtatatccaagatatccacaccaggccttaaaaaacaatgttttgcacatcattaaacaaatattcattaaacaaattcattattcattaaacaaatattcattattcattaaattattaaattattcatttttcattaaatatttcatgaatactagctcaacagatcattctaggtgctttggaggatgaaaagatgaataggaatacagatcttgccctgaaagaactttgtttataaatgttgtaaaaacaggcatttaaataactgtagtgtaagataaaagttagtacatagtaattgtcatttcagagataacatattctgaagtccattaagggaaagatcacatccagagaaatactagaagaggtggagggtgtgcatggctttctgtttgtttaggaaaacaagtaaataactctccaaagtctcagggtaattctttgtgttggactttttcttttttcttaagccttctcaaacctatcaggtttaagattctagttagtgatatttcctacttgcgatagctgagaaaatttgaggtgcaagacttgaccaaccttctcttgagtgtgttcgaggatgggagacttgaatgcatgtgtcaaaagatgtccatggagaagcaggtaataaagatgcaagaaaaacgagttgctagatctccaaacagggagagagggctgagatctagttttggttggtaaaggaatatagtacttctctagcattaaagaaaggataaactacatggacatctagaggaaacttcaagtgaagaagtgatccatgttggatttttgtctttgtttgtttaattaaataataatactgttaagtttttacatagtgcttcctacatgttttcagtgctttatataggttaactggtttaattctcacaactcttgttgtgaagtatgtattgttcttatcctcattttgaaaatgattgcgtgcaaaggccaagtagtttttccaaaatcacccaggtagtgcttttaaccactacacaatgctgacagttcaatcagcatctctggaggtgtgaggcctgagcatcagtttgggttgctttttgtttttgttttttgggtcttttttttttttttttttttttttattgatcattcttgggtgtttctcgcagagggggatttggcagggtcacaggacaatagtggagggaaggtcagcagataaacaagtgaacaaaggtctctggttttcctaggcagaggaccctgcggccttccgcagtgtttgtgtccctgggtacttgagattagggagtggtgatgactcttaaggagcatgctgccttcaagcatctgtttaacaaagcacatcttgcaccgcccttaatccattcaaccctgagtggatacagcacatgtttcagagaacacagggttgggggtaaggtcaccgatcaacaggatcccaaggcagaagaatttttcttagtacagaacaaaaggaaaagtctcccctgtctacctctttctacacagacatggcaaccatccgatttctcaatcttttccccacctttcccccctttctattccacaaaaccgccattgtcatcatggcccgttctcaatgagctgttggctatacctcccagacggggtggtggccgggcagaggggctcctcacttcccagtaggcgcggccgggcagaggcgcccctcacctcccggacagggcagctggccggacggggggctgactccccccacctccctcctggatggggcggctggctgggcagaggggctcctcacttcccagtaggggcggccgggcagaggcgcccctcacctcccggacggggcggctggccaggcggggggctgacccccccacctccctcccggacggggcggctggccgggcgggggggctgacccccccacctccctcccggacggggcggctggccaggcagagtggctcctcacttcccagcaggggcggccgggcagaggcgcccctcacttcccggatggggcggctggccgggcggggggctgacccccccacctccctcctggacggggcggctggccgggcggggggctgacccccctacctccctcccggacggggcggctggccgggcagagtggctcctcacttcccagtaggggcggccgggcagaggcgcccctcacttcccggacggggcggctggccgggcggggggctgacccccccacctccctcccggacggggcggctggccgggcagagtggctcctcacttcccagcaggggcggccgggcagaggcgcccctcacttcccggatggggcggctggccgggcggggggctgatccccccacctccctcccggacggggcggctggccaggcagagtggctcctcacttcccagtaggggcggccgggcagaggcgcccctcacttcccggacggggcggctggccgggcggggggctgacccccccacctccctcccggacggggcggctggccgggcagagtggctcctcacttcccagcaggggcggccgggcagaggcgcccctcacttcccggatggggcggctggccgggcggggggctgatccccccacctccctcccggacggggcggctggccgggcagagtggctcctcacttcccagtaggggcggccgggcagaggcgcccctcacttcccggacggggcggctggccgggcggggggctgacccccccacctccctcccggacggggcggctggccgggcagaggggatcctcacttcccagcaggggcggccaggcagaggcgcccctcacttcccggatggggcggctggccgagcggggggctgacccccccacctccctcccggacggagtggctggccgggcagaggggctcctcacttcccagtaggggcagccgggcagaggcacccctcacctgccggatggggcggctggccgggcggggggctgatccccccacctccctcccagacggggcggctggccgggcggggggctgacccccccacctccctcccggacgaggtggctgccgggcagagacgctcctcacttctcagacagggtggctgccgggcagaggggctcctcacttctcagacagggcagttgccaggcagagggtctcctcacttctcagacggggcggcagggcagagacgctcctcacatcccggacggggcggcagggcagaggtgctccccacatctcagacgatgggcggccgggcagagacgctcctcacttcccagatgtgatggcggccgggaagaggcgctcctcacttcctagatgggatggcggccgggcagagacgctcctcactttccagactgggcagccaggcagaggggctcctcacatcccagacgatgggcggccaggcggagacgctcctcacttcccagacggggtggcggccgggcagaggctgcaatcttggcactttgggaggccaaggcaggctgctgggaggtggaggttgtagcgagccgagatcacgccactgcactccagcctgggcaccattgagcactgagtgaacgagactccgtctgcaatcccagcacctcgggaggccgaggctggcggatcactcgcggttaggagctggagaccagcccggccaacacagcgaaaccccgtctccaccaacctttttttttttttttttggtgtggattgaaaactactaatggatagaaaatgattggggattggagctacttcacatggaatggcaaaggacggcatctgtaatgtggagtgtctgtctacgtggagagaaagggggaggatgtgcacaggccttgttcttggtgcagaatgaaagccattggcaggagatagttttttccccccatttcaaattgggtttttatcagagatcccagcataaatttttttaaaagagtagatagttgctttttctttaattttccatttctgttggaaaagtagcaacaataacaaaaataactgtttataggggattcctttctagaagttgttttttggtaaagatttaaatccaggctttctattcgtcctccttttgaaaaaaaaaaaaagttttggaatttgccagcctttactcaaaagccatttttgtttgttctcattctgtttaattctgtgattaaataacaaacatgggctatgtctcagtcttttttttgctgattcctctttacatgtggcttatcttcatcctgaatgtctttcttgaaatctgtactcacatattcacttgtctactcagctttgtctcttgggtgactaatagacatctcaactcaaaataaccaaactggaactgatgatctgtccactctcaatctgctctacctacatctcccatctcactgaactttctgtttgatcaggcaaaacattggatcattcttaacacacttctctttctcaaaaaattcacactgtcaacacattctcttggctctgcctcacaaattcaatttgaactacccccaatgcaaccaccctggtccaagtcaccatttctagccttattgagaaagctccttactggttcacggttttttttgtcttttttttttttgaggcagggtctcactccatcatccaggctgaagtgcagtggtgtgatctcggctcgctgcaacctccacctcccaggttcaagcgatcctcccacctcagcccccatgtaactgggactaaggtgtgcaccaccatgcctggctaagttttttgtattttttttgtagagacagggtttcaccatgtagtccaggctggtcttgaactcctgggctcaagtagtccacctaccttggcctcccaaagtgctagggaaggcatgagccaccacacctgccttctttgcttctactctcatctgcttctacttgtaagttctcattgtagcagccagtaggccttttggaatttaagtaaaattatattacttctctgctgaaaactctccagtgaatcccctattttatctcaataaacttacagagttctttaggttctgtgtgattaggcccctgtcattcctatatcctagttcctaggggcatgactctccctgcctcctgtgctttagccacattggcctcattgcagtttctctaaaatgtgccaccttagaacttttcttcttaactgtttccttggtgtggaataatactcttctctcagtgatccactggcctatttcctcacctcctttaaaccttcatttaaatctcaccttctccatgagggactacctggttaaataacacatcttcctccttccctccaccccagcgtttcaggtcctacatccttgccctgctctgctttttctttttaccatagcatttaacaccctgcaactgattctatttctctccctcttctgtatacatgtacacatttgtgcacacatgttgggaaaaaacaagtttatagtctttcatcccattccacaagtttgtgagcctttgtctttgcactggagatacatgtggctaatgctgaaaatgaatggatcatggttcatgcttttagggagcttaaagtgtaaacagacatagtaatagtgttttactattgatggtagcaacaaacatttgttgaattcttttttgaaactttactatgtgccagacactgttttaagacttacagtggattaacttatttaatgttctcaagtatcctattagataggtgttattaacctacttcttacaggttaggaaactgaggcactaaaaagataactacagatggtctctgtcttttgatggtttgacttagcaatttttcaactttacagtggtgcaaaagtgacattcagtagaaactgtatttcagattttgatcttttatttttactatttttattttattttagagacagggtcttgcttgtcactcaggctcgaatacaatggctcagtcatagctcactgcaacctcaaactcctaggttcaagcaatcctctgtccttagcctcttgagtagctaggactacaagatgtgctaccatgccttgattttttttttttttttttttttttggagacagagccttgctgtgtcgcccagactggagttcagtggcacgatctcggctcactgcagcttccacttctcgggtttaagcaattctcatgcctcagcctcttgagtagctgggagtttttttttttttttttttaagatggagtttcgcttttgttgcccaggctggcacgcagtggcgcaatttcggctcactgcaacctccgcctactgggttcaagcgattctcctgcctcagcctcctagtaactgggattacaggtgcctgccaccacatccagctactttctgtatttttagtagagatagggtttcaccatgttggccaggctggtcttgaactcctgacctcgtgatccacccgcctcggcctctcaaagtgctgggattacaggtatgagccaccacgcccggcctaatttttaaatttttttatacctatggggtctcactatgttacccaggctggtctagaactcctggcctcaagtgatcctcctgcctcagcctcctaaagtgctgggattacaggtgtgagccaccatgctcagtgacctatcacttttataagttatagggaaaaaaattctctatattttcttcgtattactatactttgtgatatgatggattcattgttttacatttctaaacagatactcagatgttaaatttatccatgaaaagaaaacgttattaaaattttaaagctctaaataataaatcatcaaggccaattagtagagttagaaagaaacttgatgattgtctggctcaattctctgattctctgtacatatagtaaaattatgtccaaaaagatgaaataatatatggaaagttacacagttggttaaacccctcccatcttctaaaggtagtgaggaaaattcagaattagctgtatatgcaaattttctctctcttatcagtcaacaatttagacaagttttctagtaagaagggtatgaggacagacagaggcttgctttgtacctgctgtgtgctagggacacactcttgcaagtgatttctgtcctaatagagctgggggtcacgttctgttatgggagagcctataaagcatgatacaattaataaaaataatagctttatttgagggccttcctgttctacacactgtgctttttgagaggtgatggttgtttgtgagattcagtatctgggataataagataggcgttgaaaaaagaaaaagggaaaaaagtcagcatccaactggagaagcagaaccagcaggatatatgtgtgcatgtgattagatagatagagatgggagttgaaattgaaattgattgtttatttggtttatgtgattttgggggctggacaagcaagtctgaaatcctcaggacaggctgtaacccacaggtatggctaaagttgctgtccacaggtggaattatttcttctctctaggaagcccctgtcgcacttaaagtcagctgattatggatttttattacttgtatgatgccttcacagcaacgcctagattagtgtttgattgcataactagggtagggcctagccaaactgatgcatcaaaaagaccgtcattttgttttcatttttattgaagtatattatgcacacagaaaaatgcatatatactaagtgtatagctcaaataattgttataaactggacacactcaggtaaccagtactgtacagggtcccttttgtatctatatatttaatttgcttcttataacagttcattgaggtgtagagatttcctccattttatagataaggattctaaggctcagaaaggtcaagtaccctgtgttacagctaataagtgacagagctgggattctaatcagggttttgaggcatatataaagtattatgggagcccaaggctgaaattgattcattcattggcgtatatgattgtgggggctaaaccattagttttgcttggggattggtagaatctttggaacaggaatgttctaccaaagagggtatatgaagctttgagttgtcttaaagcatgaatttaaatttgccagggagtgaaaagttcctttataaaaggtaccagcaaaaagatatgatatcatttcaggggacaatggtttgttgttgctaactatagagtctttacactgtattgtcatagtattaatctcttagagtaataattttcagctcaaaaagaaccttgtgtactgttttgaagagcttgaatttttatattttagtcagtgtgacatgagagtgagttaattgtatctgcattttagcaaacattttcacagtggtttacaaaataggttagaaaggctgaaggcagaaagatctggttcttagtgagaaccagaactagagcactgatgattcagaggagggtagagcatggaatttatgaagacttgcagagagaattgatgagattggtgaaccattagagctggatgatgaaagaagtggagtaattaaggatgattccaggtttcttttaagtatgatctattgggaaacaattccagagattaggaaatactgaaggagaagctgtgttttgttcttttctatcatgggtagggtgaatcacaggttgattgggaggatgatgaacaagagaatgaaaaagaatgaattcggttccgtaagtttgagttttggagctgaaggtattgaagtgtaaatgtttagtaggcagttggaaataattggagtgaagttaaggtggtggatttgataatcactgactaatttatagaagtaggttgaggaccagcctggcaacatggtgaaaccccatttctactaaaatacaaaaaattagctgggcttggtggtatacgctggtagtcccagctactcaggaggctgaggcaggagaattgcttgaacccggaaggcggaggttgcagtgagccgagattgcgccactgcactccagcctgggcgacagagcgagactccgtctcaaaaaaaaaaagaaagaaaaaagaaataggttgaggccacgggactggattcgtcctctcaaatgaaaagtaatgaaaggcagagtggagagtgttgaggaagacctccagtattttcagggttatatggaagaagaggagttggttgtcatagaattaagacatcaaggagataattgtagcctgacaaagccagaagagattattttcaaggaggttgtaggcagatacattatatagatacagtttatggacacaaatatatttgtcttcaataaattgtgctgggaaaactggatagccatgtgcaggaataaattagacctctgtctctcaccatatagaaaaatcagctcaaagtggatgaaagactttggtctttcaaaactagacccaaaactgtaaaactactagaagaaaatattgggaaaatgcttcaggacattggtcaaggcaaagatattatggataagtcttcaaaagcacaaaaagcaaacaaaaaggcaacaaaagcaaaatagacaaatgggattatatcaaactaaaatccttcacagcaaaggaaacaatcaatagagtgaaaacacaacttttagaatgggataaaatatttgcaaactatttatcttacaagggattcatatacaaggaactcaacaataaaaaaaaaatctgatttaaaaatgagggaaggatctgaatggacatttctctaaagaagatacacaaatggccatcaagtatatgaaaaaatgctcagcatcagtaatcatcagggaaatgcaagccagtaccgcagtgagataacatctcatcttagttagaatggctattatcaaaaagacaaaaaagaacatgctggtgaggattcagagaaaagagaattcttatacactgttgatgggaatttaaattatagtcactaagagaaacaatatcaagattcctccaagaactaaaaacaaaactaccatatgatccagcagtcccactactgggtatttatccaaaggaaaataaatcattatatcaaagtagtgttaatatctgcactcccatgtttgttgcagcactattcacagtagccaagatatagaatcaacctaagtgtccagcagtagatgaatggataatgaaaatgtggtaaatatacacaatggaatactattcagccataaaaaaggatgaaatcctgtcatttgtggcaacatgggtgagactgcaggacgttatgtaaagtgaaataagtcaggtacagaaaagtaaatactgcatgttctcgtatccacaataagtagtagcttaaaaagttgagctcataaaggcagaaagtagaattgtgggtattagaggccgggaagggtaggggaaaggtgaggatagggagtggttgggtaataggtacaaaattacagcaggaataagttctcctgttctatagtactatagggtgactatgattaataatttcttgtatattttcaaatagctacaagagaggatttttgaatgttaccaacataacaaaaaatgataaatgtttgaggtgaacagatatgctgattaccctgattgatttacacattgtatacatgtatatcactcttataaataagtacaattatatgtcaattaaaatttaaaaaaaaattttaagaacacggaaactaggtgtagtggcacatgcctgtagtcccagctacctgagaggctaaggtggtaggatctcttgagctcaagagtttttggccagcctgggcaacatagtgagaccctacctctttttaataaaaaaaaaaaaaaaaaaaaagaggaagaagaagaatatggaatcctgaaaatgaggaaccaaagaaataagcattttctgtatttaaccaacacttagtcagaatgagattagtattactagagtgatatatattctctcttgtgaagtgggaaagggttttctggttcttctatcacttaaatgattaccaaactcttagatgattcttgaagtctctcaagaaaacatgtgatttctaactatatatattttttctataccatatgaaaaaattggggatgttaaataattgctcacctattttgaactttcacaccttttaaaagatcatttttctttcatgctaggttttggacatagagcaaattcctttggtatgcttgataactaactcttttaacttagaaaaactgttcttttgtcttctgtcctacacctgaaagtctgttcaaaagagttaaaaattgggtaaaatgagtttgactttgggccttttgtaatagaacaaagaagaaaactgtaagatcacatgttttgaaattccagtttcttttcactgtcatttcttcagaaagattttctccatcccagccgggcatggtagctcatgcctataatcccagcattttgggacgccgagggggatggatcacctgaggtcaggagtttgagaccagcctggccaacatagcaacaccctgtctctactaaagatacaaaaattaatcgggcatggtggtgtgcgcctgttatgccaactacttgggaggctgaggcaggagaattgcttgaacctgggagacggagtttgcagtgagctgagatcaagccactgcactccagcctgggtgacagagcaaaacttcatctcaaaaaaacaaacaaacaaacaaaaaaagattttcttcattccttttgtctaaattaagtatcatttgtttgttttttgagagagtctcattctgttacctaccctggaggtcagtggtgtgatcatagcagccttgaactcctgggttcagactatcctcccacctcagtctctcaagtaactggaactacagatgcgcaccaccacacccatctttttttttttgtctttttttgttttaaaagactgtctccctatgttgcccaggctggtcttgaactcctgggctcaaggcctaccttggcctcccaaagtgctcggattacaggcttgagccacagcaccaagtttgttaccctttctcatagcattctattttctttcaaatcagtcattataattatttcaaattattcatatacagtatattatttcagtattcagtttgtttaatttctctacctgaactagactgtaagctctgtacacaggaaccatgttggttttccacactactgtattttcaagtcctagtgcagtgatacttagcattcaataaagactttgagtaagtgagtgaatgaatgaatgaatggtgactgcttttagtatttttagaagtgcaggatgctatcaattaagcagcctttgtctagtgtgaggatgaggaaatgtttcttagaggacttgaaaatgagtaagaagggggtatggtattcagtatccaattttccttagagggcaagtaggatgaatatagaaaattttcctttgaatttagaaatgtgggagtcattcatgaccgtaacggggtcaattttaatagagtgaaggaatgcaattcagattccatttgcttgtgaaatgaattagcgagaaaacagagcaaggagcttttcccagaaaagtagatctcagacacttattgctggcttatttgtttgttcataggggagtatgataaaatgaactattaactatgctttaaatattttcactgtaacacaaaaaacaaaagtgcacaaaaacagtactgtagtagaggctaccagaaggacctggttagttgtcatctgtgagtttagctgccatatttatctttcacattgaaatattaaatgtgtaagaaagggtgaaaatgtactttagattggtttacagcttccacctaaatcatcagtcctcttattttgcaagaaattagagtactgaggaaatcatggtagattattcacagtgcaccagaaaccctggctgcctcttttccatgtcctttttgtaaagcatcttaatttctgtgaattttgtctcttatttatttttttttaactttcaggtgttggtaaatcatgcttattgctacagtttacagacaagaggtttcagccagtgcatgaccttactattggtaagttttataaaagggatgagaagcactaaaagttttggatagtttaaatggaaaatgctagaaggtccattctactagtgatgatgctaaaatcagtgaaactggatttgttgttacgctgtttaatctctgtcacttttttaaaaatatgtgtagtaaaaataaatattacctaactttgtagaagtggttaaagaagctactgctgaaagacagtagtttttaagatttcaattgtaattagcgatgaaacaatttaagagacagtatccaagcatggtaagagcagaaactttgactcagcttgctggaagttaaatcaagtctctgctactaacttgctgtgcaagccatttccccgtttcatgtctcagtttctctttctgttcaatgagagtagtagtaccaatcacatgaagttactgtgagcagtgagttagtaaatgtaaaccattcaagtgcctggcaatgtggaaagtgctctagactttctcataattattaactgagaaaaaataccactgggcattttgtattttcctcagttgtaaagagtaaatgaaatagttactggtaagaaatagtcaacaaatattagctgttattatttaaaatagtgattttccattgtattaatatgcaaaggaaaaaattaagatgagtgaaaagctaaaaactttaggtaatcttactgtttcgggtttttatttgtttaaaaattatattctgaaagctgaagaatctagctggattattcttctgtggctgtagcccattaacaactagaaattagtcaaatatgaagacgagataattggaaatctagtcattctttacaacgaattgcttaatgaatctttttagccactgactgctcattttctgctgacattattaatttactatttatagcatgttgatccttatgttctgtgtgtttttaaaataccaaatcagagatagagctcatgaatcacattattaattaatagttttcaaccaagctacaggtatagtactttgtggatatattgaaatcttttgttagcaactactgtcattaagactatccgtattctattttacttttgatagttttaagtgtatacaataatgatgggtaaaacaggtaactcatgctggtcctgataactttgttttaacattttgttttgttttttgagaaagagtctcgttttgtagactagagtgaggtgcggtggtgcaatcacagctcactgcagcccccaaatccctggctcattatcttcccatctcagcttcccaggtagctaggactacaggcgtgcactaccatgcctggctaattttttgtgtttttggtagagacagtgttttgccttgttgcccaagctggtttcgcactcctgggctcaggcgatctgccggccttggcctcccaaagtgctgggattacaggtgtgagccaccgcactggcctgtttaatgagctctcttcgctgccctctctataggatttgctctttgcttaataggtttgaaactagccaactttaggcatgactcatttctaagacaactggcaaaacagttgtatttagtataggatactaaacaacagtgttcttccttttcttagaatcttatgtataaatttctaagttggtatggcacaccgagtggagaggatggacctgagcctgctgtcagaagttgacttaagcccagcgtgtccaacccacaacctgcatgcagcccaggacagttttgaatgaggcccaacacaaattcatatattttcttgaaacactatgagattttttttgttttttgttttttgttttttttttttagctcatcacctgtcagtgttagtgtattttatgtgtggcccaagacagttattcttccagtgttgcccagagaagccaaaagatcagacacctctgccataggctatacttgcggggaaagagaaaggagtagacccaagaattgtttggaaaactgtaactcatataaactgccagctggcgtcacactatgtttgctaatggcaggcactgggaaataagagtctgaaagaaaagaaaaaccaaggatctttttctccttgggttgactgtgtgttctccattcctctggctccagcccctgcctggcaggcccaaatggtctggttcttgagctctgataatctttttccgtgtcatctttccagcctaggggtggtagcagcttcctgctgtttgtaatctctgggtttataccccatctcttctttgggtttttgggggcttgctctttactgtaaccaagtccctacattaaattccctatgccctatgtacttaagtgtagtttctgtttttctggttgcactgactggcataccgttttttttctttctaacttttacagttggttgtaaatgacaaaaatttacctagatggttttaaacaaaaggacaatttattattttaatatttaggtgtgtctcaacgtgagggcagggagctagctgggtcagcctggaaccagagctcagagctcttaaggagggaacccgggaaatcctgtttctcattctcccatccttccctcattgtctcccattctcttctcatgcctatttcatttttctctctccctgttgaccattgtttttgattttcctgtctccatgttgggaaatggccattgtcaataactccaaagttcatataccattcaggagagcagagattctctttaactcaatttgaagtttcctagggacgagagttcattggctcaatttggttcaggctcacttatctcttgttctgtccactcttttcatgggcccagaatcacttttgtacaacatggtttccaaattggtagtcgtaggagcaatctgggtgagtagtcatacatagccactaccagaattccctcacacctagctattctatttagtcatcatgtccttatcttttgtcccctgtaatgatcagttctctactctgtttataaaccattgactcctgagctcatgattcttctcagtctgcctctcttgctttctctcttacttttccctaacacgtatagacactatgtgccgtcaagtctttgctgcttgctactccctgaatacttagtactttttcataccctcaatctttctcttctcagaggatgccattgcttgacatctctgcttattacagttcttttctgaacaactgtccatatcccaaaccatagctcccatttaaaggaggtaagatttgtatacccacgcctgtggagaaatattgttaacaggaaaggaacaagtactgtataggcacacagtttcaatataatgctccacaccaatagggattcttagtagctcatgcattagaaatccattgttcataatcaggattagtcctcctaaaaaggcaaagcaaattttatggaagatgaatgtaggaagtcccatctttttacctgctgtgtgttaagggaaactacacccagtacacattcataaaatggattgttttttgttggggtcatagtccagccatggctttagcaacagtctgttattaaagaacaaagatggtagctaacatgaactatttttttaaattgaaattttattttagatcctataaagtgaatgtaaatgtgctctatacattcactatgcagagtctcaatatttaagatgtttcaggatatttgaggtaatgatacttaaaaaaattatctgaagcaaacagaatatttaggatcataaaactgttctgagcatactgataggtgcttaatgttcattgtcgataatgataattacattgtttttactgaaaaccattttttaaagtgaaagccgacccagttgctcttcctctggaagaggaagagtaaaggggtgcttcttgccactaccacttatgtagagttgcatatatacattgaaagggtattcagtaccaccattcattcagtcaagctaaatacaggccagtagaagcagtattgttaatgcatgtttttgccttcattggcccaaggcctacttaacatttttgacacccatcacagcaatttatctttcagagataaaaaaaaaatagcagattattatcacatatttttaaaaagaacattagaatttttggtaaaataagtagtaagacagtatcttgactctgctgcatacttgcttttgctggatgactaaatgagggtgaaaaatttaaggttggtttatgactaagaaggtattaaatgatagaaaagagaaaataaaagaccgtaaaagtttttaaaagcctctatacaaatattctttaacctttgactatctttgagtcatagaaacagtttataaatagcttcatggacacaattcagaaggtacagactagagccttgctcctcaaaagatggttcatgtgctgttgtgctggaccagcagcagcatcagtatcacgtgggagcttgttaaagaacctactgaatcataatttgcattttaacaggatcgccaagtgattcatatgggcactgaaggttaaaaagcactggaggtaatggcttttaaatattgattacccagctggaaatacactttatgtgctttgccttgtgcacacatcctggcctctcagtggctttacttctccccgccgtgtgatcttggttccaccctgcttcagctactccctcccatagtttctctcagaactcatcattaccaatatctggaaccatttcagaatttagtttcatgcatttgactatttgactttgtatcccatccttcctgctcactttctttagtccctaattactaacaatttttttacctcatcagaattatgccattgattctagtatcttttcactctcatctctcttgtgttgctactttcctccttacccagattcaactttaatagctgtgcccttataatcattcctgcatgcacccacagttttcttgtccctctcatgctgtatcatagtctcgtggctaaaccataggttaaatctagccatctattcctgacatttacagctagacaggtctggagaaaagcacagagccatgctaactagtctcattttaatttcttggacactcacatcaagtaaatccttagtactacctgacaattgtacttttatttccattatattcaccctttagtttcctgtagaacgatatcatactttcttgctctttaagcagacatctttgctatctttactctcagctgataaccttggttttggtttcactcagaaaatagaggcaagtagaagaggattttcacaggtttccaccactgcattgacccacctacctgcattgtgccctataaactaagcctttcccttggtgctgtgggtaaacttaagttcttagccagggcctactgaaggacactgctttagtagttctttttgctttcaggcatcattactttttccttttttgatggttatttttaatgtctctattttcttttccagcttttaatccttttctctcatattagcaaaattccacagaatgaattgttcatattttctgtctacagtttccacctattttatgaacccattccacttatccctcctcccccatgtacagatctagctacttactcaacatctccttctcttagatgtctaatagacatcttaaactgaacatgtcccaaatagtttctgatttttccttctcaagtcttaagatgagtgtatatgtacatacccatattcatacccataccgcattcatacccatcctcccacctagatttactgttcttaacattttaaacaagtaaatataagtaaatagattttcccccaccaataaaaagtaaggtccatgacagcagatggttctctgttttgtttattgctgtatctgcacctggtacatactagggactttaaaaatatttgctaaatatactacctacttagtggaggaaaacttcataaagctgtacttgccattgcagggcttaatgcttgcattcctatatgttatactattcagttatgttgtttacaaataaggcacagcccactaattcccactacatttatttcactacctacaaatggacagtttgaccaatgttagtctagcggctaggccatctatatgttgatttcaccttcttacctatctctcccacttccttaaaccagtcagcctataagaaatgattgctgggctcatgcctataatcccaacactttgggaggcagaggcaagaggatcgcttgatgccacatgtttgagaccagccagggcaacaaagcaagatcccatctctacaaaaagtttaaaaactagtcaggcatggtggcacacacctgtagccccagctacttggtagactgaggcgggaggattgcttgagctcaagagtttaaggctgcagtgagccatgatagcaccactgcactccagcctgggcaacagagcaagacctgcctcaaaaaaaaaaaaaaaaagaaagaagtaaatgattggtggaaatgaaagtatacttttaggacaaagtaatagaattgaagcatcatttcttccatcaggctcaccacaggaaatcagttttaaaatatacctcatttatttgggattcagttttctagtaacttgagttgcctagaacaacattgccaagaagttagaataatagtttaaaagacctctcgaacttctcattaagctctgaaaaagtctctgtagctgattttttttttttttttttttttttttttttttttttttttttttttttttttgagaccaagtctcgctctgtcacccaggttggagtacagtggtgccatcttggctcactgcaacctccacatcccaggttcaagcgattctcctgcctcagcctcctgagtagctgagactacaggcacgtgccaccacacccggataattttttgtgtttctttcagtagagatggggtttcactatgttagccaggatggtctcgatctcctgacctcgtgatccacccgcctcggcctcccaaagtgctgggattacaggcgtgagccaccatgcctggccctctgtagctgatttttaaaatgtgaaagtattttcctctcagaatatgatcattgtgaaaatgttgtaaaaatctggagaaagttaaattccctatataactttggccctccagcaaccactgagtggtgtatgtttggtgtgtgttagtgccttctaaagcttttaaatgtattcctaaacacacacacaaagctgttctaatttgcactttccccactgatgtatcaaagtgcgcattcctcctcatccttgcttctactgcagctcattcagtttttaatgtttgtaaattagagtcaaaaaaatttttactttttcgttcttttttagtgaggctgagcatttttcgtatgtttaagaactatttatcttctctttgattttacttgttatatatctttgtcttttttttgtttgctactttgaattattaagggataactagtttttttgtttttttgttttttaactcaaatctactgtggcttcctagccttgctgtatgcaaaaattacatacaatgtcctaaatattcttctgtaactataaatttgcattctatttggtatgtggtcatgtatatcattttctttttttaaattttattttagatatgggggtacatgtgcatgtttgttacatgagtatattgtgtactggtggacattgggcttctagcatacccgttaacccaaatagtgaacgtggttctcaataggtaacttttcatcccttacccccttcccaaactccacttttttggagttcccagtatctgttatttccatctttatgtctgtctgtacccattgtttagctcctactttataagcaagaacacgcagtatttgattttttgagttagttcactgaggataatggccttcagctccatccctgctgctgcaaaagacacgatttcattcttttttatggctgctatgtctttctttaatccctatatagcttgtggcctcacaccattaattaaataagccattcattcttgtcctaatacctttgtaatatgttagacccctgtatgtaagcaagcaagcctgtttgagggtgccaaaatatgttttgttcatctttctttttttctttttttttttttttgagacagagtctcattcagttgccaggctggagtgcagtggtgcagtctcttctcactgcaacctccacctcttgggttcaagtaattcttgcgcctcagcctcccgagtagctggaattagaggcacgtaccaccagacccaactaatttttgtaattttagtagagacagggttttaccatgttgaccaggatggtctcgatctcctgaccttgtgatccacctgccttggcctctcacatctttttttctatttcatgaggcaatatcatactgtggtagttattgcaactttgtagtgtacttcataccaattggtgttctttctttcctaagttttcttgatcatccttgtgcatttgttcttccagatggaactttgccaagttgcaagatttttagtgaggcttttaaatttgaaaatagttttattcaatacatgggctaatttggagataatttatgtttttacagcattgattacctgtttatacacataatatatgttttcacttattcagactttcttaaatgctgttcagtaaaattttatggttttgttcatataggccttatgcttttttaagtttggagattgtatagattttgttgttattgtaagtaaatttttttcatcattgttaaattattttgcatgttctaggtagactttttagtcctatctgtaagttacaattttttcctaagccaaaatctgtttctcttaattttattactctaatttttgaccaaagtctctagaataatttccaaattgaaaatattataatatttttctcagtataatttgaattattctagtgttttaccattaagtatggtgtttgctgttttgttttacatagaaaattgaggacattactttttgtatctagttttcctttatttctagaattaggaaaaatcaggccaccttccctcaagtctccattttgaacttctgcagtgtctaggtttcaggaacaggaatgggggataggagtccatatgttaccatgctggtaaggaaggctgtttgctctacacctagctgtgctctctgcttagcaccccacctagtacctcagcagcctagaagttctagccttgacattacaaggaggcctgaatgggcatgccccagccttacctaggtaaggagccacattctgcctctgcacatatctgtaccagtgattacctggctctgacagatggctctttctcacagggtctctcatcattagtcatgcggatggtagtttagacattctagtgcataatatggaataataataattatacctaacatattaaatactatgtgccaggcattgttctattttatatgtaatcatccttttaatcttaaaaaaaaatctcatgagataggtattatgaataccattttacagatgagaaaactaagacaaagaaggggcttaataacttgcacagggtcacacaaccaagtagatattgattatgaatgctcagtaaatgatgcaaggatgataacgattggagacaattagaaagtgtacctattcagagtatttgattgtggaaggttggaagtgaataacatatctgagaaaataagcatcactccccgacaatgtcaggtaaatgaggtcttgactttgactccacagaaatttatctagcagccaaattggctgttaattgaaaatggatctgggaagagggcgtcaaaggcatagagaataacaatttatcacataaaaaaaaaggagaaggaaacctttctaaatgggattctcaagcatgtatacatctaaggaaaatgattttaaaatgttaatattccagagaagaaatcaagtttttggtttctatatttgtttctgaggcttccaagagactaggattcagtattttcatttgccacatagaattaaaggggaattggacccagttatgggaaggtaaatgggaaagagttatatttctgaagctgaaattaaagtgtgtttgttttcgctttgataggaaaacagaaatcatagtttttcagtaatcagcacttgtcaatttttccttttgagatgtgtatttttttcccaccaccattttttaatctcatgactaaatataatacaatagccttttaactggtctctttgcttcttgtttctgtttgtttgtttgtttgtttgtttttaaattatccatcctgacctggttgataagtgaagttaagatgtctattgtattatgacatattcctggtttagaaacattcttgatgtttacttaacaggtttatttaaaattggatgtatttttagaggcaaaatctttgtttaaagattttaagcttcataacttctgtctgcttactttattaattgtttttatttttgttttttgagacaaggtctcactctgtcacccaggctggaaagcagtggcacgatcatggctcactgcagcctggagttcccaggctcaagtgatccttccgcacttcagcctcccaagtagctgggaccacaggcacctgccaccatacctagctaattttttaatttttcatggagactgggtctccctacgttgtccaggctagtttcaaattcctaggctcaagcaatcctcccgtctcagcctctcgaattgtgggattaccggccacactgagcctctgggcccagctgatctgcttaatttgaataaagagacgaacatactaaaacccaattctagctaaggtaagcaaagagaatattctagaatgtctgtagttatgtatggaacctacagtaagttggaaacttggtcttggaattgggcaggaacaaagcatcttggagcccaggaagcagaaactgttaagagctatcctgcagcaggagcagttgtgttagcttctcatctgctcggatggaatggtcacaggtcagtttccgtatctttagccctctgctcaagatatcaattccagagagggagcatctgcttgctgttgctagccttgccttccttacctgctcacccttggtatcagcagcattgatgggtctgtttctagtttgtagttgttttttgttaaatttgacgttatgagcaatatagatagttttggattgtgcttaaaagccaacccatccctgacaatggaaggaaaaataaaatttttctctctctttctcatttgtaggtagaaacaataaattcatgaaaaagcctctactctgtctgatacctcgctgacatgtagaattttgtgcttcagtatactccttttcagtactgagtatttcaaagaacatctgtatcttacttagcagctggtttcttccctcaactaatttcatttttcatgtcattaatgggttttgtgtatgtccccaccctgtggcacagaacagatatgaatatatatattcatatagatacattatgaatctatatgcatatgtagatgcatatatatgtaaacactgtaatggttttatgtggcataatttttcaatttttcatttttcagtctgatacatcatgactcctggatctcttttctctagctttcctgtatttctgagcctaagaaacataaacatcatcttagtttcttggtattcattaggcctgtgggatggaagaagtattataatgtagagtaaaagctcatcgttttatgtcatgggacaaattacctttgtttctcacccttctaatcacagttggggagttatgggagatgctgaactggaattctgatattgggcagtgtgctcttctctgggaaactagaagttgtttttctgacaggatgacatttggtttctggggaccatgtgtgtcttcccttcaccctgactctgatctaaatactgattgaacatactctaggcagtaatgacttgatataagagatatactactttcagagttgtcttcacaactgtttgcccttctaaaattatctcctatttttctactcctattttgatgattgaatgagtgctttccaaagatgataaatacaagttaaaagccaaagtagtaaacttgtaagtgtgaagtctgtgttccctttgtcctgtaatcctatttcttataatttgcctaaaattatagtaagttgaaaaatgtatgcagaaagttcatttcagcattcactatttagtgaaaataggagaacaacctaaatctgtagcaataaagtaccaaattagcaaattatctgtacacaaaagaatattatgcagacatcaaaaataatgccatagttttatgtttattgatttgccaggatgtttgtgatacagaataatgtctgtgatgtattattaaataaaaagcaaattgcagagcagcatttatatgttcccatttgtgcaggattgtatacttatttctgcatgtgtattcatggagcactgtctgggaagtatgttaaaacattgattatagctagtggcagatttggagatttctttccttgctaattattcatgcttggaaccaatactatgatattgaaatatatctatcccttttagtgttttttataccatattaatgtaatttttaagaaattttaatatttaacatttgtgtttaataattatggctcttggatctctttttttaatttttatgttactgagcctgcaaaacatgaagaccacagttggtttctaatattgactctgccacatttcagtatcttagtattttaattatgtccttagcttatgtcttattagcacctcttccttagcttatgtattttctaagtataggaactgcatttgttaaagttgatctgtatattacctagcatagcatgtcttggaagtaaacattctgtttttaatccttgaaagtgagatatattcccactaattttgtaacaaatcatttcctactctatttaggtgtagagttcggtgctcgaatgataactattgatgggaaacagataaaacttcagatatgggatacggtaagtataggaaaagtgcactgtatgatctcagtaaagttactttatgaaagtacatcgtatatttgttttaatgttattatatgcctgttatggtttgttagacactgacttcctgcagccatgagatgaaatgtggtgctggagtagactggtttttcttatgcactgttttcaatagatgggccctgggtgttggtgttagtgagcatatctgagtgaatgttcacgttatgtggtctaaattgaaatgctctagaaactgtatttttaagaaaaacaatcagcatgtctcaagtacacataggaagtaaaataagaatatcaatattatacaataacttattcttcaggcttattattttaaatgttttagtcctaacaacttgaagtcacgttgctcttaattcagtatcctaattctgtcatacccttgttcattgagtacctattacatgtcatacaatattgtttttaatggtgattcctcatctgaaccacaatatacagaaaatgatttgagtgactgttttctctattctcccatcttagatgcataaaagtgaagttactgtattatatacattgggtgccttaaggtagcaattttcaaaccattttgtttcagaactactttatacatttaaaaattaatgaagacccccaaagagctttagcttatatggcttaaaggtattaatatttaccatattagaaattaaaaatgagaaacttaccaaatattcaatcattaattcattttaaattaataaattacttgttagggtagataatataattgtaatggacactgtatttttccaaaacaaacaactacatttttctagtgagactagtgatatctgtctgcttaatagaagacactggattctcatacctgcttctgcactgagccttacgtatgttgtttaattgaagtatattaagaaaatccagcctcacacaaatagttgggaaatggaggaccacatggacccttaaagtctgaggaattcccaggattctgggatcacactttgagaaccactgctttagggcattaggagataattcttcacagaaccccagttgagaaaacctgaaaggtctcctgttgtgtcaaagaacatattctctaaaccagcaaatgagatagaaaagatgggatttaatcatcatatacccgtggcctatttttctccagtcactcagtcttagtttctcacttgtcatgtgtagtagccattgaaagaaggaaccttagagaacatccggtctcacagactggattccctagaccaagcaagttgctgaaggctgctgtgggacctgggtttcctgatacttcctatgtgtcacagttttcccttaaatgataaccgtacatctctgtcttgccttgtccttgaattgtccactcgactctgggttcttgtgtttttttgcctcttcttcctcagtgaagagtcatacttttactatttctcaaggatttcccacatgagcctaaagcatctcaaaacatttgatttacattctctcaggcagcatctcaaaactgcatggaaaagaggaaaataaaatacacaaagtcccttttttcctagagatttaaaattaataatctccaaccaaaaagaaacattttctacttctgtattaaaagaggttctctcttcttgttttggagacagggtctcactctgtcacccaggctgtagtgcagtggcacaatcatagctcgctgcagcctcgagctcctgggctcaagcagtcctcccacttcagtctcctgaatagctaggactacaggcgtgcaccaccacacccggctgagttactgtctcttattcagaactgatttacgtaaactaagttactctttttagcttataaccttgtgtaacacacatctttgcattgtgtagtgtgaaccagactactgttattcttcaataaacatatttttcattccttatacttttgcataaatacttgtattgcttgaagtgccgttttttgttttcttttccatttaaggcaactaagatgtcagctctttggtgaagcctttttgacccccatcggaataacttattcttcctgtaatattttgtgcatatgtctcctgtagttctgatcccactgtcatagctttttgtttacattatctacccttctcagaataagcattatgagggaaggatccacctatatcttatgcagctttgtatcctgcattcttagcttggtgactgataatacagtgtttggtaaattttactgaatgaatgaatagagaatctcattctgtctaagcaacttgtagggtcactggatgtgttcaggagatatctactaaagtacatcgttttgaaaaggaaaggttaatatagtaatgataattatgtgatattttaggcataaaccacttcattgtctgtaggttattttagtttattcacttgttcttctattcttaaagtagtcccttaaataatctttgttttttgaaacttgagtaagccattcatttcctagttgtctgttttgtagattaactcgtcatacatcattttgatagaagcctggttttttgtgggttttcttgtttttgtttttgcttgagttgatttctttgcacaacaataaacttgcaaaagaaatctaaaataatttcttatgctggacagtatgagaaaggaagagaagaaaaacccttgtttgtgttcctctaggagggtagagggctcgttttctttcctctatttctgagagagatggtggtccgtttaaagacatcataacatcccagaaagaattcgaccacttccagcttctacatggagagctcccagacccaatggcctgttccagatttaaaggactgtttaaaatagtttaacttatttcttttggaggttgtttcttgagtctttgtcttacaggttttcctcttttgtttttgtttttttgggggtttttttttttttttttggttttgagacagcgtcttactctgtcgcccaggcttgagtgtagtggcatgatcacagctcactgcagcctcaaacgcctggcctcaagcaatcctcccacgtcagcctcttgagtagctgggactacacatgcatgccaccacatgcagctaattttcaaaattttttgtagagatggagtcttgttatgtttcccaggctggtcaggcttttctcttattttcattgactttcttcttactttcatacccaacttccaaaactttttaataaatgtaacctaatacacattaagattggtctcacacttagtttatatctgagtgaaacgggattttccatagcattaatgttttacagtgtgtctgtacatttggatagccggttgcatttttggtagcaagggttatgtctattcatgacccaagatgtttacaaaaccatcctagagtccttcaagggaaaattagccaaatgttattatttgttttatcagccttatagaaatgaagagttttcttagtatcttaggatatttgtctttttttttttttttttttttgagacggtgtttcactcttgctgcccaggctgtagtgcaatggtgcaatctcagctcaccgcaacctccgcctcccgggttcaagcgattctcttgcctcagcctcccaagtagctggaattacaggcatgcaccaccacgcccggctaattttgtatttttagtagagacggggtttctccatgttggtcaggctggtcccgaactcccgacctcaggtgatccacgcctcagcctcccaaagtgctgggattataggtgtgagccactgcacctggcctacaggatgtttgtcatttttatcttcaaaaaatttaaggagttttccttgcaagattttcacatccaccacctttgctttcttttgccagtagtgagaatagctgctagcagatactccttggaggcatgaaggccatcaatcagtttcacagctggaaacagtgataagagtctatcagtgcctccctttaagcactgacacttggccctttactgagttacttttctttcatttattaaaagccaaagccaaactgtaaatattcttttctgccaggggaagtcaaagaagaaacatacgttgcccctggtttctgttcattggcagaaaaaaggcagaggtatgttctcactgttagaccctggccagccattactgccttgttctgctcttgttctttttctcttactttttctcttgccttctattcctctttcagttgccttccagcatatccaaatacatttgatttcccagcccctccaaaaaaaattgtaatatggatgttttagttaagttcatttatccactcagcttccctagaaatattcctattttacatgtcttatatcaagtaagtcagtgaaacttttgaccaaattgtgtgaaaactaacatgctaaaagtttcttctcagcaaatcacaggcattttttttctcctttgaaaaacatgttactttatactcttgacgtattatttctaaaaattgaatattattttgtttcaatgcatcagtaaggatggatgaccagatgcagtgagccagggagaggacctggaaccctgagggctgaaaacaatactgcctccccacttctgcctttcctctctgctcccattactgtcacttcctccctctcccccaccatcccttaagctgggagttgaggggcttagagctccaactgttcttcctccttaggcagcaattcatcaacatttttttgaacaactacagggacaggaaactgtcttagacatttcattgtactttagtgattacctcccacctgtggtctccagtttttcttacgtggcagcactaaaagaatctgacatcggtgatcatatcctattttatctttttttttttcttgttttttgaggcaggatcttgccctgttgcccaggctggagtgcagtggtgtgatcacagctcaccacagcctccacctcccaggctcaagtgatcctctcacctcagcttccccagtacctgggactacaggcactcgccaccactcccagctaatttttttttttaattttgtagagatgggattttgccatgttcccaaggctggtcagaaactcctgggctcaagcaatctgcccaccttggcctcccaaagtgctgggattacagcgtgagccactgcgcccagctaagccttttttccaaagtaaatatcctcaaattttttaaagcattcaacttgtgctgttttttctaggtatttccacccattgttacttttctcaggatcccacaactaactagtgcaggttgactttttcaccacccttgctgtgtacactaagacagcctaaaaatcactttgattcttactgatcttactgtcacctggaatagaagttttgtacatgcatgtagatttcaaaatatttcctctcaattatagcagttccttgatagaggtctaaatttttttttttttttgagacggagtctcgctctgtcgcccaggctggagtgcagtggcgtgatctcggctcactgcaagcttcgcctgccgggttcacgccactttctcctgcctcaacctcctgagtagctgggactacaggtgcccgccaccacgcccggctaatttttttttttttttttttttttggatttttagtggagacgaggtttcaccaagttagccaggatgatcttgatctcctgacctcgtgatccacccgcctcagcttcccaaagtgctgggattataggcgtgagccaccacacccggccaaggtctaaatttttaagttgagtcttttaagtaaagtacctgagatttaatgcttgggcaagggacagtttatttggctgtttagaaatccttctttccttcttttggttctcatctgtcttctacatagctggagctgtttgataaataactagcaatgcaagtaagagaagtattactgtaatactgattctcacaaatcttaattttctcactttattggctctttgggatcaatccaggtaacatatttgagtgcctactataaatatactctagtactctgagttaagctattcctcaaggataactgaagaggaaaaaagataagcatttgagtagtgtgttcattgtatctaatcaatagtattaaaaccaaatgaccacatgaaagtgcttttggatttgtgaggagaaaaggataactatgggctgtggtagacaagctttcccagctttgtgaaagaattaggggcttgagctggtcctcaaaggaaatggaaattggataggtggagagagaagaaaatagtgtttcaggcaaggagttaagcagaggcacaaaagcaggaattttcagactatagacaagatatcagtagaaaaaaatggacttgtatgagcaagattttgaataagaaaaaattcttgtgagacaagtagaggtctgattctcaagagcttaggactttaattcaggatatttagagatttttgaactacagcttaatatgtataaagttatattttgtgggagtagaagaggaagaagaggtgaagattactactagttgccagcctggttactacaaatattgctattcaccaaaagactcagatgcatgggaaagccagtttaagggattctttatctggcagttacaaataagctttaaaattatggtgcaaaggatcaattttgatttagcaatcctcacatgaaagatgaaggtgtaagacttcttttgcacaaatgttccgtgactttaatattaagcatcactaaaaatgagcatgtttttatctcttaggcagacttgttctgctctacttttttgcatctctgagtattttgtgaatgtttttttgttgttttgttttgtttttgttttgtttttgagacagagtccagctctgtcacccaggctagagtgcagtggcgcaatctcagctcactgcagcctccgcctcctgggttcaagtgattctcctgcctcagcctccagaatacctgggattacaggcacgtgccaccacacctggctaatttttgtattttttgtagagacggggtttcaccatgttggccaggctggtctggaactcctgacctcaggtgatccatccgccttggcctcccaaagtgctgggattacaggcgtgagccaccacacccagctaatcctgtggatttttaaattaatccaacagttatattgtgagccaagagaacttactgtccactctggccactccaccccaagtttgttttgtggtgctgttcacttaggcaatcattcctgtttgactaaatgtgtttttctttacactctaagctaatattaggaatctcttactattaaatacaaagaattttgtatcctgtttggtttcaagcttccaaaatcccttttaaccaacagtttatagtgaagaggatcaaacacaacatttataattcctaagttaacttttttttttttgagatggagtctcactctgtcacccaggctggagtgcggtggcgcagtcttggctcactgcaagctcctcctcccaggttcacgccattctcctgcctcagcttcccgagtagctgggactacaggtgcccgccaccaagcccggctaattttttgcatttttagtagagacagggtttcactgtgttagccaggatggtctcgatctcttgacttcgtaatatgcctgccttggcctcccaaagtgctgggattacaggcgtgagccaccgcgcctggccctaggttaacatttttgtttcacttaaaacaatataggtcaatccgagtttggataggtatatattaaagcaccttttttttttttttttgagacagtctcactctgttgcccaggctggagtgcaatggcatgatctcggctcattgtaacctccgcctcctggcttcaagtgattctcctgccccagcctcccaagtagctgagattacaggtgtgcgccaccacacccggctaatttttgtattttttagtagagatggggtttcaccagttggtcaggctggtctcaaacgcctgacctcgtgatctgcctgtctcggcctcccaaagtgctgagattacaggcgtgagccactgcgaccagcctaaagtgctttttaaaaatcaaattactttgctttaatatgtcaaggtagttaacctttgggctaactttatgcagttagttgttatataacagtttatttatagttagagaagccataataaaaaaaaaaacttcactgggcaagatttatttcaaggctaccaataccattatcaaagagaataggccagagttgtgatagttttcagataagtaaggtctcaagaatttgtaaactattctgaacactcatctttatttattataaagtaatcatagatcttaagatgcatagctacagtcatagtcttcagtgggaattgtgtttttttatttgctcgagcttttgtttaattttgtagtgggcagaagtctagattcaaatgtattgtgtaagttatttccatattggaacgtgttttgttctttgcaaaacagttcagaaggaatgagaatggttataaaagtttgcttttctccttttcctaaatttattttgtcttttactctttactatctcttatctaggctctaaactggaagttgtggatcttatagtagtacttttctagcaatgtgttcattttaattcatcccacagaatgtccctggagagattggtttaaaggacttttacctttgcttgatgatcagccatgggcaatattagagctataaacctgatttttattttgaactaataaaatatgtatcttttttgtattacagtagctcttccttatccatgaggaatagatgctaacaccctcagtagatgcctgaaattgcagatagtgctgaactctatatatactagtttttcgatcccataacagagacggctgcagtttaagcatccctaatttgaaaatcccaaactttttgagctttcacatgacactcagaggagatgctttttggtgcattttggattttagttttcagattagggatgctcaactgataagtataatgcaaatattctaaaatcagaaacacttctggttcaaagcatttcagagaagaagtgctcaacctgtactaagtgactaccaggcaggtagtgtagtgtatacagtgaagataggctggacaaagggatgattcacatccccagcaggacggagcagcaggatagtgggagacttttatcacactactcagaatagtgtacaatttaaaacttaggaattattatttctggacttttccatttaatattttcagactgcagttgaccaccaataactgaaaccttagaaagcaaaacctcaaataagggggaactactgtacctaacacagaatcctttcttggtacataggatttacagtgaaattaatccctaaagatctagtccttagtttttctgtgctaagcagttaaagaagatatttcctgccattgtgccttcagaacagtgaatttggctgggaacagtggcccacacctgtaaccccagcacttttacgagaccgagacaggttgattgcttaaagctcagtagtttgagaccaccctgggcaacatggtgaaacctggtctctataaaaaaataaaaaataataaattttaaaaaacaatcaatttaaaataaaaacaaggtatcttctagttttttgttgttttttgttgttgttgtttttctttctttttttttttttttaaagacacagggcctcatctgttgcccaggctggagtgcagtggtgtgattgtagctcactgtagccttgaactcctgggctcaagtgatcctcctgcttcagcctcccaagtagctaggactgcacgggtaagccacaacacccagctaatttttaaaattttttttgtagagatggggtctcgccatgttagccaggctggttttgaactcctggcctcaagcaatactcctgcctcagcctcccaaagtggcatgagccattatacccggctgtcttcagtttaacctaagctatgtaaaatgatttggctatttttatagcccttttgtgtgatggctttctcactgtctaatttagcatgacattattctaactgccaaaattgcctacccaagagagggtctaattgttattttccacataggagaagttattttcattgaatctcagcacgttaggatttacagatgtccactcagctatgtgggatggagtactgattattttacgcatataactaagacattaggatttcttgtttcacttttttgttgtttttttgtttttgtttttggagacaaggtgttgctctgttagcaagactgaagtacagtggtgcaattacatctccctgcagcctcctcacctgggctcagatgatcctcctacctcagcctcccaagtagctgggggcgtgccaccacacttggctaatttttatatttttggtagagacggggttttgccatgttgcccaggctggtcttaacccatttatgcaggaagttgcaaattttttgtgtgaaaaatcagaccttggcagtgaccttgagcagtaggatataaataactcccacaagcttagcattccaataatggaacactaggcataaatgggttaaaaactcccaggctcaagcgatccaccagtcatggcctcccaaagtgctgggattgcatgcgtgagccaccatgcccagcctatttttccactttttcactcaacaggctttctctgaatgcctgctatatgccggacccagtgcctagcacacacttagtcacatgcagggggtgggggatgggggagggagggagtatagaggaagggtcaacaagagcaaggtattgtagagtgttgagtgttaaacagggtagaatatgagccgtccatgcgcattctgagggtgggaagggctaaatatttacattgcaagatcagaactcagaatgtgtaaacatcaatatttttcaagttaggggattttgaatataaaaatcgttaaaattggctttacgtttacttaattaaaatgcttatgtttttgcaaaagtaggaaaagaagggattaaaaatgaaaaataacttcttataagagctgtctcggttttaaactcagacagaacagtcacattcctccccagcaattcttaaaaaaacagaaattagtaccatgagtaaaagagaaattacctagctttgcataatctcttgtgtctgtttcacaagtggatataaagatgacttttacatcctgttgccttttgacaagcattatatatcaaatacagagaaaattgattaagtgtggagaaaaaaacttatataaattaaattcagaaccattttgcttttcataataaaatgattgctcaaagaattccatttgatgactgttgaaagctcactgcagtttatgatataactgataaaatctgcatccttggccttccaacaacctttacaccagcagatggtgggcgtaaagatgtcattcatcatttatttacaatgggttttatttattctagtgtcaacagctgccccagggagtgggttattgaattcaaatgtgaggctctgggttatttgcttcctttcaaatttgtcttcagagcttagttgctaggagtccattctgtcctttaataatgattcgtgtattgtgaagccattcagtaaattgggttgtcagggattgccaaaaagggtttagaggtcttgcgggctggggaggttgcaggagcgactacatgtgcactacatgtgcgtctcgttgacttgagcaatcttgagcaatagcggtgttttgtaactttttcctaagactggtgaagttaagttttcttgtctctctttatgcactccttccctacctgctcttattctgtatatgaataatatgaaaatgtagaggacattgtattaaaggaaactctccaaccttttttttcgttacaggcagggcaagaatcctttcgttccatcacaaggtcgtattacagaggtgcagcaggagctttactagtttacgatattacacggtgagaacttgaaaactttgcaattcagtagttgatacagagaatttttctaaatagatgtggttaacagtaatgaaagaatagcttagcctttctgccccggctactcacctttaaaactgcatcttgagtccaatttaaatttactacagaaacctgcaactgaattgtttttcttatttgaattagcaccttcaaattgaaatcggccatattatttattcattggaattttctaaagtgtgattacatttaatttataaactgaaatacaatcagtgaactctaaacccagatatggtgcttaaaactacttctcgttacataagtggatatggctaaaagtggttctctttaaaaatatgtatattgttcgttgtatactgagggaaatgctttgaacatagtaattaaattattatttatgtttaggagagatacattcaaccacttgacaacctggttagaagatgcccgccagcattccaattccaacatggtcattatgcttattggaaataaaaggtaaaaaggctaatttagagcttacattgcattagtgatgaagactgtactgtttatttgactactttccttaacatttgttcaaatgtgagttaccagcctcttaaattataaaatttcggaaattctaaggtgtttcttttgatttttaaaatgatgttaataagctttgttggaaattattactgttattattagaaatagtttttgtgtaaagaaatactttaaaaagtaatctgaaggagttttatcagattactgatgtaaagtaaagcctactgatttatttggggagttggattgaacatctttgtgctgtcaatttaaaatgctattatatgggaaaaccttcttgcttgaccagtttccataaacttctaagagtgtgggaaagttttcactaatttttgtagaaacttacagtggtaagaaaatattagtattttcaaaatgctaggcaccattctttttgttttgttttgttttgttttgttttgttttgttttgttttgtttgagacagggactcactctgttacccaggctagagtgcagtggtgtgatcatagctcactgcagcttggcctcccgggctcaagggaatcctcctgcctcagcctccaaagtggctgagactgtaggcatgcacaaccacagctagtttatctttttatttcttataaagaaagggtctcactttgttgcccaggctggtctcaggctcctaacctcaagtgattctcccacctgggcctccaaaagtactgggattataggcataagccaccacacccggcccattcattctttagggttatattaataaaatactctgaagagatgctgtttttagataggtaaaatcatgacttatatgataatgaagacatctcaaaacttttatctcattaattaacaagataaggaaactggtaagatatttcagccagttcaaaagggaactcaaattactatacattgataatcaaataaagaaactgaaatgaatttacaagatggatgcaaaactgaacagtattcacagggtattaattgtattccacaggacacagtctgcatttccatggacaggaattatttgcgtttattcccacaagttaacttctctctctgcagtctttgaaaatgtgtgagatgcagttaaaatagtactatcaagaaaatttttaaatgaacagcctagggccaggtacagtggctcacacctgtgatcccaacactttgggaggcccaggtggaggattgcttgatcccaggagttcaagatcagcccgggcaacacagggagactccatctctacaacaaattttaaaatttagctagacatgatggtgcattcctgtgattccagctactcaggaggctgaggtgggagaatcacttgagcccagttgaggctgcagtgaactgtgttcatgccactgtactccagcctgagcaacaaagcaagaccttgtctcaaaaaaaaaaagaaaatagcctaatttttttgccttaagaaactagaataagagcaaatcaaagttaaggaaagcctcctgcccgttaaaaaaaaaagagagagagaaaaccaatgaaaccaaaagctaattcttcagaagataaaataaaatagatactgatcaggaaaaagacaaacattagcaatatcaggaaagaaaggttgacatcactatagataaaaaaaagagagagaatattgtaaacagactaaataaatgaagagatataaccatgttcatggattgtaaaactaaatataagatgtcttctcaaatttatctaaaaattcattgaaggccaggtacaatggctcacatctgtaatcccagcactttgggaggccaaggcaggagcatcacatgaggcaaggagttcaagaccagcctgagaatgtagcaagaccctatctctacaaaaaataaaataataattaaaaaaaactagctaggcatgctggcacacgcctttagctctacttactcaggaagcagaggtgagaggatcacttgaatccaggagctcaaggttgcagtgagctatgattgtgccacctgcactccagcctgggcaaaagagcaagactctgtctccaagaaaaaaaaaaaaaaaaaaagatttattgtaaccctaatcaaactatcaaacattggcagacttttttgggagggtagatattgacaagctgactttaaagtttatgtgcaaaggccacggaatagccaaatcaactttgacaaagaggcacaatattggagagaatttactattctacaaattttaagatttattatactatagtcaatttactattgtttggcataagcagacatagatcagtagagccgaataagaagttccagaagtagattcatatatatatgatatattaattttttgacagagatgctaatttagttgaagaaggggtaatctttttcatcaaatggtgctgaaacagttaatagtcatatgtaaaaatatgaacctcaactgttacattataccatttacaaaaattaactggaagtggatcatagacctaagtgtgagagctaaaactacttaaaatttctaaaagaaaacaaattgtagtgaccctgttttggcaaacatttcttaaatgggacagagaaaagcatgaacttatagttcagaaaaaaaatcaataaattgttctttaactgaatttaaaacttttgttcttcaaaagacggttacactattatacaacatcgtgacatggttaatgatgatatagtgcattctggaaaaatgctgaaagagtggatgttaagtgttctcaccacaaaaaacgataactgtgagataatgcaaattagctagattaaccattccacagtgtatatatactttaaaacaatatgttgtacatgataaatatatgcaattttacctatcaatttaaataaataaatttgaagaaaaacggttacaaaaatgaaaagacaagctacagactagcagaaaatatttgtgaaaaatgtatctgacaaaggatttatatctagaatatatgaagaatgcttataattcattaataagaagacatccactttttaaaaatgatctaaagatttgaaccagcaattactacagaagatatactactgatgggaacgtaaaatgatacaatcactttggaaaacaatttggtagtttctttagaaattaaaaggccgaggcgggaggattgcttcagcctaggagtttgagaccagcctgggcaatgtagggagacttcttctatacaaaaataagaaattttttaaaaaagtagctgaacatggtggtacatacttgtagtcccagctactccagaggctgaggtggtaggatcacttaagcctgagaggtcaaggctgcagtgagccatgatcatgccactgtattccagcctaggccacagagcaagaccctgtctcaaaaaaaagaaataaagcacacatctatatttcctagccactttactcccagatgtttacccaacataaatatgtcttcatgtgtccacagaattatgtacaaatattcataccagctttatttctaatagccccaaactggaaacaacccaaatatcaattaacagatgaatcgaaaaatagtgatacagcattacaacagactacaactcagctataaagaggaatgaactattgatacatgcagcaaaatggatgattctcaaaataattacagagtgaaaaaactcagaccaaaaataccatgtgattacatttatataaaaatcctagtaaatgtgtactaatctgtagtggcagaaagcagatcatcagctgcctagggtgcaggggcaagaagggatggattacaatggagtatgaggaaacttttgggagactgatggcttcacgggcttacatatcttaaaactcaacaaattttgcatttaagtacaacttcttttatgtctgttacacctcaaaaaagctataatgtaaaacatcgttatactgtatagattttagagtgttgttttaatagaaattgagatttgctattaagagaaaatattacctaagtgatatttacattataaaaagctaaacattgtttacttctttgtgtagagaagaaactattatcatattctctgaaggcctttcttgggtattcttttccacatttaaatcatctcactaaacctttttaaggttataaagctattggagggaagttttagtctttctatgatggaaatagttattctgtcattcaaggtatgaaataataagaggagaatacttggaaaataaagagaatttttatccttttattttaccaattttttccttgtggctgaaacatgatgagtgacagcttactggtggcttaaatttggtcaccgaccactaggagctgatagttcaaatgtgagaagaaataaacaaagcatagtatgtaaacgagatgtttctgatgatcgtaggtgggtgacctttaaaatcaggagtataacgaacaagaaagaacagagagaaataaatgagatgattatttttagatgaattgaactgtggatagacatcaaaacagggaataagcaatttttgaattagacgcattaagcagtagggagccagtgaagggcagtgacctagtcagagcaacagatgacacaaatttttcttactatggcattttattaataaattggttatataagaaataggaagcagagatttaaaaaatgaaagttttttaatagtgtaagggttgtaatgcaaaccctaaacaaaaaggggccataaattaaaagaaagatacttaagtaacctaagcaacttaagtgggattcagagggagtgaactaagacaacaatatgatgtaatgcctggaaaactgaggtatttttaaaactttgcactaagtatatcgtcaagtactatggcttttgagttttttgatttgacctatagtaagaaatgtattttacatcatgacctagtaaataaattgtgtatacacctacacatataacaaaatattcgtaaattatacctttatacgtaagttccatgaaacagtagatggaacttatgtatataggtgatagactctgatattttatattgtttcttttttttttcccttcccaagatggagtctcactctgtcgcccaggctggagtgcagtggcgcgatctctgctcactgcaacctccgcctcccaggttcaagcaattctcccgcctcagtctcctgagtagctgggattacaggcacccaccatcatacccagctaatttttgtatttttgtagagacggggtttcaccatgttggccaggctggtcttgaactcctaacctgaggtgatccacccgccttgcctcccaaagtgccgtaattacaggtgtgagccaccgcacccggcctattgtttctttttttaaaaaaaaattctgattatttcctactgagtgatttttacaattcattgagtcatgacacagtttgaaaaatcctacccaggcttaacgcagtgtctcagtcctgtagtcctagcaattgggaaggccaaagtgggaggatcacttgagtcctggagttcaagaccagcgtgagcaacatagtgagactttgtctctgaaaaaattaaaaaaaaaaaactgccctggaaaagccttggcacgtgtatacacaaatatatatatatattttatatatatatgtaaaatacatatattttaatatatgtattttatatatatataatacatatatatataatgcttattgtaacattgtttgtaataatgaaaaattataaataactttgccttatagagaatttaagttgtattgcattcattcagtagactgtaattcaccagtttaaaaacaaactagatctgcatgtattatatggataaatttgaaaaacatagtgttgaccaaagttaacaagttgtaaaacagtagctacatctgaatttttaaagacatgaaaaagaaatactatttatggttataaacatgaggataaatgcaaaaacatgcatgagaatgaaaacaccaaatttaggtagtggttacctttagggtaagagggaggagagtgggatcagagacacacaggtggtgattctgctgttgctgattttatttcttaaagggaaagaaacctgaaatctggcaaataatatgtcaaggctagctggaagtatgtggacattatattatacatcttttttcatgtataaacatgtaataataaataatatataaaaagtaataaatataataataaagttttttaactttaaaaataaaacacgctttaaaagcaactgctacctcccctcccccccactaataaaattctagtatgataaaaatgaataccctgctttcattggaaatttctagcttacactttctctctcactccgtttctccttttctgtctctctctactccttctccctccctccctccctctctctctctgtctatatcaattttgctttaagaggaaactgggaattaaacaaactgggatcaatgatgtaatgtatctttagtactttggattttctaaacaatttcctgtagtttctgagagttgtattttaatcacattcatagaaactcagtcagtctggccaatggaggagaatagtatagtcctgctctttcaaattatgttaagcaaaatggctttcttctctgggaatgcactgtactcaaagatataaggtattagactagaggctcccttaagttacggctagttctaacgttctaaagctctaacacagaatctttcttctgttggattgttagttctttgaaactagacagtgtgttctaaatactaaccctcataataccctgaataatacagttagtatgttaaaaattaattaaaagaatggtcatcacaactttgaattccatggtacactttccacaaatgcttctgtttgtaccatgttgattagtaatgtgaccctttctttcccatgtttagtgatttagaatctagaagagaagtaaaaaaagaagaaggtgaagcttttgcacgagaacatggactcatcttcatggaaacgtctgctaagactgcttccaatgtagaagaggtaaataagaggccctttaaaatcttcatctttatacttaatagaaatgttttatatatcttcattttacttattatttaagtttttagtcggatggtctttgaacatcataaagtaggaaagtttcttccctttgaaatcccttgtaacattcaccttctgtcagactcttaaatcatattgagccttctaaagcctgaatgttttcttacatttttgtacgtattttcactccctccctttttctaaacaatttcctatagtttctgagagttatattttaatcacattcatagaaagtcagtctggccaatggaggagaatagtgtagtcctattctttcaaattatgttgagcaaaatggcttctctgggaacccactgtactcaaagatataaggtattggacttcttcgtgttgcatggtagggaaatcttttttgtgttgcatgggagggaaacaaggaaccacactaatgaaatttggaaatgtttcaagacagcagaacgtttgtagctatttatatccacttctgcttatttttttaattttatttatttttttaactgtcaatatattaccacatcaccacttctgcttaaagtattctattattgctgtgtaacattttacaaagcatgagaattctgtttcatctattgatgaaatttgtattatttcagttatttccattgatgaacctgaactattggaacttttctgaacacagtgtattcttttatgctctatgtgtttgtgtttggaggtagtatgtatatacatattataaatagatgattacgtagttgatcctttctaaggtaaatgtattactatactgttattttataaaaagaggtaatgaagctaagaaaagtagtagtttatccaaagtaatacttagttcccgatttctagataagaacagcttataagagcaactacagaaagtagttctaaaaaacaaatgagttaagaatcactgccgtaaggataacagaggtcagggtcctgggcaacagctagcatgtgccttcaatgtagtaagcagtcagtaaatatttattaagaatgatacttggagctcttctgattaacccttgaacctaaaaattgactacagtaattctacagcattggtattttcaccgaagaattctttcttaggtaaaatattatacagtcatgtgttgcttgacaaaggagatacattctgagaaatatgtcaccaggtgatttcatcgtcacgtgaccatcatagagtgtacttacataagcctagatggcatagcctactactgcacctactacacacttcccttagtagaccttggtgccagaggaatgacacagtgatgatttcccttggttttctttttgccacatacccgagactgggtgctagagaaacaggcaacctagaaaggtcaacaggcacagaaaaagaaagtcttctagccagagaaccaggaaataggcaggtcagaacagtgttcgcaagccagaacactcttagaaagtaaccattctactgtagccaaacatcacagaaaaaattgtggctctgcttccacaatccccaggcagtaatgaagtagcaccctaccaccaccatttcccttgttggagtggagtgagaggaagccaactaaacagtggtttaaataagacccagagtctcataacatagtatctaaaatacccatgtttcaatagaaaatcattcatcatacctagaaccaggaagatcttaaattgaatgaaaaaaagataataggtgccaacagtgaaatgacagtggtgtttgaattatcttacaaagattttaatgcagcaatcattaaaatgcctcaacaaacaaggaacatgcttgaaacagaagagtcttagcaaacaaacaatctgagcaaaagaaatgcaagataaaaaaaagaaccaaataggaattttaaaataaaaaaaaatacaataattgaaattttaaaactctttcaaagctctttgtacactagaaaaaaaaacttagtgaatggactcaacagcagaatggagataaaggaaagaaatagtgaactggatgatagaacaatagtaactacttagtctaaactgcagagagaaaattgaggaaacaaatgaacactacctcagggacttataggactgtaacaaaagctgacgttatatgatgcatcataagtcctagaaggagaggaaaaaggaatggctctgaaaaatactcaaagaaataatggctgaaaacttcttaaatgtggcaaaaagtatataaacctacagattgaagacagccccaaagaggttaaacccagacaaatccacatgatgacgaacctctgtatggtcaaatttctgaacgtgaaagacagaaaaaaaaatcttgaaagcagcaaaaaatagcaccctacgtataggggaaaaacagttctaatgatagcagatttctcatcagaaaccatggaggacagagaaaatagcacagtgatttttgtttgtttgtttgtttttattatactttaagttctaggttacatgtgcacaacgagcaggtttgttacctaggtatatatgtgccatgttggtttgctgcacccaccaagtaatcatttacattgggtatttctcctaatgctatccctcccccagcccttcaacccccaacaggccccggtgtgtgatgttccctgccctgtgtccaagtgttctcattgttcagttcccacctatgagtgagaacatgcggtgtttggttttctgtccttgtgatagtttgctgagaattatggtttccagcttcatccatgtctctgcaaaggacatgaactcaacttttttatggctgcatagtattccatggtgtatatgtgccacattttcttaatccagtctaccattgatggacatttgggttggttccaagtctttgctattgtgaatactgccacaataaacatacgtagcacagtgttttgcaagagcagaaagaaaagaactatcagcccagaattctttacccagcaaagaaaaaaaagaattagcaatgaaggtgcaatcaagacattcttagagaaggaaaaaccaagaatttattagtagcagatttgcataaaagaatggctaaaggaagttttctaatagaagtgaaatgattgaagaaagaatcttagaacaccataaaggaagaaaaaaacataagaaacaaaaatatggataaatatgatagacttttttcttcaagtcttgcaaattatgtttgatgtttgaagtataaacaagtaaccactgtctgatgtgattatcagtgtattccacaatattataagccatggggaataaagggatttgattagcccacaggaaggcaggagaaggaaaatagaaaacaaagtaaaatgtcagatgtaagccctcatatatcaataactaaatgttggtggtcaaaatacacaaatcaaaagggattagcagagagaattttaaaaacaatgacttagctatatggtatttataagaaactcactccaaatacaacagtacagttaggttgaaaataaaatgataggaaaagttatacaaatattaatcaaaggaaaacaggagtagctatattaatatcacataaacttaagggcagaaaaaaattatcagagtgggacattatataatgataaaagaatcagccctccagaaagatgtgacagtgctaaacatgcgtgtaccagatatgtgaagcaaaaactgatagactgcgaggagaaatagagaaattcacaattacggttggagacttcagcatcccttaggtgctcacagaatatataccaagatagaccgtgtcctgggccataaaataaacctcaatagattttaaagtattgaaatcatacggaatgtattctccaaacaaaatggaattaaactagaaatcagtttaacagaaaataggaaaatctacaaatacttggaaactaaacagtacgcttctgtgtgtcagtgagcaagtcttgaattacaaaaaacacattgaactgaatgaaaatacaacataccaatttgtggaaaatagctaaaacagtgttacgagagggaaatgtatatcattaaatgcacacaatagaaaagaagaagtctcttccttatacgttatacaaaaattaactcaagatggattagagatttaaacataagacctaaaaccataaaaaccctggaagaaaacctagacaataccattcaggacataggcatgggcaaagacttcatgactaaaacaccaaaagcaatggtaacaaaagccaaaattgacaaatgggatctaattaaactgaagaacttctgcacaccaaaagaaactatcatcagagtgaacaggcaacctacagaatgggagaaaaattttgcaatctatccatctgacaaaagggctaatatccagaatctacaaagaacttaaacaaatttacaagaaaaaaacaaccccatcaaaaagtgggcgaaggatatgaacagacacttttcaaaagaagacatttatgcggccaacaaacatatgaaaactcattattactggtcattagagaaatgcaaatcaaaaccacaatgagataccatctcatgccagttagaatggcaatcattaaaaagtgaggaaacggccgggcgcggtggctcatgcctgtaatcccagcactttgggaggctgaggtgggcggatcacaaggtcaggagatgagaccatcctggctaacagggtgaaaccccatctgtattaaaaatataaaaaattagccaggcgtggtggcaggcgcctgtagtcccagctacttgggaggctgaggcaggagaatggcatgaacccaggaggcggagcttgcagtgagccaagatcacaccattgcactccagcctcggcgacagagtgagactctgtctcaaaaaaaataaaagtgaggaaacaacagatggtggagaggatgtagagaaataggaacacttttacattgttggcgggagggtaattcagttcaaccattgtggaagacagtgtggcaattcctcaaggatctagaaccagaattaccatttgaccctgcaatcccattactgagtatataccaaaagtattataaatcattctataaagatacatgcacaggtatgtttattgcagcactgttcacaatagcaaagacttggaaccaacccaaatgcccatcagtgatagactggataaagaaaatgtggcacatatacaccatggaatactatgcagccataaaaagggatgagttcatgtcctttgcaggggacttgggtgaagctggaaaccatcattctcagcaaactaacacagaaatagaaaaccaaacaccgcatgttctcactcataagtgggagttgaataatgagaacacatggacacagggcgggtaacatcacacaccagggcctgttggggggtgggggcctaggggaaggatagcattaggagaaatacctaatgtggatgatggattgatgggtgcagcaaaccaccatggcacgtatatacctatgtaacaaatctgcacatgtatcccagaacttaaagtataatttaaaaaaacaaaagaaaagaagtctcaaaataattttaactcctacttcaagaacccaaagcaaaataaaccataaaaaagaaaaacccaaaataaatagaaaggagggaatattaaagataagagcagagattaattaagttgaaaacaaaaatcagtgaaacaaagagctggattttttaaaaacttcagtaaaattggcagacctctagcaaaactgacagaaaaggtgcaagttaccaattatcagtaacaaaacagaagctatcactacagattctccagacataaaagaggtaattagggaatgctgtgaatagctttacccacataaatgtgacaacttagatgactaatagaccagtttatccaaaaacacaaattgctacacccagccagtatgaaaaagttaatttgagcctgggcaacatggtgaaaccctgtctctactgaaaatacaaaaagtagctgggcgtggtagcaggagcctgtaatcccggctactcgggaggctaaggcaggaaaatcgcttgaacccaggaggcagaggttgcagtgagccgagaggcaccattgcactccagcctgggcaacaagagtgaaactacgtctcacaaaaaagaaaaaaattgaatagccctataaactacaacggaaattgaattcatagttttaaaactccccaaaaacgaaacctctaggtccaaatggtttcactgcggaattctaccagacgtttaaaaaaggaatgaacaccaattctagaccatcttttgcagaaaatagatgtaacacttccctatttattttataaaactgattttactctgacactaaaaccaaagacaatacaaaaaaaggaaaagtacaaaccaatagcctttataaatatataagcaaaactcctcaacaaaataccagaaaatagaatttcaacaatatacgaaattgtgtatgtgtacgtttataaagtatatatacatcatggccacatggggtttattccagggatgcaaggcttgctctgtattcaaaaacaaatcagtgtactccaccatttaatagggtaaagaagagaaaccacgtgattatagcagttgatgcagaaaaaccatttgacagaattcaacacccatacatatttaaaaactctcagaaaaataggaattgaggaggacttcctcaacttgttaaagagcacgtgaacacacaccaaaaaaaaacccacaactaatgttatacttaagggcaaaaggtcgaaggccttgttccttagattaggaacaaagcagtaatgtctcttctcaacattaatcaacatattgatggaagttctagccagtgcagtaaagcaaaaaaaaaaaaaaaaaaaaaaaaaaaaagaaaaggcatacaactaagaaaggaagaaataaaaagtgttctatttgtggatgatgtaattgtctcagtaggaaatctcaagggatttgcaacaaaaaaaagtgagttcagcaaggttgcaggatacaaggtagacataaaaatcaatcgtatttctatgttttagccatgaaaacatgaacaccaaaactcaaaatatatcatttttaagcacacaaaaaataaaatgaaatacttaggggtgaatctaaaaacagcatgtgcaggccatgtattctgaaaactacaaaactacttacagtggtgaaagaagtaaaagaaaatctaaataaatagagaggcatactatgcctactgtttggaatattcaaccttgtaaaatgtcacttattcacaaattgatataaatgtttaacacaattcatatcaaacttccagtacaatgttttgtagatatagacaatattattataaaatatatatggaaaggcagaagaactaaagtagctgacacagcttagcaaaggagaatacaatgggatgaatccacccattgatttcaagttttgcttagccagtcatcaggactgcgtgatactggtaaagggatagacacatagatcaatggaacagaataagtaacctggaaacacgcgtacaaatatgcacaactaatttttaacaaaggtgcaaaagtagttaaatggaagaagatagccttttcaacaaatggaactctagcagttagaaatccaaaataaatgaacttcctcctaagtctcacaccttaaaaaaactaacacaaaatcctggagttaaatgtaaaatatgaacatatttatcttttaggggaaaaaaaaagaaaaagaaaaatttcagtatctgagccttagcgtatgtgtcaccaaaaggatgattcataaaaggaaaaagtgataaattagctttcaaaaactttagccttgtgaaagactgtttaagtagatgaaaagacacatcttcagagtgggagaaaatatttacataccaggtatccaacaaaagactagtggctagaaataaaaattctcaaaagtgttgagtaattttactcggtagtaaaaaaaaaaaaaacaatgcaattacaaaatgggcaagagagatatgagcagatatttcattgaagaggatctacaaatggcaaataagcactaaaaaagatctttgacatcagtagccattagggaagtagaaattaaaacttcagtaagccaggcctggttggtgtaagctgctactggggaggctgaggcagcaggaggatcacttgtgcccaggaatttgagactggactgggcaacacagaccctgtctcaaaaaagaaagaaaaacacccaatgagctgtcactacatacctgtcagaatgtcagaaaggctaagatgaaaaatactgagaacaccaaatgctgaagagaatgtggagaaaccagatcactcttacgttgcatgtgggaatgtaaaataacacagccactctggaaaaatggcagtttctttaaacactaaacatgcagctaccatacatcctagctgttgcacccctggacatttatcccagataaatgaagagttaggttgactcaaaaacctatacacagatgttcatagtagttttattcagaatggccaaaaactggaaacaggctagagacattgggttgaaggacactttagtggctgcatggttacagtgtggtccatctataccatggaatactactcaacaataagaagggggaaactacagatactatacagcaatctggataaatctggagagaactatgcttagtgaatcaagccattctcaaaaggttgatcctgtattatcccatctgtgtaactttcttgaaatgataaaaatttttgtaacaatgtactaataatgtagttttgtatgaagtcactactggggggaaactacataaatgttacacgggattcttctgtattatttcttacacctgcatgtgaatctgtaattatcttaaaacaaaaagtttaatcaaaaaataactgtgtacatccaacttaaactgattgagtcctttaacaccatgatgacagttttaaaaatgagaattcatcaggaagaagcctcctaaccacaataaaatactaatgttagaatatggaatatggctatagaagcttgttggtattttatgaattcttgaagaatacagattttcaaattactagatttttgctctgtatgttgcgtttctgcacagggcaaacttttatacaaatagttccctccatatatgtttagcatatgcctagcaaataataattaatgttgagatttttattatgcatagactttattttctttctttttttttttgagatggagtgtcgctctcacccagttgggaatgcattggcacaatctcaactcgctgcaaccttcacctcccaggttcaggcacttctcccacctcagcctcctgagtagatgggactacaggcatgtgccaccacgcctggctaatttttgtacttctagtagaaacaaggtttcactatgttgcccaggctagtctcaaactcctaagctcaaatgatccgcctgctgtggcctcccaaagtgctgggattataggcatgagctgccatgcccagcatattatgcatagactctcttaattacatttctcagaagcagctaaagatgaaattgtactaatatggaataagaaagtcctggttagaagaaaaaccgcattcattcacaatgtccacatgacagatttttaagtaaaaggcatttttaggacaatacacttttattcattagcttatttttctacatcatgtatatcaaagcattttggtaggctcacaatgaagttgatagagctggtgttaagcctcattttattttgtttttttgagacagggtctcactctgtcacccaggctggggtactgtggtttgaactgtagcctcaacctcttgggctcaagtgatcctcctgcttaagcctcccaagtagctggaatgacaggtgtgtgccaccatgcccagctaatttttttttttttgtagaggcaaagtcttgccatgttgcccaggctggtctcagactcctgggttcaagatatcctcccaccttagcctcccaacgtgctgggattacaggctcaagccactgtgcctgggcagcctgctcttaaaaattaacttaatcggtactatcacttaaaaaagtaaacccttatagacatcatctagttttagaagttaccaccgtgtagacattttgagtcttatatcccatttgttgagcaaatgccagaaatatttttacctataaatatttcgatataagtaattttaaaaaatataacacaataccattatcatatataacttaacagcaattccttaatatctaatataaagtcttaatgtcatcccttttatttcattcaacaagtaatattggaaaacaagtatttagtttatttgggatcaaggaagactaacaaaagggtttcttcctccttagagaagtaggaaggaggagaactaaaccagcacttatttggtatctgccttttgataggcattcaccatcagttcctatggcaggagagccaagaccaaactatgctgctgacaaattacaatatactgtctcagagatttaagcaagaattatcctgcagaattagatccaaggaggtaaatgttaggcatgcatggcccattgattcttgatcaggttgacccttggacttagaaagaaacagcaattacagtaattatggggaagtttgttctaagtgctatgccttatgtttttgcttttcaagggctcagatttgcctaactatgccatccttttgttccttaggagaataagcagagctctatgggagaggcggtttagcacagtgggtagaaactgaccgtgggctcagacaggatctatcctcagcttgctctctggaggactctcttctatgagagctgatcatgtgatgggttaagaataaggcaggtattctaatgacacatcccacttgtctagtgacagtggtggttggtgttgggacatttcagagaaggtcatcatcctgttttttataatctgttgagaattattcacaacccagctgatccttggcacctatgtgtagagaaattttaatgcacagggaaccctcttaaaagattttttagactattattatttgttaagattaaatataaatggcacattgatgatgtttagaattggacctgtttccttttgatgttgtgctgtagtctatttatacatgttcaccaagacccagttactgtaatacaagtggacaccatgaagtttaactgttacagttccctgtaagggattggataatttacagcataagataacaacagctttgttccagcactagctgtgttgttgctggaaataagtttactattagtctatagatttcctattaatcagctttatgatttcatccaagaaggatctgttgagggggaaaagaggcaacgtggtaaatgaatgcaaaggatatctcctcataacacagaattatctcgtccaaaatgtcagcagtattgagattgagaaacactgaattagaataataaaacacagttcaactcaaggaaatgaagcacccactcagcataatatatgaatcccctttattcacttagtaataggagggatggtgctatgatattattattaaaaatgagtgcaaatgtcatagcttatgcctgtaatcctggtattttgggaggctgaagcaggaagattacttgacgccaggagttcaagaccagcctagccaacatagcaagaccctgtctctatttaaaaagacagaaagagagggagagggaggagaagaaagaaaagaaaagaagaaagaaaatagatgcttgattgatagacagacagatagggtttggatctgtgtccctgcccaaatctcatattgaattctaatccccattgttggaggtggggcctggtgggaggtgattagatcacgggagcagtttcttatgagtggtttaacaccataccgcttggtgcagttcttgtgatagttctaatgagatctgattgtttaaaagcatgtagtacctcccacctctttctctttctcctgctgtggtcacgtgaagtgcctcgctccccctttgccttgtgccatgattgtaagtttcctgaggcctccccagaagctgagcagataccactatcatgcttcctgtacagcctgcagaaccatgatacaattaaacttcttttctttataaattacccagtctcaggtatttctttataacagcgggagaaaggactgatacagaaaattggtactgaggagtggggctttgttataaagatacctcaaaatgtggaaacaactttggaactgggtaatgagcagaggttggaagagtgtggagggctcagaagatgaggaaaaatttggaacttcttagagactgcttgaattgtgaccaaaatgctgataatgatgtggacaatgaaacccaggctgaggaggtctcagatggagattagaaaattattggggactggagcaaaggtcacttttgttatgctttagcaaggaagctggctgcgttgtgcccctgccctagggacctgtggaacttggaacttgaatggtgatgatttaagatatctggcggaaaaattatctaagcgacaaagcattgaagatgtggcctggttgcctctaatagcctatctcatatgtgtgagcagagaagtgacctgaaactggaacttagacttaaatgggaagcagagcataaaggtgaaaaatttgtagcctggccatgtggtagaaaagaaaagtccatttcaggagaggaattcagacaggctgcagaaatttgcataagtaaaaaggaaccaaatgctaatagccatgacaatggggagaaggcctggaaggcatttcagagacttcacaggagcccctccctcacaggctcagaggcctaggaaggaagaatggttttgtaggtcagggccagggtcagggccccaccaccctgcacagcctcaggacactactccctgcatcccagccactttagttccagctgtagctcaaaggggcccaggaagagctcgggacactgtttcagagggtgctagccacaagccttggtagcttccatgtggtggtaagcctgtgggtgcacagagtccaagagttgaggcttggaaacctctgcctagatttcagagaatgtatggaaaactttggatgttcaggcagaagcctactgcaggggtggagccctcacagagcacctcttctagggcagtgcagagggaaaatgtaggcttggtgctccacatagagtccccactggggcaccacctagtgcagctgtgagaagatgaccacgtcctccagaccccagaatggtagatacaccaacagtttgcacccatcacttggaaaagccacaggcactcagtgccagccagtgagagcagtggtggggtctgaaccctgcaaagccacagtggtggagctgcccaaggccttgggagcacacccatcacacccctgtgccctggacgtgggacatggagtcaaaagattattttggagctttaagatttgatgactgccctgctgggttttgaacttgtatggcacctatagcccctttcttttggccaatttttcgtttttggaatgggagtatttacccaatgcctgtgtccccattgtatcttgaaagtagctaactatttattttacaggctcataggcaaaagggactaatacatatatacatatatatatataatgcttcatttcaagctgggggtggtggctcacgcctataatcccagcactttgggaggccaagacgggcagatcacctgaggtcaggagttcgagaccagcttgaccaatatggtgaaacctcatctgtactaaaaatacaaaaattagccgggcgtggtggcttgcgcctgtagtcccagctactcaggaggctgagacaggagaattacttgaatcagggaggcggaagttgcagtgagctcaaattgcaccactgcactccagcctgggtgacagagtgagactccgtcttagaaaacaaacaaacaaacaaaaatgcttcatttcagtgacaccctgagctgggagggagtaaagactcataggcaaaagggactaatacatgtatataaaatgcttcatttcagtgataccctgagcaaggagggagtaaagactaggaagtactgttaggaagtgacaccacttttatttttggagctgtctctgacctgtgaatcctacagtgaatactcttaaatattttagtatctgtccagatgatattggtacccagatcctttaactatacctctgatattccaactgttttgctcttacctgaatttatgctgcctatcttgaactaggatcttaaatttaaaatggcacccaagacaacactttgaagtttatttccaaagagcataagaataaaatgccctagtcttcctaaactaggtgttacttagcgggaagaatttctcaagacaggatcatagagagagagagtactatcatatactacattaataacactaatatacaaccacatagatatttattgtatacacaagtaatacttggaaaatctggattaagtaaaagtcgacaaatttttctaacagttgcccaagctatacctgggcctttttgagctgcagctagagctggagtggctgagatacacaagcagtgtcctgaggcaacacaggtggtggggccgtggcctgacctacaaaactgttcttccctcttagggcctccaggcctgtgatgggttgggctcctggaaagtctctgaaatgcctaaaattggaattggcgggggatgcgtaacatctcttaacataccatggactgatgtctgtgttattttgcttactctcttatttcatggtcactattatatgttgtggtgggtgcatggagactgctttttcttttttaagctaaactaagaatgcctcataagacttttctttttttcgggtcaattgtcttttttttttttttttttaagatttttttgggccgggcacagtggctcacacctgtaatcccagcactttgggaggccgaggcgggcagatcacaaggtcaggagatcgagaccatcctggctaacatggtgaaaccctgtctctactaaaaatacaaaaaattagccgggcgtggtggcaggcacctgtagtgccagttactcaggaggctgaggcaggagaatggcatgaacccgggaggtggagcttgcagtgagccgagatcgcgccactgcactccagcctgggcgacagagcgagactccatctcaaaaaaaaaaaaaaaaaaaaaggtttttgtagagacagtgtctctcttatgttgccgaggcttgtctcaaactcttcggctcaagcagttctcccacctcggcctcccgaagtgctgggattatgtcatgagccaccatgcccagcctacctaagtcagttgtctttttgaccagagcttcccaaatactaatgtacacttaagaattctgttaaaatgcagattctgattcagtagatctgtggtgtggcctgggagcttgcatttgtaaccagtcctcaactaatgtagatactgctgatccaggggtcacactctgaagagatagagaggctgtagaggagtccagtctgttctatcacaggacaatcaggcagagtgctgtctcctcccatttcctcagagatgttattgcttcaaaccatctcattatattcaccctttccttctctattgattcttggctcccagcatgtaattaagtttcaaccatcttataaaatcctttcactccatttctcctggatgtttttccttctggcttctattaagagctgtctccatttccttgttctttttctcacctgtcttcatagtctgacttcttccaccacggccaaggtcatcctggtcttcctaaaagccacaactaacaaatacttttctgggtttttgtttgtttgtttgttttggtatttatttttacttttagaaaaagtttattataaaaaagtaattgcatgaaagaaagcttgcaaaatagagaataagtaaaagaataataaaaacatatcatgcataatatgtaaaggctagaagaaaatacaccaaaatgttaacagtaatgatgactgtataggcgcccaaaaagcaagaattatacctttttttttctgcttttctgttcttagcttaaacagtcctttgggaatatttgatacttttgactactcttcagtaaacttctttcttagctccatgacaccgttttctttctttttctctttctctctctctctctgtgtctccccgcccccggtcctgctccctctccctcttcctctccttcttcctctccttcttcctctccttcttcctctccttctcctccttctctctctcctctctctccttctccttctccttctcctcctctccctccctccctccctcttcctttacccccaccccacctcactggccttccccagattttttttaccagttctttgttccactttgagatatcacctaagtctgttacttcaggtaccattttaggctgtatgttcagctccaccctgacagctgctgcctagacagttgtgctgagtgatcttcacacccttccgatttaacacatccagctgaactgatagcccttctctattctagtctacagatcctctattctatagtgttctttctcttaccccttgacattgatttattcagttaatacgtatcacttttcacctgttattgtttctgcctattaaatatctctccaaattgtcttctgtcataattgtatcctaattggacttcctgtcttcatttttcagtcccttacactgtgacctctgggatctttctaaaaatgaaggttgaatgtctctctccagttttattaaccatgcagtggttccccacagcttcagcatcaaactccttagcttggcatgcaggatgctttgattgccaacccctcacaccatatgctctccatagtaaactaggagtcgatcagctttacagtgttctctccccttctccacaaaaaagtattctctgcacttgaaatgcccttccttccgacttgatcctccaagggtatggttaagtctgatccctcctctggaatgtgttccatgacaccagcatgtcttccttctgccaccagccaccacacacaacatctgaattgatagacttcttcttctccttattcctgtgttgtcctgggcatgaattcaccttagtatgatatcattgcacttgtttgtcatgtcggcccaccaaaaggattgagttctttaaagacacagactcttttcatttctgcaacccccacatggtagataacaaaagtttggatgagtaagtatgtatttgcttcaaccatgttcttcttccttcagtctttcattctggttatgctttggtcccatttgttacatgtaggtagaattctgtcctaaaccttatctttgcccaagcattttaaaacatgagattttagaaaatccaggtgaggctgggtatggtagctcacacctatactcccaacacttagggaggccaaggtgggcagatcacttgaggccaggagtttgagaccagcctggcccgcatggcaaaacctcatctctacaaaaaaataaaaaattagccaggcatggtgggacacgcctgctgtactcccagctatgaggtaggaggatcacttgagctcaggagggcaaggcttcagtgagctgagatcatgccactgcactccagccggggcaacaaagggagaccctgtgtctcaaaaaaaaaaaaaaaaaaaaaaaatccagacaagcaaattggcctctcatcaggtgcttcttccttcagtagctgcctggaatctttgtggtttgaaaaggcctttttaggtggagagatgttcatgtcataatggcaggctaggtaaacccccacccttcccagaagccttatgcttatgctgctgaagtatttatgctactgaagtactagataccaccaagactatagctgaaaatacaaccagctaaccctaagacagattgcagtaacccaccaagccacctaaactgacaggatagatgaatttctatgtccagagagaacacatgacttactaagacattagtaactaggaagactaccagtttcaagtccccttgctaatacctgcattctgtctcagtacttgaaagtctgtagactttatttgcattgagggaccatcttgtcttgggctttgttgtaactggtggaatgagtatttttatgtagctgtaatgaggttgtaaactgaaggctttgtttcccccttaaatctattctgagtgttaagcccatggatgcataccacaagacttcagtggaaatctgacctggccttcctcagcagttttccagtatcccttgaggatagcttagtttaataaatatttaccactctcctccacattttggtagacttggctgactagcatcagcttcttcacctctaatttggccatcatccccggaacttcatagatgatccaaactctgactttgaaagttgcatccattttctgtacttctaaaccagggtggctaaacattacccaagaaaattatgctaataaatgcatgtcatatacttacacactcacatttatctgtagcttatattcccatataagtgcacaattatatagatcgccatctaccaagagtttcccacttgtacgatgtattagaattccacgtgtctaaaagaaatttttcattccttccttgaaaactgattttcttcctttttaatttatctcaattcatggtatacccttttatctcatcacttaaaccaaaagcggagtcatccataaacatatcaccattttactctgtcacttaaagtcctgttaatttcttcacaacagatattaggtttgagctttgccattcattctcgttgccaccatctgacctttctttcttgggtcattgctctggactcctcagtctccctgtggccagtatcgcccccttgtgattcattctctaaactctcctctgattttgtccctcccctgcttcctaccttttcagggttcctctgcctatagggccacatctctaactttatctcacgttcctggccgtcctcagcttccaacagaattgaacttaaaatctgctcctctgtccagaatgcccttcttcccctcagttttcctaatatatgagtgggagcttacctgtctttcaggccttcacttgcagggcttttctctctcagaagtggtcatgctaccttattcatctaagcaactgaaggtttttcttctatgttcgcatattggatgcatatctatcctatataccacatccttgagatgtaaggtattcatatttatctgagtgtcctcagtgcctggtacaaatcaagcactcaggaaatgcttattaaatggaagaactaaattgctaaggaattaaacatttttgtgttacctctgacagaaagtaggaacaggaaattctttttttaattgaaaacattttaatatttacttttgaatataaataagcattctaagaataacttggagtaaaatttttctttatgagctaagtttaaatccacttgaattacaaaacgtcagtcattggttcagtatactcagtactgaagagtaaaatgctgcaatatttatgatttttaaaactattaagtttacatagaaaaccaattattaatctgcattgcgcagctgttgctatgttatgctgcagcaacaaaccctaaaataaacaactatttttttttaagttctgggatacatgtgctgaacatacaggtttgttccataggtatacatgtgccatagtggtttgctgcacctatcaacctgtcatctaggttttaagccccacatgcattaggtatttgtcctaatgctctccctccccttttccccaacctccctacaggtcccagtgtgtgatgttcccctccctgtgtccatgtgttcttattgttcaactcccacttatgagtgagaatatgcagtgtttggttttctaggaacaggaaattcttaaatgccatattccccaaacctttctaatcaaatagttctagtttcttcccctcttcagtttcctgctaaaattaagatgtgtttaggctccctactttcctttaattagcattgatactggtgatactaatttttgtaaagggtaggaaagagacaaaagatgtaaataatacaaattttatatacttccaaaaataatcctagaaatccaatataatttctagctaaaagggttttaaaggatgtaggaagtatatgctttttatgttcatttttaactgcaacataaaacaaatgaaaattcctttgacttgtattaaagatagctgatcctaataaaggaaagatatatgtagtgagaagactattagattctaatcctgcgtctgctgtaattatgtgtggtcttgggcaagtcgtttctccttttgcagctcagtcatatctacaaaatgagaaaattatagattgtagatttagcaatggcccttttccttctagtgaaacacagagaaactgtatgagagaagtaacaccacaacagctctactttggaactggtgatgctatagaaagaggcggggaagaggcagaggttctccctccacagggctgtccctactccatctcattccaaaaggtggcccctgcagaattgccttgaaatacagtttaaaagccactattggatgatatacgagtttttcttcactgacccgaaatcagatagaatcacagaatttgaagaagtttcttaaactccctaatatgaaattctagtctgctgtgcttttcacaggactctcctatctttgcccaatatctaagtcttattaaatatattttattttggggggctcattgtgcacattatatgttgccaattcacttttttaaggtttagctctatttaatcaagatatatgaattgactatagagcattgatcaccatttctctccttgactttggagtgtctgcagggcacatacacatttagcaccagtactcccttctcctgttgttccccatgtgtctttgcatccagacgttcatgccaacagctgacacacctattgggtgcttactacatgtcaagcacggttttcagtgctttacattaaccttcctagcaatcctatgaagtgggctacatttatctttcctttattaggatcatttatctttaatacaagtcaaaggaattttcatttgttttgtatgttgcagttataattgaacattaaaaaagcacatatttcccacgttatcatcctcattttacagagaggctaagcactggttccagagcaacacagctggtaagaagtggtactggggtttgatcctggagagcctggttctagagccctcagtaattctgttcattttaaaggtctaacttcatcccacaaatacagattttcttgaaagcaaaataaagttaacattaattttcttatttgtttacatacttagaatttcttttaagaaatagtgaaaacctttgtaaatcagtatagtgactgtcccatagtaaatacttagtatatattgattattattaacttaggcaaatggataactgtaatgttcatagcattgacttttagcagttgagaagaaaagccacattttagctacctcatatttctcagttctaagagaaaactaaaagtcgcttgtttacaagataccctgctctgtagcatctgttcaagatatttaaactgtccaaaatactggtcttacctaatttttatcatgccaccaggtggcagcatgttatgtaaggaagtaatttaaatattctattgaagatcatttattttcaatattttgccttaaaaactgcccaaccataataaaaaataaaatagtatctcatgtttccctttgcctgcattctctccagtctattttaaagaccctgttagcacaatatccgtgagacctgccttaatccagccctgcattcttctatcggttagtgcagaaagtttttttcttccatctttatggagatttgagccattgggcttagattctgccaactaaatgattttattcctacctaaatagttcctattgttcagcaacaatagtcctcctcatctttgtgtcttccatggtacctacagaagttctgaatatgtggcaacgatttttttcttaatagagacaggggtcttactacattgcccaggctggtctcaaactcctgacctcaagcagtcttcctgcctacgcctctttcagagtgctgggattacaggtgcgagcctggccagtgacaatagttttaacaggtgcccttgggtaaatgtcagtgatatgtaagatccacattagcgtgtgtatttactgaatgtttatttgaattagaacatatttatagtcttttgtggttacggttgtttcaactgtgcaatcgaagtccctgaaattttgccttaagtttaggtattatcagtatcattcagattaactgctgccaaacactgaaagattagtgtttgaggtggaaagcaagagaatgaatggctaaggaagaaaaggaaggtaaaggactgaatgtggcagttaaagtctgggggaaaggaaaggctagtggtaaaatgagagaggcaggcttcttttactgcaacagagcaccggccacatggggaagcaggaggaccaccaaattcagttggctgcagagaaatctgtttatacttcataatcgtggatctgcctagacattgcttgtttcatggtgcaaacagtgaaatcattgaaacaaatgaaatcatttgacatcagtttgttaacaaatattttttcctattctaaaacctattagttttgcctactgcttgtcccttaatgaagtcttaaaagagcttgcccctaaagagatgtacataagcaaaaagaaaccagcaatttcatgtaagcccaccttaccctgtaggtatttccttgctaagggtaattgagtttaacaaaggcggtttaagtacctatgctattttaggtattgtgctagagattcaaaactacaatatgtttaacatctatagataaggtatttttaagagaatagcttaaccattcaaattaaactaattctgtgaagaacattagtactgccttgagatatttaccaaccaatacttaaaatgtatttttgtacattatatatatatggaatgcagtggtctaaagatggattagaaacatctataccttaaaaagtttatatatgggattgatatttaatgaatagagtgaaatgatcaattttttaaaatcccagccaatgtgttatatacatacatatttctcatctttttggaaatgttttgcatcttaagtggaggagattttatctgtgacacccaaggctcttaccttagaacttttatttgacctctcataagccttactagtatttggttaatgttcattatatttaggaactcagcaatttcaaagtccatggccacatattttattgtttgtgtgtgtgtgcaaagcctagtgttattgcaaatagccacatacttttaaaacaagtatattaatgtctacatttgtcatgctgggtttcaaacgcaaaggactcattaaaattagtcattaatcacttagtaatatatattaaatattaatgtttgtcatgaagtatgtaaaacaacccgtttgtattgtatcctctataatatgctcagggggtagaaaatacttgattttattgtctgtaatgtgtaatcagagattgaacgaccaagtaatgtagcattatccaaagattatttgttatatttcagttgtaatggagttaattgcatgcctttcagataaaaaaatactgtatgtacatccttaattcatctggtacaactatgtttaaaagtgcttaataaagtattcagtactatttaggtaataaaattagtagtgacttacttaattttatgtagcatcactttcttaagcctgtttttaaagtgatttattaccagacgggcaaaaaggcaatttttatgcaaattgacacatttaataataacttttgtagtataaaagtgcttgtttgtatgaagttataactcacttatggggccttgtagttctatgtaacattctagtgaaatgtgcacatgtggatgctcttggaagcacttccagccctgtgaatttatgtatctgttgacttcaatattaggtagcttgatttctaaagccatcacagtaattgacatgttattggaaataaagttaagtttttccttatttatagggataacctcaattttgaagaatgtgaatcaattcatacttggctgaaagccagttccctcttcagtttagctctagcacatacatgaaaagcgcactcgcgtcctaagtgccttgtgaatctgcagtgattaattcttctcattattttgctgcaaattctcatgaccctctgtgatgattcgatcagccacttagagtttatgcatattcatatctctgtgctcctgccgcagacgttcagatctccttcactgactggtgtgtgcttggtgcagtaattgagctgcagtagattgattactctggggagctgtaaggcctttaaaggtgaaaacatatcagtcctgttaattaggaaacaaaagctctgatggcaagttcagcagtcaaatgtttccagtgtagaaaagataaaaggtatgatttgttcctctccatgaatgctgtttactttttaaactttaaattaggtctgtatcagtggtaatggagtatagctttcttttatgaatttttatagaatgctaattgaagaggactttattgattggtactgttatctgtgatctgtcaaatctgatagtttagaacctattcagagtttgtatatgccttctatagcattcgtaatatttatatataatttctaaatattttacatagagaatgcttgtgtataaattttggtatttataggcttcatttggtctacagtatttcaacagtagttttttattttgacaatttaatggcaaagaagttgagccgtcttttctctctttatcgtaagcgtcctttgattttgctttcttaaactatatactaaataatacattatcatggcaaaaaaggccctgagtggaactgtattatccagaagtaagctagtttttacatggaggattatgcagtttacataattgaaatgtgtttttctctgtgtgctgttctcatattccaatattcttttttcctctcatggtcatgatgttttcttttgagatataattcacataccataaaattgatgcttttaaactatacaattcgttagctgggtgtggcagcacacacctgtagtcccagctactcaggaggctgaagtgagaggatcacttgaactgggaggcagaggttgcagtgaaccgagattgcgccgctgcactccatcctaggcgacagggtgagcccctgtctcaaaaataaataaataaacaattcagtggtttttagtctattcacaaagttacacaaccatcaccactatctaattccagaacattttagttaccccaaaaagaaacctcatactcattagcattctctcccctttttctcttccatctagcttctggcaaccagtaatctactttctgtctccatggatttgcctattctagacatttcgtacaaatggagttgtagtattgtggcgttttgtgtctgccttctttcatttagcacagtgttttcaaggttcatccacattgtagcatgaatcagtacttcattcctttttatggccaaataatattctactaattgaatatctcaaattttgttttttattgactgaacatttctgtagtttgcacttgttggctgttgtgaataatgctgtttgtaatgctaattagcatgtgcgtacatcctttgttcttaatcttaggggaaaggctttcagccttcatcttcgaatatgatgttagatgtagtttttcttagatgccattctttagatcaggttgaggagttcccttctatttcgacttgagtgtttttatcatgaaatgttggattttgtcaaatgctttttctatgtctattgatgatcatgagggcttgtttattaatataatgtattacatcgattgttctttattaatatgttattaatatctttgttctttattaatatgtattacgtcgattgactttcatatgttgaatgttatgatattctatagagcatatataatgttattttactgctttggttttatataatatgaaccaatttctctatatttcaggcatttattaatacagcaaaagaaatttatgaaaaaattcaagaaggagtctttgacattaataatgaggtatatacatataaatattgttggtcaatattaatttagagttcacttttgattactattttatattttttattttataattcattattttataatttttttaattcctaaaatcaatcatgataatcagttaacaccattagtttacagtcatccaactgaaaaattggtatatgtggtatagtagttaaatatttatgttctagtagagcaacactttgtctatggaaatggattaaagtaagtggccctatccattcattgcaagcaatgcaaaataatataaatcccccaaagagaaaagaaaatccacttttatccacatgaccatatggtgtcatctgctttgggaataatgttctggtatataaatgcatgtactatgtactaatgcaagatgctctctctgttatctggcaggaaagagggaaataccaaatttggaaattactcccaatatagcatagcatgttttcaggagactaaattcatatatatatatataaaattggcatttggcatagggttttttgtaatgttattttgatcctgttttggtcaacatgattaggataaaatgtaaagctttgaagcatctaattcagagtgttcaccaaagatcatcacttgacccacatccccactctgcatttatctgtatttatttcaaaatgtttatgtggatgtagcctacttattcttacataaatatttttgccattctgtattaagatttctggcttctgaaagaaaagccctggtttctccccagttgcagttagaaaagcattgtgttaggaagccattatgtatgtctctctcatcctatacataaatgaggctctctattacttcagtagtctctgctcagacaaacagcagtttacctaaggtttccaaaaagtacatgattttttcattgtttaatttggagtaatatagtttctaaatcctatcttctaggcttatatgacggtacttcttgagttagtttaaaggtgacaccattcagagactaatgccatataaattgaacagtaattgggcctctatctaaaagggcacattcattgtttctgtctggtttcatatagtagctgactgctttactgtgccttatgcagctttgattgtaatgtgctgttgggagccaacaggccgtgctatttatttggcctaatgccaagtctgactccttgactcctcaagaagttgctaccagcccagagggggcaaaatcaatgagccatagggcatgctttttattaaagaggagtcaaaagagcgaaaagaaaccacatcagctgctgtcaatactgagctagtgccagaaaccccaaggctactactgttgcagaacaactgccaagcactataaatctgagatttactgtgacgtaaagtttccttaagagcttaatttctgaagctactgtattacttttctcaaagtgttgtatttttaggtaaaatccacttgagggagtgagggttaagacataagtgtgagtttgatgaatgaaagaactactctgtgtgtgggttcttggcaagctgccatgtctttggggatcatagaaattattgatgacacagaacactcatatgcccttagcctgtacagctgattcaacatggaacagaaacactgtctagagaaaagattttacgttgtattaaagcagcatgggctttgggtatttttatgctttaaagattacttgcaataattattttaaatgatttctgcattatgagaatttcctgaaaagcagcattatccaataactgtttaccccgtacctggtatgataaagaattattttcagaaacatttccacagtgtttttaaaaggaaggaacatcccttaggagatattgttttaattgttgctaaaatctacttgctgtatttttctcagttgtttgataaaattgtatcataaagaattaaatgagttttttaagaattagttaaactatattgtctggtcatatttattgttctgttctcttttatttcaggcaaatggcattaaaattggccctcagcatgctgctaccaatgcaacacatgcaggcaatcagggaggacagcaggctgggggcggctgctgttgagtctgtttttactgtctagctgcccaacggggcctactcacttattctttcaccccctctcctcctgctcagctgagacatgaaactatttgaaatggctttatgtcacagaagactttaatccgtcaaattcttgtataactttgaataaatggttaatgttcacttaaaagacagattttggagattgtattcatatctatttgcatttgatttctaggtcaattgatgtgattatttttgttaaatgttgtcttgtgcccttaactacgaactgaattgtattaaacactacaaagtc

SEQ ID NO: 37044 - DNA, 10627 bp, Homo sapiens
gcaagcgcagattgtgggcggctgtgtcagctgacccaaggggccttcgaggtgccttaggccgcttgccttgctctcagaatcgctgccgccatggctagtcagtctcaggggattcagcagctgctgcaggccgagaagcgggcagccgagaaggtgtccgaggcccgcaaaagtgagtttcagggtggggctgcccggcgtggcgcgagtcgaagaaagaccgctgggcctcaggtggtgggtagattaggcccgaaaaactgcggggtgcgggcgtgcgtatagtcgcggaaggttgtgtgtttcgaagctttgaggagctgaggctctggaaggcttgcggatcgcctggaagccacgatgtgagatggtaaattgggcgtggaaacaataatgggttaccgtccttggggcctggaggcatgtgaaatgggctctccaaacggagctctttgttcttcttctctcccacttaaccgctctggggtggtcagtctcggtgaagggagccagcatccacacagttgcttggtctagaaacctggagtcctgcttgcctcttctccctccctcatttagtcagtcgccaaggcttgcgtatctttcactttttcccccatgtctactaccagcgtcttagtccaggacaccagtttctctaaaggtactgtagttgtctaaatcgttggcgtgtgtgcgtgtgtgtgtttctgatatgtggcaagcgcagtgtgtgtgtgtttctaacatgtggcaagcgcagtgtgtgtgtgtgtgtgtgtgtgtgtgtgtttctgtctaatatgtggcaagcgcagtgcccagtgcatcagttgtctcccctaacgtggcattcagtgtcgcagtgaaggaagcaggtattgggtcagttaattaattgcaggagagatgagggctggagtggagaaatgtaaggttgctaaagaatttaacaggtgagtttaatctagactggggagtggaagaacccgttctggtcccctccagtcaatccattctcctctctgcaatcagtcatccttctaaaatgcaaatatgtgacttcctgctggtaaggaacaaaataaataaataagtgcagatatgatttccctaccgcctttgtagtcagacgtttagttcctgcagaagaaagctcaaattccttaatgaagttggggaggctcttgtgggtcaggcctggtgctttcctccagctatactgaatcgttgtggtccctcagaagcagcatgatgtctttcacctgcaggtttttgcacacgctgtttcttctgacgtgagaagccttttccaattctcctcccctttgttctctgacccttagtcttccatcagacctcaatttaggaaacacttcttcccgggaagcctttcctgactcatgcttgtcccccggactaggcttggagtccctcccaagtgctgatttctgccactgccgtgcaataacctgtttgtttatatggctcagtcactagactaagcttctggagaacagaaactatgtctcatttaactttatgtatccagtttcccgtctggtgagaaagatgcttctatccctattttacagatagtaaaaatgaggctcagagagaaatgatttatccataccctgggaagcaacatagttgggactcagaagcctctttttccatgcaaggcgaagatactgatcttagtaattccttggtgtttctcctagtataggagttattctatctgacatccaactagatttcaagcatgtctcctctacttgtgcagttaggggttgtgtggtacttggaaagctttctttgagggtgttgggaatgagaagaagccttttgttcttgctccggtgactggaaagttctttgttcttcccagaatatttccagtcatgcccttgatagtgtatttccagaatgacttctcacagtttgtgttctgatggctcatcagtaacagaagttgtatctgtcgggagggataggagaatagattggggaagtgcaggaaaaaatgcttggaataggtaagaataattctgagtgccctagccaggtaggatttatgttttatacctttatcctgtcaagcctggtgcagggttttgtatatgtcaggtagctgtgaattggttttaaaaagtattaatttggctgggcgtggtggctcacgcctgtaatcccagcactttgggaggctgaggtgggtggatcacctgagatcaagagtttgagaccagcctgggcaatatggagaaactccgtgtctactaaaaatacaaaagttagctgggcgtggtggtgtgcgcgtgtagtcccagctacttgggaggctgagacaggagaaacgcttgaacccaggaggcagaggttgcagtgagcggagatctgtcccacagcactccagccttggggacagagggagacgccgtctcaaaaaaaaaaaaaaacaaaaaacaaaccaaagtattagtttatggcttacatacttctcagatttttttttttttttttgagacagagtctcactctgtcactcaggctagagtgcagtggcaccatcttggctcactgcatcctccacctccagagttcgagattttgtgcctcaggctcccaagtagctgggattacaggtgcctaccaccatgcccatctctactaaaaatacaaaaacatataaattaatacataaataaaaaaataaatttttgtatttttagtagagacagtgttttactatgtcggccgggttcttctcaaactctcggcctcccaaagtgctgggattacagatatgagcgactgcgccttgcctgtctcagaattgttaatagttaggaacagagaggtagtcagaagaactgcagtttgaaaatttgcctttcttgatttataattatggttgatttgcccagttaagagttgggaagaggcagtatataaaatgatcccatccagtttttttaatgaaatcattgagttggaccttaaattttttttattattttttattttattttatatattttgtttatttatttttttgagatggattctcgctctgtcgcccccaggcaggagggcagtggcgtgatctcggctcactacaatctctgcctcccaggttcaagcgattcttctgcctcagccgcccgagtagctgggactacaggtgcctgccaccatgcccggctagtttttgtgtttttagtagagacagggtttcaccatagtggccaggttggtctcgaactcctgaccttgtgatctgctcaccttggcctctcaaagtgctgggattacaggcgtgagccagcgcgcccggcgtggaccttaaaattttaaaaaagtttgtgttaatggcatatttcattggagtgaaacaaaacactggctcccatatgtaaggcccaagaagaacaagatttaagagaaatacgattttctgtttaaatatttttgatttttagaggcccctgtcaaaattgaatgttgaagatgtttgccaaaggcagtaaatggtattatcctgagttataaatgcagggagccatgggagttgggaggtgatgtcttgtgaaatcatgcggagctactgcataatgttcaggccatgagtgttatttatagattgttggtttcgaaagtatctttagctttgaaatacagcccattatagctgatgggaagatagcatgtgaaggattggggtacaggtggccgaagcagacagtagtaggccagaaataatactggagtgaatgtggacttgcagaaatagttcttggagttttgagagagagacctgttaattgtttcagactagcatcagggaatgttgatgtcatggggtcatttcattacaggtccaaagttctgttctgaatcaggatgtggaaggttaagttcattttcactcattcgcgtggactctagacagttggtatacaatgatgtacagtgttgtataacaaagcttaattttagatgcaggatgtcttttgctctcaaataaataggttgatggtctagaacctctctttttttttttttattggtgagcggagactcaaagcagagattatatgttggctgtccttgtggtctgttttcatgtagactctgaccaaacctagagattttttccagctgtatgttaagccactcacttctagaaaccaaaatacctgtgtctcctcttctctcagccacttgtgcagtcttactgtccagtactcctcattcagcattccttctcagtcaccactgtccttacttccttgtgacagggactgcttttagtttccagtgttacattatatagttggttcattagttacattatatgttgctgtcccttgcgagcttattagccttcttgctaagcatctgagtagggttgcacctttaatcagcagcatacttaaggtgtttacttctggagaagagttccctagatggttaatgttactcattttatgttggttcttaatagttgagattgagagaatattctgacacattctacaatttttttccatctttttaatgggctgtagttacagaaggtattcatttttgtcttgtcacttcctagttaagtacagcctataggagggaggaacctgtactgtttgttagctctgaattccctctttcccatgcacatctcttcggactgtgtcataatttattcttggcttattgttataatataccatcttgtctctgcttgcttttctacttttaaccacttcctgatatagctctctcctttgaaaacaggaaagaaccggaggctgaagcaggccaaagaagaagctcaggctgaaattgaacagtaccgcctgcagagggagaaagaattcaaggccaaggaagctgcggtggggcaccatttgtttttgttactgctttagtttctgatcccctgtcccgccaaggctttcagaatatccagcatagctcagagatcctggtcgaagtttgaaaatgtggtagctgtgtgttttattggctgctcaggcatctgtcttttaggatgatcagtttttccattcatattgatttctaattttcatttattcactcatttaacacgtatctgttaagcagttaacatgcgccaggtactgtgctagatgctagggatcagttgtgaccaggaatagacatggtcccttccctcatggagtgtagcttaccatccagtggtcagggagactcagtaatacagtgcaaatcatgcagagctactactgaaaaatgctgtgacggtcataaacataaatcaaatggagccccactttagtatattgtatatagtacagacatttaccagtgatgtaggctatactatggtgcatacaataatagtacaaaaacagatcacagaaagcatagaggaggcagggacaattgtggaaaggggaaaggatggataagggcctcacagagaaaagaaactatcaggactcttgggtgcaggtaacaaaatataattaaaactgattctaaatgggatgtattggcctatataattaaaaacccaagagcttaaataatatgctcaggactttctctcacctctgtgtttggctttgtatcattctcaagttctacactgtggcctctagtagttccagcatacacacttccaggcccaagtccagtgagtaaaggcacatacctccctccttgcattaagtagcaaaaattttgatcaattttttattttttctttttaagagacagagtcacactctatcattcaggctttagtgcagtggtgtgatcatagctcacggtgacctggagcttctaggcttaagcgatcctcccctgcccagccttctgagtagctaggactgtaggcatgatccatcatgctcagctaattttttttttgtttttgtagagatagggtcttgctgtgttgccttggctggtctcgaactcctggcctcaagtgatcctcacatctcaacctcccaaagtgctggatcatctttgttcttggcaattacagtgccattaaaacgtggctgggcatagtgactcacacctgtaatcccaatactttgggaggctgaggtgggaggattgcttgaagccacaagttcaaaaccagcctgggcaataaaccaagaccctgtctctacaaaaaaataagacaaatacaaataaaacttaacatgtttctttgattcttgaactggggctgataggtgctgtaagttgtcaggctgctcataaaacaatgtagaaatacccttgtgtcagggcagccatcatcttcatttttttttttttttttctgagacggggagttttgctcttgttgcccaggctggagtgcaatggcatgatctcggctcactgcaacctctgcctcccaggttctagcgattcttccacctcaacctcccgagtagctgaaattgcaggcatgcgccaccacatccggctaaatttgtatttttagtagagatggggtttctccttgttggtcaggcttgtcttgaactcccgaccgcaggtgatctgcctgccccggcctcccagagtgctaggatgacaggtgtgagccaccgcgcccagcgccccccgcccctttttttttttttttcctgtccgagatgtagtcttgctctgtcacccaggctggagcgcagtggcgtcatctcagttcactacgacctccacctcccaggttcaaatgattctcctgcctcagcctcccaagtagctgagactgcaggtgtgcgccaccatgcccggctaatttttgtatttttagaagagacgggggtttcactgtgttggccaggctggtcttgaactcctgaccttgtgatctgcctaccttggcctcccaaaatgctgggattacaggcgtgagccaccacgcctggcccatcttcatatttttacattcttttttctttttcgtggcacaggcctaggaggtcccaatgacatgtgccctcatattcttacattctgtgctgtagttgattatagagatggtactggtattgcactgtaaagcacaagctctgattccttttttctttcttttcttttctttttttctttttttttttttttttgagacagtttcactcttgttgcccaggctggagtgcaatggcgcgatcttggctcactgcatcccccacctcccaggttcaagtgattctcctgcctcagcctcccaagtagctgggattacaggtgcccaccaccacgcctggcagttttttttttttttgtctttttagtagagacagggtttcaccatgttggccaggctggtcttgaactcctgacctcaggtgatccacctgcctcagcctcccaaagtgcagggattagaggtgtgagctaccatgctcagccaagctctgaatctttctagcagtgttccattgtaacctctttagtttttgagacaacttagcggagcttggcgtatggtttatattcaagaaacaggtaatggggttctgaacataaaagaatgagttagcaactgagctgttaatgaaatgccccaggagattcctgtaatatgaacagttatagtatagtatgaagagccctaagggcacagtggctcatgcctgtaatgctagcattttgggaggccaaggtgggtggatcgtttgagcccaggagttcaagacctgcctgggcaacatggtgaaactctgactctacaaaaaaaatacagaaattagccgggcatggtggtgtatacgtgtagttccagctacttgggaggctcaggttggaggatggcttgagcccaggaggtggagattgcagtgagccgagatcgtaccactgcactccagcctaggcaacagagtgagactccatctcttaagagaaaatggagtgataaagtcaggcacagtggtgcacacctgtggtcccagctctgcaggaggatctcttgagcttggagtctgaggccatcctgggcaacatagtgagatcccatctcttcgggaaaaaaaaatggagtgatagcctccttataggtcgttgtgaggaataggtaatggagagactcctttgcaaattaatatattatgcaaatatgaagggatgttattagcatatatatatatgtatatatagtgaggcaagaacaggttaggtgaataaaaagggtcagacaaaaaagttacgtcttccagaacgttataggttaagttctaataaagaaggcacagcagttaacaaaaagctggctgtattgtgaagatcatagaaagtaaaagaaaattcatgtcagtgtgtgtgaaattgctaagagaaactgaagaggtaaaatgtttacgctaaaaattcaggtaataaaaaggggcaggctgaggcagatggatcatgaggtcaggagatcgagaccatcctggctaatatggtgaaaccctgtctctactaaaaacacagaaaaaaaaattagccgggcgtggtggctggcgcctgtagtcccagctactcaggaggctgaggcaggagaatggcgtgaacccgggaggcggagcttgcagtgaacggagatcgcgccactgcactccagcctggacgacagagcgagactccaactcaaaaaaaaaaaaaaaaaagtgtgggggcagcaatgagaaattagttttcctctctctcagacctgcagtcctcctcagagccagtcactgttaacaggtttctttttttattcttctagaatatttatatttgcaagaatagatgtgacacactggtgaatccactgttgaacttaagaactaaaacactaaccaataatggtgaaactccttgtatattcctcctaaattgtatcttccttgtgtttgttattcttgtttggagatggggtcttcttgcagttttgctcaggtagggctccaagtcatgatcctcctgcttcagtctctcgaatagctgagactacaggcatgcaccaccacgactggcttgtgtttattattatttaggagtttttaaaaaccttgtatctccccacatttaaaaccacaggtacaaaaacatactaaccacattgatactgttgtatatcttgcttttccccctccttaagctgtattttacagttcactgcaattcctgaatagttctcttgcacagaagcaagttgagtttttaggttgattcctatctttggttaaggctatatagcagattcttttttttttttttttttttttgagacggagtctcgctctgtcgcccaggctggagtgcagtggcgcgatcttggctcactgcaagctccgcctcccgggttcacgccattctcctgcctcagcctcccgagtagctgggactacaggcgcccgctaccacgcccggctaattttttgtatttttagtagagacggggtttcaccgtgttagccaggatggtctcgatctcctgacctcgtgatccgcccgcctcggcctcccaaagtgctgggattacaggcgtgagccaccgcgcccggcctatatagcagattcttagaggagagatgcgaatacatgtctttggaataatttcctagcagtgggaatactgtgtagtttacttttggtagatgtggctcctgttaactctgagaatacctcacatgtgctccagccatgaggtcatattgccagcttctgagtatactgataggtgagcctgggtttctccaaaagtcaacaagtagcttacgaaatgtacctgaccaaccagagcattgttctgataatccctccgtgacatcactccccatctccaggcattgggatcccgtggcagttgcagcactgaagtggagaaggagacccaggagaagatgaccatcctccagacatacttccggcagaacagggatgaagtcttggacaacctcttggcttttgtctgtgacattcggccagaaatccatgaaaactaccgcataaatggatagaagagagaagcacctgtgctgtggagtggcattttagatgccctcacgaatatgaagcttagcacagctctagttacattcttatgatatggcattaaattatttccatatattatataataggtccttccactttttggagagtagcaaatctagcttttttgtacagacttagaaattatctaaagatttcatctttttacctcatatttcttaggaatttaatggttatatgttgtctttttttcctatgtcttttggctcaagcaacatgtatatcagtgttgactttttctttcttagatctagtttaaaaaaaaaaaaaaccacataacaattctttgaagaaaggaagggattaaataatttttttccctaacactttcttgaaggtcaggggctttatctatgaaaaagtagtaaatagttctttgtaacctgtgtgaagcagcagccagccttaaagtagtccattcttgctaatggttagaacagtgaatactagtggaattgtttgggctgcttttagtttctcttaatcaaaattactagatgatagaattcaagaacttgttacatgtattacttggtgtatcgataatcatttaaaagtaaagactctgtcatgc

SEQ ID NO: 37045 - DNA, 8290 bp, Homo sapiens
agtgctcatgctcgctgcaggggtcggaggtcagggcgagcgtctcgcaggccgtaggaggaagatggcggtggagtcgcgcgttacccaggaggaaattaagaaggagccagagaaaccgatcgaccgcgagaaggtgaaggccccctccgctttggggtccgggaagaggttggggatgagtcccgcagggtgcagaggcgcggcctgtgtgctggaggagatggtgtttttggtctcggggaggctcggaggccgcaacgcctcgggaagagagatgagctccgggttcgcagctggtgtttttaacttctgcccttccgttttctctctccctcagacatgcccactgttgctacgggtcttcaccaccaataacggccgccaccaccgaatggacgagttctcccggggaaatgtaccgtccagcgagttgcagatctacacttggtgaggagggcggggtggcctcagggacccgggccgggaacctggaacaacagttaattgcctttgccagtgtagagttattctccctgatttcaatttcatttctccacttggggccttcggactcagctttcaggaagttagaagtttttgttgttaggtgaaaggagatttgcccgtattgtaacgcttttgtgattaatgttgcaacttttgggcggttaagaatggacagacccaagattgctgtcactgttatggctgctaggtacaaaagtgataggtagataaatatgttgtagtatctgccctaaagggactcatagtcaaataaattgcactaggacaacatggtaagggagagtgatgctgtcgagtggtatttgttattctcaaagagcatttccacataatattaagccttaggtaccaaagcaccaaaagtgaaaaataaactaccaaaacccgagttatttcttctctaagggttattggaaaagcttttgatatgtgtttagtgaagatggttcctgaatgtttatctcttgggtgtacctccctacaaactactgtgggcttgtctttagcgctgcacataactccttggattgacaccataatggctttttagtataagtaaaaggtgtgtaattgaaaaatatgtgtatatactctctctatatatttttgagacagagtcttgctctgttgcccaggctggagtgcagtggtgccatctcggctcactgcaacctccacctcctggattcaattgattcttctgactcagcctcccaagtagctgggattacaggtgtccaccaccacgcctggctaatttttgtatttttagtagagatggggtttcaccgtattgaccaggctggtctcgaactcttgacctcaagtgatctgcctgcctcagcctcccaaagtgctgggattaaggtgtgagctactgcgcccagcctaaaataaattttttattgtgatgaaaagatatataacaagccaggcacggtggcttatgcctgtaatcccagcactttgggaggctgaggctggcggatcacttgaggtcaggagttcgagaccagtctggccagcgtgatgaaaccctgtctctactaaaaatgcaaaaattagccaggtgtggtggcgcagaattgtaatcccagctaattgggagactgaggcaggaggatcgcttgaacctgggaagtggaagttgcagtgagctgagattgtgccactgtactccagcctgggcgacagagcgagactctgtctcaaaatatatatgtgtgtgcctatataacaaaatttgccgtgttaaccatttatttttattttttgaatctcactctgtcacccaggctggagtgcagtggcgtgatctcagctcactgcaacctctgcctcccaggttcaagcgattctcacgcctcagcctcctcagtagctgggattacaggcgcccgccaccacgcctggctaatttttgtatttttagtagagacagggtttcaccatgttggccaggctggtctcgaactcctgacctcaagtgatccacccaccttggcttcccaaagtggtaggtttacaggcatgagccaccgcacctggtcattaaccatttctaagtgtacaatttggtggcattaatagcattcaaattgttgtgcaaccactgtttctacaagtttttatccctccctccaacagaaaccctgtaccccatcctgcctttttttaatttttaaagagacggagtcttgctctgttccccaagctggatttgagctccttggctcaagcagctgggactacaggcacacaccaccatgcccagtgtgccggtaccctgttaaggacactctgtgcctattaataatttcccattcctcccctgccccatcccctggtagcctctaatgtattatctgtccatatatgaatttgcctattctgcatatttcatttcagtgaactcattacagtattcgtcattttggcttatttcatggtgtttttagggttaatgttgtagcatccatttagccttgtcaaggctgaatcatatttcattgtatgtgtgcatcacatatgtactcatctattgatggacacttgggttgtttcaccttttttgccattgtgaataatgctgctgtgaacattggcatacaaatgtgtttgtgtcgctgctttcagttcttttgggtatgtacctaggaggggattactgggtcatatgttaactttgtttaatttttgaggaaccaccaaactttttcacagcagctgcactattttatattccccaaaagatgtataattttaaactatttaagccctgtacactagagctaatcccttgaagattgggaccttacttgtcttatttggaggtgcttgttaaatttatgtagtagtatgatacctgtacttaagcatcactcaagggtaagtgttctaggaaggttgatttagcttatatggaagaactgttgaataatggcttgatgaaaatctcttcagaaattaaagtgtatgtttcttccaacaagagttcctatttgccaggtgctgtgtgtgcttagatcctgagggtataaagtcaagacggtactgctcctccctgtagtaagtccttttatcagggaaagcggatgaatagagtgatttttagggttaaaatggcagggtgaggttgttccacagaccttccactctgaatcaagaaaaaaaattaccaaaaaaatcctgtcctaaactataccgtccataaattgcaaccaaacaaagaaggaacaactttaagttacatctcaaaatggtggccaaagaaaagattctgaaagactggatgattggtatgggggtaacacaaaggcctgccctcattcccagaaatagtaatgagggaaaattagttaacatatactggaaattctcaatttggagaagtagactgtggggttaaataggcagtcccaagagaagttatggaaacaggagtggaagtccagaggagcccagtagaggcaggctgtgttcaccaaagtcaatcagggctcagccagaaaaacagaattgggagagatgtgttaagagatttatttctgctgggcgtggtggctcacgcctgtaatcccagcactttgggaggccgaggtgggcgggtcatgaggtcaggagttggagaccagcctggccaacatggtgaaaccccgtctctgctaaaaatacaaaaattagccaggcatggtggcgggtgcctgtaatcccaactacttgggaggctgaggcaggagaattgcttgaacccaggtggcagaggttgcagtgagccgagatcagcgccactgcactccagcccgggcgacagagcgggactccatctcaaaaaaaaaaaaaaaaaaaaaaaaaagctttattgcaaagaatttggtttacgtgattgtgggggctgtctaggcccttaattgtcaaatctgtagggcaggttctcaggaaggaaaggctgctcttagggcctttcaactaatagaatcaggcctccccagattatataggatagacctctgaatttaaggtcaattggttgttgactttagtcacatctataaaatatctcacagcaatacctaggttagtgtttggttgaatatctggggactgtagcttcgtcaagctgacacaagtactgaaccccaccctgtcctcaagcttctgactagtgatgaaaaagcaacacttggcactccaattgttggtctggaaagacagtccttagaaggtgggaagcttgtgtaggtttcacactgtcagaactgataaaaggtgtgatataaatcccccaaattaattaagagcaagacaatattgaaaatatttttagaaaggaaaaaattctttctggtatatatcatcataagtatgtactgtgtatcagaatatagactgagcatcgcaagtccaaaatctgaaatgccacaaaatctgaaacttttgagagctgacgtgacaccggtggaaaattgcacacataagttcttgacctctttttttttttttttttttgagacagagtcttgctctgtcatccaggctggagtgcagtggcgcgatctcggctcactgcaacctctgcctcccaggtataagcgattctcctgcctcagcctcctgagtagctgggattacaggcgtgcaccaaacttcctttcatgcacacaattacttaaaatgatgtataaaattgtattccagctgtgtataaggtatgtttgaaacataaatgagtttcttatttaaacttgggtcacaaccccaagatatcttacgtatatgcaaaaattctaaaatttgaaaaaacctaaaacgcttctagtcccatgtattttgggtaagggatactgaacctataattgatacagaatagttaacatcaaaatatcaggttgaaaaaaggtcacctctgagacagataaaccaatgtgacctcaggtttttttgtttttgagacagagtctcagtctgtcacccaggctggagcacagtggcacagtcttggctcactgcagcctccgcctcccaggtcaagcgattctcttgtctcagcctctcgagtagctgggattataggctacagatgtgtgccacaacgcctggctaatttttggatttttagtagaaacggggtttcaccatgttggccaggctgctctcgaacttgagctcctggcctcaggtgatccacccgccttggcctcccaaagtgctgggattacaggcatgagcctccgcacctggcaaaaaaatgtatactaggttatttctaagatgcttatatgttaaaatatttttttcagattgttctcttattagctcaggggactatatgaaagttggattcaagtcaatatttgcagggtaagaaactattgtgacaagagcctgtgcttcattgtaagaaacttttgtatatttcattggctctagtactcttatctgttgtaaaacttacaattctatctaagaaagaagaaacacatctggctgggcgcagtggctcacgcttgtaatcaatcccagcactttgggaggccaagataggtggatcacttgaagtcaggagttcgagaccagcatggccaacatggtgaaaccctgtctctactaaaaatagaaaaattacctgggcgtggtggtgggcgtctgtaatcccagctactcaggaggctgaggcaggagaattgcttgaacctgggaggcggaggttgcagtgagctgaggtcacgccactgcactctagcctgggcgacagagcgagactctctcaaaaacaaaacgtcagtatgaaaatgctttcctagtacattgattctaagatacattccaatttcagagatgctaaaatgtggaagggtacatgtcttagaactaatgggatacatctattttgcatatttggatttatttggactagttacccttaggtaaatcactaggccataaggtgttgtgtagcaacagaagatagcatatagaatctctgaagtcccttttagcactaagagtctaattaattgaaatttccagcagtaaggctggtacatggagtttttggaggcaaatagtatttttagctgctttaaaattaatctctagtataagaccctggcagtttctaatgtaaatcacaactcagatatatgtaattaactcattgttagtatcccttttaatattattgctgattaataagcaaatgtaaatgtcttttttaaaaaaaatccaggatggatgcaaccttgaaagaactgacaagcttagtaaaagaagtctacccagaagctagaaagaagggcactcacttcaattttgcaatcgtttttacagatgttaaaagacctggctatcggtaggtaacttctcatttttaagtcctgtaatctctttgtttttagtatgttttaactgatacagataactccttcaatgaatcttgttagtgggagaatatgggtttatattaatacgtggtttggcttaataaagtagttaaattttggaagtgtgttataaaatgatggagaaaatccagtgccatattcactttgtagtacatactgggtttcattgatttggatccattaacagttgattttctttcttacagagttaaggagattggcagcaccatgtctggcagaaaggggactgatgattccatgaccctgcagtcgcagaagttccagataggagattacttggacatagcaattacccctccaaatcgggcaccacctccttcagggcgcatgagaccatattaaattctatttactatttgttgaatttatttttccgtcagttatgtaaaataaacatactcttcttcctcccctgattattgccattaagcctttaaattctaaacaaattataatgcatcatctatttaggagttagatttggatgtgctattgtatgattacgaatagtctgtatgtttcaagcccttctgtaaaatatgaagaaaagtgctcttagcattctgtgtaaaactgtactgttaaatatatgtgtgtaatcagcctgagtgtgaaagttaatggaggcctgggaacagggtttatactaagtagtggaggagcgtatggttaagcccaaaggggcagaacaagaaagccacgggattgtatgaaatcaaacatgagtttgtggtgtagactgctgtatgcagttggaaaggacacgtgagagtgagctcaagtggcagcagaggcagtttggaataagctgcggcaagttgaagaagctgtgttggacgagattgccccgccttgatcagggtaccatgacataaaaggttaaagaacaggcaacacaatgagcacttaagtttttaacatgtggggaatagggcattttaaaggctggaaccagttcagaggaaacaagggtttgggtagaggtagaaaggtttaattaaccctggagatctgcaaatggagggaggggtgaaggaggaatcttaagaccgagggagaagagccaaggacaaggtcaggttgaatgagtaggaggtgttcacacatcctcttgtgtgctaggtagtggcgtgcatctgatctgagaggcagtaaagcagtgatgaagacagtgcagcagaacattgaagtcctgattgcagcagtgactctgcaaccttggataaattatttcaatctttattttgtaaaacggagataacggcctataggattgttaagactgaatattttaaaagagcttagaatggtgcctgacaaatgagaaacaataaatactgattattggccataaagtggtattaaaactggatctcttttcttccatggcactactctcattttgaagtttatgaacagtacgacagtgtattgtaaattccctttagtttgttacagtagccaattgaaaatgtatatcccaaaatttaaaaaaaaaagtaccagcagcaataaaattgcactagttttatctggtacatacaaaaacagccatttaaaatctgatgattctgtggaattggtgtccctgttagcaatggcagagaccagcctggagcctagatctggtgcttcttctgtgctgtggtttaccccaaacctttaggttgtttattcattcagattagatagactggagccataaagttaatttgcacctagctttttggagaatagccatgattaactgctattcgtggtgggggtgggggggaaccctatgatttactatgcagatgaagagggtaggaactaaataaaggactttgtaagcc

SEQ ID NO: 37046 - DNA, 10317 bp, Homo sapiens
agggaatcttatgaacagaaccaggacagggaggctggccggaggttcctgcagagggagcgtcaaggccctgtgctgctgtccctgggggccagaggggttgcccagcatgcccactggcaggagagagggaactgacccacttgctcctaccagcttctgaaggtaaaatccttacaaacgaggagcagagctttgatggaggaaaaaggaaaggcagaaaacttcacgtaggagggcttggggcaatgatagagggctgacaaaggcagcataaaaaaaggcagaatatagacaacctatttctcttaggctcaccccatccacccctacttcacccccttacctaccactgttttcagggttaaagcaattttagcaaccctttactaggaactgtggggagatagcttgtattttcagtaagttggcggtggggggcagggacaaactccaaacaaactctggaaaacgaatgtaggaagtttttatgttccttgtcatttggctgtcccttttctccttcctcgcacaaccctgtatcagtggggcagcacttccttctcagaccgcttgtcccagggtccctgccttcccctagtgaaagaagctcctgcctccatcggtgggcgttgggagcatcagcggagatgcacgcaatgataaacagcagacagggctgcttgaggagatgaggtgatcacggttaaagaagaggggctgtcctacatggatgatcatgatgcgccaagactgttgaaaacctgagtggaaatgggagcatcgttcttgagggcaggagagagactgataccgcgggggtggggctggtggaggacaatagaggaagaagaaaactgggagaaagtactcgattcctttggagaaaaattaggagaaagtctagagaagcaatgagggaaggatacaatttagctatagtctagaaagttagtcgaagttaactagggagggtgtgaggggcacggtgccatgtggggatgttggtgatatggccctgtgtgttatacctttgaaggtgacactgagccccaggtgacgccgcaccaccaaagaaggtgcttgtgtttgtcagacaaatacagccaggcctgccaccccttaggctccaaagtccggaggtgcagaaagccaggaccaagagacaggcagctcaccagggtggacaaatcgccagagatgtggtaagtgatcaagggtccctgagatgacacagactccattcccttcatcttctcaagaaaagcgctcaagggccaggcatgatggctcacacctgtaaccccagcactttgggaggctgaggcgggaggattgcttgagcccaggactttgagaccagcctgggcaacataaggagaccctgtctctattaaaaaaaaaaaaaattagcccagcgtcatgcgtgtcacctgtggtccctgctactcaaaaggctgaggtggtagaatcacttgagcgcgggaggtcaaggctgcagtgacctgagatcgcaccactgcactccagcctgggtgacagagtgagaacctgtctcaaaaaaaaaaaaaaaagggctcttgtctgaagcctgggttttggtttgacctgggccttttctttattccgacctaagattctcccccatggccgattgactgcctctcttcttccccctttcttctgcctctggcaaatagcgcgttctgtcctaggctactggtgcctggtcacccgccaatctatgcctctgttttttcaggtgcattgtcctgttttcacttttggcatgggtttatgctgagcctaccatgtatggggagatcctgtcccctaactatcctcaggcatatcccagtgaggtagagaaatcttgggacatagaagttcctgaagggtatgggattcacctctacttcacccatctggacattgagctgtcagagaactgtgcgtatgactcagtgcaggtatgttataagcacaaaaagaatagagatggaagactagggctaaggtagcggaataaggatgtgggagggagtgccacctgtactcacagtgaactggagtcaagtcctagtggcataaatgttctattctctctgtcccttcttttaactccataccaaaatattaccctttcctagattttttttttgtgactcttctcttagataatctcaggagacactgaagaagggaggctctgtggacagaggagcagtaacaatccccactctccaattgtggaagagttccaagtcccatacaacaaactccaggtgatctttaagtcagacttttccaatgaagagcgttttacggggtttgctgcatactatgttgccacaggtaaggctcacccttctgcatgtgccttattgacccagctaaaagattagaaatgagaaatccactgagcaacacattgaatgaggattctgttcgtaattcttataaaaagtgttgacttggcctgggtcgctccataaatcacttttgtgaaattcaaatgcatgatcatatcttagtggtgatgatgatcatggtaataacacatagtacataataaacagcaatttgttgagagccactataaactgggtatgtattggggattggggatttttcctattttaacacaatcgtcactttaatccttcaaggtaggtattatttgctccatataaagatgaagaaaataaggactaggaaagttaataacttgccaagaatcacacaaggaatgtgtagtatttaaacccattcaatatatggcattcaaaccttcaaattctgggtacttctgtatctctctctaggttaaaatgaagctaggacatctcataaagccaaactattgtttagatttgacagaaggaccaacatcatataaagcaatgaatgtactgattcctccctgcagaaggcatcgtcatgatgtttaccttgcagagtgtcattcctggagctgaaatgctctgtacatgagaaaagtcaaggatctctgacattaagagctgcctaggccgggcatggtagctcacacctgtaatcccagcactttgggaggctgaggcaggtggattaccggagcccaggagttcaagaccagcctggccaacatggtgaaaccctgtctctactaaaaatatgaaaaattaaccaggcatagtggtggtgcgtgcttgtgttcccagctcctcgggaggtagaggcgtgagacttgtttgaacttgcttgaaaatgtggaggttgcagtgagccaagatcccaccactgcactccagcctcggtgacagagtgaggctatgtcacttacacacacacacccccgagcttccttatagctgtgtagtggtagggctcaactctggaatcatatgtcaggagagtaatatggaataatagtagcctgaaatgtgatcccttgacggatctttaagcaataggcctttcctactttttcttacccttatggttttggatttaacctcattctcccttcttggtgtttgttcttgacctcagcctctttctactctttgtagacataaatgaatgcacagattttgtagatgtcccttgtagccacttctgcaacaatttcattggtggttacttctgctcctgccccccggaatatttcctccatgatgacatgaagaattgcggaggtgagcttggtgttaagagggttgcatgttccctgggatttggaatggctgaggcctcagaaagggctttgtccacccttccaacttcgattaggccaagccttcatttggcacttcttttttattttagaatttatttatttatgtattatttttaataatttcaatagttttgggggtactggtgtttttggttacatggatgagttccttagtggtcaattctgagattttagtgcacttgttacttgagcggtgtacactatacccagtgtgtagttttctcgcccctgtttcaacctcctcccacgttgagtccccagagtccattatatcactctgtattggcatctattcttagttactcataagctgagatgaagccacaagaaggaggaagataagactatagggtaaagttagttaattggataagagagatagatgcctgtaaagggtctactgggggctgttcataaccagaaaggctccatcctaagcaaagtgatggaaacctaatagggattgggtattcctactgatacgtattgcacgtgtaattgctctatccctccagttagggcagggatctcaggttagtttgaatgcaggactgtcagtttctgagagaaggaatcatagaatagtgcaggaattcctttgcttgaccctgtatttgattctccctttctctttttctctgttagttaattgcagtggggatgtattcactgcactgattggggagattgcaagtcccaattatcccaaaccatatccagagaactcaaggtgtgaataccagatccggttggagaaagggttccaagtggtggtgaccttgcggagagaagattttgatgtggaagcagctgactcagcgggaaactgccttgacagtttagttgtgcgtgatggttgattaataccccacccttaacttacacagagagatctctccctgaagacaaatttttttttcatacagcatctttctctgttgctcaagctggagtgcagtggtgcaatcacagctcactgtagccttgatctcttgggctcaagcaagcgtcccacctcagcctcctgagtagctgggcccacagacgtgtgtcatcaaacccagctaatatttttattgttattctttttttttttacagagatggggttttgctatgttgctcaggatagcctgaaactcctagcctcaagcaatgctcccacctcggcctcccaaagtgctgggattataggtgtgagccactgcactcagcctgaagataaaattatcttttctcctgacccttattttcttcttattttatgtgacatttaatgcctcttttatttgtatctcccacttcccaattttacctcttccctttagttctttccctcttctgatttcatcattttgttcagtttgttgcaggagatcggcaatttggtccttactgtggtcatggattccctgggcctctaaatattgaaaccaagagtaatgctcttgatatcatcttccaaactgatctaacagggcaaaaaaagggctggaaacttcgctatcatggagatcgtgagtaacttagaagtgcctctttggttggtgataccaaagtccccaaacaatgtgggatcaaagcaggtagatgatccaggcacactggaagcacctgtgatctcagctaccgagggaggctgaggcaggaggatcccttgagcccaggaagtaggagtttgagtccactctgggcaacagagcaaaaccttgtctctaaaacaaaacaaaaacaaagcaacaataatttaaaaaacagatagattgttgttctgatagaatcctgagatacttcacttcttcaggaaaatctaaaccagtcaacggttgctagaaatgcctcaacctctagtaatcctttaactagacctgagactgcagacagcttgcgggtggttagttggtaatgccatatgattttagacatctgctgtattggaatgttaagcatcaggattgaggacaactggacgattttagaaagtgtgagaatgatgtaaatagaatgagagtcttcaactatttagtaattttttcctcctgtcccaacttctgttctttcaagcaatgccctgccctaaggaagacactcccaattctgtttgggagcctgcgaaggcaaaatatgtctttagagatgtggtgcagataacctgtctggatgggtttgaagttgtggaggtaaagtaccaccttggcttctccccagtccctggccccagatcaggatgagcggactgaaattgtccagttgtttacccaatgtatgtgtgtgatcaaggtataacacctttcccataaacacaacagcttaagatctgtagttctcccttgtgagtcatggagctgcctggccagcttggcattctctctgccttcagtcttcttgaggaaggggagttgacacgttggggcaaagctttctgtcagcctcatctcctgggtgctttaggtctgctaagatgttcccaagcttcttgtggtgaggactcctcattgatccaaggccagagatcaattccagttttgattttggtttcccatatctctcttcagaaataagtggtgatgtttattattctccagggacgtgttggtgcaacatctttctattcgacttgtcaaagcaatggaaagtggagtaattccaaactgaaatgtcaacgtatgtgtctcttcaaagtggaagtctttctttttctctcagagagaatggaaagatcagcacatcaaaattcaaatgcatggtttcctcttaggcatgtgagggagtgggttgggtttttgaagggaagccagtcatggaagcttttctagtcccagccccgcatctggtcccaggccaactagatcggcatgtttctttccaagaaaggggctatgggataggtcgagttagtagccccacgtgggtgcatttgtggcttccactgggccttcaccaaccactgagaaccaggctcttcactacggctttcatggggccatctgaattggcatctcagcgggtgagagagctgagagatgccagttggggaggatggccacagagaggctggtgtggggaggttcatcccaggtgtgcctgtggatatggggtggggaagcagtgaggatgaacctggccccatgactcttccttggaggaagtggctgtcctgaccatcgctctccttccttcgtctggtagctgtggactgtggcattcctgaatccattgagaatggtaaagttgaagacccagagagcactttgtttggttctgtcatccgctacacttgtgaggagccatattactacatggaaaatggaggaggtggtaggtttcttctactggagaagagagagagagagtgagaaggtgttggagggtggatagcataatctgtgccagagacagagtttggagacaaatgaaggcgataggacagacattgttcatccccttggcttcgtccaaagatacagttttcatctggagcagggcaagttcaggggagcatcagcctcagggaatcatagaggtcaccaactgagttcacagctgcagcaggaattcccctacaacatccatttcatgggattacccaccttttgaccagttatttcatgtaaaacccacaggagcaatgccttcagctttaagccaccaaactacactgactggctttcttgatgtagaggctttggtcatgctaggtgcagggctgaatgagaccctaatacgttctctgcattgctctgtatttatttcgccactttcccgatgccttctttccttctgctttggagatgttccctttgtctccctggcaggctagaggcctgagggattgtttggaggaagatattttttttctggctgatttaatctgatttactacttgaatcctagacgagctgaggttctgaaggaacggggcagggtgttggggtcggaggggggaatggaagaaggaagatgtggtggtgagtgtggcctgtgttctctgtgctattccaggggagtatcactgtgctggtaacgggagctgggtgaatgaggtgctgggcccggagctgccgaaatgtgttccaggtaaggagggctgaggcttggggagagatgatagccatgggtgactgggagtcaccttctgaaagcaactgtaatcctcttgggaaaggactgaacagtgacctgccagagtccagctcagtgaggtggcagtatcactgtgccgtgggctgccagggccgtggggaacctcctcagccgcactgaagccaggccaactggaaggaaatagaaacgtcagccagcgacagttggtgtctggtaatgtagctgcagtgagaagatacagaactgctaaaaacagggcctgaaagctgagagtgtgtgagtaatcaacactcagaaacaagtctagctaaatagcctagttattatattaaaagtttatagggcagcaagatatagaggaattcaaagaatgaggaagataagagttgggtagcagaaggctgaggcaaatccaataggataataaccatcctgggtggtactgaaagctgaagactgagctgatttgttgcatttattatctcattcgtgtccgtataacagccctgtgagctaggtgtcattggtcttatctgaccaatgtcaaatgtgaatgggtggggtgcaagttcacagagttagcaagtggcaaaggcaggctttgagcccaggtctgtctaagttcacagcccattgtgctcaacttggagtccctccaggctgtctagtaagggatttaagtaagcagcttcacttgaattcagttattagtataactgaatggtaatggcaccagtcactgggagtgagaggtcagggccaaagaagggacccctctctacttcctaggctgacctgtggtttactaggagggactcaggtgcaactaggactccagtaaagaaggtgattaaagtttgatctgggcatctgaagaaggcagaaatctttcctcctccaccatctgtgtgagaaaagggtttccagcactggctcttgattgggcaccggcctcatgtgccgagttgggaggtgcaaaggggacccctgcctccaggggggctgtgggtcgcactgtggatagtgtgaggcattagtgcatctggactcagtgattcacacactgcctccgtttaactgagctctcccatgagccagcttatgacatcggcaaagcgggatgtttaggtaaggccagagtgggtcaggtattgagattgttgaccaaatagggttgactattttgtactagagaatcctgcaacctagcaggtaacattatgtgagtggttggaggatttgcaggaagccagcatcatttcttcctccttccctgtgttgttttattccttcctagtctgtggagtccccagagaaccctttgaagaaaaacagaggataattggaggatccgatgcagatattaaaaacttcccctggcaagtcttctttgacaacccatgggctggtggagcgctcattaatgagtactgggtgctgacggctgctcatgttgtggagggaaacagggagccaacaatgtatgttgggtccacctcagtgcagacctcacggctggcaaaatccaagatgctcactcctgagcatgtgtttattcatccgggatggaagctgctggaagtcccagaaggacgaaccaattttgataatgacattgcactggtgcggctgaaagacccagtgaaaatgggacccaccgtctctcccatctgcctaccaggcacctcttccgactacaacctcatggatggggacctgggactgatctcaggctggggccgaacagagaagagagatcgtgctgttcgcctcaaggcggcaaggttacctgtagctcctttaagaaaatgcaaagaagtgaaagtggagaaacccacagcagatgcagaggcctatgttttcactcctaacatgatctgtgctggaggagagaagggcatggatagctgtaaaggggacagtggtggggcctttgctgtacaggatcccaatgacaagaccaaattctacgcagctggcctggtgtcctgggggccccagtgtgggacctatgggctctacacacgggtaaagaactatgttgactggataatgaagactatgcaggaaaatagcaccccccgtgaggactaatccagatacatcccaccagcctctccaagggtggtgaccaatgcattaccttctgttccttatgatattctcattatttcatcatgactgaaagaagacacgagcgaatgatttaaatagaacttgattgttgagacgccttgctagaggtagagtttgatcatagaattgtgctggtcatacatttgtggtctgactccttggggtcctttccccggagtacctattgtagataacactatgggtggggcactcctttcttgcactattccacagggataccttaattctttgtttcctctttacctgttcaaaattccatttacttgatcattctcagtatccactgtctatgtacaataaaggatgtttataagc

SEQ ID NO: 37047 - DNA, 14941 bp, Homo sapiens
agcaacggggtgcggcagggtggggaacgcgggagcggggccagctcccaggaaagctggtctgcgagcggcccctgcccggctcccaggtccctgcgcgaccccgcccttcccgagaccccagccgggctgccgcccgcgtcccggaaggtgagtgggggaggggagatggagcctggggctgccgagaagcagggagagaggggaaaggtctgcaggcctctgggcgcgggggacctttatcaaagggagcggcgaggggaagggagggaccatacgcaggcggagaagaggtagctggggatcttaaggattttgtagggaaaagccttagcggacccatgggtgtagaagggacgggccgtggcggatgcagactgggagggcctgacgggaaagggaaaggatgggcccctgtggacgccacagcgcgccttccccatccgcaaaggctttccctccctctcctccagctccagcctgaaccatgtttttcacttgtggcccaaatgaggccatggtggtctccggtaagtactgttgttcccttcccagccagtgaccccagaacccctgtgagtctggcctctgccccttctccctctccctaccaacttcccagcaccagacttctgccccttgatggccacgaactgcccagtttgattcccaccattccaaggcccagactgcttcccctccagctcccagattctctcctgtgggttgctgtcccctcacccccgccagttcctcagtcttccacattcaagctctgccaccgttcctcactgccccacaccttgcagggttctgccgaagccccccagtcatggtggctggagggcgtgtctttgtcctgccctgcatccaacagatccagaggtaggcaagaagggaaccagggaagggggacctccgttttctctttttcctcctcttcttactgtctgtcccttctttttcccctaggatctctctcaacacactgaccctcaatgtcaagagtgaaaaggtttacactcgccatggggtccccatctcagtcactggcattgcccaggtgaagctttcagagccttttccccacagtccacttccccatcaccctctctcccagacattaagacatcttctggccacagtcttctcaacccttgcctgcagagaagttcctctgctagtctcatcttttccaggcaccccaaggcacttgcctcctcctcctttctttccctgaaatggaagaagcatttcttagagggctctcccttctctctctgctttttctctgacttcatgagacccccaccacacctttcctacccctactctggctacaggtaaaaatccaggggcagaacaaggagatgttggcggccgcctgtcagatgttcctggggaagacggaggctgagattgcccacattgccctggagacgttagagggccaccagagggccatcatggcccacatgactgtggaggttggcctaggggcagggaaccatctggaaggatgtcaaaatgaggggggcccaaggcccacactagtctgtgagagacagtggatccaagagcatacatcccggccgggcagggtggttcatgcctgtaatcccagcactttgggatgccaaggtgggcagatcacttgaggtcaggagttcgagaccagcctagccaacctggtgaaaccccttctctactacaaatacaaaaattagctgggtatggtgatgggtgtcggtaatcccagctacttgggaggctgaggcaggagaatcacttgaacccaggaggcagaggttgcagtgagcaaaaaaaaaaaaaaaaaaaaaacttacatcccttctccccaccatcctgttatcacaggagatctataaggacaggcagaaattctcagaacaggttttcaaagtggcctcctcagacctggtcaacatgggcatcagtgtggttagctacactctgaaggacattcacgatgaccaggtaaaactaggcaattgatccttccccacttccttgctcccatctcttaagccctccaaaggactaatttctacatctctcccacaggactatttgcactctttggggaaggctcgaacagctcaagtccaaaaagatgcacggattggagaagcagaggccaagagagatgctgggatccgggtgagagagatgggggttgcttagtgggaaaggggatagaagtggcacaactgagaagaagcaggggtgctgggtgagcagggaaaatacatgaggcagaaagagaaccttggtgggaagcaggctgtcaccgtggcctttctccccctgccctgacatttcctacctgatctctgcttggacaggaagctaaagccaagcaggaaaaggtgtctgctcagtacctgagtgagatcgagatggccaaggcacagagagattacgaactgaagaaggccgcctatgacatcgaggtcaacacccgccgagcacaggctgacctggcctatcagcttcaggtcagagccactgccaggccactctctgccccttccccattcctctcaggctgtccatctcaggacaccactacactatttctcatactttaactttggtcttattctggctctccatctctggaccaactcccccatatgaggagagatttaaaagactcagacgttacagctgaaaagctttaaagaaaaggccagccgggtgtggtgactcatgcctgtaatcccagcactttgggaggccaaggcgggctgattgcttgacctcaggagttcaaggccagcctgggcaacatggtgaaaccgtgtctatgcgaaaaatacaaacattagccaggcatggcagctcgggcctgtagtcacagctacttggggtatgaggcaggaggattgcttgagccaggatgcgcaggttgcagtgagtcgagatcacactactgcactccagcctgggtgacagtgaaatcctgtccaaaaaagagaaaaaaaaggccacgcgcggtggctcatgcctgtaatcccagcactttggtaggccaaggcaggtggatcacaaggtcaagagttcgagactagcctggccaacatagtgaaaccctgtttctactaaaaatacaaaaattagccaggtatggtggcacgcacctgtagtcccagctacttgggaggctgaggccggagaattgcttgaacccgggagacagaggttgcagtgagctgagaccacgccattgcactccagcctgggtgacagagtgagactccatctcaaaaaaagaaaaaaaaaaaagagaaggccaagaagggatatgatcaataaggctgatcatatgtttggagcaggctgtgcccgtgcaaaggcatctgactgagaaagtggatccgagctcagatccggcccatgcccctctaatcaagcagtgcattctgacatgggtctgcatctacacagaggaatttctgatttgcacagaggcatgctatgggctagcggcagccctggttaattaaaaaagggtatgaagaaggaaaacatggacttggacattgaatcctgcaaagtgagatatgggcagcccttgatattgccaggaagtatagttgatcttcattcttcattattcgtatctgagaatttgcctattcactaaaatgtattggtaacctcaaaaggttaccaataaagtcgcagcactttcaggatcttttgcagacacgcacagtacccaggtgaggttgatcaaggagatgctctgctgccttgtttcagctctcataccgtaagccgtgttattttcacagtatatttactgccgtgttttttgcatttttgtgctttttattggtgaattcactctttaaaatggcccccaagcatcagtgctgtagtgctgtctagtgtcctttagtgcaagcgggctatgatgtgccttatgggagaaatacatgtgttaggtaagcttcgttcatgcataagttatactgctgttagctgtgagttcagtgttaatgaatcaacaatatattttacataaggtgtctttaaacagaaacacatataaagcaaggctctatgttgatcagttgatgaaaatgttttgaccagaggctcacgggaacctagcctgtatttcttctaggaacaaattaggtattaactaattcagcattcatggctactttatagaacagaactaccaagaacaatgaaaatcaactgtactttgagacctttacccaaaggatagcaatattatgcattttgtttttgccaagagttggtacaggctgaaagcataatgaaggtaaaaacatcttttgttattatgttaaattcctgggtgacttgacaggttgaacatggcatacagctttgcaactcaaactgtgttctacccagcagcagctgcagcatcactgcgaagcttgttagaaatacaaaattgcaggccctggccctgaccagctgaatcagaacctgcattttaacaaaatctcaaggtgaattcctaggtgatttgtatgcacattggagtttgagtttgaaaagggttaccatgatggaaactgctagcttgcagtgaagctatggataaggttcttaaccttctaaacatgaccttacttgtctgcagattaagggattggactggttggactcttttcaacttttatcagtttctcgttatgcaccaggcagtgtgctaggtgttcaggaaagaaggatttattcaacaaatatctgttaagtgccttctatgtgctagacaccattttggaggtgaggctataaatatggaggtgaggcagaaaagattcctgcccttatgcagcttacattatgacacaggaaacagctagtaagcaagtaaatgaccttcccaggctataattcttgtttaggtgctgtgaaggaaataaacagggtgatgtgaaaaactgtgggaggggagttagtatattaggttagcgggtggtagagaaagtttctatgaggaagtggtgtttgagatcagacttggagataagaaggaacaatgtacagttctgagccaagaatattctagcctgtgctttttaagtagtcatacttaaaaagtggctgggcgcggtggttcatgcctgtaatcccaacactttgagaggctgagacaggaagatcacttgaggccgggagtttgagaccagtctggccaacagtgaaaccctgtctctaccaaaaatacaaaaaatattagccgggtgtggtggtttgagcctgcagttccagctacttgggaggctgaggcgtgagaatcgcttgaatccagaaggcacagtgagccgagattgcgccaccgcactccagcctgggcgacagagcgagactccttctaagatagatatatggatggatggatggacggatggacggacggacggacggacggacggacggacggacggacgacagacagtcagtcagtcagtcagtcatacgtggcttgtggctaggcaggggaccagtaagtgcaaaggctgtgaggtggagtcagaaaggaggtttctgatctgggggcgctggtgtgctgtgagtgaggaggaaaggcaggcagggccagatcacaaagggtttgtgtggtcacgatggagacacagaagagaactgaaagcacagtggaaagctattggagaacttcaagcagaaaggtgccatggtcttatttatatttgtatagggatcagtctggttgccttgtggagaacgggcaaagagaggaagcaaggccgggtgcggtggttcacacctgtaatcccaacactttgggaggccgaggtgggcagatcacgaggtcaggagatcgagaccatcctggctaacatggtgaaaccccgtctctactaaaaatacaaaaaattagctgggcgtggtggcaggcacctgtagtcccagctactcgggaggctgaggcagaagaatggcataaacccgggaggcggagcttgcagtgagccgagatcgcgccactgcactccagcctggatgacagagtgagactctgtctcaaaaaaaaaagcaaaagatgagttgggctctttttcagagatgatggattaaacaaatgtagctaattttactctctcctaaaacctcactaaagccaaaatgattttttttttttttgagatggagtctcgctctgtcgcccaggctggagtgcagtggcgcgatctaaaatgattttttttaaggtaaagatagaggcttgtccaaaggtagtgagttatctcaattgattgttcagtcagttacagattgaactccttgttctactctttacctacttctcactattgcacttgattagtctttctttcttcctttctttccttctcttctcttctttcttctctcctctcctctttgagaccgggtcttactcggtcccccaggctagagtgcagcggtacaatctcagctcactacagcttcaactgcctgggctcaagcaatactcccacctcagcttcctgagtagcttggtctacaaacatatgccaccacgcctggctaatttttgtatgttttgtagagacggaatttcaccatgttgcccaggctggtctcaaactcctgggctcaaaggatccttcccgcctcagcctcccaaaatgctaggattacaggcgtgagccaccatgcccagctgactaggctttaaaaaaaaaaaagatggagaaaataggaacggaaaccagagcatcattttggaaactggaagtcagtagtaattgactaagcaggtatgacacagctgagcttgaaacctgcaaaagggaaaacaatgaaatgatctgaggctcaggagctggcagcacccagtgcttctccagctgtggtagactggttaaataagaggaacatgtgaaaagcaccttctcagagcccctcactgcctctgggtaatggttcctgccctgctccaacagacatctggaggtttattatcttatttatctattttatttatgttttttttgagacagggtctctcactctgttgtccaggctggagtgcaggtgcagtggcgcagtctcggctcactgcaacctctgcctcctgggttcaaatgattctcgtgcctcaccctcccaagtaatcctcaactgggattacaagtgcccaccaccacgcccaggtaatttttgtatttttttttttttttttagtagagaggggtttcaccatgtcggccaggctggtctcgaactgctagcctcaagtgatccatccacctcagcctcacaatgtgctgggattacaggtgtgagttaccatacctgccattggaagtctattatctgaagagagtagactagaggatgtgatgggggctggcccagcacaggtgaggacctagatagtttaccagtaacaggggcatgaaatgactataactttcatgaatgctaaatactgagagccaaccccaaccccaaccccctcaaccccactcagctcccagaacttccatcttccaaaaaagagatcagaagactgctctggggaacatgaccaatccaaaaagaaataacttaaaatcctgaatcagatgtttctccgtacatggcctatccagatcaccgtagggtgaagctcaaagtcagcaagcctcacccacatactcagagcttcctttcagtgttgagaccttcttccctctgagcagatgacaaaggagtttgaaaccagcctggccaacatggtgaaaccccgtctctactaaaaacacaaaaattagctgaaatggtgactgtaatcccagctactcaggaggctgaggcaggagaatcacttgaatccgggaggcagaggttgcagtgagctgagatcgtgccatttcattccagcctgggcaacagagcaagccatcacagatttgggagcaaccaagaaagccagggacagggtatgcttggtaacctggcaagagctgacaaaggggaaaaataaaaccccacagaaagaagcagggaagtaagggaaagggactaataagagtcaagcagggccaggggtgttggctcatgcctgtaatcccagcactttgggaggccaaggtgggtggctcacgaggtcaggagatcgagaccatcctggctaacacggtgaaaccccaactctataaaaatacaaaaaattagccaggcgtggtggtacgcgcctgcagtcccagctactcgggaggctgaggcaggagaatcacttgaacctgggaggcagaggttgcagtgagatgagatcatgccactgcactccagcctgggtgacagagcgagactccatctccaaaaaaaaaaaaaaaagtcaagcacatgcaaatgtggcatgacttattgggagcagaaacattctgagaaaaattatataaaaatgaggttttagattgaaatggtctactaagtgcccaatgcaatgaatgaaaaatatatacattgaaacataacactgtgaaacttaagaatgctgaggacaaaaaatatgaaagcttctagagagagagagatctcaaagaggcaggcttcaaaatgacttcagattccttttttttttttttttttttttttttcagagacagggtcttgctctgttgtccaatacagtggcataaacaaggctcactgtaacctcaacctcccaggctcaagtgattctcccacctcagcctccccagtagttgggaccacaggggcacaccaccacgcccagctaatttttaaatttttttctagaggtgagatcttgccatattgcacaggctggtcttgaactcctgggttcaagttatcctcccaccttagcctcccaaagtgctgggattataggcatgagccactgcatcaagcccagctttcttttctttttttttttttttgagatggatttttgctcttgtcacccaggctggagtgcaatggcgtgatctcagctactgcaacctctgcctcctgggttcaagcgattctcctacctcagcttcccaagtagctgggactacaggtatgtgccaccattgctggctaatttttgtatttttagtagagacggggtttcaccacgttgaccaggctggtcatgaactcctgacctcaggtgatctgcccacctcagcctcccaaagtgctgggatgacaggcatgagccaccatgactggcccaagcccagatttcttaaaaagctagaaaaccatggaggaatgccttcagaattctgatggaaagttaatcccaacatagcagcctgctttcagcctaactggtattaaaatagaagggtagaggccgggtgcagtggctaacgcctgtaatcccagcactttgggaagccgaagcaggtggatcacctgagataaggagttcaagaccagcctggccaatgtggtggaaccccatctctattaaaaacacaaaaattagctgagcgtggtggcaggcacctataatcccagatacatgggaggctgaggcaggagaattgcttgaacctgggagatggagattgcagtgagccaagactgcgtcactgcactccagcctgggtgccaagagcgaaattccatctcaaaaaaaggtagaataaaaatctcagagaaagcaagacctcagaaaaaatattgtctttatattctttctgaggaagcttctggaggttgagtttcaccaaaaggtgggcatagacaggaaggaaaaagaaacagacaaatggttgcctaagggacacaggagagaggtgatcctgcacaccggtgtagagggcaacgaggccagtttggaacgggtttgaaaatttagggtgaaagacagtacagagtgccgtctccagagctatgcttctctctggagtgaacagatgggcccgggggaaggtaggaggcaggggaagcatcacatgtattgatgagacctacaatgatgatggtgcatggctgagcctgagcaatgggacaacgaaggcatgtgttctggctgggtgtgatggcacatgcctgtaaccccaacactttgggaagccgaggcaggtggatcacgtgagcccaggagtttgagatcagcctgggcaacatagaaaaccctgtctctacaaaaagtacaaaaaatagccgggtgtgctggttcacacctgtagtcccagctactctagagggggaggcgggaggatcatctgagcccaggcaggtcaaggctgcagtgagccatgattacgccattgaacctgggtgacagagtaagatgatgtctcaaaaagaaaaaaaaaatgtgttccttgcctggcacctctcctcactagcatcttgataagagccttctgattccctcacactgcaaggaataagaagatgaaatctaggctgggtgcgatggctcatgcctgtaatcccagcactttgggaaactgaggcggatggatcacttgagatcaggagtttgagaccagcctggccaacatggtgaaaccccgtctctactaaaaaaaatacaaaaattagccagacatggtagcacatgcctgtagtcccagctacttgagaggctgaggcaagagattagcttgaacctgggaggtgaaggttgcactgagctgatcgtgccactgcactccagcctgggcaatagagcgaaactgcctcaaaaaaaaagaaagaaatctgcctaaataagaggaattctatgaatacacacattcttgtagatgttcagagtatccctggaaggatacacaagaagctggtcttggtggtttctctgggaaagggacccaggtggtttggagaatgaggaagaagcctcgtggttcacttttttttctgttaaatctgcaccatgtgcaaaagacaaaaaagatcacctgtccccacccccacaaaaaataagtcagctattgcagtagcctaggctagcactaaggttatcgcagcaacagtggggggatttgagcaagactggagatagcagaaagccaacatgtgctcagtgccctcaaggtatttatactctagaagggggcacacgtgggaaaaatagattaaacgggggctcatcagagaaacactggactccactggactggccaagcagacaggagggaacccaccttcatgcacctgctcctttttttttttttttttttttggagatggagtcttactctgttgcccagggtggagtgcagtggcgtgatcccagctcactgcaaccttcgcctcccaggttcaagcaattctcctgcctcagcctcccgggtggctgggactacaggcattcgccaccacacctggctaattttttgtattttagtagagacagggtttcaccatgttggccaggctggtctcgagctcctgaactcaggcaatccaccctccttggcctcccaaagcgctaggattacaggcgtgagccaccgcgcccggccaccggctcctatttttatatcccactctggagctctggttcccgggcacttgctcttcacctctgactcagagcgtgaacctgacttcaccctcctacccaggtggccaagactaagcagcagattgaggagcagcgggtgcaggtgcaggtggtggagcgggcccagcaggtggcagtgcaggagcaggagatcgcccggcgggagaaggagctggaggcccgggtgcggaagccagcggaagcggagcgctacaagctggagcgcctagccgaggcagagaagtaaatgtcccctccctgaccctgcctagctcacttgccacctaggcaccccaagatggagtgctgaagccttcaccacctggactcctatggatttcaggtttcaggagcgtctgcctctgcagcactgggcctttctcctgggagtaagggctgctgggctccaccctccacttcccttctgtccacaggtcccaactaattatgcaggcggaggcagaagccgcgtctgtgcgggtgagttaagaggcagttccatgctggcttgtggagagggtgggggttgctgcttgatcggggatttcttgttcttaatgatttccgtcaatctcacaagcatccttaaccctcagatgcgtggggaagctgaggcctttgccataggggcccgagcccgagccgaggctgagcagatggccaagaaggcagaagccttccagctgtaccaagaggctgctcagctggacatgctgctagagaagctgccccaggtctggaggtcatgtgggcaccaagaaaggaggaaatagaaccagggactaaggggtggggtgtagtgaggggcttagggagaaacagcctagggggactctaaattaggggtgggaattattagtgaccaaagtgaggaaggatgatcagtggaacgaggaccttaaaacccagagtaagttgttttatgaggaatgtggtcagatcatgggcactgagtgggtgtctctctcctgccaggtggcagaggagatcagtggtcccttgacttcagccaataagatcacactggtgtccagcggcagtgggaccatgggggcagccaaagtgactggggaagtactggacattctaactcgcctgccagagagtgtggaaagactcacaggcgtgagcatctcccaggtgaggtctcaggttggagctgaggagaattgctaggttcctgtgttgtgtgacacagtatgcctagcatttaaccagcatccaggcctgggagtcattgatgtttattaatcactttctgtgtgccagacacagtgctaagcttctacataaatgagttgttttaaatcaaactaccattagggtatataggattttacaaagtccagaaactcaacatccagcatgttcctactcattctgctagtgcagctggagtgaaatccaggtcgactgtctctgcaacctgtgcttgtggtcaccccactagtatagggaactagttgcagcctattgacagttaattaattctagggcatatcactgcttttctcagcgccccagttaattcacctgtagatcatggtagaagtcagcaaacaggctctggaaccactgttttgttgcgaatcctagctacaatgcctgctagctgtaatcttggacaagtaatcaacctctctatacctgtttcctcatcttaaaattgggttaataattagaaactaccctgttgaattgttgaggggctcgagcaaatatttgcagtgtttagaatagtgcctggtatatagtaagcattatgtgtatgttaaagaaatggggccaggtgcagtggcttacgcctgtaatcccagcactttgggaggctgaggcaggcagatcacctgaggttaggagttggagaccagcctggccaacatggtgaaacaccatctttactaaaaatacaaaaaaaaattagccaggcttggtggtgcatgcctgtaatctcagctactcgggaagctgaggcaggagaattgctggaacccaggagccgaaggttgcagtgagctgagatcacaccactgcactccagcctgggtgacagaataagactctatctcaaaaaaaaaaaaaaattccaggcgcggtagctcatgcctgtaatcccagcactttgggaggctgaggcgggcggatcacgaggtcaggagattgagaccatcctggctaacacagtgaaaccccgtctctactaaaaatacaaaacagccgggcgtggcggtgtgtgcctgtagtcccagctgctggggaggctgaggcaggagaatggtgtgaacctgggaggcagagcttgcagtgagccgagatagcaccactgcactccatcctaggcaacagagcaagactctgtctcaaaaaaaaaaagagaaagaaatgcatattcgggctgggtgctgtggctcacacttgtaatcccagaactttgggaggccagggtggacgatcagctgaggtcagaagtttgagatcaccctggccaacatggtgataccccatctctaccaaaaatacaaaaattagctgggtatggtggcgcatacctgtaatcccagctactcgggaggctgaggcaggagaatcacttgaactcaggaggcggaggctgcagtaagccaagatcgcaccactgcattctagcctgggtgatagagtgagattccgtctcaaaaaaaaaaagaaaaaaaaaaagcgtatgtaaataaaagcactggatcataccaatgaccttcaagctgggttccttggagcctcctggaggcctgcagtagaatattcagagctaaggagagtgtgcaaacaaggctctgccccctctcctctcttcagtgatttattgtatgtgggtcctgatgtctttgtttggggaaacaggtggtagggcaccagaaagaaccctggccgtgtgtgttctgcctatagcccattcgtctaaactggggcccgggagagtaggggcctcagcctcccgaatgttcccaagtgtcatctactgttgtctttttgccaggtgaatcacaagcctttgagaacagcctgagccttcagccctcacagatgcccagcctcatagctgaagttgcctgaatgatcctcctgttgcatgtaacccactggcctccctgagcatgtccattgacagtgaggtcccacccctcatctctccttgccaaatagtttgtgccttgtcttgaagggggttgctccccttgccaacctcacactgctatgattgccaactccagcggtcccatgtcagccttctgatgatcccactccaccccacctcaacttatttaacttcctaattaaatcagactgtttgagcctgttgtctagaatattttcctgaccaagactgagggatgggctggaggttttcaactttgctacccaaataaattgctgtaagtaagtact

SEQ ID NO: 37048 - DNA, 16550 bp, Homo sapiens; identical to SEQ ID NO: 35593

SEQ ID NO: 37049 - DNA, 27607 bp, Homo sapiens; identical to SEQ ID NO: 36869

SEQ ID NO: 37050 - DNA, 9193 bp, Homo sapiens
acgttgcggccttcctcgcgtcacagccgggatggtgagtttcagagttaggggtattgcagtgggggtcctgggctgaggctggggcccaattccgagcactgacgttactgtcttgtccccacagaagccgatcctactgcagggccatgagcggtccattacgcagattaagtataaccgcgaaggagacctcctctttactgtggccaaggaccctgtgagtgttggctggagggggtccgggaggggcgggatccttctgccaggacgatgggtggacacgccagttttgccgttagcggggaaccaaagagcagcccattgtgagaagtagggagaggccatgccgggggtaggttggcgaaagtattctaccgggaaaggtggggaagaactctattggccgagtgcggtggctcacgcctgtaatcccagcactttgagaggccgaggtgggagggtcgcttgagcccaggagttggagaccagcctgagcaacgtagtaagacccatctctacacacaaaaaaattagcctgacatggtggcctcgcgcctgtggtctcagctacttcggagtctgaaacgagaggatcgcttgagcgcggtgagctgagatcgtgccactgcactccaagaaaagcaagagaccactgtggaaaggggataaagatgagggtcagcttgcccagagaacgggatgcgacctttagggataatctaatctttctaccaggataggtgcaggctgtgttattcagacacagggaacttaatgagggtgtctctagtctcattttaagtcaatcccatcctgctactcaatgccaaacaatccctcatgatactgccttttgaggcacctggccattttattttattttttcttgagacggagtctcgctctgtcgcctaggctggagtgcagtggcgcgatctcgactcactgcaacctctgcctcccaggttcaagcgattctcctgcctcaacctccctagtagctgggactacaggctcgtgccaccatgcccagctaattttttgtatctttagtagagatggggtttcaccatgttggacaggcttgtcttgaactcctgacctcaggtgatccgcctgcctcggcctcccaaagtgctaggattacaggcatgagtcaccacacccggcctggccattttcaagatgagaaaactgaagttcagaggagagaagcactgtatttgagatcatatagtgagacagtggcagagcaggcaccagaacccagacttccttactaccagctgctcccacttggataagacatcagagatactgtttttctggactggagctcaacttggccttttattctttggagccgttgggagtcccaggagagctggagctaacaaatgaggatgcctttacaagccgcctgactcctctgttgcttcccttcaggaagggaggagaatccaggagttggtctttttaccagctccctgctgtttcccaagaaataaacagaagagggcagaatcagccttgctacaggctgctgagggttcctggggcaaaataggaagccattgctcttactgggatgtgtactatcctgtggtttgacttttccagatcgtcaatgtatggtactctgtgaatggtgagaggctgggcacctacatgggccataccggagctgtgtggtgtgtggacgctgactgtatccttattttgggtctgagtccgtgttgctagggtctgtcagcgatggagaggctgagttgggagttgggagttgggggtgctgttgagggcctagagaacgatacctcctactccctggtctcttcactgactgaggaaacattcaggacaaattccagttctggataaggaggtaagaggggtagaaaggctctttggggctgaacagggagatgattcacttggcatcccaagaggacaagggctcgggtgaacttcgtcatatttcttaacaactcttcaggggacaccaagcatgtcctcactggctcagctgacaacagctgtcgtctctgggactgtgaaacaggtaagctgggttcattcacctttttagcaaatattgaggacctacagtgtacctgtttgagtaaacaggtcctaggaaaatagagatgaaatccatagatagtttccagtctagggaataagagacaagaaagatagatgagaaaatacacgccatggtagaggaagcatagattaagttttctttttttttttttttttctttttcttattttggagacagagtctcactgtcacccaggctggagagcaatggcactatctcggctcactgcaacctctgtctcccgggttcaagggattctcctgtctcagccagccccagtagctgggattataggcgcacgccaccatgcttggctgatttttttttttgagacagattctctcgctgtgtcacccaggctggagtgcagtggcacaatcttggcttactgcaacctccgcctcccaggttcaagtgattctcctgcctcagcctcccaaatagctgggattacagacatgcgccatcacacctggctaatttttgtatttttagtagagacagggtttcaccatgttggccagactggtctcaaactccagacctcaggtaatccacccacctcggccttccaaagtgctgggattacaggcatgagccactgcacctggccaccagctaatttttgtatttttagtagagacagggtttcaccatgttggccaggctggtctcgaactcctcagctcaagtgatccacccgccttggcctcccaaagtgctgagattacaggcacaagccactgtgcccagcctaagctgttctgtttagtgccaggtctatgctgggtactggggacatggagggaaatcagatcaggtctttgctgtggagaagcacagtctgagggagagacagatatattgcagtctacgtatgagtagtgccacattagcaggatgtctgaggaaagagtctaggtaagaagttaaaatacttggccaggtgtggtggctcacgcctgtaatcccagcactttgggaggttgaggcaggtggatcacctgaggtcaggagtgcaagaccagcctggccaacatggtgaaaccccgtctattaaaaatacaaaaatgagccaggcatggtggtgggcacctgtaatcccatcgactcaggaggctgaggcagaagaatcgcttgaaaggttgcagtgagccgagatcacaccatcgcacagcagcctgcaggacaagagcgaaactccatctcaaaaaaaaaaaggccgggcgcggtggctcacacctgtaatcccagcactttgggaggctgaggcgggcggatcacgggtcaggagatcaagaccatcctggctaacacggtgaaatcccgtctctactaaaaatacaaaaaattagcggggcatggtggcaggcgcctgtagtcccagctacttgggaggctgaggcaggagaatggcgtgaacccgggaggcggagcttgcagtgagagccgagattgcaccactgcactccagcctgggcaacagagtgaaactgtctcaaaaaagaaaaaaaaaaagaaaagttaaaatactttttaagtttgggtcactggagcaagacaaacagtgagatgtgatggtagcattctctagaatgtcctccctgcaattgcaatggatggtgtagcccagactttgcctgactccaggaaagcagctggcccttctcaagaccaattcggctgtccggacctgcggttttgactttgggggcaacatcatcatgttctccacggacaagcagatgggctaccagtgctttgtgagcttttttgacctgcgggatccgagccagattggtgagggctgggaatagggctggggttgaggtaaagggtacagttctagagcccagggcctaacatctactgccccacacagacaacaatgagccctacatgaagatcccttgcaatgactctaaaatcaccagtgctgtttggggacccctgggggagtgcatcatcgctggccatgagagtggagagctcaaccagtatagtgccaaggtaagaggccacatggggcctgagcctaccagaataatttttttttttttttttaagatagagtctctctctgttgcccaggctggagtgcagtggcgccatctcggctcactgcgacctccacctccctggttcaagcaattcccctgccttagcctcccgagtagctgggattacaggtgcatgccaccgcacctggctaattttttttgtatttttagtagagacagggtttcaccatgttggtcagtctggtcacgaactcctgacctcaggcagtccaccgctcgtggcttttttttttttttttttttttttttgagacagagtatcaccctgtcacccaggctggagtgcagtggtacgatctcggctcactgcaacctccacctcctgggttcaagccattctcctgcctcagcctcttgagtagctgggactataggcacctgccaccatgcctgggtaatttttgtatttttagtagagatggggtttctccatgttggccaggctggtcttgaatcctgacctcctgacctcagatgatccacctgcctcgggtcctggtgatagcacactagttcagaacaagggcagggctgtatgctgtggctcacatctgtaatcccagtgcctttgggggccaaggcaggaggatctcttgagcccaggggttggggctgcagtgagctatgattgcaccactgcactccagcctgggtgacagtgagaccctgtctctaaaaaaaaaaaaaaaaaaaaaaaagttaataaaaaattttaaaaagagcagaggtgagattcaaatgtagatttcaccactttctagctgtgtgatcttgggcaatttacatgacttctctgaccctgtttatctgtaaaatgtttcaaggatcaaatgatatcacatgtttgaaaaacttgtcacaaagtactcaggacatgttaataaggatcacaggccgggtgtggtgactcacacttgtaatcccaacactttgggaggctgtggcaggattgcttgagacccggagattgagatcagcctgggcaatataggaagaccctgtctctacaaaaaaaaattaaaaattagctgggtgtggtggagtgtgcctttggtcccaggtactcaggatgttgaggctgaaagattgcttgagtctgggagattgaggctgcagtgagccatgattgtgccactgtactccagcctgggtgatagaacaagaccctgtctcaaaaaaataattaaggatcacaaatgagcatttccttgccaccactgagtataatgccctgtataatgctgagtataatgctgaactcctagaacaaagaagtaaatcagatgcagtcccttcccccatggggagacagacttgcaaacagctagcacctgagtcagattgtgaattgtgccaccatagaggtctcagccaagtgtggaaggtgcactctcccagggaggtggcgtgtacattaaaccctggagaataaatggagcttcaagcaggaaggaaagaacatcccacaggcaaaaggaacagcaaaggcaaaggcacagagttaagaaagtatggagtcttcagaaacccttggggtgtggtcttggggacagaggacggggaatagattttaaacgtccttcagtgtgaggaggtaaagagttttgactttcctccaggcagtagggaatctttaaagggttatcaatggccagattttccttccaacagcttttgcagtttatgtttggagagtgaacctgaactagccaataggcataggatgtacattactggacagagtcaagggatatttaggggtgactgataggatagagggggtgaggaaaacacaaagtccatgctgtctcagctttcatttgggtgcttgggtttctggggagctgagattagtagggattgggcccattcagtgtcactcttcttccttccctagtctggagaggtgttggtgaatgttaaggagcactcccggcagatcaacgacatccagttatccagggacatgaccatgtttgtgaccgcgtccaaggacaacacagccaaggtgagcctgggcagcggtctggcagggctgctccctccctccggctgcacagctcaccctgcccgacttcccccaggaaagctctttacagatttcccccctgccttctctctccagctttttgactccacaactcttgaacatcagaagactttccggacagaacgtcctgtcaactcagctgccctctcccccaactatgaccatgtaagagaaccccacctgccttcctgctgaagcctcaggaagcttccaagttctagatgcttgtccagaagttgggctacaacattgtgggggaaatgatgtcaggcagagaggagatgcccagaggagtgacaaagctggaaggattgaatagccccagggcagccagcaggaggtggcagaagtgtctgatcatcccctacctttggtatcctcccattgagccgtgtgagatgttaaaaatgtatatggcagcagaaaaacacaaaatggacttggtgtccattggtcccatctagagtttcttcttccattcaggtggtcctgggcggtggtcaggaagccatggatgtaaccacaacctccaccaggattggcaagtttgaggccaggtaaagaagaagagagctcttccaaattaaaatctcatgtggtgtaccttttttgtttgtttttgtttttgagatggagtctcgctctgtcgcctaggctggagcgcagtggcgtgatctctgctcactgcaagctctgcctcccgggttgacgccattctcctgcctcagcggcccaggcgcccaccaccatgcctggctaattttctttttgtatttttagtagagacggggtttcaccgtgttagcaaggatggtctcgatctcctgacctcgtgatacgcccgcctcagcctcccaaagtgctgggattacaggcatgagccaccgtgcccagcctttttttttttttttttttttgacacggagtcttgctctgtcacccaggctggagtgcaatggcgcgatctctgctcactgcaacctctgcttcccgggttcaagcaattatcctgcctctgcctcctgggtggctgggattacaggcacccatgaccacgcctggctaatttttgtatttttagtagagacaggatttcaccatgtttgccaggctggtcttgaactcctggccttaagtaatccgcccaccttggccttccagagtgctgggattacaggcatgagccactgtgcccagccttcattatatttctctatgtctaaatttcctctactgtataatgagacaatgacaatatacttaacataaaattatgcagattaaattattcagttaatatttattaagctctttaagcactgcccagcacatagtaggcactctataagtattagttatgtattcaggcagacatctgggtccagtcttccccatataataaaaaagttaaaaaagtaagagacagggtctcactatgttgcccaggctggcctcgaactcctgggctcaagcaatcctctgtcctcagcctcccaaagtgctgggattacaggcgtgaaccatggcacgcagccaccaatttccatcttattttgttcacattcacttcttatctcaatttttctgctttattattattattttttgagacagggtctcactctgttgcccaggctggagtgcagtggcaccatctctgctcaccgcaacctcctgggctcaagcgatccttctacctcagcttctgagtagctgggattacaggtacatggccaccgtccctggctgctttttgtatttttagtagagatgttggccaggctggtctcaaactcctggcctcaagtgatccacccgcctcggcctcccaaagtgttgggattacaggcgtgagccactgcgcctcggcttctgctttattttttgtgatacaatttgcatttgaggccaggtgtggtggctcatgcctgtaatcccagcacattgggaggctaaggaaggcggcttgaggccaggagttcgtaaccagcctggccaacatggtgaaaccccatctctactaaaaatacaaaaattagccaggcatctgtaatcccaaccactcaggaggctgaggcaggagaattgcttgaacccaggagggggaggttccagtgaaccgagattgcgccactgtactccaccctgggtgacagagtaagactccatctcaaaataaataaataataataacaatttgcatttggggagtgccacctccaaagtgttttggaagaagatagaaagtgaattaattgtgtcccttttcctccaggttcttccatttggcctttgaagaagagtttggaagagtcaagggtcactttggacctatcaacagtgttgccttccatcctgatggcaagaggtagggtaccagtgaagcagctgacctaagcctgggttgggtctctgcctttcccagagtaagcacctgactggtgcctggctatctttttccagctacagcagcggcggcgaagatggttacgtccgtatccattacttcgacccacagtacttcgaatttgagtttgaggcttaagaagctggatctcctgccgggcgtggtggctcatgcctgtaatcccaccactttttttttaaggcaggcggatcacctgaggtcaggagtttaagaccagcctgaccaacatggagaaacctcgtctctactaaaaatacaaaaattagccaggcatggtggcacacgcctatagtcccagctactcaggaggctgaggcaggagaatcacttgaacccaggaggcagaggttgcagtgagctgagatcacgtcattgcactccatcctgagccacaagagcaaaactccgtctcaaaaaaaaaaaagaagaaggtggatctccaaccaggccagagaagattctcacagaaggttttgaactctaagaaataaattggtttggtaataaatggcttctggtcagat

SEQ ID NO: 37051 - DNA, 16211 bp, Homo sapiens
gacgcttcagaggatccttaggcctcagtggtctttgacccccggccccaggacctgaccccaaggaaacctccgggacctgtggctggagaggtgaccgccaggcatccggggagcctttggagatctcggcttcctttttcccccgctgcttgccggcgtgtcctcgggtggacgcgggcagcccgaaggggagtttacagacgctccctcacatcggggacgcggctcctttaagggcgtaggtgtccagggcgccgcctgactggaaagtcgccccccggccgggctcctggggcggacccggggcgcgggcgcgcggcggcggggcgcgggcaacggggagcgctcggcggcgcgggaggcgctcggggccgggcggcaggagcggcgcgcgaggcaggcgtgcagagggcagccccgcgttaggccccgccccgcgcgccccgcccgcgccagggtcctcggagctgctctggctgcgcgcggagcgggctccggagggaagtcccgagacaaagggaagcgccgccgccgccgccccgctcggtcctccacctgtccgctacgctcgccggggctgcggccgcccgaggtgagcgcgtgcgggggccgggccggggccgcggggcgggggtcgggccgaggcctctactcctgttgggcccgggcccccgactgccccgcgccccgccccgccgagccgggccccgcgccgcggccgagctttccggggagcccgagaggccccgcgctcggcgccggctcggtccgcgctgctggcgccgctgggctgcggcccgagcggccgggccgccgcaggccttcggggccggggctcccccacttcgcccccgaggtgcgcctggcgcggggccggggcagccacctgcagccggggccccgcgaggccgcgccttcctcctgcgcggggagcggcttccggggtcacggtcgccccgcggacggataggatgggccgcggggggagagtcttggattgcaacatcgctggctcgcgggggtgggggccggcgagcgggcttgttttcggtgccttaaaaccaaaacaagtgtaagttttcttgtgcctctgaagatgctccgctggcgcttgctggggccctgaacgtgagcgcctcgctggagggggagttttattctgttttggacatctctttttatcggttgaatagtagttggttctggtagttaacgtgcgtaggaggaatgtaagggaatgattagttgggcttgtgatcgtggcctgtagtcacgcttgaatcgcagaatgaagtggttttgtttgtataattggaagttacgcttagtttctctgtttgcaaagtgcctgtctttggggagttcggtttgtttccttttacaggacctaccccaagtgtttcttgctcttcaagaaacgttgcctttgggtagagaacctatgcaacggaagacgggacggatcctcagtttgccctgattgctcattcagagaggtccgttccctaggccactgggtgattgctggtgtgcgcttgtatggtgtctcagggtttgggatcttgcttcagaaacattctcggggcctggggcagatcaggtgcggccaggtaagcgtctcccgactgcaggtgcttgggtcttgcagaagggaatacctccccaagcctgggagagtttgcatttgggtgcaggagggcctttaaaggcttcttgtgccagcctgtcgtggcgaccacccgttgtggagatcagtgcggtggagttgtgggaggtgagtgctttgctcaccctcagccaggaagttgctctgaagtcggtgctgtcaaccagcagagcaaggcggtgatccgagaagctaaagctcagccggttgcgggcgcccagcaggaggacagaaggcagactttcgggccgctcctggagtgcccggccctgtccccgtttctgcagtgtctgggccttgcctggctctaatagatgagggttgtttttgtctttgcatcataaaagtttcttgctctgaagcgtttagtaactactagccgttcactaagtgcctatctgtgaatttggaagggcaaattcgattttcagcggaattttgaacgcttgatctgtgttgtgattacattgtaacagattggccgctttctccagaaggccagtaggagggggtgcagggggaggggcctggcttctgtctgggacacggtgggtgtgcacctgtggctccttgccctggcggtgcagtgcctgtgagaccaccccgtggtgctgagtgctttggggcaggggacacagcagcagcagccaggtcttggcaggaggtctcgcaggaccacccctcacgacttctcacacctgagacagcaatagctaggtgctgggacgggggcctctaggcggctctgtccagtcctcagcaggagggctgcctgtggcagggtcccaggcccgtctggcctctctgtggcctggccttgcctggctgtgaggatagccttgcccatggtccttcagtgtctggagcactggcctgaggcttcagagacttgcctgatgcctggcctcgctcagaccccgggcacctgggaggtcgtgcctccttgaaatggccactcgccaggctgctttgcaccgcaccgggcacaggctgcggccactcaggaagcccatcctggggctggggaagcgagagctgtgagtcctcaagtcgcagctgggctgctccacgtgggagtggagggtggaggaacgtgtggagtttcggagtccagcccagtgcggagacagccttgaaaccgtggttggcgggcgctccactccgctctgggctcgaaccctgcctgaccatagctgtgccccccactttctccctgtctggcccctggctccccccccctcacttagaggagggcacggggaagggcaaacggtccagagggcgggcggcctgcgggctcctctgcatcatgtgaggagggcgtggggaaggacatcccggtggggcccggtctggggctgcctccagcccgggctgcctgtcttggacttagtcgtggacctggaggccagtgcccggctggcccctgtcaccctctcgctgtgacgccagcgcctgctgactggaggacccaggttccttcgcctgctttttctcaggctgccctgaggatctgtgtttggtgaaaaggagccaaattcacctgcagggcaggcggctctagcagcttcagaagcctggtgccctggcgacactggacctgccttggcttctttgatcccaaccccacccccgatttctgctctgctgactggggaagtcatcgtgccacccagaacctgagtgcgggcctctcagagctccttcgtccgtgggtctgccggggactgggccttgtctccctaacgagtgccaggtgaggctgcggcggctccgacgcaggtggagctgctgacctggcccctttctgcggctgcgaggtgtgtgaggttcgtgggcctccacaggtgtgggagccatccaggtccccagggcccttgtggctattctaggacagcccaagccgtagtagggacggccccccacagcttagaagacctggctcagtcccccagctttgtagaggtggctcttgtttggtgttgagatatcagacttgggggtagtagcttcagtgttcccatggactttgaaaaccagcacacacttaggtttgaattcttgggcaagttttgtatcttgagcgctgtttttcgtgggtaaaggtggccaccagtagggtgacagttgagggtggcattgaggctgctggccctgtctgcctggtgtccccagtgacagtgctggccgacaggctcccgccgagaacgcaaaggcgaaggtgccaagcccccgaggtcccgtgcagatgtgtggagctggaatctggcgtgtgtgccgctgcctctgatcagggacctggtcccctaccccatgctcctgccctgccctgcaggacccgtctgtcccctgaagccacagggacgtggtagtggctgcacggtctgggaagggtgtccccgtggagggctcctctctcagtgaggctgagcctctgccctgtggtacttgttctgctctgtcttcaacatggtgaaaccctatctctactaaaaatacaaaaattagctgggcgtggtggcacacgcctgtagtctcagctactcgggaggctgaggcaggagaattgcttgaactcaggaggcggaggttgcagtgagccgagatcgtgccactgcattccagcctgagcaatagaatgagactctgtctcaaaaaaaaaaaaaaaaaaaaaaaaaaagaataacaggtgtcccctggcccagcctgagtctcagttctgagcgcctgatactaaggcagggacccagcaccccacatccatctggggccccagccctgcctagtccccacctgatggtatggtgaggaccctgccatgtcagccaccacagggtggcagctaccccccagccgcagcggcccagcctctgaacatctgtctcctcaccttcgagcagaggccgcagcatgtgtcgcagaccagggctgggttggggccatggggaggggtcctacctgcccccgcctcccggtgatctgggcgccgctcacaaggcctcccctggtagacccccggggtcggacgacggcttgcaagaagagagtccctgctgggccaggccaccgtatgttaggagcaagcctgcctgctgcgggccacgtgcgcgtgctggggtggcaggagcccgctcgcctctcctgaccccgtgctctgcctcctgtgttccagggactttgaacatgtcggggatcgccctcagcagactcgcccaggagaggaaagcatggaggaaagaccacccatttgtaaggagggcttcatttctgtgtgcagtgccgcggacaggctccctcggctgaaaccgcgccctccctactgggagggagctggtcgcgtgcctgggctgggccggtgggactcgcaggccggttcttggtggttttgctcaaactagatgccgccacgctgatatgcttttgtggttgttttcttttctctcagggtttcgtggctgtcccaacaaaaaatcccgatggcacgatgaacctcatgaactgggagtgcgccattccaggaaagaaaggggtaaggggcgctgccggcctcctgcctgtcggggctcagcagatgcgtgcggcagtgccatggggatactccgctcagatccctgccgtccgtgacggccacccttgtcacaggccgcggtcaacagctcagatccccagctgtggcctggcccccgccccgtgaggacttgagctcagaaggtggtgctggcaaggttggggtgacagctgtgtccctaccgagggcatttctggttgagaaggaagcaggctgggcctggccgggcacagggctgagctgtggcagaggggaaggggctctgatgtgtgttgggagcaggcctgaggggcgggcagcctttgcgtgctggaacccgggattctgctgtgtccttccaggtgtggctcaggtcgcgggagctgggtttgcaggagagccaccccggcctaaaaccgtctactggagaacctcctggggcacagggactggcggcagccacctaggatgcctgcttggggccccgtgtgtctgtggcaagcagggcggcccatgtgcctgtcctctttgcccggctcacatgaagtgcttggccagggactccaggccggcttgcacataaggttcatgctcgtggactctgaaggaaggagagatccctgaggtgttggtcctgcccgaggccttgttccctccggcccatgccagcctctgggtttcgctctgaaactcacagcagctccggccccctgagctgagcagtcccagcaggactcagctttgcccgagacaggatgtggcttggatttgtcacttgtctgaggctctgctgagaacgtcccttgcccttcacattacggcgaggcaggtgcgcgcgcggccccaaggaagacgggagtggtgtcgggttgtggggtggcaaaggcgcctcatccaggcgggacctggggcaggggcttgcagaacaccctggggtgagggcacgggtgtgctcttggcgctgccggccccagtgtgcggcactcgttgccccccagcccagcccccgacccccgtctcctcctctcctttccaggagggcctttccgactcactctctgggcatggcagaggtcctgaccgcccccttggtggggctggtccaggcttcaggctggtatgggagccgcctctgtcgggcctctggcccccggtgtcctcgcagtcctggaggttgtgtcctagaagcgatccccttcctcctgggccggcctgcggcaggcaagcagcccatctcaccacggtttatttccccacagactccgtgggaaggaggcttgtttaaactacggatgcttttcaaagatgattatccatcttcgccaccaaaatgtaagtagctccctgttcagtgtcctggaagtcggcctgttcctgcggggattggagtcctctccaaagaggcccgtggctgtggccgtggcgccctggtccgggcgatccatggagctgggagggagtgagatcacagatttggaggtcggctttgatccctgatccccgcctcaggctgcagatgcgagtctgtttccagctccacgggtgggcggtgcacgtaatagacttagtctctcatcccagctaattggctgggaagctccagagtcctttgcagggagaggctgtgagatccaggctggagctcctgggctaggagtgcctggaccctcagtgattgttggcgatgaagacaggatttggtgcccacaagaccccagccctggatgggatggacgtgcagaagcgccaccactccgagtctcactggagggtttatcttgccccacctcactgctcttcctgtgggctctcgcagtctctcccacccggggctgcgtctgcagccgggcaggcatagagcaggggagcagcagagaaggcgcgagaagaaagggctgaggccaggttcgactttgagcctacagctaagttagtgatctcagtcagttcagcaaaactcaggagagggaggagagggccgccacgtccctgccgtcccatagctggaaatcggcaggccctttctgtggtgagttccacgcattaacacgtgcccagcacctagacagcgcctggccacggtgaggcgagagtgctgtgtaaaagcttccactgcaattgtcactcaagacacacaagtgttttccacagtggcagtgaccagaggagcttgaggactgctgacagcaccagctggtcgagacttgcttcatttttggattgtcctttgctgtttgattttttttttaaaccatgagcaggtattacttaagatgacttattttaattaagaaaaatataagaatgagacacagtagctgctttcattgattctgttcaaccgttgattggaattccaagcaaatgcagcaagacaagaaaaagaagtcacaacggaagaggtggggaggaaggccaggacaacagctcagtaaagctgaggtgcaaggctgggcacggtggctcacacctggaatcccagcacttttggaggccgaggtgggaggatcacctgaggtgaagaccagcctggacaacatggtgaaaccctgtctctactaaaaaaaacaaacaaacaaacaaaaattagcgggtgtggtggtgggtgcctttaatcccagctgctcgggaggctgaggcaggagaagtgcttgaatccaggaggcgggtccagtgagccgagatcgcgccactacactccagcctgggcagcagggcaagaccctgtctcaaaaaaaaaaaaagaaaagaaaagtagcacaggacctggtaaaggaaacaaagctaaataataaatataaaaatgaagtcgagattgaggtacacaaatctgcttttatatcatttcagcgagcaaggttttaaaactgccatttatagtagcatgaaatacgttggaataaatgcaataaaagattggttcaggacctctgtaccgaaaactgtagaatattgcaagggaaaccaaggccggcctgagcggtagctgagctctgccgtgtgtgtggaggggaacacacgacattgtacagacagcccttctctccaggctcgtctgcagattccatgtgatcccagttggagtcaagcacatcttgttggaaactgtcccatggacccaggaaatgcagaaacgtggaggccttggcttcttggtggggtggcgagacccaggctgaggctccgtgggtgcagagcacacccacccaccccccactagacctgccacgggacacggtgatggagactgcaggcttgctgagaagacaggcaggcagacccgcggacagaacgaggagtccggaggccacgcatgtggtggtttgggctgtgacacctgagggatattccagcaggagagacgagctctgcctcccaccatagagaaacagcttccagatggcttgtggtgcccaagcaggacagcgtggagaggaagacccgggatggtgtccgtgagccctgggcaggcagggatctcttcaccagggatgcagtgaagtgctggccggagggagattgacgagttgactaagttgaaattaagaatctctctttatcataaagactgcagttggcgccgggcaggagggcacactacagtgtatgtacgtacctcagccctcaccctgaatctaccaagagctcctgggaatcagtaagaaggctgccatgacgtccagcgtgtccctcacaggaaaggcctccacccagccagcaaatgcggcagggatgcctggctttgccaaagagtgaaagcctccccagtgggatctgccgtagcgcacaggggagcagacggagccgcggcgcagggcagcgggagcctcagccaccgctggagagagcggatgttctgaacgtttcccctggacgctgcctgccacaccagtggaagctgagctcatgctgtaggacctggctgttcacttgagtcagtcgagattcacagaagcacatacatgtgtccaccagaggcacagatgggtgccggtgtcacccccacttgccccagcccagacgtcctaggatgacaggtagggaagagtgaagaggccacatgatgcctggcggacagtccagacaggagggcaccccctttgtgttccttctttgaagcgcgggagcggccaagccggaggccatgaggaagtaggaggcagcctctaccttgggagggacaggtggacctggcagtgctggcatccagcatctgtgcctttctgcgggtaagttgtgatcggcagaagaaacgagattgagaatcagattaaattgaaattaggcaatttttgtttttgccaaaagattcccttagaagaggaaaaggtcgggccgggcgcgttggctcacacctgtgatcccagcactttgggaggccaaggcaagtgaatcacttaaggtcaggagtttgagaccagcctgaccaacagtggaggaaccccggttctaataaaatagaaaaattggccaagcttgatggcgggtgcctgtaacctcagctactctggaggccaaggtgaggcgggagaatcacttgagcccgggaggtgaaggctgcagtgagccgagatccagcctgggcaccacagtgaaactccatctcaaaaaattaaaaaagcaaaaagtcaagccccaagcagaagagccctgtaagacgtatcgcttgaggaacttctgcgaagcagtcgccaggaagcagcctgggccgaaaggggcgctcagcggtcaccagcaggcgcagcgtagcaccacggagtggctgccgtgcacctcacccggtggctggaatccgccagcgacgcagcctgcgtgagcagcctggaagcagcacggcttgagggccaacaccgtcaccccacattccacagcagcgcgctcacgcgtgttcgcactcaggacagccacgcagctgctggtgtcgcccgtgtgctcctgcggtgtgggatggtcgcggtgtgggacggtctgcggtggtgtcttcgcgttccccagggagtgtgccctgtgcatctccatggtacctgaagtccaggaagctgcctgcggatgttgcagttgggattacggggcagatgcagtggtcggtaggagcgagtgttcggggaagctgtaggtgttcgtggcgcgttggctttctggtaattcctccggctgcactagacatgccgcactgtgtgtccttccgtagcattgagagagaagagggaggatgcccaggtaaaagatgggaaatagcctagaatatcaactgtgatggtccctggtggggctaatggtggcaaacttttctgcttttttgtaaagaaataacacagggtcctaaaagcccgtatatcctggaagcagagggtctgcgtcggaacagccgactctggaagggcgttggctatgtccctggacgtctcctgcagctcctcccatctcccctgagtctggcccagctggaaaggatgtgggggccacaggttaagtggccaccctggggcctgtgttcccagactgcctggctgtgctgggagttctgtcctgggagagacacagcttcgtctcggctgcggccgtgtccccaaggctctgttccctgtgtgcaaaggtggatatgtcttcctttagtctcctcatggccacaatttaatttttttgaaaagtttttggccaaataacctggctaccaacccggggccccagtgttgggaggagggtgatgtggggaaggacgtgactctgggacagtgcctgcctccaaaaagtgcttcctttcttcctcttcctccaggtaaattcgaaccaccattatttcacccgaatgtgtacccttcggggacagtgtgcctgtccatcttagaggaggacaaggactggaggccagccatcacaatcaaacaggtacggggcctccgcctctggcaccggcagggctgccttagtctcccctccggacacgtgggtctgtggtcattctctgtggctgaggccgagtctcacggtgtctccctttcaaactgctcacacccgtcttgtgtttttgtctctggcacagatcctattaggaatacaggaacttctaaatgaaccaaatatccaagacccagctcaagcagaggcctacacgatttactggttagtagcagccctggccccgctggtggcagctcctccccgtcccagccaaggccgcctggcaggacgggagtggaggacacaggctcaccctacggacagccagggtccacgcctctgtggggaaggtcggggggcataaaccctgtgggcagcaggcaccgttgcacaccgtctgcggtgggcatggatggcgccggagccgtgtcccggggagggagcaggccaggtgacgggctgtcttgggccactgccccagtgagttgtggccagctaggaggggaaggaccctgggcgtgggtgccagaggaggccatgctgagaggcctctccaccggctcagcctcccatggaccccagcctcccgcgccgcccttgctgcttgtccccatcccctctacaacttggttccttctgtgggggggcccagcccagcagggctcagtgacgtgatgctgtcacacggaccctgggcttccaccctgtccctgtgaggtgctgctgtggctagaagggtccccgtgggcctggggtcctgtctgcaccgaggagggcctggtgtgagttaggatgcagacgacagccaaacagtgctggggaaagcagggaggaccctgccctgagcagaggccatgcgcccgcctgtcctgttccctctgcagctgttctgggcaggtccataagaaggtgggttggggcctccgaccccccactgctccgcctgcagcgttgagaaacccagccccatctcaccacgggtccccacacctctgagggggtctcagggcccccaatggccagggacccagaaggctcacctgcagccaccccacacatccctgccactgtgggcatcagaggccctctccctccagggtgcatctcctggtcaggaggggggaggctgaggggtcccggttgccttaggcccggcctgcacaggtcgtgaggaaaagcacctggtttcggccgggcgcagtggctcacgcttgtaatcccagcactttgggaggccgaggtgggtgaatcatgcggtcaggagttcgagaccagcctggccaacatggcgaaaccctcgtccctactaaaaatacaaaaaattagttgggcgtagtggtgggtgcctctaatcccagctacctgggaggctgagacaggagaatcacttgaacccgggaggcggaagttgcagtgagccgagatcctgccactgctctccagcctggcgacggaggaatgctgtctcaaaaaaaaaaaaagcacgtggttttggagagatgtgtttctccctggatgcgggcccagcccaggtgtctgcaaggtgccctccctggtggccgagggtggcacagaggccccaggcagggagcaagtatcacagcagccaccccaggctcagcctggctcccctgcatggtggtgcacacctgtagtcccagctatttgggaggctgaggtgggaggactgcttgagcccaggaggttgatgcgcagtgagttgagattgcagcaccgcaatccagcctgcttgacaaagcgagaccctgtctcaaaaaaaaaaaaaaactcatagccgctcagtcagccaagccattgctggaagtggctcgtgggacgtggcgtgacctgggtttgtgtgctggcctgctgtgccctaggagtccgtgaaatgcattcccttggacaggaagccacagtgctcgtgggtgtccacatggcccttgaggcagaaaatgttttcttttttttttttttttttttttttaaacagagtctcactctgtcgcccaggctggagtgcagtggtgtgatctcagctcactacaacctctgcctcctgggttcaagtgattctcctgcctcagcctcccaagtagctgggattacaggcacccaccaccacacctgactaatttttgtatttttagtaaagacagtgtttcaccacgttggccaggctggtctcgaacttctgacctcaggtgatccacccgcctcgcctcccaaagtgccgggattataggcatgagccaccgtgcctggaaaatgatttctaggccaagtgtggtggcccaacacctgtaatctcaacactttgggaggccaaggtgggctgattgcttgaactcaggagttcatgactagactgggcaacatagcgagaccctatctctacaaaaaattaaaaaatttgccaggggtggtggctcatgcctgtaatcccagcactttgcaaggccactgtgggacgttacctgagcccaggagttggagaccagcctgggccacatggcaagacctgctctctttaaaaaaaaaaaaaaaaaaaaaattaagccggggatgatggtgcatgcctgtagtcccagctatttgggaggctgaggtgggaggactgcttgagcccaggtggttgatgctgcagtgagccaagattgcagcctgggtgacaaagtgagaccctgtctcaaaaaaaaaaaaaaaagcatgccgggcgcggtggctcacgcctgtaatcccagcactttgggaggccaaggtgggcagatcacgaggtcaggagattgagaccatcctggctaacacggtgaaaccccatctctagtaaaaataaaaaaaattagccgggcgtggtggcgcacacctgtaaccccagctactcgggaggctgaggcaggagaatggcttgaacctgggaggcggagcttacagtgagccgagatcacgccactgcactccagcctgggcaacagagccagactctgtctcaaaaaaacaaaacaaaaggcaaatgttttcctgcctagcccttagatggtctgccatccccagcatggtgtgggcgtgagctctgtctggcctgcaccccatttgccgaccatctccagagctgggctgtggctcccatctgcggcgtgggctgggcagggttgcagtcccccgccccgtgtgactctccccagcgtctcctgggcttggtgcctgctgggctgcactgtacacttgcgtgcacgtaaacaaacgttctttctcctacacacatccgcttgaaaagcaccctttgtgaagcatgtgtgcgggtttcagatcgtttttcctgggtttcctggaggccttggaccgtgttcctgccctggcaggtgccttttctcggggcctctgcttggtcaaggaagagctgggacgtgtagccaccgcctctggttccttccacgcccacccagctgagctgctctgccctggggccggctggtggcccaaggagggcgctggggtctgggctgcggtccaggcccttggcgtgggtgggggtggcaccggcgctgctgccgtcctgggctgttccaccatgcagagtgaggctcagtgtctcagaccaggtccaatcctggcgagactggcaggactgcgaccccaggagccacctccataaatgtcatggtgttcccccatcctcagggtcacactgcaccctgtgacccatcagcccctaggtgcagcctcggccgccctcccgcccacctgttttgcccgggcagtgtgtgccatgccactctcctgggcagctgcttgcaggctgagcctcactctacccagctccagacctgttcgctgatgcccctgcactgcccagctcgggcacaacgccttctcaaccaggcctgccttcccacacctttgcccctgcggctgagagcctcatggaaaaaccctccagaaattggtgtctatttttgggaattaacaaaaacagtggcaagcagtcagtgttttcagtttattaggactgtccccagacctacagaaaagagaagctgctgattactagttaggaccagacttggcatcggcaacgatgttgcaggccctggcgtgggccctctgggcctgagccctcctcgcagccctgcgggacccctctgtcccccttgaacaccacgttcacccagcgtgggttcctctcctccctgcccttctgcccccgtcagaccacgggacagtctcagccacgtcagagccagcatgggctccccaccacgcaggcctccctgcttctccgggcttctgcttctgttactatgacgagctccacactgccctcccccaggaggtcccatcctgcagcctggtctgcccagctggctccggggcgagcgtgagggccaggcagctcagccctctaacacgtctcttctcttttgacctcctcagccaaaacagagtggagtacgagaaaagggtccgagcacaagccaagaagtttgcgccctcataagcagcgaccttgtggcatcgtcaaaaggaagggattggtttggcaagaacttgtttacaacatttttgcaaatctaaagttgctccatacaatgactagtcacctgggggggttgggcgggcgccatcttccattgccgccgcgggtgtgcggtctcgattcgctgaattgcccgtttccatacagggtctcttccttcggtcttttgtatttttgattgttatgtaaaactcgcttttattttaatattgatgtcagtatttcaactgctgtaaaattataaacttttatacttgggtaagtcccccaggggcgagttcctcgctctgggatgcaggcatgcttctcaccgtgcagagctgcacttggcctcagctggctgtatggaaatgcaccctccctcctgccgctcctctctagaaccttctagaacctgggctgtgctgcttttgagcctcagaccccaggtcagcatctcggttctgcgccacttcctttgtgtttatatggcgttttgtctgtgttgctgtttagagtaaataaactgtttatataaaggttttggttgcattattatcattgaaagtgagaggagg

SEQ ID NO: 37052 - DNA, 62743 bp, Homo sapiens; identical to SEQ ID NO: 36892

SEQ ID NO: 37053 - DNA, 11481 bp, Homo sapiens
atggtttatcaccggaatggaaaggaggaaacggggagtgggggaaagggcgaagccaccagaagcagctgcggcattttgctgactattcgcccatggagccggtttgccatccagtgatgccagagtcccggcgcgacagaaagcaggactcccaagatcttcctcctgctgcattttaggcactgaaccccaatcccgaccgtatgttaacactgaattctgagtaggagttttgttttggcagtgtgacgactgcgcatgctcggaaaggggacgcaagtccgagatcccaaacgcggtacagaccaaaccgcagtccacgttacggatcggcttactccgcggagttggcctcatttctgcagtcggcgctccctgtagtttctcctctcgaacgccaggtggagcaaccggccggataccgccacagccctggcaggcggcgctgtgatgcctgagctgatcctgtatgttgcaatcactctatccgtggctgagcgactcgttggcccgggtcacgcatgcgctgagccttcctttcgctcttcccgctgctccgcccctctctgtcttctctgcagtgggagcaggtaaggccttgggacctagagccctctgtgcgctgcgcacgcgcgcgggacacctcaccttgcgcggatgctttgaggcgcttaccttgcgtgctcccaccctggtcctctcgccctttcttgcttccgctatcccttagccttagagttggctcttccgcgtgccggtgacctccaaccgcgcgggcctggcgccatcttggatgtctcgcagggggaggataccttggagctggccaaagttagatcctggagtgctgcttttcacctgttccacccagtccctgcaaacactcttttctcgccctctggccctttcagattgtgacaacccccaggctctcccctcctatctctgctttctcttctcatcctgacttgtgccttctttattctgaaatctccagactttaggccccagaacctcaggtgctccgagcaatggagatagtggatcgtctaaagtcaccaatccctctagtcagcacccctcaatttaaaaagtaaaccttgaacatggtagaagtgggaaaaaaagccaaaacatcgcctcccgttaggttgtggcttgggatagctaaggcagaagagagaggctggttgctttggaatcactagttatttaccagtacctttctcgcatcccggcacgctggtgaagttgtaaaagtcacaaatggtgggctagagatgagggtttctgttgaggcagcaggcccagaaaggtggggtaaggccaagctagtggggccagcatgagaccctgcctgccagctttcctgtgaaggattaattaacctccccagattctgctgttacaaggaaaagaaggtttaaggaaaggaatagttaagttactacccctgtgactcatctacactgaggaaaaagcccgtgatgattttggagtcctgattctggatagtgcctttgcccaagttgtaggctaacaattgcagagttgccatggttagatagccaatggtgggatcacttaattgccaccccttgttgtgggtttattatatgccagcaccacattaaactctttatgtatgttaatttgtaaatgaacatacttaatccccctaagagctgcattttacaaagaagataataaggtataattcccttagaaaagaaccaccccttctttttctaaaagccttaaagaactattggattttgacccaagaaaacctgaatagtacggcagcaaaattgggttagagttacatataggcaaaaatcagagttctagataggacaagagttgaagacatccattaacttaaaagtaattaaggctgggtgtggtggctcacacctgtaatcccaacactgggaggccaaggtgggaagatcttttgatgccaggagttccacaatagcctgggcaaaaaataaattaagagcaattaagatgttggattcagaagtgttttaacctgggacaatctgagttcagttcatttaatgaagtggtatttaatagccctaagcattcactgagtatttcagcctgtgacatattagaaagcatgtaacttaaaagatccaagttcaagtctatcctctaccactaccacagtttcaagactgggtttagggtcacgctcttgcgttaagtatacctaataatcatctgggaaacttgtttgaaatacagggcacttgagccttattcccagagatcttttttgtttgtttatagacagggtttcacgttgttgcccatactggacaactggcgtgatcatagctcactgaagcctccagctcctgggttcaagcagtcctcctgcctcagcttctggagtagctgggactacaggtgcacttccacctcacctggctaattttatgttttgtagagatgaggtcttgatgtttgcccaggctggtctcaaactcctggcttcaagttatctttccgccccagcttctcagtgttgggattacaggaatgagccactgaacctagctcccccagagatcttgaccaggaaggtccaagttgcgcccaagaatatgcattttttaatacgtacaccacccagataattctagttcagatgggcttctcacttcacttggagaaaccctgcctttaggtttttaactcaccttctgtttgaggtaagttcacttctaccaacttagatacctatagggtgtcagatcttctttagatcttggggagacacaatttaatacttttttttttttttttgagacagtttccctcttgttgcccaggctggagtacaatggcgcaatcttggctcaccgtagcctctgcctcctggattcaagcaattctcctgcctcagcctcctgagtagctgggattacaggcatgcaccaccatgcccgactaattttgtattttcagtagagacggggtttctccatgttggtcagcctggtctcgaactcctgacctcgtgatctacccgcctcagcctcctaaagtgctaggattacaggcgtgagccactgcgcccagccactaataccttttggatagactaataacagagttcctccttgatcttcctcatcttattaatacaggaaattgaagtattttcaggaatcagatacttccagggatcagcaaagagattgttggagaccttccagtgtcttggccttcaacaaatatctcccaaaactacaaagactctaaagggcaactttttgtttgtttgtttgtttgtttgtttgttttgagatggggtctcgctctgtcacccaggctggagtgcagtggcgtggtctcgtctcactgcaacctccgcctcctgggttcaagcaattctcctgcctcagcctcctgagtagctgggattacaggcgcgtgctaccacacctggctaatttttgtatttttagtagaggtggggtttcaccatgttggtcaggctggtctcgaactcctgacctcgtgatccgcccgcctcggcctcccaaagtgctgggattacaggtgtgaaccacgtgcccagcctaaacggcaacttttaaaggtccagatgatgaagtcttgagaagcgttccttttgaataaaaactaaggaaaacttaggcaaaagacactctgggaaaattcctgtggcaactgcaaatcatgaggctatggaaatgggtaacaggtcttacctgaacccaagtgttcacttgttcagaccaggggaagtcacttcattataaggaaatcttgggagctgtgtggggtttctggaagaagtcatgacttcagggttttaattctatttctgccaatgacttaaggtcagtcactgttttctgggccagttaagctttctagggccccttttctgctaataaggatatagtttagtgaataaggagcgtttacaatactgcttctgtaattccagctctcctgccacagctcctcaccccctgaaaatgttcgcctgctccaagtttgtctccactccctccttggtgagtacctgcttttctgggagagttttaaaggagagacatcttgtctctctctttccatcagaccttgttcttcacagcaaggctgggggagaggaggtccaggcgggcagatcacttgaggccaggagttcaaaaccagcctggccaacatggcgaaaccccatctctactaaaaaaacgaaaaccagttgggcatggtggcgggcgcctgtaatcccagctactcaggaggctgaggcaacagaatagcttgaacccaggaggtagaggttgcagtgagccaagatcgcaccactgcactccagcctgggcgtcagagcaagactctgtctcaaaaaataaataaataagtaaataagtaagaaagattcttggggagggaaggccctctgctatgattgcgtaacaggatagagtgaatgcttgctagatactctcctgccccatatcccttggcggccagttaattttttttttttttttttttttgagacagagtttcgctcttgttgcccaggctgcaatggcgcgatccaccacaacctccgcctcccgggttcaagcagttcacctgcctcagactcccaagtagctggggttacaggcacctgccaccatacccagctaatttttgtatttttagtagagatggggttacaccatgttggccgggctggtctcaaactcctgacctcgtgatccgagtagagacagggtttctccatgttggtcaggctggtcttgaactcctgacctcaggtgatccgccgtcctcggcctcctaaattgctgatattataggcatgagccaccgtgcctggctgtgcccagttaattcttacccagccatcttaggagaagaatagagatgagaatctagaccaagatcaagttattcctactcctgaaactatatgtcgtgtaagctggccatccagagtggtaaatataagtagattacataacttggactgagtatgcactgtgtgtaggatcttgtcctgagttagccatagctaaggagttcattctgggacttaaatttggataggaagctaaaatttacataaatacacattggaaaagtatttgactcagaaacaacagtatggaagaaatttttgaaatagtagctagaggaggcggttggttcattcacaaataaaaaggagtaccatttattgagcatttaccatgtgccttagcactcactgagtttactaattggtatacataatctcatttactcttcaaatcaaccccaagagatgatattttgatttcataaatgagaatacaggcttagaaaggtttaagtgacttatcctgagaatacactgctgataatagaattaagatttgaatctcactttatctgatgcctaaagccctggctatgaatcaccatgtgtctgttttggtgtcactggcttggggttagtcagaaaaggctaccagaaggaggtgagttttgagcatgaatctttgttcctattttccaaaaggatgtgttcagggaaagttactggcttctttcttgtgggctgaccattacccatacagaaggcccccaactttagattaagattttttttttttaactttatgatgatgcaaaaatgatatgcattcattagaaaccatacttcgggctgggcgtggtggctcatgcctgtaatcccagcaccttgggaagccgaggtgggtggatcacctgaggtcaggaattcaaaaccagcctggccaatatggtgaaaacctgtctctactaaaaatacaaaaattagctgggcgtggttgccggcgcctgtagtcccagctacttgggaggctgaggcaggagaattgcttgaacctgggaggtggaggttgtagtgagccgagccgagatcacgacactgcattccagcctggcgatacagcaagactccgtctcaaaaaaaaaaaagaaagaaagaaagaaaccatacttcgaattaggaatctttatcttttcccaagctagcaatgtgtggtacaatactctgttgcaatactcagcaggaacccacagctcccagtcacctgcccaatcacaggggtaaacaaccagtactctacggtgtactgtgttgctaggtgatttcacctaactgtaagctaatgtaagctagtgtaagctttttgagcacattgaaggccagactatggtgtttggtaggttagcagtattaaatggtttttcaaagtatgatggatttattggcacataaccctatggtaagttgaggagcatctgtatatatttcccttgttgagtgaggcaaatgcttctgaggcttagatttcttcttgttctcaagagctataaaaggatatagcaaggttggatgctcccttatggcccaaaggaagtagactttctttccttaaagcaaagtctgagaagcaagagaaatggtgtggttctttaatttagactttgctaaaaggaagaatgatccaaaactctaacgtacatgtgaagatggaaaggccatgagaggaaagaaaatcttgtctgatgatgtaacaacgtggcatagttctgaaactcctctccagtcttccttgaccttcctgcccctgtatgtcattcctgctaggtcaagagcacctcacagctgctgagccgtccgctatctgcagtggtgctgaaacgaccggagatactgacagatgaggtaccttacagtggagttgggactgtggttttgggggtgatgggtggggagggttacctgccagaaccaggaggtagaatgctgaggacagtcatcacaggctaaaattcatgaatggccaaggccatgggctttaggtggagatggaggacacttaatacactgtatgctatagtgctccagcttttgccactggcagcacatgcccctgtgcactgctgctaactggtattacttggcctagtctactgacttcagttggaagcatttagtcctaggaagatgatctccttggggcagcaagaatagactagggcctcagtcttacacttcttgaccacacctgaatcttaaaggcatttgaagtctacatcctacgttaaaaggttctacttgccagcattttagggcgttaaacaattttctgtttgggggagaaacaatgggatttggcagcttaaagggttttaaatggtacaaaagttaccaaagcaaaaaactttaccttctacctgcctctttttcacagagcctcagcagcttggcagtctcatgtccccttacctcacttgtctctagccgcagcttccaaaccagcgccatttcaagggacatcgacacagcagccaagttcattggagctggggctgccacagttggggtggctggttctggggctgggattggaactgtgtttgggagcctcatcattggttatgccaggtaagataagttggaccctccactggttatctgatatgctttccaaaggtcagaaaatatttgggggtctagaactatactatcccacactgtagccactagctacatgttgtttgtttgtttgtttgttttgagacagtaacgctctgtttcccaggctggagtgcagtggcgcaatctcagctcactgtcacctctacctctgggttcaagcgattcttgtgcctcagcctcccaagtagctgggattacaggcacacacaatgacgcccacctaatttttgtggttttagtagagatggggtttcgccatgttggccaggctggtctcaaactcctgacctcaagtgatccacctgcctcggcctccctaactgccaggattacaggcatgagcccccgcgcttgacctgaattttagttttaattaattaaaaatacatagtttcagttttcagttcttcagtcacgctaaccatatttcgagtgctcagtagccagatgtggctagaggctaccatattcaacaatgcaaatatagaatgtttggctgggcacagtggctcactaatcccagcactttgggaggccagggcaggtgaatcgcttgaggtcaggagttcgagaccagcctggccaacatggcgaaaccccatctctactaaaaatacaaaaattacctgggtaaggggggcgtgcacctataatcccagctattcaggaggctgaggcagaagaatcgcttgaacccgggaggtggaggttgcagtgagctgtgagccgagatcatgccactgtactccagcctaggtgacagagtgagactttggggaaaaaaaaaaaagaaaaaaacaaatataggctgggcgaggtggttcatgcctgtaatcctgcactttgggaggtcaaggcgagtggatcacctgacgtcaggagtttgagaccagcctggtcaatatggtgaaaccctgtctctgctaaaaatacaaaaattagccaggcgttgtggtgggcgcctgtagtcccagctactcgggaggatgagacaggagaattgcttgaacccgggagacagaggttacagtgagccaagatggtgccactgcattccagtctgggcaacagagtgagaccatcaaaaaaaaaaaaatttatatatatatatatatatatatatatatatatatatatgtgtgtgtatgtatgtatgtattagaatgtttatatcattgtgtcattgaagaaagtttcatgaacagctttggtctagagcatgtgttggcaaactaaggcctaagggccaaatctgggccatagccaggttttgtatgattgagctaaaaataattttatggccgggtgtggtgccttacgcctataatcccagcactttgggaggccgaggcgggcggatcacgaggtcaggagttcgagactagcctggccaacatggtgaaaccccttctctactaaaaatacagaaattagccaggcatggtggcagatgcctgtaatcccagctactcaggaggctgaggcaggaaaatcacttgaaccctgaaggcggaggttgcagtgagtagagatcacgccactgcactccagcctgggcaaaagagtgaaactccatctcaaaaaaaaaaatagtttcgcatttttaaaaggcttcatttttgttttaaagcaaaagagactatatgcggcccacaaaacctaaaattatttacaatgtggccctttacagaaaaagtttaccttccctgttctagagactcagtgaacatagtggctttactgctattttttcccatctctgggaatttccctctgtcactcctgggaaaactggcactgcagccagcccctggtttctgacacctgggactgtttagtactcccagctctggataactcagttaaaaccaaattaatcctctagagaccaggaagttctcttaatgtcttttgagaaatagagttctttttaagaatttgtattaaacaagaagtctgactgctgctttattcactattctgttaaatgttggtgtcgatttaccttacccatcaagacttctggaggtatcagagtaagggaaatacagattatatatgggccttcaacactgggagtcctttatccatactacttcaactcataaaccccatagaccatttgtaacttcttttttttttttttttttgagactgagtctcgctgtctcccagactgaagtgcagtggcacaatctcagcccactgcaatctctgcctcccgggttcaaatgattctcctgcctcagcctcccaagtagctgggattacaggtgcccaccaccacgcccggctaattttttatttttttattttattttattttatttttttgagacagagtctgactctgtcacccaggctggagtgcaactgtgtaatctcagctcactgcaacctctgcctctcgggttcaagcaattctcttgcctcagcctcccaagtagctgggattacaggtacgcaccgctacccccagctaatttttgtattttttttctttcttttttttttttgagacagagtcttgctctgtcgcccaggctggagtacagtggctgcggtcttggatcactgcatcctctgcctcccgggttcacgccgttctcctgcctcagcctcctgagtagctgggactacaagcgcctgccaacacgcctggctaattttttgtatttttagtagagacagggtgtcaccgtattagctaggatggtctcgatttcctgacctcgtgatctgcccacttcggcctcccaaagtgctgggattacagacatgagccactgcgcccagcaatttttgtatttttggtagagacagggtttcaccaggttggccaggctggtctcgaactcctgacctcaagcaatctactcatctcggcctcccaaagtgctgggattacaggcgtgagccaccgcgcctggcctaatttttgtatttttagtagagacggggtttcaccatgttggccaggctggtctccaacttctggcttcaagtgatccgcctgctttggcctcccaaagtgctgggattacaggtgtgagccaccgcacccagcccatttgtagtttcttaaagccccagatcttctgactatttgaaatgagagaacataatctgtccctcttactcttgtcttctagaagagcggtgttccataaatccttaggattctgaggttatgccccagagactgtcttagagaataaaggggagaccaagccgttaaaatttccccactacttttgtaccattgcagtttggcttttagatgtttactatattggagttctgcttaaagtttgaaaacactgctctagatagacccttccatcctatttgggccctggatattaagtgtctgggccaagaggtcttaatttgtggtaatgagatgggtgaaccattagtgaaggtcatgattatacctgggccatgttacaggattttagattgcctgctcccccttcattcagttcctgtagagcctttggggaatcagggcaagaatttgggcatgatggtgttaccctaaaagcttctttattatgtgagataatcttgaagagggggattctccctgagcccatcttagatatttatccttttctttgtgtgaactagaaattcagtcttttctcttctccttctaccaggaacccttctctgaagcaacagctcttctcctacgccattctgggctttgccctctcggaggccatggggctcttttgtctgatggtagcctttctcatcctctttgccatgtgaaggagccgtctccacctcccatagttctcccgcgtctggttggccccgtgtgttccttttcctatacctccccaggcagcctggggaacgtggttggctcagggtttgacagagaaaagacaaataaatactgtattaataagatgttt

SEQ ID NO: 37054 - DNA, 77542 bp, Homo sapiens; identical to SEQ ID NO: 36964

SEQ ID NO: 37055 - DNA, 19748 bp, Homo sapiens
cgctgctgccgctgctgttgctcctgaggctgctggctgaggccggaggatcgagcggcggcggcggcggcggctgagagggcggcggcgggagcggagcgggacgagggaacgggaggaagcgagcgaggagcgcgcagagcgcgcttttccgtccgcctgaggagccgaagcagccccggccccgccgccgccgcctgcccgccggacaaagccgagagcccgcgcccacagccatgtcctcgtcagccggcagcggccaccagcccagccagagccgcgccatccccacccgcaccgtggccatcagcgacgccgcgcagctacctcatgactattgcaccacgcccggggggacgctcttctccaccacaccgggaggtgagcgccggccagccgtccgccgcgcccggtgtcccgccgcggtcctctaactcctcggcgcctcggtgcccggccgcttcgcccccgcccccagctccaccgaagccccggggacgctgcccttgggcccgcccgagcgttcgggaccctttacttcgtgttcgctcttgcccgcagctcgagtcggcgcgcgccccactcgggaatgtggctgtcctgtcgcgaaaaagagctcttgtttccgcttcgtggcaggcttacgcattcgacccagttctctctctcctctctgcctccttcccgggcggatttggctccacttggccttgcattacagtctgcattgcctgtcgtagattgtgcaaattaatgcttgattttggagctggctccggggctttttaaaaaagaactttgggagaggaattcggccctggcatcctgcgatggcttgtttttgctgcttttagaacaccgggaggaggctggaatgcggagtctggaagcctcgcccagcgttatcccgctttgacagcattgtttactttgctggacgaggccccacgggtgaggggagtccccaggccgggaggagagcgtgataaaataaagctcaagtaatagccaagggaaagtaggtgggggtggtagggtgctgacagccttaaggtagggtgtctttcggcagcgacgcctttggaaatggattgaaggacctttgtcaaggacaccccagttgggtggggtggttgcttgatcctgtggaaggggctagagagaggcaatccagagagagggtggttccctggcattgcttttcaaagcatgaccaggaactgtttacaaataagtaatactggggtagaggtgaagcttggtcacgggaagagagctcaaaggttgtctgtgccctaactgggctgtcctccagagggaggagcctggaaagcgattttgaggagccttattgaagggaacggggcctcctttttaacttcagaactttgtcttcttttggtgctggggtggcctcttgctagagggtggggacttcgcagctcctgcggtctagaggattgctagccttgttcctgtgggcagggctcaggagctgtactacaaccaatccgatgcagttaggcctggaccatccttaaatcagttgcacaatagcaaggcctgtggagtaaggagaccttcttgccaacaccaagggataaaatctaggagggagctttacagagaaattcagccaggccgctctgggggctgggcgggctgccttgaaaggctttttaaatgacccaggcagaagttcagtaatatatatggagagctgggtttaaggaaatgttaactttgcagaatagtggagttcttaggtggcttaactcatggaagaaatctccccccgatatgatcagttcaagaccaactcgtgtttgagcatggtacagggtctcactctgtcgcccaggctggagtacagtggcacgacctcggctcactgcactctctacttcctgggctcaagcgatcctcccacctcagcctcctgagtagctggaccacaggcacgtgccaccacgcctggctaatttttttgtattttggtagagtctgggtttctccatgttgcccaggctcgtcctgggctcaagttattcgccccgtcagcctcccaaagtgctgggattacaggcgtgagccactgcacccggccaagatcttgctttttaatcctgaaaaattttggcagaccagaatctgctccatataagagttgtcttgaacttgaactgatagcttttaagaaatagatgctgttttccgaggtgatggaaagggatttataacttcttccagaattctttgtggtattgctcagtaaatgcctgtgcttccagaagttcagaacacgtcatagtgacaactgcactcagctataatgtatttggaaagggaactaaactttcagctatatattaatcccctgagggaagagccacctagacacgtttttggcttatgtcaaatagtcaagctaccatacttttaaaaataagggcatagtctttaagcgttgcttcaaagatagaagcctgtctcatagcctggattagttcttaaagtgcttgcaaagagtctgccagaaatactaattcattacccctcctcctaacaacactcaatcactgttttctcaaatatcacttaacttcccccgacattgtttctacacacagtttcttgttttggatttaaatacttgtgatcttggctcttctttactgttgagcttgtatttattgggagagcccatcataatctttggatttatttgtttatttatttatttatttttggagacggagtttcgctctgtagcctaggctggagtgcagtggcgcgatctcggctcactgcaagctctgcctcctgggttcacgccattctcctgcctcagcctcccgagtagctggggctacaggcgtccaccaccacgcccagctaattttttgtatttttagtagagatagggtttcaccatgttagccaggatggtctttttttttttgttgttgttgatcattcttgggtgtttctcgcagagggggatttggcagggtcacaggacaatagtggagggaaggtcagcagataaacaagtgaacaaaggtctctggttttcctaggcagaggaccctgtggccttccgcagtgtttgtgtccatgggtacttgagattagggagtggtgatgactcttaacgagcacgctgccttcaagcatctgtttaacaaagcacatcttgcaccacccttaatccattcaaccctgagtggacacagcacatgtttcagagagcacagggttgggggtaaggtcacagatcaacaggatcccaaggcagaagaatttttcttagtacagaacaaaatgaaaagtctcccatgtccacctctttctacacagacacggcaaccatccgatttctcaatcttttccccacctttcccccctttctattccacaaaaccgccgttgtcatcatggcccgttctcaatgagctgttgagtacacctcccagatggggtggtggccgggcagaggggctcctcacttcccagtaggagcggccgggcagaggcgccgctcacctcccgggcggggggctgaccccccccccacctccctcccagacggggcggctggccgggcagaggggctcctcacttcccagtaggggcggccgggcagaggcacccctcacctcccagatggggcggctggccgggcggggggctgaccccccacctccctcccggatggggcggctggccgggcagaggggctcctcacttcccagtaggagcggccgggcagaggcgcccctcacctcctggacggggcggctggccgggcggggggctgacccccccacctccctcccggacggggcggctggccgggcggggggctgacccccccacctccttcctggacggggcggctggccgggcagagggctcctcacttcccagtaggggcggccgggcagagcgcccctcacctcccggacggggcggctggccaggcggggggctgaccccccccacctccctcccggacggggcggctggccgggcggggggctgacccccccacctccttcctggacggggcggctggccgggcacagggtctcctcacttcccagtaggggcggccgggcagaggcgcccctcacctcccggacggggcggcttagccaggatggtcttaatcttctgacctcgtgatctgcccgcctcggcctcccaaagtgctgggagtacaggcgtcagccactgcgcctggctgtaatcagtggatttttaacatgagggcttatttaatatctttataaggacatggtgccgttgcagttggatttaatcactattacagcaatgaatactgtttaggtgttctttacttactgatttaacttccccctctgacggtttgtgtatctctaatgctacattcatcttcctctcatcatgtaattttatttccctcaaccagggtgcaatagtttgttatctggccacctccagactcctggattaatatggttaggtatcgttagtaaattttgtgtgcccaggggagtggttcgcacaaaaggggacaacagacaaaagtaggaaatacagtccttggtctgaacaggtttaaattcttgatttgggggtaggggcagacagataagatttttagttctgaaagagtagagtcaagtgctaacatatatttcagacttgaaaacatttagaaaaatgagtgataggcttgtattggaaatctctatttagtggtaagggaggggattaacatttcctgcctcaaacttctagaaatcttctggagggtcacatacatgtcagagcattccagcataacaacagttgatggaccgaatgccctaaatgatcagactgagcagggacattcacagcatagcaaacttagagtttctcccccttgaagagttctttattcattggggatcacaggagatacagcttacccttgagctttctcaaaattgtctttctgtggtttgggaagtgagaagtgggtgaaaacacacttgctgtaacctcttggatttctcatattgctggaagagtaccctttctccttatgaaggaagaggaaactttttgttgggcaaattccaggccaaaaaaaaagctcttggattttatttttttttctatctgcctgtggaggagtggggatgatatttggttcttccattgagaagctacctctgccctcaaaggaaggtaaagttactatagttggctccacttttaataacactagtgacctagaagaaacctaatgctttcattttattattgagagaaattgggacccagagaagttaagtaacttgttagtattaaacagctaattattgtccgtgagtccctcaaatttagtatcctgatcactattccagttttttcctctactgttttgagatgcttatcttactaggaaaggaagtttgcaaacatttaaagagacttttctacctctggaatgctagctaatatgattctttccgctaccttatttcctttctaggtgctgaactgcccccttttagaagagttgttttgctctgcggaatgagcagaaacagagacacctcttttaccctttctctttgcctttcttttccttcacagagttctcatcagccatggaaaagtatgctgttaccataacaagggcagcagaggggaactaactgtgatggtctgaaattttgtctgggttgtagctcttctgcctcttggatagttgatatgattggttcattgggacagaatttcataaaggtcattggatgggtttggaaaaaaggagaaagcaggaagaagggaaaataatccactgggagtgaaagtgaactataccaaaataaagagtattgggggtgaagggagctgcttttttttttctttctttctttgagacagagtttcactcttgttgcccaggctggagtgcaatggcgccatcttggctcaccgcaacctccgcctcctgggttcaagtgattctcctgcctcagcctcctgagtagctgggattacgggcgcccaccaccacgcgtggctgatttttgtatttttagtagagatggggttttaccatgttggccaggctggtctcgaactcctgacctcaagtgatccgcccacctcggcctcccagagtgctgggattgaaccaccatgcccagccctgtttcttttgttaagataaaaattgtctttgttggtttattagcacttcagagatttgatggttgtgcacagtgaatgtggtttggccaccacctgtctccctgaagaatacagagttaggcagcttttagtttcctctgggttatttgccatagagcttttcaggagtctgtctcttcatccagagtctccatgaagaacagatgtttaaaactgaagttcattcatgaatgttctataactcagtcaataaaacatagaccttgttctaccttcctaagttgaaagaataaaaagcagagaaaacactttctttgttaagtcctttctgttttttcctttcttattttcccttatgggggtgggagagagaaagacaggcttagacttcttttctgagtgcattagaagcacttgctgcttgttcatcttgtatctgtttctcatcttttggtgggcccttatgtgagacatagctggagaattgtcaagaattcctagtagaaattgaagttacatgccaaatgctttgtttctttttttaattcaatgtctaggcttgaaggataccttcctcctcgtggtccctgctgccctagcagtgttggtttgtatgtatgtatttataagatattttgtaagcatcttttttcttagttccttataatggttttttaatacactatctcttgatgttttaaacatacataacaaaaatttccattttagtcatttttaattgtacagctcagtgggattaaatatattcaccttgttttgcaaccatcaccaccatccatcttcagaacgtttttcatcttcctaaactgaaacctcataccaattaaacaataacttcccattaagcagtaccaccgcagcctccggcagctaatcatcctactttgtgtcttcatgaatttgactactctaggaatctcagttaaatggaaccacgtagtaattgtcctttcgtaaatgaacattcatcagtgttcatgctttttttcttgccattttgctttttttttttattattattacatttttttaatacctatgaaagcaacaaagttgtaaaagtcatatagtcttactggccacacaacaaaaagcaacattccgatgccccgttccttcatctccatttccactctcagagaaaccattttaaactcatttagctaatgtgcactgcagccttgacctcctgggctcagcctcctgggatcataggagtgccaccaagcacggctaatttttaaaatttttgtaaagatgatttctcaccatgtttcccaagctggtcttaaactcctgggctcagatgaccctcttgcctcagcctcccaaagtgctgtgattataggtgtgagcccctatgcccagcctatttcttagtttgggatattaattcattttctgctatggaagatgaggatttagttgttatatacacccttctcccaatgtatatacttctgtctcctatcctcttaatttaacttttttttaccctttttggtcaaactaatatgtatgtaatctttactaaattttggtaaatattgaatgcagatgtggctgacattgttggtttcctgctcaatagctattccctcttcttgcttgctgccagattccctcattttttaaatggcaaggtgctaaaccccaggatatagactgtgacagctcttaagtcagtcatagtttccccagtgtttggtctggtgggcatctgaaccagttctggacaaatgagatgtaaaggaagtctgctgatggcttctgagattttcccctccaacggagaaagtcccaggaggaaagccctgtttgacttcatgttctcctttcctgcttggaactctattttatgagggtgtgggtccatctcagcctttttggagggcttgtgggcaagttacttaatgtttcgttctccaggctgtctatttgcgtgagtaaatggttaattctaattctggaagcagacttagttaaacagaattttatgatggcggccggggggtgggggtgggggctccctgtaaaaatatagttaacaactaccctgtaagttaaccatgttatagtggactttctctgtgtggtttaatttcagcttacataatttcttaactatatagcttaatgcatggattatttatcatttaaactaaggtacttggtattgaaagaggccgttacgcttgaatgaccttgtttctatactagccatcttggcaagcataactttgggctttattcattgaccttcttgttgttttctgcagtttgagaatcactggtttttagattcaaaggtagatagggtttttcccccctctctgtcaaagggactcagttttactctcatatttccctagtaatgttaaatctagaaagtcctggatgaaagtattagatttatcctaatatctggtcactaagggatgaaaaatttataaatagctaatgttaacctagatctaaagcttcctattctgaaatccaaacatgaagactaagaaaaatatgtacattttgaaacaaagcagaaaaatgaaacttcaacaatgtaaaagagggtaaaatgccagtagacagccactttcagcagtttctgtttacagtgcttttgctggctaccattgttgctgtaaataatatatgtatactgtgatttctttaacattagacaatactgttaactccccattatgaaagatgaggaatctaagatacttttattactttctgtctcttgtttctcatcctctctccatttactaatttctgtaaattgtattatcatttttggctcctctagtagttatctttaaagctctaaataatatgtgtctcaacctgtcaactttagctctccactgtataaaagtacaccattcacctgtcctcctgcctttactttgctggtatgtaacctcattatgtttataatatcagggtttgtgggcaggcttggtggcgtacacctataatcccaacactttgtgaggccaaggcaggagaatcgcttgagcccaggagtttgagaccagtcagggcaacgtaatgagaccccatctctacaaaatataaaattagttggactgtagtcccagctacttgggaggctaaggtgggaggatcacctgagcccaggaggtcaaggttgcagtaagccgtgatcatgccactgcactcaagcctgggtgatagagcaagaccctgactctcaaaaaaaaaaaaaaaaaaaaaagaaatcagagtttgtaacatttacgtactgttccttaactgttaattcttctatgcttttactatagtttgattataaacgttgaaaatcaaacagcatatacaatattgtgattttttttcataactttccaatataagactaaggagcatgattattttcatagagaaggaatggaaaattgttttttaatttttgtaacactccatcaattgatcacaatcatgccccattttaatactgtgttatatgagctatggatttcttgtgtagtctgttttccttcttcagtagcttaaggttaacttgtttctagttacttatggctgcattggttgacattaaattgagctgacatagcgttggagggagtctgggtgaaatgtgaattgctaggaagtccttgcttcagaaaatgtacatctgtgcatgcatatgtataagaaaccttaaatattttagattttttaatagattgtcttggaattgatgtaagtttatagtaaacataatattcaataaaggaaataaagggttttttcctgccattttatccatggttgaatcttaattttttttctttgaataattttggttttttaaaaggtcagtttcttttgaattacaccctaaaatcattagtgattaacaagctgattctgtatttttgctttatacccactacaattaaattttttttagcttgcagagattactaaaattcaaaaacttataaatactatactttcatagtcatatttttcctggctatatttgagaacattacagcattaagacgctagttcttcagtgtgtcttgttgtctgaattatttactgtgttggcattcaaaatcaaacatatcttaggaatgcattaaaaaaactattagaaataataggtgagtttgccaaggttgcaagataaaagagccatatagaaaaacctgtttttggcccagcacagtggctcatgcctgtaatcctagcactttgggaggccaaggcttgcagatcacttgaggtcaggagttcgagaccagcctggccaacatggtgaaaccccatctctactaaaaatacaaaaattagctgggcatggtagcgcatacctgtaatcccagctatttgggaggctgaggcagaagaatcacttgaacccagagggtggaggttgcagtgagctgagatcacaccctgcactcccgcctgggcagcagagggaaaatccatctcaaaagcaaaaacaaagaaaactggtcacgcttgttatcccatcattttggaaggctgaggtgggcagatggcttgagcccaggagttcaagaccagcctgggcaacatggtgaaaccccgtctctacaaaaaatacaaaaattatttttttctgggtgacatgtgcctgtagtcccaactgctagggaggctgaggcaggaggaccgcttgagcccaggaggtgtaggttgcagtgagccaagattgcacttctgccctctagcttggacgacagagcaagaccctctctcgaaaaaaaaaaaaaagaaaagaaaaagaaagcaatcccatttacaatagcatgaaaacaatttgataggaataactttagtcacaaagcataaaacttttactctggaaactacaaaacattgttgaaagaaattaaagaagacccaaataagtggaaagacatttggtggccatggatcagaagacttaatattgttaagatggtagtactccacaaattgaccttcacattcagcacagtccctatcataatctcagctggcttctttgacaagctgacaaaattcatatggaactttaagggacctaaaatatccagaacaatcttgaaaaagaaaaactaagttggaggacttacactttgtggtttcaaaacttattacaagtcaagacagtggggtactagcatatggatatacatatagatcaatggaataaaattgagagtccagaaataaacccagcaataatggcccattgatcttcaacaagggtgccaagacaattctgtggaaaaagaacagttttcaacagatagtgctgatacaactggatatgcacacagaaaaactgaaggtggaccagatggctcaaagacctaaatgtcagagcaaaagctattaatgtacaacctttagaagaagacagaggcaaatctttatgaccttggattaggcagtggcctgagatatgactccaaaagcacaaacaaaagaaaaaaaaaaaaacatacattggacatcatgaaaattaagaacttttgtgcttcgaagatcatgaagaaaatgaaaagataacccacagaataggagactatatttgcagtcacataagagatttatatccagaataaagaactatcataatttagtaataaagacaaatcattgaaaaatgggtaaaggttctgaatagacagtttcttcaaaagaagatatgtggtggaatggcctgttaagtacatgaaaacagcatgttcaacataattagccatcagggaaatgcaaattaagatcaaaccacagtgagaaaccacttcatatctgctaatgttggctacaatatataaaaattagaactcttacacactgctgatgggaatgtaaaatagtacaaccactttgaaaaacaggcagttctggccgggcgcggtggctcacgcctgtaatcctaacactttgggaggccgagctgggcagatcacgaggtcaagagatcgagaccatcctagccgacatggtgaaaccctgtctctactagaaatacaaaaattagccgggcatggtagcatgcacctgtagtcccaggtacttgggaggctgaggcaggagaatcgcttgaacccaggaggcggaggttgcagtgagccaagatcatgcagctgtactccagcctggtgacatagcgagactctgtctcaaaaaaaaaaaaaaaaaaccaggcaatttttcaaagggttaaaggtagagttaccatatgacccagtagttctaccttaattttttaattttttttttttttttttgagacagggtctcactctgtcatctaagctgagtgcagtggtgcaatcatggctcactgtaacctccatctcctgggcttaagtgatcctcccacctcagcctccccagcagctgggactataggcatgcaacaccacgcctggctaatttttgtatttttttttaagagacgggattttgccatgttgcccaggctggtcttgaacttgtgaggtcaagtaatacacgttggcctcccaaagtgctgggattacaggtgtgagccatgcctggctaattccacttttttagtttggtatatacccaagagaatggaaatgtgttcacatgaaaacttgtacgtgaatgttattcataatagacaaaaagtggaaacaacccatttatcagttgatggacttgtttttatcgacttaccagtccatcaactgataaattgataaggtgcgatatatacatacaatgaaatatttggtaatgaaaaagaaatgaggtactgataaatgctacaacataaatgaactttgaagacattatgaaagtgaaagaagcagtcacaaaagactgtattgtatgattccatttatatgaaatggccagagtaggtaaaactatatagagacagaaagtagattagtggttgcctagggtcagagggtgtggggagatcaggtggcatctaaggggttgggggaggttatgggggtaatgaaagggttctaaaattgattatggtgatgattgtacagtcctgcgaatcaactaaaactattgaattatacactgtaagtggatcaattgtaaatgaatgctatttcaataaacttgtaaaataccgtatcttatcagctctttaaggtcatagaggttcttcagagtttctcttatacctcacacatttaggcagaatctccactacctatatcctagttggtttaattgcaattctttaatgtatgcgttgttgctgatacataatttagaaagcttgcttctgtgctgtgcttttttcaccacctcatctccacaatttccaagcttgatgtactacagaagtaagaataatcttgttccagtttgcaagttgactcatctgacagtgaaacctcacccttctgaaatctcatcatgaacaaaagtggggtaactcaaacagataggcaaagtccattgttaaagctccttccctttgttcattggaaggccatcagaccccctttcagcctatttgcccttattttacatagcatgctaataagcaagttgctgatttccaaacccaccagactagaaacaccaagttagaaagggtgttaagggtgtgctatacagattgaattgtgtctccccaaaattcttatgttgaaaccttaattcccaacatgatagtattaggaggtggtgcctttgggagttaattaggctgagttgaggtcataaaggtgggaccctcatgatgggatttgtgcccttataagatggaacaccacagagttgaggcccccttacccccatgtaagggacacaaagagaaggcagctacctacaagccaggaagagagccctcaccagaaaccatccatgctggcatcttagtgttggacttctagcctccagaactatgagacaatttctgttgtttaagttgtgcagtctgtggtattttgttatggcagcctaagctgactgagtcatagtagtagcctggaaaaaaggtagctcttagtctaaggggacaagggcactgtgggggaggggtgcaccagcacaactttgaccatccgaactctgtatagtgatgttcagctgtacagagcaccaacttgatagggcttagagacttcttaggtcacaacatagtataataaacaattttcataatactgtgattcatcaagagggttgaatcattttctgttgaaggccataaagggatttaaatctgtattagaagtattttcattcaagataattgaaattgtttaccctttgaaagttgaactaagttttgtgctacccagaatgcctcgttcctcataatttctagatgcctttttgagtgctactctagtttttgtttttcaaagcaaagaggttgaaggtaagtttctactttccttgtcctaaaattatatttgatttacattttgaggcaggatcttgctctgttgcccaggctggagtgcagtggtgcagtcatagctcactgtagcctcgaactcctggactcaagctattctcctggctcaacccccgagtagtagggacttcagaccaacagcacctcacttggctctttttaaaataatttttttagagacagggtctcactatgtggcccagactagactcagactcctgggctcaagcagtcctcctgccttggactcccaaactgttggaattacaggcatgagccaccatgcccaggctctcttgtctttttgataatagccatcctaagagatgtgaagtgatatctcattgtcgttttgatttgcatttccttgatgattagtgatgtcgagcaccttttaatgtacctgttgaccatttgtaagcagcacgtttccataactgtttatcagttaaagtgtactcttcaaaactattgtttttaaaacattcaggtagcacttaactggtaagcagattgttttgtagaatagagaggggctgccagtttcagctttgactatagctgtgagaagaatgttagtctcagtccttctttggaaagcctttaaaaggggctgtttattttttctcatacttgtttattctttcatttaaaactttttttttcttaaagatgttaatgttagggcctaggtcacatataaataagacatagccctgacataagaaactcagagtctataaagagagacagatggataaacaggagtcctgtaatacatgatgtgtgtaagatggagaggaagaaccttttaaaaaagtgaggggtgggggtggcttcataaaggaagtgatggttggagctgagtcttgaaggatcaacaggagtgtccctggcagaagagaaagggcattccagatggcagaagagcctgtttacaggcagagaggttagagattatgctttcaacttgaattgtaaaatccttaaaagttaggattacatgggatttaaattaaattcctgggtggtattatatgttgataaccccttaaattgtttcaaactctttttaaccctgttttccaggaactcgaatcatttatgacagaaagtttctgttggatcgtcgcaattctcccatggctcagaccccaccctgccacctgcccaatatcccaggagtcactagccctggcaccttaattgaagactccaaagtagaagtaaacaatttgaacaacttgaacaatcacgacaggaaacatgcagttggtaagagaatggcgatgttggagacctagagcgtggctcttggaatttgaatgtctgtttgctgtaggttgagaagctattgattcttcagttttgttttttgttttttgttttttttgagacacagtctcattctgtcactgaggctggagtgcagtggcacaatctcagcacactgcaacctccgcctcctgggttcaagcgtttctcctgcctcagcctcccgagtagcggggattacaggcgcctgccaccacgcctggcaaatttttgtattttttagtagagacggggtttcgccatgttgcttaggctgttcttgaactcctgacctcaggtgatccacctgcctcagcctcccaaagtgctaggattacaggtgtgagccactgtgcctggccaattcttcagttaataactaatgttcagttatatgtctctaaggtttccctcctcccccaaaggtttcttgaaatactctgaaaaccctgaattctaaatcataaatctgatgtagttggtgggagaaaagaatccagaatcaggatgataaaccccaaaaatgactctttgaaccatgccttaaggacttcctggcctaggcttcattggactaaggataacacacacagaaaacaaaacaatttcatagcccccatttccatcaccctcaggcaaatagaccttgtttcttttgttttgttttgttttttgagacggagtcttgctctgttgcccaggctggagtgcagtggcacgatctcggctcactgcaagctctggttcccgggttcacgccattctcctgcctcagcctcccaagtagctggggctacaggcgcctgccaccacgcccggctaattttttgtattttttagtagagacggggtttcaccatgttagccaggatggtctcgatctcctgacctcgtgatccgcccgcctcagcctcccaaagtgctgagattacaggtgtgagccactgcgcctggccgaccttgtttcttatatgagtttcttttatatggtgtgaggaaaagcggtatggtttatttcctctattttccagaactgcgtttaaggtttacctaaattacccctcctccaacacattctttttttctttatcactgtagaagcagaatggtgcggtaggagtggccagctcctgaaatattcctcagggactgcacttggtgacccctagatgggggccagcattccgctttgtcatatttcagatgagttttttaatggacaaagtgttagtttggagcagggccaaagtccaaagcctccagaagaatgtgctcccctgagagatggcaaagagctccccaagagctgctgtttagtcatcctgaagacaaagggacaatggggatgttttcacttgtgtccttttccccaaaacttctccccatgggtgatgggactgccattcttatttttcagattaagaccagccaaagcaaagcagagtaattgttttaaggcagcagagagtgggacaatttgaattactttttgtctctcatttagagggaatgacagttaaaactgttatgcttctttgtgtacgtgctaaactcttcattttattggtcctaactaggggatgatgctcagttcgagatggacatctgactctcctgcaaggattagaagaaaagcagcaacactgatacttgtgtgcacctgatttggccaataggatcaacagtgaaaagacagaagaggcaataccagcagtccccattacagtctccacctccccgtcttcctctgggtgccaaatgatgggaagatgagcttcatctgaccatttcttctccctgtctcctgttccccttcccagttaaacaggttagattgaaggcccttgctgtatttctgtagagctaagcagcccttagaggaaaacagttcaactctgactttcctagttgtttttttattgagagccaccctcataccctgtaattttgtcccaaatcaaatatcaacctaccaacaactgcctggctgggaagtctggggaagggatacagagcttggtgggcctaacaccattcatattccttaccctctgtctctcctccctgtatcccacctatggttcagtgttgcaagagtctgggcttggggtctttaaaaccagcagggggaaatgataaaaagagagctgctttcccttttaccttgaggtattcgtccctcgggacagagcacagcttgtgcaactctggtagcgttaccctgtgacactgttttgaggtccacttcctttctttcctctgggaggaatgtcttctgtctttggtattatagttcatcttcccattcttttacttagtgcatttgtgcagatatttttaactctgtacatcagaagagagcccttggtaaccagttttgctcttcttctgccactcctccctgcttgcatctcgttgctggcagagtcctcttgtacttcaagaaagcaaagtgattttgtctgctcctagagcaggtccataccaagtaatagaggcactttagcttccacttggtgggtaaggcctgatcatagtattctgtcagataatgcctaagaatgaccgctgaagaacgttgacccatttgagtacccggtctcagtcgtcatttttaagtccagtgagcattgtggtagttgttcttagattgcagtttcttatgttttgagtttgaagttgattttcagaatgttcttagaaaagaactgcatttttttcctttgtggatctgctttgtttggctgctgggatagataagcatgggcttaaaaaatgtgttcctcccagttttcttgcctttcctgttgtactctgaatttctctccctacctccctcactttcttcctctctccttcctttccttcctttttctctaccaggccatttttcaaatttacatcaaagatacctgaagtgttggtatctgagaatatctgtcactcctcttatctgagaagtgaccttttatttttaagatgactacagacctatttttagatatgttttcagtacaattttgaacagcaactttttaattaaacatcttccagtgttaggaagttgagaaacgttcataggcaagtctgctgttctatgtcaccatcttttgtctcccctagtcccccaggagctctttcctttcccctctagttttgggtgtgcatgtttggagtttgtagtgggtggtttgtaaaactggaccattctgccttgctatgggttgttcaagaaagcctcattcttttctgtgaccctttcgcttttgcattcaccctccttcccacctacctgtcctggggctgttgagcagcataataatcccgggagaatgattcccctcatagaaagacaaaagcatccatcccctcatagttaagtagccactggtgtcctgggaatttctggttggatttggtgccctgaacttttttattaagaaatcagatcccagggtgagagtaacaggccatttggccaagaaagaaacctgtttgtttttcttttgaactatgaaaagaccctgtttgtgaatatattttagaaagagaggaaggatgtctgcagaactttgttctgttttctgccacaaaaatgtgaatagttcagagtgaaaaccttttgtgatggttgatgtctcaggaataagctggatctccaatgttttggggatgctttgagtctcaaaaaaaattgataatcagaaaagtaatttttgtttgtttgtttaatgtatccctgttctgtttttaattaaactccaagtctcatttt

SEQ ID NO: 37056 - DNA, 10773 bp, Homo sapiens
acgtgtatcgctgccgtcaagatggaggggcctttgtccgtgttcggtgaccgcagcactggggaaacgatccgctcccaaaacggtaagggcgggccgggcctgggtcgggtttgcggccggggagggccgagtcccaccgcgaccggaccccggctgccctcgtttctctcctttacctccgcagaaagggcctcggggccccgcagccggacccagcccacccgccgttctctggggcagggcgctgtggccccacttttcccacagcgaggaggagccccgccgcgcgcggcagggttttgagaccggcaacgcgtggatgtggtgtccggggcggcgttggaaacgcgccctccgcgggaaagcgggcctcccgggctcgcacgtgcgggccacgcctcgcacccccttttgtttcagggcgaccccctgagtgtccatgttaaacgccaggttttattttaggaccatttaccagaaaaagagtaggtccatccgcgcgccctcggatgagcccggtgccctgtccgcccgcagctgcagtcgaggtcgggcgtccggcgtccagccgtatccgggttgacagcttcttacagtagagttagcccaggaaacgccactcgagtgcattgaccccaggagacggcagcgctaacttagcagagcgtttgctgtcaggcctttggatacctacagagcttactgtttcttgatagattcctaatttttttcgtaaacaaatctgaaagtcaccaccttccccgttgactaccgatttctctcctcacagataaagagagttttaatgagcaaaaaacttgcagaatctgaaggaaaaggctggtatagctgtacgaagtggcagagcatgaaattggtggttattactttttttttttttccccgccatcagattccaccccgcatcaaagctgtgccaaataggctcgctttgtttagggacagggtcccacctgtcgcccagacgagagtgccatcatagctcactgcattctccaagcacaggtccgcgccgccgcatccggctttgtttttattttttgtagaaatgggtttcgctatgttgcccaaaggggtctcaaactcctggcatcaagcgatcctcctgcctcggcctcgcagtgttgggattacacctgtgagccacagtgtctggccccatttacactcttagtaggtggtttttaaataattaacacagatttgtagatttgggaaatacgggggctgttggatgtcatttacctttaggctgaaattactgtctttcagagttgtggcttatcctcatttcttttttatttttaattgattgtctacagttatggctgcagcttcgattgccaatattgtaaaaagttctcttggtccagttggcttggataaaatgttggtggatgatattggtgtaagtacacataactgttgtgttagtttccttaaagtaaaactatcttcagtgttttgctatgttctttctttgactttatcagaatccacgtactggaaggtgatattaaaggtgaacgtgtattataatggggctgtgttgatttctataagtggttcatattttttcctgcgaatttcttaggatgtaaccattactaacgatggtgcaaccatcctgaagttactggaggtagaacatcctgcagctaaagttctttgtgagctggctgatctgcaagacaaagaagttggagatggaactacttcagtggtaggtagactggctaaagaatgatcatttttctaaaaacgaccgactttcagaaagttgaagccataagtgggtcatttgtgctgtgtcagaaataagttacatattctgaatgcccagaagattgagcaagaagaaaaaacaaaagaagttacacatttaagaggggaaataagcttcttaggtacagattcagaaacaaaatttgtaagttgatagttacagctagtttgtacagtttaagtaggaaagaatttgagttcatttgacatagccccattgttttaaatgttggtattcacaagttttgagggcttatttttccttttatggcagtattcagacatcacacagatttttttatggtctctcaaaagtcttgtttcctcccccatcaccccttgagacttggaaagctctcaacttttctgattatttggaggataaaatgttaccaatctgggggagaaacaatgtttttatattattatttttaagagaccatctgtagcacagtctgaagtgctgcagtgctgtcatatctcactgcagcctggaactcctgggttcaagcaatcctcctgccttagcctcccagagtgcttgggattgcaggcatgtgccaccacaagcaactaattaaaaacctcttttttttttttttaagagacagggtctcgctatgttgcccaggctggtcttgaactcctggcctcaagtgatcctcccttctcggcctctgtagtgctgggattacacgcatgagctgcactcagcctgttctattttttaaatcctgacaggtaatctcaggaattcaaaatgggagtgtgagaaattaataaatacatcatgatatgacagtgtgatcttaccgagtcagtaaatgtgatacacagtataaactcttcatagatcatccagcatgctggtatagtagaaacactattgtttggtgagaaagatgttaattctggagaaactagatagtttgtggggaaaatgtatttctagattaaactttagccatgaaagaatggaatctactcctaaaatatgaatatgatctttgtctaacttacgataatgtgatttaacaaatgtagttttccttccataagaagctgacagtctttttgctttaaaaatatttcttagtgttttatcaacttgaagaactatcttttttaaataaaataatagcttaatataggtcatatgaatagtcacactcggtttagcttctgttgagcattttttctaaaggtaatagatgtgttgtcttttacggttgtattgatgaactagtttcttattgctgaactagtttcttagaacatttttctggctcctacccagttttggccatttgcatttataatacaataagacctcactgaacatccacagtggcttcatggaaactgactttaagaggaaagatgatgtataaaaaaacaagttttcctccccccatcagcgttacaataaacaactgtatttgagaaattgctgtccattgttttgcttaaagtggcagtttccaagaatttatgagtaacgtggaggacttggagtgttttgtagcgttcttctcccttcacgcccaggtttctaataaccagttaattcatttcatcactaccattttggttaataatatatggccattttagtgtcattccatatgtattgcacatgttgaatatccggcacactcagaccagtgaatgttttctcaacaggttattattgcagcagaactcctaaaaaatgcagatgaattagtcaaacagaaaattcatcccacatcagttattagtggctatcgacttgcttgcaagtaagattgtttgcattcagagaaattttttttgatgtaatagttgtaaactgtgttgtcttaacgttttgattaataactaaattttaatttgaaaaccttcaatttaaatgttttagcatttaagtagtaatatttgaagttaaaaacttggaccagtatcttttttctcatttgactaccacattttctcctaataatagattttagtggctatgcttatgggatagattaaacttgccatgatctgaagagggagggttttttcatgtcctcctcctatatgaaatggctgaacggatattattacttacgacattttggctctgtgttaagcatgatgaatgcaaagagtttgagtagtgactttataagcgtttttctcccccacacttttaaacagggaagcagtgcgttatatcaatgaaaacctaattgttaacacagatgaactgggaagagattgcctgattaatgctgctaagacatccatgtcttccaaaatcattggaatgtatccttgtggttgtcagataaaatttagactttttaaagcataagactttgagatgggcatggtggtatgtgcctgtagtcccagctactaaggaggctgaggtaggagtattaattgaacccaggagtgccagtccaatgtgggcaacatagcaagaccctgtctcgggagtgggtgcgtgtgtgcgcatgtgttgcgcgcacgcgtgcgtagtagcagcagtatcaattttgtgcaataaaattttgaataaccaattttatgcaaattgatatcaatagagaggagtaatgctgtattgaaattacctgttgccttccctgcttttttagggtgaaaaggtaataaaaagcatgtctaaaagtgatatgaattgcagatagtgataatgttgtaacattttggtgacaagtaatgcttgctgctttaatagattagattactaaaaggaagtcccttgaaattacccttgatttttcacgtgtgtaccctttgtccattccaaacctgttactgtccttaacttttggcgtagaaatggtgatttctttgctaacatggtagtagatgctgtacttgctattaaatacacagacataagaggccagccacgctatccagtcaactctgttaatattttgaaagcccatgggagaagtcaaatggagagtatgctcatcagtggctatgcactcaactgtgtggtgggatcccagggtaaggtttgggatttggtttatagaatgagattgctacagattaaaactagcttttcttttggctgggcgcggtggctcatgcctgtaatcccagcactttgggaggctgagtcaggtggatcacgagggcaggagtttgagagcagcctgtccaatatggtgaaacctcatctctactaaaaaatacaaaaattagctgggcatggtggcacctgcctgtagtcccagctacttgggaggctgaggaaggagaatcactggaacctgggaggcggagattgcagtgagccaagatcacaccactgcactccagcctgggctacagagtgagactccgtctcaaaaaaaaaaaaaaataaaaaatgtttttttgtggattatgtgcagtacatctttttgtaatttaaagcacatacaacatggtagaaggaatgtgaattaaaagaaattacgtgcatttaatgccataaaatttttctaagataaaatgcaatgaattagtctaaatttgtgtgtttacatacaatcgattataggtactctttattatgcttttaaggatagacgtattaacttaatcttatgttcaattgtaggcatgcccaagagaatcgtaaatgcaaaaattgcttgccttgacttcagcctgcaaaaaacaaaaatgaagcttggtgtacaggtggtcattacagaccctgaaaaactggaccaaattagacagaggtatgttgagagattatttttggccttttaagtgtgagtgtcttggaggactttaacatttttagccaagtcaaactattttacttccagaaaaattagcctggtggtgtttttagagggatttggggttatacaacctatatgaaaatcggcctttttgtggaattttgattgtatgagtctattaatattaaagatgtaaaagacaggaatctaatttcctcaaagcagtacagaactcagcagtatagtattgactgtaacctactgtttgctagatactggaggtgcaggtgatattagtggttggcatgccagaagagctaatggtggaggtagtgtgaccattgctatagatttgactgcctgacagtcacttaaaacaataaattgtttaggctgggcacagtggctcatgcctgtaatcgcaacactttgagaggctgaggtggcaagaatctgaagcccaggaggttgaggctgcagtgagctgtgattgtaccactgcactccaacctgggtgacagcgagaccctgtctcaaaaaaaaaaaaaaaaaaaatagtttaaacagtagttagacctacaagaaagctttgccaagagtaagaaatgtgctgtcatcttttaaatcagtctgcacgggtgttcttttttccttccttcctcatacaacaaagtgtcctttcttccatcaaagccagtccctctacagtaagtgttctagagtctgtttccttctgctctagagccttttctttgattcttgtttcatacttgcatcttcaactaattatgctctttcctggattcttcctgtggctcttttgtccttcaagcttcttcatacatccttgtgctataggtactccctatcgtacatctttacaggcagatgtcatgagtggtttactacacaaaacttctctggtgcttttcttctcatcccttttcagccctgttctccatttgagggactgcatgttaaggtctctagcgtgaaattcggaagacattttcagccttcctcttacttgacctttagcaaccctttgattatgtccttcttgaaatgctttcggggatggaaggctttgtgatgctgctttgtctggaccatgtcataatactctccaggatagcccctttgttcccatgacttcatgtattatctctctatgccagagactctttcagctgtttctctaagctccaaacacacatacctctatctagtagaatgcttttcaagcatctcaaagtgaacatgtctaaaactgaacttgtgataataccgcaaatctgcttttgaccattttagtgatggggagtccttcacacaggcagaaaactaggaaatgtccttaactcctcctttttaccaacactttttctcctaatctgtcaccaagaccgcttgatttctacctccaaattaaatttacctacttttcattttcttgcctagactgttgtagaaacacacccaagctagtctcttagagaagcttttctttcttcttcaatctaaattatattctgttgtaacttcctgtattttttcttcctggggcttattacagtttttaccatgagtttatataacagtgtgtagcacacagtacttgtttagtagacaagctgcttttgaggttgatctgtaattcattttactttaaaaattcttcgaatgatctattcacatggcttcactcatattgactcttcaaatctggatctcccatagtttatggtttccatgatgtaagtgactgcctcctgggagcttcacctgagtaacagcagagacttcaaacttaatcttgtcctcaactaaactctcatttcccatcctgcccccaaaactcttgttatttattttactccaggagtcacccaagccataaaatttgacttttctgtttaggttgtctttcagcttatatctcatgttattatcttcttgtcttcagccattcagtgcagtttccacattgataatcagggaatccttttgaaaacacagatgatatactagtcttgcttagagatattaagcttagtatctagattgtttggtgtaacctgcaaggtttttcacttttctggttctgccttcttttgtgctttcaactctggactcctgtttttgtttgtttgtttgtttttgagacggagttttgctcttgttgcccaggctggagtgcagtggcacggtctcggctcactgcgacctccgccttccgggtttaagtgatactcctgcctcagtctcctgagtatctgggattacaggcgcccaccaccaggcccaactaattttttgtatttttagtagaggcggtttcaccgtgttggccaggttggtctcgaactcctgacctcaggtgatctgcccgcctcagcctcccaaagtgctgggattacaggcgtgagccactgcacttggcctggactcatcttcattgtccacctcctaggctaaatttatgtcttttatgtgcttgtaatctctgcataccactttagtgacacttgccctggagtgtgattggtaatccctctccccactagatccttgaaggcaggacctgtgttccctgtttaaccatagttctcaattagtaattcaaatttgggttggggagagctaagtggtaatttttaattccttcaaattttccatgaattggactaatttaaattctggtcagagataacaaaggataatacaatttgatctatgattatcttgtgataaatacttaatggaagttaaattatttttaaaaatcacagaaggtaactcaggttacaaaaatactttgcagagaatcagatatcaccaaggagagaattcagaagatcctggcaactggtgccaatgttattctaaccactggtggaattgatgatatgtgtctgaagtattttgtggaggctggtgctatggcagttagaagagttttaaaaagggaccttaaacgcattgccaaagcttctggaggtatgtcttgtgctggctgtcacataaaatacttttattatccctgatcctatcaaaggtctttttacattggaatattgacagaaaacagctcaaaaacatttatattctcttaatgctttgtgctaccaacacatttatagagccatttttcatgtaactggagaaattttgttggaaatttgtgaactgaatttgttcatttctaaaatgacagttccatcttaggataaaaggagttaccgtgtgctgcctaactaaattctaaacttgtaatatagcacttttaccacaaatgctactgagtccaaggatattaaaatcatgaaagagcaatattcacagatcctttgtaactctcttattagcaactattctgtcaaccctggccaatttggaaggtgaagaaacttttgaagctgcaatgttgggacaggcagaagaagtggtacaggagagaatttgtgatgatgagctgatcttaatcaaaaagtaagagccactttctaaaattgtaaagttataccgattttgttaagtaaaagtaggttttcttcccatttatttgctgcttgtagtctcacagtgatacgagcagttatacgcatgggataaaataacattgggccactgtaaattgagatgaagtaaccattttcatctcttctgcagggactagacattgtttctgtatagtatatctaaatatcctgtgtaggcaggacttaagggaactttatgtagacttattttattaaaatgccattttttttgagaaattgatggtcttggcaaaaaaaaatttttaaaaatgctattacaagaattgtacttttgttttgaacagtactaaggctcgtacgtctgcatcgattatcttacgtggggcaaatgatttcatgtgtgatgagatggagcgctctttacatgatgcactttgtgtagtgaagagagttttggagtcaaaatctgtggttcccggtgggggtgctgtagaagcagccctttccatataccttgaaaactatgcaaccagcatggtaagaacagtcatttcttgtcttagaggcctgagagcagtagctgtggacttcaattttttttttcccttttgtgaagtcacctaattttcttcttttcctaggggtctcgggaacagcttgcgattgcagagtttgcaagatcacttcttgttattcccaatacactagcagttaatgctgcccaggactccacagatctggttgcaaaattaagagcttttcataatgaggcccaggttaacccagaacgtaaaaatctaaaatggtaagcatggtttcccgctctttgttaacctctgcagaacaggttgcattaaaaaggatagtagtcaattacatgtcagcaaacataagtaacagacttgtcaaatacttaacatgaaaaacttcacagcaagcatttgttgttcagtcactgtaattcaagggataatgactaattattagcactggtgtgtcttcgttaactgtgattgctaatctctccctgcttcttttggtagaaagactacctacaagatctctagtctgatttaaaaatcaaccttaatacttgaatgaaatgctggagttaataggccacctaatgaaattgtaagcggccgttaaataattctttcttaattgcaggattggtcttgatttgagcaatggtaaacctcgagacaacaaacaagcaggggtgtttgaaccaaccatagttaaagttaagagtttgaaatttgcaacagaagctgcaatcaccattcttcgaattgatgatcttattaaattacatccagaaagtaaagatgataaacatggaagttatgaagatgctgttcactctggagcccttaatgattgatctgatgttccttttatttataacaatgttaaatgcaattgtcttgtaccttgagttgagtattacacattaaagtaaagtacaagctgtaaacttgggtttttgtgatgtaggaaatggtttccatctgtactttggtcctctgatttcacatattgcaacctagtactttattagtttaaaaagaaattgaggttgttcaaagtttaagcaattcattctctctgaacacacattgctattcccatcccacccccaatgcacagggctgcaacaccacgacttctgcccattctctccagtgtgtgtaacagggtcacaagaattc

SEQ ID NO: 37057 - DNA, 49746 bp, Homo sapiens
gtccggccggaacctgtttgcgaccccgagtcccatgacaccgcttctcctcacaccccagtccgcagtgcccctccccagcctcggccgggcctcccgggagccgggcgtggcgttccagctagtgagccgtttctcccctgggctcggaggcggaagcttgaggggcgcggggaggagcttcgcgtgcggggtgaacgcccgctctacgtgctcgttctcttcgcgaccgctgcgcgcgagccccgtgtccccacggcgggcagcagcggcggcggcggcggctgaacgcggagggggcggagggagcccgcggcggcggcagcagctacagcgaaatggcggagaccgtggctgacacccggcggctgatcaccaagccgcagaacctgaatgacgcctacggaccccccagcaacttcctcgagatcgatgtgagcaacccgcaaacggtgggggtcggccggggccgcttcaccacttacgaaatcagggtcaaggtgaggccgtctctcccctctcccaagaaacccctcccgctggctctggtcacccccactcgacccgggagtggacccccgcgggcagccacagcctcccaggccgggagcccccttgcagaggcgggccggggtcgtgagccagggcccctcttcctgtagggctggtgtggggggctgcagagcgagcccggcgcgctggcacttggagaaggtgctcgaagaggagggcgtgggttgagcgccgcttgcccctccagcagctgatcagggaatgacatttgagttggaaaggggtagatctttcgagaacacatcccttcgctgggaagggaaagagatgttgacagagaaaaggggcttgcgcaaagttaaagccttttcccagttttctcttcctggagacttcccagaggtagcaagccaacccggctgctccaggcccttcccgagctgctaaagtaacctgggttgtgcagtcttctgaacgggacttaatgaaagttcacagaagcctgacaatttttgatagggctgagccagaccagaagggtgattggacatggttgacttcagcattttgggccaccgccctgccaaaggctgaggtgtggtgtcacctacctcataatccagaactacagttgctttaagaaaagactagggatcttgctctcttaattcgagatttgcacttaattgaataaagaaatcaacagaaataaaatatacctaatttcataactagtatttgttggcaataatttagatgatttgaaagatgttaattgaaaatagtgcttcactttcactctataattcaggattaaagaatttgcccatgtatggaagcatctttaaaaattaattacattaatttaaagatgacagcaaattattaaaagttaagtgtaaagcgatttttcctttaatcaaaatttatatgacaagctactattaacatttaagtgaaaaaattctcattaacttacacactttgtgtcgtgaaaaacacaaaaatcaaatttaccatcctaaccatttttaagtgtacatacagctcagtagtatattcacattgttgtgaaacttaagtatttttaaaaaatgattcttacgtagttagcattgattttaaaaagttaatcaaactttaagatatgaaacgaatagtttaatgtttcaagccactgttgtcttcttatggatgtgtaaaatgtggatcataggccgggcgcggtggctcatgcctgtaatcccagcactttgggaggccgagctgggcggatcaccgaggtcaggagttcgacaccagcctgaccagcatggagaaaccccatctctactagaaatacaaaattagccgggtgtggtggcgcatgcctgtaatcccagctactcgggaggctgaggccggagaatctcttgaactggggaggcagaggttgccgtgagcctagatcgggccattgcactccagcctgggcaacaagagcaaaatcccttctctaaataaataaataaaaattgaatcataggatatgttgtcatagggaaactgcaaaatccagacttcagtacacctggggaactacattcatacataaacctagtggaaaagtgaatgtttttctaattgtctgtaatacatgacagatggttcactaaaaagaacttcctcttttgccctattcactagtattttctttttttttctttcttgtgctaaaacagaacttggtattcttgtttctatacttccatagcaggtacttcctgtcacaaaactgaattggaatctcctgcctacacttcctccacttactttgagtttatcttgctgaatgcattatattaaatgggttctagtataataatttaatcctcttttttttttaatacacctaataccttagcaaatagctgatgtgacacttaaaaatggtttctgggcctggcgcagtggctcatgcctctagtcccagcactttgggaggctgaggcaggtggatcccttgagctcagaagtttgagaccagcctgggcaacacgttgaaaccccttccccacaaaaaaagaaattagttgggcgtggtggcgcgcatccctgaggtcccagctactccagaggctgaggtgggaggatcacttgagcccaggaggtcgaggctgcagagagctatgatgaggccactctactcaagccggcataacagaatgagaccctatctcaggagagagagaaaaaagggttttggtatagtcatttacatgttaaagaaaattttttttttttttttttgagacggagtctcgctctgttgcccaggctgcagtgcagcggcgctattttggctcacagcaacctccgcctcccaggttcaagtgattctcctgcctcagcctcctgagtagctgggattacaggcatgcgccaccacgcctggctaatttttgtatttttagtagagatgggatttcactgtgttggtcaggctggtcttgaactcctgacctcgtgatccacctgccttggcctcccaaagtgctgggattacaggcatgagccaccgcgcctggcctgaaaataatcttttttaagaacgattaatgagtcagggaactaacaaattatacacttactttggtttgtatttttgtataaaccaactcactgggtgttaatagctgttaacagtcataaatgccagtgcctatgtgaaaacctaattgagtttttaatgcatgaaatgactttggatttctttctttttttatttttatttttattctttttgagacagagccttgctctgtcgccaggctggagtgcagtggcgcgatcttggctcactgcaacctctgccttccgagttcaagcgattctcctgcctcagccgcccaagtagctgggactacaggcacgcgccaccacgcccagctaatttttgtatttttagtggagacggggtttcaccatgttgaccaggatggtctcagtcccttgacctcatgatctgcctaccttggcctcccaaagtgctgagattacaggcgtgagccaccatgcccagcctggatttcttttagtatgtaatgtgttaacttaaaactaaggacaccatatagtaaggaaattaggccttatttgagcagcatatgattttttagagtaattatagtcttgcattaaggcagagtggctatgacatgaatagtttaatattttgtaatttttttcttcttgagataagagtctcgttctgtagcccaggctggaacacagtggcatgattgtggctcactgcattctcaaactcgaggactcaagtattccccccgcctcagcctcccaagtagctggactacagggtactactatacctggctaattttttattttttgtcagatgagacttgctatgttgcccatgatggtcttgaactcctggcctcaagtggccctccccctctcagtctcccaaagtgttggaattacaggcatgagccacctcacccagccctgcaattttatttattattttctaaatgttgctgctctcccgaacccctactgactaccttttgctgttgaatttgctatgtggaaaaccattttatgttccagaatttgggcttttaaactatcttacagttactgtctcattctggtcttgagaaaaatttacagttttacaggatctgattgaaattactctaattcacagggcaattttatatggatggtggcacttagaatgcaagtttcccaatctccatttatcttttggtttgaggatagtgtttaagactattaggatcacttgattagtatctctgggcttttgaaaataattacacagtgttatgtttttaaaaattgttctaatgggtaggtacagcagagagcaccataaatgattaaaggtttaggaaagttcaaggtctggaattatttaggcatattcaagagaaggctgaaagcaaaattcagtcactgtttatgaagtttgtgctgtaatataactttaatattctggagatttttaagttaatcaagatctattttacctggagaccactgttttgaacaggaatggaattagaatctttcttgagctctgacatagtcctcagttcaaagaatagatttaacatttcctagctgggtaagatacaaaatcaaagctccacttcccctctgtgaaataggtgtgctaataatagtacctacctcttaggactaaatgggataaggcacatgaatctttctagcacagtgcctggcacataataagcacgcaaaatttagctctttctaaagatagacattttctaaattaaacgtcagtgatcaactacattttctgtgtgttaatgtttagttgagttactaaaattgttagattttcttgtcaagaaacctacttgtcatggaagtataccttcattaagcaagcatggtataaaaataagctatcttatttggtacttaaccaagtaacctttgtgtatgtatttattttttcgagacagggtctccctctgtctctcagcctagagtgcagtggtgcagtcacagctcactgaagccttgacctcccaggctcaagtgatcctcccaacctcagcctctctactagctgggaccacaggcgcataccaccacacccagctaatttttaaattatttgtagagacgagatctcactatgttgcccaggctgctcttgaactcctgggctcaagtgatactcccacctcagcctccaaaactgctaggattataggtgtgagccaccatgccaggctccaaataatcttttaaagttgagctttattaaagcataaagctgaataataacgttggctgataaaaattttgacaaggtgctaaataaatgtagcatcttatcttgacagtgcttgccgttctaaacttgtatatgttttttcctctgggtcagtcatctaatcttaaattaggagtcattaatatccagattggaagctgagaaataaattttaaaatcttagacttatttttgggaattataaacatgtattattgaagggctaaaatattaatagtattttaaagaatcggggggtcgggcacggtggctcctgtatgtaatcccagcacttgggaggccaaggtgggaggactacttgagctcaggcgttgccacacagcctgggcaacgcagtgagaccctgtccctacaaaaatttaaaaattagccaggcatggtggcgtgtgcctgtagtcccagctatgtgggaggctgaagtgggaggatttcttgagcccaggaggaggtcaacactgcagtgagccacgatcataccaccgcactctaacctgggtgacacagtgagaccctgcctctaaaaaaagcaaagcaaagaaaaaaaaatcagggcattttgatgccagaggacatctgcagaatctatgtagctctatcaattggccaatgagatgttgtctgttacacatgttgctgccagctacggctgacttttccaggatctccatcaaggagaagcatgctattagcagtgaagattctgtccttatctaatccatccccagaatggagagtgggggaggaagacagtggctattttaaagtagtcctgttatattgagtttttagggattctgttctgttaagggatgtatcatttgagtatcttttatgtgcaaagcactgtgctctatctataaaatttaatcttgaggtaaccaagcagagtagataatattcctgtagaagctgatcaactgatcctcatctcttgtcctttcctcattttaactccagtcctgaactggtatctcccaattaagctgagttcttttgtatccaggccttttgcacacacttcctcctctgttaagaacaggcttcctttaagagcctcatctggttactatcacttatcctgcaggactcagccttaatgtcccctttttaaagattttgctgatcccttgactctggaccagatttccttcctgtgtgccctggtagctttgttaggaataaatttgtttgcttgtctttggcttcctgtaagttcctgtgtcacccattataagctcttagaggacagggactgtcataatcacccttactcaatatccaacactgcttggcacatagtggacacttacaaataaatgaagtttaagaaagttaacttccccagggtcacagctattaaatggtaaaactgggatttgaacctagattttcggaccttcagagcccgtacttttgtttgagacagggtctcactctgttgcccaagctagagtgcacggtggtgcaatctgggctcattgtagcctcgacctcctgggctcaggcaaccctcccaaccttcgcctcctgagtaattggggctacaggagcacgccactatgcctggctaatttttttgtatttgtagagacagggtttctccatgttgcccaggcttgtctcagacaaggttttaccatggttgcccagagccctcacagaaaattcatatcacctgaggagcctttgaaaccattcaggttctcttttactggggtggggtggggtttgggcagtggcggtttttttttttttctttgagacggaatctcactctgtcacccaggctggagtgaggtggtgcaatctcagctcactgcaagttccacctcctgggttcatgccattctcctccctcagcctcccgagtagctgggactacaggtgcctgccaccacgcctggctaattttttttgtgttttcagtagagatggtgtttcaccttgttagccaggatggtctccatctcctgacctcgtgatccacccacctcggcctcccaaagtgctggaattacaggcgtgagccaccaagcccggccggcagtggtggtttaaaaagcatcccagtaagggcacttatatgcagcaaggatttctcctgctgcttatcatgctatctgtctcactgagatagatagacagtagagaaggaagagaaatatacatagaaccacaatggttggtagctttgatgggattaaaaaaatagattctaaaatagtaaaacataaaatgaatagcagatcttggcaacagagaggaaaaccagtgacatttgtcaaagatagaaaactttttggaggggaggcatttaaatattaactgaaagcataccaatctctacagcttaagtttttgggaggaaggggagacacagactacattcaatcaagccagatctttttgcccttgtcttgcatcatccatgtctatatccctgtataataatcatgaaagtaagccagaagtaaaaaaaaaaaaaaaaaaaagacatatgtattcatttaagaaaggaattttttggagacaggttctcgctgtgttgtccaggctggtcttgaactcctgggctcaagtgagcctcctacctcagccaagtagttgggattactgttgcatgccatcaagcatgcctcaaaaaaggaatctttataaatattgtcactttatacctgtaaaggggaaaatctaaaaaagtgctttgagctatcctggtgatcacatgcaatagacattttcctctcctgctcacctttatcatcatgcttatctcaccccttccagaaagtagtagactgttattattagatactttgatgtttgtaccatgttatgctgctttcatgtaaatagagccagcaatttcttgaacatcagataagaaagatggtgtccaaaaaaatcttggaactgctattttcttttttccagaagtttattcttagggccgggtgtggtggctcatgcctgtaatcccagcgctttgggaggctgaggcgggtggatccctcgagatcaggagttcgagaccagcctgaccaacatggcaaaaccccatatctactaaaatacaaaaattagccagtgtggtggtgcatgcctataatcccagctactcagggggctgaggcacaaagattgcgtgaaccttggaggcagaggttgcggtgggtggcagcgcgactctgtgccaaaaaaaaagagaaaaagagaaaaaaagtttattcttaaatgtgcaacaggctccaagacatttcatcctttgcttcctagagtggaagcagaagattttatagtaggaaatgcagatatttaaataggaatgggatcaagggtcatcattgcctcggacacagtggtttgttttttggtttttgttcttgttttccagatttctcccttctaagtactaaccaggcccaaccccgcttagcttctgagatcagacgagcaattgcattcaggatagaatggccatagacttttgccggatttcttaattccacctatccagggaacccttccctgtggcctttgcttttagctcctcaagttttttctgctcctcttcttgtttctgcttgaaatccttgtcttcctcatacatctccttggcctgtttctcgtcaggggcttcttgccgtaggtgcctgtcaggaagctggacgtggtgcctgccatcccttccttagacccagcacaggaaactggaactgcagtttactgttttgattccttagttaaaagacaaagctttcaaccaaagttctacttcatttttttgtttgtttgtttgttttatttatttatttatttttgagacagtctctcaccctgttgcccaggctggagtgcaatagtgcagtctcagcttactgcagcctctgcctccctggttcaagcaattctcatgcttcagcctcccaagtagctgggaatatataggtcgtgcaccaccatgcctggctaatttttgtatttttagtaaagatggggtttcatcgtgttgcccaggctggtctcgaactcctggcctcaagtgatatgcccacttcagcctcccaaaatacaggcatgagccaccgcgcctggccactacttctttaaagaaatatttaactgacaacctaggaatttggaatgtgttagtaaaatgtgacgtttgctatagcttgccagaaaggttgtatcaggtagtatagagtttgggctgttctcagataaagaggataattttttgtttttttggtttttttctccacatggagaggtttcaggtacagtccagggttagtattgtggcttgactatcagcttctaacatcatattcacattctagccaaggggaatgtttatttctgcccttgaaggacacaaccaggaagtcgtattatttctgtttctgcgcattgctgtacttagctacaaaagaagctgggaaatttaaccaggtggccatgtgaagaagggaagagtagacactgttctttgctttgccacattaacaaatggttgtggttggcccttctaggatatggctttaagctacactgtgatcatctgttatttcctttttttgctaatgcctggaatttcagtttagagtaagttcatttgatttgcaagaaataaaattgtactttcattagtttggaagtcttaagtgagtaagttttgattctttcatgataattaattttgttaagttgagaaaaaaggcaagcatgaagacatggcatatctgataggggtataccttgagattgggctagagattctaaaggtagttgattaacctttttttttttccttccaaggctgcttaaaactattttggttttacttaggaccaccattgtagttgctgacattgaatgatggagtatataatttgagccaccaaaataaatgaagccagtgtctcttggcagagaatcacttaatctcttagcagagaagtagagaattacttaaaataattttgtaaagttactttgtgtccagcagtattggaatggtcatttgataattatttgttctgtaaactttgattttatcactgatggagcatttcttttggctttcctaaagttattttagcacctgccacctatagcttgtttgctttccgttttttctagtcctgcccttgtgggatgaagttctctgttgtataagtctcgtccatattgagaaacagaggagtctcaaagcccctccttgtgtctggtcttggtatctcacccctctcttgtcttgactttactggttatcttcaagtggaaacaagtagagaaaaatcttgtcagctaggcatgtatgtgtatatcaccaggtcttgtcttaaatttacacccaaagattcccccatggtatataactgaggacattcttaggacactgaggagtttaaatagagcaagggttggcaaattatgggcttacctttttttataaataaagttttattggaacacagcatacccatttcttcccatattatctaagaccacttttactctataagggcagaactgagtagttgaaacagtatgtttactatcttgccctttaagaaaaggtttgccaattttatgtctagagtttgctcatgtaacattgaaataatggaaatcaaaaggcacttggagaatctattatcaaaacatgaggccgggcatggtggctcactcctgtaattccagcactttgggagtctgaggtgggtggatcacttgaggtcaggagttcaagaccagcctgaccaacatggcaaaaccctgtctctactagaaatacaaaaattagccagctgtggtggcgtgcccctctagtcccagctactcaggaacctgaggtgggagcatcacttgaaccctgggggcggaggttacagtgagccaagatcacaccactgcactccagcctgtgtgacagaatggaaccctgtctcaaaccctaaaaaatatcatgaggctatggaaaaagcattcatttaggaagccagtagtaaacgactgaggaaatagtcattaaatataacactgcacattcatcaaataataagatcttaatgcataaccctattgttgggtggtgaatgaaatattagataccattctttcctcctagaggcccagttttacatagaaattgtaactttgtgttgtcatcccactgataatattaaggccaggcacaaggtttttcaacttttgaagtttattttctcactcgaaaccttttatgtaaactcctttgaatacccacataaaggaaagaaagttggtgctgataaactagtgggcagcaggttcatggtggttcagggtcggtcagcaaaccagtgccaacactgaagatgatgccaaacaaaattgactgcaatctgttctagccaggatcatggtttagatattttctagccagaattaattaatttattatttttttctttttttgagacagagtctcgctctgttgccaggctggagtgcagtggtgcgatctcggctcactgcaacctccacttcccaggttcaagcaattctcctgcttcagcctaccaagtagctgggattacaggcacgtgccaccatgcccagctaatttttgtataattaattaatttctcatacagtatcatcatttaatgatttgtggggttttgtgtgtgtatgtgttttaagagacagaatctcactacattgcccaggttggtcttgagctcgtgagctcaagtgatcctcttatctgcctcagtcttctgagtagctggtactacagatgtgagccattacacctgtcttaatgttttgtattcttacatgttaaccccctatgtaatatggcaatgtgcagttgtataaataatttttaataatatttaagttggtattggttgaactattaacataggtaagtcctttctacaaactctgtctctcttgtctaaaagctgggtgtggtgatgcatacctgtagtcccagctactcaggaggttgaggtgggagaatcatttgagccaaggaggttaaggctgcagtgagctataatggtaccactgcactccagcctgggtgacagagtgagaccccgtctcaaaaaaaaaagaaaggaaggaattaagttgaaaattgagaaactgtgataccagctctaaatgggacaacatagtgaattgatagaatttttgtcttagtttagaaggccagattatgttgatatgcttaagttgggataaattgcagttttagagcgtttttgtttagacctcagcatgattcttatctataattgatatttgttcagttttcttccctcaaaacatccgatcaattgtttttttctaactaaatttcttttttagagttgttaactttaacttgagtagctcctgtgggtcagttgatttattgagtacttgcaatgctaagtttaataacacatgttactgcattcagtaagttcacagcagcctgaaacagggctagatttctctgataagttttccccagaactgtccaataaatgaacatttatgaactgtctgttatattccagacattgctagatgcttgtttaaaagatgaataagatatgcctagcctttggaagcttccaaactggtggtaaggagagtggggagaggtaaattcataaaatatgcataatctgtagtgggaacccaggtctgccctgaggggccaggagtgtgtgtgggcagaaagtgagccagtagtctagctagggggagcacctgtctcttttgtgcttcactgccagcatctgacatcaatgacatgccagaatcacacagtaataatactggagtgattccttgttactctctgacacaaacatttttctcgatttttatttataattttatatataatgtataatttggttttaaaattgttattttaatttttattttttaataaatagtgacagggtcttgctgtgttgcccaggctggttttgaactcctgagctcaagcaatcctcctgcctctgcctcccaaagtgctgggattacaggcatgagccaccacacccggctataatttgttttaagcatcgatgttcaggcggtatggtaggcactttcactctgtgttttctctgatatagtttattctactgcattttcttacaaactgtaattactcttatttccagttaaaacaaatgataggctgggcgtggtggctcatgcctataattttagccctttgggaggcagaggtgggaagatcacttgagcccaggtgttcaagaccagcctgggaaacatagggagacttaaacgttgtttttttttgtttgttttttgttttttaattatctgggcatggtggcatggactagtagtcccagctacttaggaggctgaggtagaaggatcacttgagcccaagtggttgaggctacattaagccgtggtcgtgccactgcactccagcctaggtaacagagtgagacccggtcacactcaaaaaatacatcctagatattgaccacttcatcattcttacttagcaataatcgtttcctgtttcctcctgtcttactccattttcacactgctataaatttactacccgagactgggtaatttgtaaaggaaagaagtttaattgactcacagtattgcatagctggggaggcctcaggaaacttacaagcatggaaggcaaagaagcaagtacctgcttcacaaggtgccaggaaagagaaagtgagcagaaagagccccttataaactgtcagctttcgtgagaactcactcattatcacgagaagagcataggggaactgcccccatgatacggtcacctgggggtttacacgtggggattacaattcaagatgagatttggatagggacatacagccaaaccatatcacatcctgaccatgctttatgatatagctaagaaagtctacctgctcttttcccatgctaaactctgatgatctttcctgattcctcttgccagaagctaatccagtgtggacttgagcctgtagtcttagctacttgggaggcagaagtgggaggatcgtttgaggccaggaattagaatctgcactgagttatgatcttgcccctgcactccagcctggacaacacagcaaactctatctctgatgagaatgctgagaacacattctattctatactgaatttatgttcccaggcaaaagaataaaaaaaatacaattttaagaaaaaaaaagggaggcaggagatacagtgtctcacgcctataatcccagcactttgggaggtggaggcgggtggatcaccagagatcaggagtttgagaccagcctgtccaacatggtgaaaccccatgtctactaaaaatacaaaaaaaaaaaaaattaggcatggtggtgtgtgcctgtaatcccagctagtcgggaggctgaggcaggagaatcacttgaacctgggaggcagaggttgcagtgagctgagattgcaccactgtagtctagccagggcaacagagcatgaccctatctcaaaaaaaaaaaaaaaaaaaaaaaaaaaaagaatgctcaaagctcttttaagaatttcttacttagaggcctcagaaataacaccacacgtctacaaccatctgatcctcgacaaacctagcaaaaaacaagcagtagggaaaggattccctatttaataaatggtgctgggaaaactggctagccatatgtagaaagctgaaactggaccccttccttaacaccttatgcaaaaattaactcagatggattaaagacttaaacgtaaaacctaaaaccataaaaaccctagaagaaaacctaggtaataccattcaggacataggcatgggcaaggacttcatgtctaaaacatcaaaagcaattgcaacaaaagccaaaattgacaaatgggatctaattaaagagcttcagcacagcaaaagaaaccatcatcagagtgaacaggcaacctacagaatgggagaaaatttttggaatctatccatctgacaaaggtctaatatccagaatctacaaggaacttaaatttataagaaaaaaacaatcccttcaaaaagtgggcaaaggatatgaacagacacttctcaaaagaagacatttatgcggccaacaaacaattttaaaaaagctcatcatcattggtcattagatgcaaatcaaaactacaatgagataccatctcacgccagttagaatggcagtcgttaaaaagtcaggaaacaacagatgctggcgagaatgtggagaaataggaacgcttttacactgttggtgggagtgtaaattagttcaaccattggggaagacagtgtggcatttcctcaaggatctaaaaccagaaataccatttgacccagcaatcccattactggatatatacccaaaggattataaatcattctactataaagacatgcacacgtatgtttattgcagcactatttacgatagcgaagacttggaaccaacccaaatgcctatcaatgatagactggataaagaaaatgcacgtatataccgtggaatactatgcagccataaaaaagaacgagttcatgtcctttgcggggacatggatgaaactggaaactatcatcctcagcaaactaacacaggaacagaaaaccaaacactgcatgttttcacttattagtgggagttgaacaatgagatcacatggacacagggaggggaacatcacacaccagggcctgctggggattggggggcaaggggagggagagcattaggacaaatacctaatgcatgtggggcttaaaacttagatgacgggttgataggtgcagcaaaccaccatggcacatgtatacctatgtaacaaacctgcacgtttttttgcacgtgtatcccagaactaaaaagaaaatttcttattttcttggccgggcacagtggctcatgcctgtaaccccagcagtttaggaggccgaggcaggtggattacttgaggtcaggagttcgagaccagactggcaacatggcgaaaccccgtctctactgaaaacacaaaaaattagctgggcatggtggtgcatgcctgtagtcccagctactgggaaagctgagacagaatttcttgaacccacgaggtggaagttgcagtgagctgagatcatgccactgcactcccgcctggcaacaacagagcaaaaaaaaaaaaaaaaaaaaaaaactccttacttatattcttatagactatattattttaaatgtggttattccagagattgatggtggtgatgtttgcataacaatatggatttacttaatgccacagaactctgtacacttaaacatgcttaaaataattttatattatgtatattttaccacagtaataaatatggaaacaaacagtatggaggggccaggtacagtggctatctcctgtaatgccagcactttggaaggccaaagcaggaggatcacttgaggtcaagagttaaaaaccagtctgggtaacatagtgagaccctcctctctacaaaaaataaaaattagctaggtatggtggcatgcacctatagtcccagctactcgggagactgaggtgggaggattgtttgagcccaggaggtcgaggttgcagtaggccaggattgcactgctgcactccagcctgggtgacagagtgagacccaccatctcataaagaagaaaaaaaaagcgggggagaactggagagggcagtttctttcccttcaaactatcaaagcaaggaaaaaagtagttctttatgtctttttgccaagaactctcagttcttagtcatctattgtgttttacagtctactttatctgatactaatatagccagtccagttttcttatgagtatttgcagggtatgtaattttctgtcctttcacttttaacctgttttgatttttgaggcagtctcactttcttacccaggctgggatgcagtggcatgatcttggctcactgcaaccttcacctcccaggttcatgcgattcttgtgcctcagccttccaagtagctgggattacaggctcgtaccaccatgcctggctggtttttgtatttgcagtagagacggagattcaccatgttgaccaggctggtctcaaactctcgacctcaggtgatccaccccgccctcggcttcctaaaatgctgggattacaggtgtcagccaccaagcctggctcttcatgtggatttcatttactatctggtatcatttttttcagccggaagggctttctttagtatttcttttttctttttctaaggttcccatcagatgggtaatgtgctgaagtcataacaaggtttgaaggaggcatgtcacacacatgagcatgaaaacccaatcatcatgcttacaaactacagaaggatttctttagcatttcttctaagtcaggtctgctaaccatgaaggcttgtagtttttttgttttgttttgtttttttgtctgggactgtcttatatttttatttttgaaggatagtcttgttagatgtattagttttttattgctgaattaaaaattaccacaattgtagccctcagaacacccccagccaggtgcagtggtttgtgcctatagtctcatctacacaggaggctaagacaggagaatcactttagcccaggagtttgaggcagctgcagtgtgctgtgatcatgcctgtaaatagcctgcactccagcctgggaaataagcaagacgctgtctcttaaaaaaagtaaaaatttaaataagtaaatggagttttaaattattttaaaaacaccaccaaatatcatctcacaagtttctgtaagtgagaagtctgaatatggcttgtctggactttttgctcagggtctcacaattgcctacaatcaaggaggttggtcggggttgtggtttcatctgaggcccgggagttctcttccaggcttacatagttgtgggcagtattaattttcttggagctgtaagtttagagtagccttcctcttaaaggccagtggaaaaaatctctttgatctcagggaagactaaagcccccttttaaggggctcacctaattaagtcaagactactcacaaaacttggtgaagtcaaagtcaaactgattagggagtttaacatctgtaaaatcccttcacctttgccatgtaatgtaacctaattatggaagtgacatccattgcattcataggcctcactcacattctaggggaggtgtgtatgccaaggggtggcaattttaggcaccatcttggaattcagcctaccacgctggatagggaattctttgttgattttctttttttctttgagcgctctgaatatgctgttgcttccttgtctccattgtttctggtgagaagtcagctgttaatcttattatgggtcccctgtagtgatgagtagatttctcttgccactgtattcaagattttgcttttctttggctttttactgtgatgtttattgggtgggaatctctttgtgtttatcctacttagagttcattgagcttcttggatgtatagattaagggtttagtcaaatttttttaagttttcagccattatttattgtttctttctctcatcgtgggactcccattacatgtgtgttgatatgcttgttagtatcctacaggtccctgatgctctgttcattcttatttttttctttctttctgcttttcagaatggacagtttcttgatgtgtcttcaagtttgctgatgcttttgtctgccagtttgaatccactgttgatccccttcagttaatttttcatttcagctattatacttttcagctgtagaggtccaattcagtgttttttaaataatctttttgttgagattctctattccttgaatcattgtcatcatgctgtctttcagttctttaagcatggtttcctttaatttgaacatattgatagctgcttggaaatcctggacagctgaacagctgaaccaccccagagacattttctgactttttatcctcctgtctatggctcacactttccagtttctttgcatgtctcataattttttgttaaactgaacattttagataatacgttgtagagactctgagttagattgcctcctgcccctccccaaaggggaggtggtggttgctatttattttttttagggacttgcccacattaagtctgtagtatgaggtggtgatagcacggatcaattttttttttttaagccaggttttctaagggtcaccctgagtcagtttgtcagcttatctcagtggtcagaaatgactggtcaaaggttatgcgtagctacttgagccagtgaggcttcagcctttttctttttttaagagacaggatcttgttctgttggccaggttggtcttgaactcctggcctcaagcagtcctcccaccttggcctcccaaagtactaggattacagacgtgagccactgcacctgaccagcttctgctttttgccagtgcaggttggggaacaagtcaaagttcaggcagtttacaagttcgccccagcttttacttcgtgccgtcttctcatgtccatggctctcccttgtctgtgaaaggtctcattcagccatggatgtttagataactagggttctctccagctgagcatgcatacagctttgtgtaagcacacatacttttttttttttttttttttttttttgagacggagtcttgctctatcgctcaggctcgagtgcagtggcgcgcaatcgtggttcactgcaacctccacctcccaggttcaagtgattctcttgtctcagactcccaagtagctgggattacaggcatgtacccctatgcccagctaattttttgtatttttagtagagacagggtttcaccgtgttggccagggtggtctcgaactcctgacctcgtgatccacccgcctcagcctcccaaagtgctaggattataggcgtgagccactgcgcccgacatcacacagattttcagacctccacagatacttgggagttaatcaaggccccaccatggctatgtaattcttctggtaagtctgctggttcattgcttgcccccagtattgcaaccttgggttgccgcaatattagccttccccactgtttgctgccaatgttgctgttggtttcaacaatagtcctgcatttgggacttctatattctactcctgaccagtggcccccctccagcagtgatggtgttggttttcacagcttgccacatcctggtagaactaccattgatagagctggtggagcatggtaacaatagccctaggttaaaacacacagacttctggccgggcatggtggctcatgcctgtaatcccaacactttgggaggccagggcgtgtggatcacctgaggtcaggattttgagaccagccttgctaacatggtgaaactccatatctactaaaaatacaaaaattagccaggcgtggtggtgggtgccggtaatcccagctacttgggaagctgaggcaggagaattgcttgaaccagtgaggcagaggttacagtgagccgaggtcgcaccactgcactccagcctgggcaacaagagcgagactccttctcaaaaacaaaaacaaaaacaaacccacacacagacttctgctcttcataactgagttgagtagtttttcttgaatgattacttttcaatttgttatacacctgtgcccactttcctgagttctgatatagtggtttgacatgtttgtctagttttttcattgaattttggagagacgctctgttgagctcactctactattccagcagttccccctttacctttttactttatacctttcttttaggttctcatatttttaagagaaatggtcttattcatattatgtttttcttcacattattatgcttttactcttaatttataggtgctcagaaacactttttatgcagtgtttaaatgtttttagaagcttcttaatcaaatatttccaggccccttgaacatagtagttgttgagatattcattaaatgctcatttagtagagttttaaaggtttatttaatatctgctttgggtcaagtactataaccatagtgtgactttagagcatggactttgaagttgaacgtgtgtaagaatcctctctctgttaatggacatgtgaccttgaacaagttacttaattcttctcttttgaatgtcttcggccataaaataaaacttcagaggagtaaatgtgacttaaggcataatatttgccctacattaagtattcagtaagtgataacttgtgagaatgtgtgagaagaatgtataataatagtttctacttaattattaaggtaagtgacagtattttctttctttttcttttaagagacagggtcttgctatattgcccaggcttgtcttgaactcttggcctcaagcagtgctcctgagtagctgggattacaaacatgagccactgcacctggctcattttaaagatggtaaaactcagattagagaaggaaagtaatttggcatgatcgtactgttaatgagttccagaaagaggagtcgaacccgggtctgcttgactaattcatttttccctgctacttccaggaatcagaaaaggtgtcaagggctaggcacagtggctcacgcctgtaatcccagcactttgggaggctgaggcgggtggatcacctgaggtcaggagttcgagaacagcctggccaatgtggcgaaaccccgtctctactaaaaatacaaaaaaattagctgggtgtgggggcacatgcatgtaattccagctactcgggaggctgacataggaaaatcgcttgaacctaggaggtggaggtttgagtgaaccgagattgcacatggcactccagcctgggtgaccatgtgagactctgtctccaaaaaaaaaaaaagaaagaaaaggtgtcacaagtttgtggttagctcctatcattggtacaaagcaaatattgaattatacttacatatgtttgtttgcattttccccccaccccatgcaacatgtcaagaacttccactacaaaagtgatataccaattatttgaactttgtgtgtttctgtaagatacagccttagtgaataaaacctggaatttcttaggtgagcggaaaaataagaggctttaaactcttcatccacaaatacaagcatgaaaacttggacactttttaaaaaaattttcttttttatggcggttgaggtggaggtttcactgtgttgcctaggctgccctcaaattcctgggctcaaaggatccgcctacctcaggctccctagtagctgggactacaggcacatgccaccgcacctggctctcatgaacacttttgatatgtagtggtgtaagtggctgtaaaaagtatacttagaaaatttttgttagctttaaagcctctgagcctaaaacattgtatatacatgtttttatcacaatgtactccaaagattatgtactctcttacagaaacctccccagtggtattccatctctttaattctctttcctgacctatgtttgtctgttctgtgacacctactctgcttgggtatcctcttataattcttaactgtgtcataaaatcagctaatgcagggacaatgttcatgtacttagttcatggtagattctttttggaggagaggggtatccattatagttgattctttttttgtttgtttttttttttttttttttgagacaggatctcactttgttgcccaggctggagtgcagtggtgccatctcagcttacttcatcttcatccttgacctcctgggctcaggtgatctcccacttcagcctcccgagtagctgagactacaggcgcgtgccaccatgccgggctaattttgtatttttagtgaagatagggttttgctatgttgccaaggctggtctcaaactcctgagttcaagtgatcagcccacctcagccttccaaggtgctgggattacagacacaagccactacacccagcccatcatggtagattctttttttttttgaaatagagtctcactcttgtccctcaggctggagtgcagtgccacgatctcagctcactgcaatctccgcctccctggttcacgtgattctcctgcctcagcctcctgagtagctggattacaggcgctcaccaccatgcctggctaatttttgtatttttagtagaggtggggcttcaccatgttagccaggctggtctcgagctcttgactttaggtgatcgatccgcctgcctcggcctcccaaagtgctgagattacaggcgtgagccaccgcacctggcctcatggtagattcttaatgccttttatgttgtacacttattagcattctaagtaacatcattttaatggctaatgagctgccataatcaatatttatagatatcatggtttaaaatcttaccatgcttccaagtaagatttgagggctagagataaaggatctggaatgatatccttttcttacaaactctgcaactcagagtagaggggaaggtattggaaggtggagagaaaggtggccaaagtacttagaaatcaattttaaattatgaggaaaagaaccagaatattctgctctccagctctacctcaaccacttattatacctaacagttaaagaagatatagtagccagaaaatattttaaattgtgctaagctgattatgtattgaaacttttgatggcaagttgcagcttctcttagccgtggtttatttaggggattcttagacaaagagttactttccatttctaataaaaagatttttatgttaagtgatttgagtactgtcagactgttagaacaataaacattctttgtggagctttatgaaaggagtaaagtattgtaatggcactactgtcaatctgcaaatttaaagcatatgcgtgtgtatagtgtttaatgtcatgatgtctagttgctgttatagctaatcactctgactggaagagtttattaatatatgtatcactcatgtgttagagaatttagacttattaaacattcattttcatgttttttatagttttccaagtaatacttcaagctttgaagaaacagcttagttttgttcttttataatataggtggaagccgggcacggtggctcacgcctgtaatcccagcactttgggaggccgaggcgggcggatcacgaggtcaggagatcgagaccatcccggctaaaaaaaaacggtgaaaccccgtctctactaaaaatacaaaaaattagccgggcgtagtggcgggcgcctgtagtcccagctactcgggaggctgaggcaggagaatggcgtgaacccaggaggcggagcttgcagtgagccgagatcccgccactgcactccagcctgggcgacagagcgagactccgtctcaaaaaaaaaaaaaaaaaaaaaaataataataataatataggtggaaactgttttatatatatatatataaagagaggtagagagagagacagggtcttgcttgttggccaggttggtattgaactcctggcttcaagcaatcatcctgcttcagcctcccaaagtcctgggattacaggcacgaaccatcgtgcccggccaaaactgtttcatatgactattcttagaggtttattaagttatttattgtagagagcaactcagtcttcaattacagtttttatttagaatcttacctttctttagcatagaaaaactttagctgattttatcagatttctaaattatgaaggaatactttccttgctgaataattgagaattaattgacttttctgtattattgaggaacttcaactactcagaatataatcagaagctaattaaggaagtagaaaagaactaaacagcgaagagttgaataaataacaagtctatatactttttctttttttgaggtagagtctcactctgtcgccgaggctggagtgcagtgcgtggtatcagctcactgcaacctccgctttcatgtgattcttgtgcctcagcctcccaagtagctgggactacaggcatgcaccaccatgcccggctaatttttgtatttttagtagagacgaggttttaccatattgggcaggctagtcgtgatctcctgacctcaagtgattcacccacctcggcatcccaacatgctgggattacaggtgtgagccaccgtgcctggcccaagtctatgtacttttgagttaccaagtttttagagatgaaatactgtcttctcatgatctgcatcttgtttagcataactctaccaaagtcaggttattgcttcagttgattattgctatgtaaaaaccctaaaagttggtgaccgaaaacagttacaattaaacattcacttcattacagttctacagtttggtcaggtcttgaagtcatggcttgtctctgttccacttgatatctgtggggccacttgactgggactggaggatttatttttgagataactcggtcatatggctggctgccagctgggatatcagatggagatgtagatcaggtcctcagttctccttcatggggagagttagacttctcacagaataacggtgacaggatcgcaagagagaatgtctttatgaacaaatgttccaagaggacaggccccaattcacaaatgtttgatcaaaggcagtcacatggccaagccaatgtgagagaggatacaaaaagatatttaaatattgagtgtcatggtttgttgtaggctaccaaagtagctactactactgcagtgttccttctcattctatagcaaagtagcctttctggaggacaactcgaagacttaacatttatagtctttggcctagtaatttcacctttagggtttattctaaggaaaatatttaaactccctggatctgtatcaaggcttcatttagttttcatccattgcattttgcctagagttagatagctggttaatgcaggaatccagattaaagccagattttctagttccagaactgtgtgcttcatcattgtactatacagcctctcacccagggatgtctgtatataatcatgttaatgatatgagaaactgataatatatttaataaaaataagatttgtatatataaaaatctaaaaggctatatactgaaatggagtatctacaagtcaatatgtatgttttttaattgtaaggatatcttttataagtctaccatgcaaactcaatatattcacatgtatatgttttgttttgttttgtttttttgagacagagcctcactctgttgcccaggctagagtgcagtggtgcaattttggctcaccgcaacctccgcctcttgggttcaagcgattctcctgcctcagcctccgagtagctggaactacaggcacatgcctccacgcctggctaatttttatgcttttggtagaaacgggttttgccatattggccaggctggtcttgaactcctgacctcaggtgatccacccgcctcggcctcccaaagtgctgggattacaggcgtgagccactgcacccagctgtcacatgtatatgttatatatatatatatatgttttttatatattttaattttgccttgattactcaaatactggtctccaccctttcattcaaacatcaaagagctgtgtgataaattgcggctgtaaatgctacatgtaatgaatcttggaagagtattccgctctcccctccccaccccctctttacactgtaaatataatgtaaatataacccttgaggaggatgtcttgagatccctgtagtccatagctgcctgatgcaccatatgtagaagcttagaaaatacgagtacttactgaatagagcttcttaaccaatattctttaactggcttccacatcacagttttacttataatgactttacactccattctcacagtattattccaaatcactacccttaaagaggtaaaatattatcgcccatatctgtcccagctaagctaaaccagaattacttggtgattgtacaaattcccaagttcctaccctctttcacatttattaactctagggcagcagttattcgctctttcagccaggctggagtgcactggaacaaccttggctcactgcaacctccgcctcccgggctcaagcgattctcccacctcagcctcccgagtagctgggattacaggcgtgtgccaccatgcccggctaatttttgtatttttagtagagacagggtttcaccgtgttggccaggctggtctcgaactcctagggcagcagttcttgaccctggatgcacttgagaatcatttgaaaatactgattttcagattccaccctagatcagttgcatgagattctctagttggcgtcacttgagtgtgtttcttaggattggacaagttgggaagacaccagaaaatagttttgcattttaaagattgtccaaaaaaggtgttagactattaatagacagttttatttcagcataagcctgtaggattatgtaaatcttcatgaattgttatgaatgaattttcctttaaaatagaattattaatgcacagtttcattagagattactcattgaaaaccttgtgtgagctctccaatgagtcttgttgctaattcacaaatgaagaatatggacaatgtaggaaaagtatctggaattccttggtttatgcatttaagctagtctagataatttattctctactgttttggaaattataccataaaggatacttcttttaaaataaggaggaattgtatcactggaaggcatgtccttattttttaaagaaagaaactaaatacgttggcttagtgacaatctacatttcaaaggttctctggactaaaagcttattcttcatttaaatgacttcttctcagccttattaagagttcatctaggttataaaccatatctccagttattcatgctgttccagattgggtaaaacaggtatcaaaagtactgaagggtgaagcaatagcttaagcacttctcagtttatcttttatctctagatgtagatatttggagaaatgcagctgtttaatgagaactgtagtggggcatccatttacatctcttaggattggttgaatagagtatggcctattgaatatacttttgatgttgttgccagtctcttttcaaatgtacacgtgacactatctgaagaaatactagaaacacctagtaaacatttttctaatatctattgttaagctatattcaggtgatcacattttgaggcttggttttctgcttggctatcagtgataatcaggtaacatatagggtatctgtgagctgctgactttaataggtcagcctgtgtaagtgtataagacctacctttttggagaccaataatgtggtagtttcctgtgcttagacttgaagggagcacttgttttagacctctataccatggtttgagaaatcttttccttagtatgtaatatccatttgcattcctgatgatcttaccctgtgtgattagtaatactttttgtggaaaatggctggtttctcttttataaaaatagtagtttaagagtatccggcatacacatatctcttttaacattttattgctttgcagttttgttcctggtatattagaacaaatagacaacaacaaaataacattgaacaattcaggtttttagtcttgttcttttctagttctttgaatgtcccaggatcttgtaattatttcatcactttttcataagccaagcaaaatatattctcatcttgcaaatgaaaagcaagatacccagcagcttgagcattaccccgaatttctccagaagagtacaaatatccaagtagactataaacccttgtttaattctgtttattaaatcaacaaattgaaaacattctgtacttaatacatcggtatattcacactgtatttggcagggagtggggctttccttcagtaaagcaatctctcctaatggttaaagttagataaataacttcacctaaaaatgtgaattctctaagaagcagagtttattttgtggtctgatagttctgtaagttcgaattagctaggcaaattctaaatggcaataaattttattatgaagggctggttcaggaaaaaggaattaaaaggtggggaaaagataactattggaggaatctgacctctccttaccaagtgacccagtaatgggacaaactgacattatgtgccttccgatggaaagcatcaacactcctgccatttaggaacattactgccaacaatgcaaaacaaagctggtcatgaggaaacagacaaacccaaatgtagaatgttgctctgaactctttattgtcagtgtcttgaatgacaacaagacagggggcgactcttctagattaaaggtgactaaagaaacaaccagagggctgagtgcagtggctcatgccagtaatctcagcactttgggaggttgaggcgggtggatcacgaggtcaggagttcaagaccagcctggccaacatggtgaaaccccgtctctactaaagatacaaaaaattagccgggcgtggtggcgcgtgcctgtaatcccagctactcggaaggctgaggcaggaggcggaggttgcagtgagccgacatcgcgccattgcactccagcctgagtgacaagggagactgtgtctcaaaaaaaaaaaaaacaccaccagaggtgggaggatccctccagcccaagtgcctgtagcgcgctaggatgttgcctctgtgctccacccttggcaacacagggagaccctctttttttgcctgtcttctttgataatgttggtgatctattttatagttttccaaagaaatgttactaagtagtggtaacaaattaactagcatttggcaaataacaattaacaaaggcatgttttgagtgtggaataacatagttttatggactcagtggattccaggaaaccaacttaacttttttgagatgcaggtaattacagttctctgctcttttaatgttagtttgggccctgacataagctttaagtgactgttaatattgggtttctaatatagaacccttgagagctatccagattatttgagcctctgtctttgcttcagatttatgatgaaacgtgatttgcagaacttttgaactccatgaacaaaattgaagtctaaagtagtccagggttactcaaactcagaatcttcagcatttactagtatatacctatacaaatagatgaaggctgtggcttactttttggttcttgccctatgctgtactttacttttgcttgtctcccatcttacctgtctgtgatcactgtgcccacatcggctgatctattgttatttcccacaaataacatatttcttgtatttcctacaaatattatttcatacagatggttgtatttaacacttttacctgttaagaaataaaatgaacagtagctaggaagaaaattgtggcttccactttatactcagcctgatactaagcaacttctcttaaaattagggggaaaatatgaatattagagtgagagaatactaaatcttgctgtttaaatttcaaaagttttagtcatcttaaagtaagttaacaatatttaagcctgatttacatttaatttcagaattcagcattctttctgggtaaatctagagcatttaaagtggcatccaagataaaacctttaagggatttttgctgtaatttgcctcagtagtctgactcttgtccatacatttcaaagcagataaacctaggaatcaactagagccatctgttcttaattctacaccttaatgctacatgcagctcatctgtggcttctacttctgtagtaacttctctgttctattttttctgttcatagctatcatttttctattcaaacatatttattaactcctgatgctcacaggtagtcaccttagccccatatttagagtgcaatttaaacttttcagttttatttcccatcattccctatgctttagaatattcaagaattatatactaaatatacactgtacttgtttcttctctgcatttagctcacactattttcaccattttcagctgtcttatagtatggctagctctgtgttaaaagagtcctggctgaggccattgcactcgcgccattttaccctagcatgggcgacaagagcgaaactctgtctcaaaaacaaacaaaacgaaaaagagtcctgactggccgtacgcagtggctcacacctcatattccagcactttgggaggctgaggtggaaggatcccttgagcccaggagttcaagaccagcctgagcaacttagggagaccctgtctctaaaggaaggaaggggagggagggagggggagagggaggggaagcagagagactgaggaaaggaaagaaaaggaggggaaagaatgaatgaatccgggccaaatcaattgtcaattcttccgtgcttttcatattatacaaatggtattatgctatataatatactgttctgaaactttttttttttttttttttttgaggtggagtctcgctctgtcgcccaggctggagtgcagtggcatgatctcacctcactgcaacctccgcctcccgggttcaagcgattatcctgccatagcctccggagtagcaggaattacaggctcgtgccacctcacccggctaatgtttgtatttttagtagagatggggtttcactgtattggccaggctggtcttgaactcctgacctcaagtgatccacccgcctcagcctcccaaagtgctgggattataggcataagccaccgcacccagcctgaaactttttacatgtcatacattctagacagcttttctgattaacctatggctgagttatattttgtaaaaagctgtgtaatataagcttgtaatgtaagatttattgtttctggtcttttttggggtttttttttgtgtctattacaatgctaaaatatttttgtatgtgtggaaatatttgtaggattaattcccattgaaattgttcattcaaaagttatgtgtatttaatagagtaatggataatgtattcaccaaaatgccccccttttttttgagaccgtctccctctgtcacccaggctgaaatacagtgagtgatgtgatcacagctcatgcagcctcagcctcgaaggctgaagccatcctgacaccttatcttcccactacaggcatgtgccaccatacccagctaatttttttttttttaaacagagtttcgctcttgttgcccaggctggagtgcagtggcgcaatcttggttcactgcagtctccgcttcccgggttcaagcagttctgcctcagcatcccgagtagctgggattacaggtacccgccaccatgcctggctaatttttgtgtttttagtagagacagggtttcaccatgttgtccaggctggtcgcgaactcctgacctcagatgatccacccgccttggcctcccaaagtgctgggattacaggcatgagccaccacgcccagcctgcccagctaattttttattttttgtagagatgggggtctcaccatgttgcccagcctggtctcaaactcctgtgatcctcccacctcagccttccaaagtacagggattacaggcttgagccatcatgcccagccagtttgtagtatttttaaccatggaaattcaactttttatatgcttattttctaaccttgattggtgtatgtttcataagggccaggtctgcatcttattcatcattataaataatgattctcccttatctagcatggtgcccttttatagatgatcagtaaataatagtttagtcctcctgaagctgtaggtaaaaaacctctccgcccttcaatcattttatgaaagttaaataaattgaaagtgaccaatcacaggagtttcagcagtgatagttcagtaccttaaacaacaacaacaacaaaaaaaaaaaacccacattttgcacttagttattttaatcagttacattgaattacaaatccttgtaatgatgaggaagacgtttaacaggctaagttaaccactgcatatgtaatgggcaagtgatgtttgaatttcttgatgtgactttaaactctaaagcagtcctcatgcaaaaagagaaatcataaccagttaagaaaactaaaggaactttcttaagctaatcatggtcctctaaatttaagtatataaactatcaaactattagctaatcatagaagggaaagtacttttccccctcacccctcccctttctgttagagtgaatcagatataatcatgattgtgtcaaaagttcaaaagggaaaatggaaggtaaaatgagctgaattggcactcttctctcaacattgtacctgtaagcttgatatgttgtttcagagattaactttatagacttccgtacccagaagtatgaaaattcttaggggactcttttcgcaagcttgatcttaacgtatttgaataaagagagcagttaatcccctttgtaaagtaatttgagaggagggaattcagaatgtaaaatctcacctgcagaaaacactcaactctgtaaaggcctttttatctttaaggcatttacaaagacttaatattttaatgcggaagggtgaacttggttaaaaagccaataggtgaaattagagagaaataatccagtgctttctttctgggaattattctactctccaggggacctaattttattccctgtggggaatgagaataccctctgtacaacaagccagcatctttaaatataagcttgacttttagtataataagagtcttgttaggtgcaattttttccttagtcatttatacaatgaacaaatgttgtggttacctgggaaagaaaattcaagtgcttttaaatctcttgtgagatttggtttcatgcttgaaacctatacactgttatgcccaatagcatctgttgaaaattctgagctgtaaggtatacaacatagagaagttaatacacttaggaaaaaattgagaccactacaaaatggatttaagggcctgaattaaaagcttttcttgtgctgagtgacagctacttaccagtagcattaagcttaacaaataagtagaactttcttaggagtgaatattacaagatgatgtccctgtatacacagtaggaagccagtctttccttcaggtggcacttaacttttttcttccaattgtaaaacactttttagttctatgcaaattctgtgctaattagttcaaagtctgaattaacggacagaatataatctaagagaatatatagtgttgagtagtatttttggtagggtatggcattagttattatgttaagtcatttctgtctcctacaaactttgtgataatttgcacattttaaaatctttttggctgggcacggtggctcatgcctgtaatcccagcactttgggagtccaatacagatggattgcgtgtactcaggagttcaagaccagcctgagcaacatggtgaaaccctgtctcaccaaaagtacaaaaattagccagatgtgatggcatgcgcctatagtctgagctacacagggggttgaggtaggagaaatcacttgacttgaccctgccatgatcatgcctctgctctccagcctgggttacagagtgaaaccctgtctcaaataaaattctcaaataaaataaaatctttcttctcctttttttttttttttttttttttgagagagagggtctcatttgttgcccatgctggagtgcagtggtgcaatcataatcatagttcactacagtctggaactcctgactcctgggctcaagagatcctcccacctcagcctcccaagtagttaggactacaggcacatgccaccatacccagtaaatttattttattttttgtagagatggaatcttcttatgtttcccaggctggtaactcttggcctcaagcagtcctcccatctcagcctcccaaagcactaggattacaggcatgagccaccatgcctggcctaaaatctattcttaatgataaaatactggtctcataccactcctaatagtctttagtgtttttagtcataaaccattttttattggatttggtagcatcttttttttgttttgttttgtttgagtcagagtctcactctgtcgctcaggctagagtgcagtggagcgatcttcggctcactgccacctccacctcccgggttcaagcagttctcctgcctcagcctcccaagtagctgggattgcaggcgcccgccaccatgcccagctaagttttgtatttttagtggagacagggtttcaccgtattagccaggctgatctcctgcccaggctggtctcttgcccaggctggtcttgaactcctgaccttgtgatcggcccacctcggcctcccaaagagctgggattacaggcgtgagccaccacgccaggcctagcatattttttcttgttgttgtttttgtttttggagacggagtctcgctcagtcgcccaggctggagtgcagtggcgcgatctcggctcactgcaaactccgcctcctgagttcacgccattctcctgcctcagcctcctgagtagctggaactgcaggcgcctgccactacgtctggctggtttttttgtatttttagtagaaacgaggtttcacctgttagccaggatggtctcgatctcctgacctcgtgatccgcccgcctcagcctttcaaagtgctgggattacagtcatgagccaccgcgccctgccgcatattttttctttaaaggggatccagtaaaagataatagaaatctttcatgttactttttttaaatttagaagttgactgaagtggcaacaagtagcctttgcaatcttaaaaagaacagtctccagaaattttcttacattccagtgtaacttcaaagtactgggtgttatgttttcagttcttaaacttgccctccgcctttaaagctctgggtttatgagcttggtctactgagtacgatttaatttcctactaggggtaagacccatagacactgtatgcagcactttccctgcttttcttggcattttttagaaggccattaagaataatgttttatttaggtcttttattatgcaagatctaatccagtcctcataacaaaatattttggtttcatttagaagcagctaagtgggccaggtgtggtggctcacgcctgtaatcccagcactttgggaggctaaggtgggcagatcacgcggtcaggagatggagaccatcctggctaacacggtgaaaccccctctccactaaaaatacaaaaaattagcgagccatggtggtgggcatctgtagtcccagctacttgggaggctgaggcaggagaatggcgtgaacccaggcggcggagatctcagtgagccgagatcacgccactgcactacagcctgggcgacagagcgagattctgcctcaaaaaaataaatcaaaaaaagtagttaagtgagccagcacagtggtatgaccctgcagtcccagctacccgggaggccaaggcgagaggattgctggagcctaggagtttaaatccagcctgggcaatggagtgagaccctgtctctgggagaagaaaaagaacttctacatcaacgggcagtgtgataggcattgagacataggttagggttttgctatgatgaatgagcaccaagaaaataaaattttaaaaattaaaaggtaaggtatatttcccctatgaggactgtttgctgaggtactagctaagctggagaatagtcaagagctagccttttttcacccctgcttagttgacatttttaaagctcactgaaataataagaaaatgacctacatttatgtaaatatcctcaggcagaatgacatccaaaagcatgcatgcaaaggtacatttaaaagttgtgttcttgtgtaaatacttttaaagaactagtgggccaggcagtggctcaggcctgtaagcgtagcattttgggaggccgaggcagcagatcacttgaggtcaggagtttgagaccaccagcctggccaacatggtgaaaccccgcctctactaaaaatacaagaaaattagccaggcctggtggcgagtgcctgtaatcccagctacttgggaggctgaggcaggagaatcacttgaccctaggaggtggaggttgcagtgagccaagatcacatcactgcctgggcgacagtgagattctgtctcaaaaaaaaaaaaaaaaaaaaaaaaaaaagaactagcaaagttttattttgttatgggtaaaaggtcatattaaaaacatcatgatttcggccgggtgccgtggctcatgcctgtaatcccagcactttgggaggccgaggcgggcggatcacctgaggtcaggagttcaagaccagcctgggcaacatggtaaaaccccatctctacaaaaatacaaaaattagctgggcatgatggtgggtgcctgtaatcccagctacttgggaggctgaggcggaaaaatcatttgaacctgggaggtggagtttgcagtgagccgagatcgtgccattgcactccagcctaggcaacaaagggagattctgtctcaaaaaaagaaaaagaaagtcatgatttcttttgttttgccatacccgtccccccatttttttgaagtttccttaatgtgcttcaatttaggactaactttttttgtttcagacaaatcttcctattttcaagctgaaagaatctactgttagaagaagatacagtgactttgaatggctgcgaagtgaattagaaagagagagcaaggtaagaatgatttatgatgcaactttaaagcaaaacattccaagttttaatgtttaatatttctcaggaaaatgatattgaataaaatgggtaaaagcaaatatgatttctttttttcaaatagttcagtgtcattttatagaggtagagtctgtgtaaattttccttagaactctttctcttgtctgctttggcccagttgaggtctttgctgactcacacttcaataacacttcttagaaccttgttgctattacttccttcctttccctcatcgtcctattccatcttcccctctccacacacttaagccaagtttctcttcctcaatacattttataaatgtcagtgtatttccaattttgttttagtgacatataagtttttttcatcacatatatgttcatgtaacagaagtttcataaagcagtaatgacctcactctgtgtgatatgtgctgatattcttcagattagcgtttttaaatgatggccatgatccactaatgggttgctgccggcaatttaaaaacactgttacatgcctgatcttctcttagaatagaatttggtagctttggcatcaaaataaattaaagcaaggtctcactctggtgtctctcatttcagccctgcctcagaatgacatcagaggcaaggagtcatggaaggacgtggtgtgctcagaatgatgaaaagttattttgtgactagaaagtaggtaaaaaggtgtgggtatggtaggagtcctgaactagatgaaggctagtctgtactcatttctcaagtttaataagggttttctttttttttctgtttctagcctaagataaaagtggctgcatatgagcacaaaatatgcagatcatagcattccaacaaaaatgtaaagaaggccgggcatggtggctcatgcctataatctcggtactttggtaggccgagtcaggaggatctcttgagcccagcagttcaagaccagcctggggaacatagtgaggccccatctcttccaaaatttttaaatatgaataaaactagaaatacaaaatctgtgttaagaaagctctcaaactttaccaaaagaccagacctaaataaagaggggccaggtgcagtggcttacgcctgtaatcccagcacttcaggaggccaacgtgggtggatcacttaagccaaggagttcgagaccagcgtgggcaacatgcgaaaccccatcgctacaaaaaatacaaaaattagccaggcatggtgacatgcacctgtagtcccagcactcaggaggctgaggcaagaggatcactttgagtccaggaggcagaggttgcagtgagctgtagtcttgcccctgcactccagcatgggcaccagagccaggccctgtctcaaaaaaaaaaaaaaaaaaaaaaaaaaaaaaagtgtaatactgtattccttgtaatactgtattcctcgtttggaatgtttactgttgaagatttttttattttataaacattttagctcgtcctttgtgttctaggagttacaggtagagctatgaacaaattaaggtcccctcttttatggtgcttatatcctattaggtaaattgcgggggagggggttgttgaagagaaggcaggaaaaatatagtaaaatatatagatgtcagatgatgagaagctctaaaaaaaaaaacaaagctaaactaagggaagtaggaagtgccaggggagccactctcatatagagcacaagggaaggcctcactctaggtgacattagcagagacctgcatgaagtagagcagtatcttctaacttatttataaattcataagattgtagtagaaatttcagtagggctgtttataaagttgcagatttatttatgagctttagaatcagaaaaagctcaagaataaccaaaaaatattttcagtatatagtgggcagcaggttatttgttctaccagacatcaaaacatcttttttttttttgagactgagcctcactctggagtgcagtggcatcatgtcggctcactgcaacctccatctccggggttcaagcaattctcctgcctcagcctcccgagtagctgggattacaggcacccaccaccacactcggctaattttttttatatttttagtagagatggggtttcatcatgttggccaggctggtctcgaactcctgacctcaggtgatccgccctcctcggcctcccaaagtgctgggattacaggtgtgagccactgtgcctgacccaaaacatatcttaaggctatagtaattcaaacaatgtggtgtagtcatatggcacttaatgatgagaatacattctaagaaatgcatccttaggtgatttcattgtttgtgcaaacatcatatgagtatactcacacaaacccaggtggtgtagcctactacacacctaggctatatggtacagcctattactcctagactacaagcctatccaacatgttactgtacttaatactacaggcagttgtaacatagtgggaagcatttgtgcatctaaacatataaaagatatggtaaaaaatacagcgtggaagacttttttttttttaaagcatggaagattttttaaatagtacacctgtatagggcacttaccataaatggagcttgcaggattgaaagttgttctgggtgagtcagttagtatgtggcgagtgaatgagaagacctaggacattactgtttattactgcaggctttataaacactgtacattgaaatttataatttataaaatatttttcttcaataataaattaaccttagcttactttttaaactttttactttaactttttgactcttgtaataacacttagcttaaaacacagacacattgaacaaatgtacaaaaatatgttctttatattcttattctataagcttttctctatttaaatttttttaactttttcttaaaaattaagtcacaaatatacatagtagcctaggcctgcacagagtcaggatcaccaagacatctctaggcaataggaatttttcacctccattataatcttaaggcaccacagttattatcttaagtggtccatctctgatgggaaacactgttatgcagtgtatattgctttaggttgggcaaatagattagtggaatataatagagtttagagtttgacccatgtatttatagggaatttagttcataacaaaaatagcattgtcattcagtgggaaaggaattcagcaaatggagttgaaatatttgtctattaggaaataaagatttatatctcactatattacaaattacagatggttgggagattgattgattgattgattgacagagccttgctctgttgcccaggctgaaatgcggtggcgtgatcatagcatactataatatcctccaactcctggtctcaagtgattttcctgcctcagcctcccaagtagctgggactacaggcatgagccaccatgtccagctaattttaaaaaattttttgtaaggatgaggcttcactatgttgcccaggctggtcttgaattcctggcctcaagtaatcctcctgccttggcctcccaaagtgctgggattacaggcatgagccaccacacctagctgagaagtgtcttgatacataggctttgggctttgcttgacataccatgtggcacactggaaatgtttaataaacgtttgctgagtgtatattttgcttttttttgtaaatttatttattcattttttaaaaatttttagtagagacggggtttcaccgtgttagcaagacggtctcgatctcctggccttgtgatccgcccgccttggcctcccgaagtgctgggattacaggcgtgagccaccccgcccgaccgcttttgtttttagtaacagctttattgagatataattcacataccatgcaattcacccatttaaagtgtataattcactggtttttaatatgttcacagagttgtgcaaccatcactattttagagcactagtcaattttagagcatttttatcacccaataaaagaaaccctgtccccattagtagacaccactgatttctccccaacccttcctcactcagcctatggcaaccacctgctagtctcctttctctgtggatttgcccattctgggcatatgtaaatggaagcccacaatatgtgatcttttgtgtctggcttctttcacttaacatgttttcacagttcatgcttttctaacatgcatcaattacttcatttctttttattcctaaataatatcctattgtatgcttataccacatcttatttatacacttatttggtggacattttgttctactttttggctgttattggtagtgctgctgtgaacatttgtgcataggtttctgtctgcatgtgttttcatttcttttcagtatatacctaccagtacattgctgggtcataactctttttaaccttttgaggaattggcagaccgtttttccaaagcagctgtgtaattttacattcttaccagcaatgtgaggttctacttttctccacatccttaccaattgcctgtcttctttattatagctatcctactgtttgtgaaggggtattgcattgtggttttgatttttatttctctaatggccactaatgttgattttcttttcatatacttactggtcatttatgtatcttctttggagacatctttattgagagcttttgcctttttcaatgggttcatctttttattatagagttatgtcgagaatatataagactcttagagttccctatcagatacataatttgcacatatctcccagtctctgggttgtttttcactttcttgatgttgtcctttgaagcacaatacttcacatttaacattagaccagttaaatatattgagagttaaatccatgtgaaagttttactcgtattacagtattgcaaagaacaatgtaatcaagttattttgtggtatattagtacttttaactaagatctgttaaactaagctagaaattagctgacatgtattatggtcagatcttttagcttttattctagtttgctttagctttcaatatattgtgctcaccagatattctcctatttctcaccccacatgcacgcacatatctttgcattcatgactttttaattagtattagaattttttttttttttttttgagacggtgtctagctctcgcccaggctggagtaccgtggtgcagtcccggcttactgcaatctctgcctcccaggctcaagcaattctcctcagcctcctgagtaaaggggttacaagcatgcaccaccatgcccggctaattttttgtatttttagtagacacagggtttcaccatgttggccaggctggtcttgaacttctgacctcaggtgatccacccaccttggcctcctgaagtgctgggattacatatgtgagctaccgcacccaacctggtgttagaattccagttaggtgttttcagactgcttcagcaaaaataatttgatgtagaagagaatcttagctggatgagccatttatgatttttatagatcattaatcctgttgcctaccacctccccatccatttgaatgactagtttgaatatgttaggaagagtgtatctctacagaggataatgcatagctatccttttcttaaattcccattatatatgaaatttatatatatttaattatatatatattgttacattttttatcattttccttctttctttaactgacatccttgagctatccttttcttaagtttcatgctaaattctaccctgaattaatggtggtcatttatttaacacagtggttccagaattctttttttaaataataattgtgtagatacagatatttttccctgcccaccagatagccattctactggaacgtaatggttagcattcctttgtttctcagttatagaaggtccctgcagattttaactctcaactaaacagatgttaacatgggggtgagatctgagaatgctagcataaatttacggagacaaatccatagatatcttcatcattggtcatctgaggagagtaaatctaggaagggattataaagtttatttggacatttggtttttttgtttttattttgttttttgttaatctatatgaagtcgagttgctctttcccttttttaccctattgaattttgtttgaggataaacaactcgttgtagaaactatatcaagggtttaaagttttaatttttttgaatatgtgtaatttgtattattggtgaaaagaaaaatatgtatcagtttactatatatatttctccttgttctgattgtttgcttacacatttctctgtttgcgtttaaagtaaggatccagctaagtggttggtcatttaacagatatttgagcttctgttgtatgcccagtttttcttaaaataaccacaagaagcctaagacaggggtcttgatttgaagacattagtatgatagattgatggttttccaccaaaggcagttttatcccccaggagacgtttgacactgtctagagacattttttattgtctcagctgggggtgctatgttgtctagtgggcagaggctagggatgctgctaaagaaaagaatgccagcctggccaacacagtgaaacaccatctccacaaaaaatagaaaaattagccaggcgtggtagcacgctatgtacctgtagtgtcccggctatttgggaggctgatgcaggaggatcatctgagtctgggggaggctgcagcgagccatgatcgcaccacggaactccagcctgggtgacagagcaagaccccatctcaagaaagaaaagaatgcacaagaaagccccccagtacaaaacttatctgattctcagtagtgctagggtagagaaaccaaactaacctgtgaaatagctaggtgctatttaatcaaaacaagtattttgagctccagaataacatttttaaaaatttattttttttttaagacggggtctcgctgtcacctaggctggagtgcagcgacattttagttcactccagtcctgaactcctggactcaagtgatcatcccacttccgcctcctaagtagctgggactacaggctcacaccaccacacccagctaagttttttttatttttgtagacatgtgcccaggcttgtgtcaaattcctggcctcaagcaatcctcccgcctgccttggcctcccaaagtgcagggattgcagatgtgagccactgcacctggcccagaataatatttgagctccagataattcccagaagggagagatcagcaggagttgacccttggttaggctttgaaggggaaaatttgggatcttcctatagtgcgagaagggagaaatgacaggtctttgggaaaagacagcaggatagggcatttgggagaaagttgacttgtttcttaatttaggaaacagaatagtgacaactagagttattggtattttgtcatcacctcaaacacaagtaggaaagactgtatgcagatggtaagaggttgaagaaaccagaaatctttttttttttttttttctagacggagtctcactctgtagcccagctggagtgcagtggcgtgatctccactcactgcaagctctgcctcccgggttcatgccattctcctgcctcagcctccagagtagttgggcctacaggcgcccgccaccacgcccggctcattttttgtattttttagtagagacagggtttcaccgtgttagccaggatggtctcgatctcctgaccctgtgatctgcccgcctcggcctcccaaagtgctgggattacaggcatgagccaccacgcccggctgaaaccagaattcttacctaaccatgttgcagagagaacattaacgtttcttcatttaattgagagttgattttgatctctgcagtttccattgcaataaggcattgccttctccaagtggcatcacaagtgtctgaggggcatggtaacctttatttcagtgttgtgagtgttctctttgtatacctgggctttgataaggccaagaaaaatgatataagctatgggccctgcctttgaattaggagcttttgtctgatgggctattctgcatttgtctaaacatttggtcttttttcagtgtattttttgctcttttatatttcaactagtttgaccggacgatggctgtcatagtgaggacatgctttgtcttcatgttgtgctctataaattttcacaacccagtcatcatgatcaaggagtttctgtcttcacattttaggtcgtagttcccccgctccctgggaaagcgtttttgcgtcagcttccttttagaggagatgatggaatatttgatgacaattttattgaggaaagaaaacaagggctggagcagtttataaacaagtaagtgcttcctattcctcaaagtgtaggactactttaagtgactacttgtagtttagatgttaagctaaactgcactgttgccttttctttcagccatttcctaacttttcatatcatttaaacaaagtaaaagtatctgacaagttgaatatcatgtgataaatattaacacatttgagtgattgaaatgagcatctttgtgttgacctacgttttgtatttgtttttcttggttaatttatgcaaattacatttaaaattacggcatttaaaaaatacagttttacttatgattctttctgatttaaggtatgttctagcatgaacaataaaacttacaatgtacttgcaatcatcttgtttgattgcagatggaggtattagcatgtcttgtataaaggtgcatgtttttaattttcatggtaaaatgtattcttttgaaaatgtaagaagacttaggattgtttcttttttactttagaaactcttgataagctcaaaccaatatttttagcttttaattttattcccatttgaaatatagctattttgtaaaataatagaaagccagagtgttagaaagatttatgccaagaaagacctcactgtaattgtgcattggccttaaactagcaaaagtaaatcaaatcgtacagaatatggtaatgtgagcttacactgtaaattttatctagtgatttgaagatccatgagtggtaaacaggagagaaagggttacataaagcccttggttatctactgtagcactcaatattcattgtctgtgaatctgttttccttttggagaaggcagtactatattagatttttttttttttttttttgagacagtcttgctctgtcgcccaggctggagtgcagtggtgcagtctcggctcagtgaaacctccacctcccaggttcaagtgattctcatgcctcagccacctgagtagttgggattatagttgcgcaccatcgtgtctggcttatttttgtatttttagtagagacagggtttcgccatgttggccaggctggtctcaaactcctgacctcaagtgatctgcctgccttggtctcccaaagtgctgggattacaagcatgagccaccacgcctggcctatattagatatttttaaattctgaaataatagtccggttgcccagtgtggttttaagcaggcaaaaacaaacaaaatacctggatatttgtgcctgtttttttagtattttgggcttttattgaacttcattgtatttctaacttcaatcctgtatcttctcctctttaaaatagactctggcctggtacagtggatcatgtctgtaatcccaatattttgggaggccgaggtgggcagatcacttgaggtcaggagttccaaggccagcctggccaacatggcgaaaccctgtctctactaaaaatacaaaaattagtggggcgtggtggtgtttacctgtagtcccagctactcaggaggctgtggcaggagaatcgcttgaacctgggagacagaggttgcagtgagccaagatcacaccactgcactctagcctgggtgatagagcaacacttttgtctcaaaaaaaaaaaaaaaaaaaaaagattcttaggatcaattgacatgcttcacttttaacattaaaattaatttaagtttcttatgaatacaccagctatgatgtaaagctaattgggtacatgtgccacaagcagtgaaaaatttgtgattaatgttttcttaattagagttgtgaaccaaacaaaagaacatataccattagttgatagtgcatagctttatggacagtccagaataatacttattggtaaactgtacatgattctgagccgggcgcagtggctcacgcctgtaatcccagcactttgggaggctgaggtgagcagatcacttgaggtcagggatttgagactagcctggccaacatggtgaaaccccgtctctagtaaaaatataaaaattagctgggcatgatggcacacgcctgtagtcccagctactcagggggctgaggcacgaaatcacttgaacccaggagacggaggttgccatgagccaagatcagccactgcactccagcctgtgcaacagagcaagactccatctcaaaaaaaaaaaaattatacatgcttctcaactttaaaatatgtgttttgaactcccccaccttgtataaaatattggactaaatttatattttttattctcagggtcgctggtcatcctctggcacagaacgaacgttgtcttcacatgtttttacaagatgaaataatagataaaagctatactccatctaaaataagacatgcctgaaatttggcaagaaggggcaaaaacgtgactattaatgattgataagcaccagtgaagaagttctaacttttagcatgctgcacagaaactggtataacatgccttcagtatactaacactcatatgctcagttttgttttgttttggcagttgacaagaagttaatttgctttagtaaaaatccctcattccagcctttctatataaatagctctttcttgctgttttaatgtggtgcacactatagcctcacaaacctgttattccagtgtaatctgcagtgtcgtaactaaagttactggcttggtcttatttgcacagtttttgcgtcttgtttgcttcttgcatctgattaactagaatatttctctttcccccttttaatttgtgatgtcacttgaccccatttatgtgtaggagcactacaccattggtttccaatactgcacacataagatacatacttgtgtgcagaaagtatcttcctccaggcttgtaatacccttcacatggaagattaatgagggaaatctttatattctgtataaaaacaaaagcaaatttatatactaaaatcatttgtctaaaaatttaagttgttttcaaataaaaattaaaatgcatttctgatatgc

SEQ ID NO: 37058 - DNA, 43457 bp, Homo sapiens; identical to SEQ ID NO: 36927

SEQ ID NO: 37059 - DNA, 12977 bp, Homo sapiens
acgggcgagcggcgaccctgcctcccggagacggcgcggcctgccctgcgcgcctcagccccgggtgccggcgtctcgggcagcaccaccaagtctctctggaggggaaaggatggtcggatttgccccatgtcccttcctctgacccctccctcaagagtgccccgggacaccccgcctgtggctcagcctcccccgccccgcgctgccatctcctcagggccgggcagcaggctcccgagcgcccacagacccggggtgcggcccagcccacaaccgtcacctcaggggcctcaggcgcccagcggtgctgggcggggctggggcacgaccgggagcatgcgcagagcgcgcgtttcgcccatcgcgcacgcgcacacacctgctccgcccccacgctgcgtgccgctgctgggttccgccacgcccgtcatggcggcggccccggccggctctggccccgcccctcggtgacgcgtcgcgagtcacctgaccaggctgcgggctgaggagatacaagggaagtggctatcgccagagtcggattcgccgccgcagcagccgccgcccccgggagccgccgggaccctcgcgtcgtcgccgccgccgccgcccagatccctgcaccatgccgtcggagaagaccttcaagcagcgccgcaccttcggtgagtgtcgccgcgagggcggcgggtgcggcggggccggggtccgagctgtggagggcggcagggcctgggacgccgtgaggggtcggggccgagccgggaggccgagcggggccggtggctgccggccggcggggccgagggatgcggggcccggggccccgtgagggacccaggccgggaccgagccgggagggccaggggctggtctgggccggggcggcctgcggacctctcggaggcctgggaggaggcagccggcggagggcgggcgggggccggtgcgctcggggccccgggcctgctgaatcaccccgcgccctccgcggcggggtgcctgccgtaccccggccaccgccgcccccgcaagcgcgctgcgggcgagggtcgcgcttctggggcccaacagcccccggggccgcgctgggccgttcggctctgaagcggggctgcgccgggacccagcgcgtcaccttcagggctggttttcccgtcgagggagcccgcccgggtgcgagtgcctcttacagacctcagtgcctcggtcgagaggaggggaatgtgctgggccccggcctcgccgcgcccgggacggcccacagcggtgttgccagttcctgtctgtagcccaggagctggggtgggagacttctcttgggtttgcgattacgttctcaccttggcaccaggaataccgaatacatcccttttctgccggttcagactggaaacccagcttaggtgtgctggcatttggttaaacgtgcaggtgtcaccatcacaatatttactccacgcagatgatgcgaagtgattatttcccgcttgagcaagagaacgccgcagatccaggtatctgttgttgcctaagttccagacaccggtttggaagggaagcaccgtgttcatcgcggtggactgcgaatgcctgccgccatcctcgtcaggagcccacacagtggtgctgtttgtctgcttttgcctagtttcccggagtctagaaagagtttagcattcatttgagtttggatatagttttgcaggtctcattgaccattattttttttcttatgcctgagaaacttaagcaaattaaaatggaccttagcttgccaagcatatcttttcagacagcctcttgaggcagtccgttggttagcaagacttacacgtgccttttttgttagtagttttcttgttagtcaccttaatgaactctttactgtagtgtctaggcttattgagccctgagagcagcattaaagacagattttcttttcttttttattttgagacagggtctcactctgtcacctgggctggagtgcagtggtgcaatcacagcccactgcagcctcgacctcccgggctaaagcgatccagcggcccccctcagacctggcttctgttttcaccaatgaaaagttaactgggaacatttatgtaggagagatgccctttttctcataacagaaactatagttattttcttttttgcttagtacttttgggttattctggaaaagtctctgcgaagagtgggtagtaagggtaggaaatgtgagactaacacatccgaacaaggaatttcctggaacctaaaagtggccctgagggtagaccagcaataatgccccatttttttcccattgatgtatggaccttgtatatactgtattttcagggttttttcccttggctcacctttattttgccccctcccctttaaatatctctttaatagtcactttgtagaaatgtgtcaaatatcttaacagctgttacctttccttgcttctgattttggtaattaaaaaaaaaaatctttctagttcatgaatattttggtaatgttgatcatgagtactgacagttttcagacatgtgtagcacagtaagtgagggaaatgaatccttagagagaacctctttatggagcctaagataagccccagttagcttgagtggtgttttctctttccaagtgagtgagtttaaggttaatactgaatatagctctgctgataaactctaccaggattgacagggttctcaaagttgaaatggattttaaggctcactgaaaacaacgccttccttttgtagctaaagaaactgggtggggcctggtggtgaagatcatggtccacctagtggcagagtctggactggtacctttaacctggcatgaattcttccagtctccagtaggtagccatcatttccagtatattaagtggaccaagactgtgtgagtcaggagacatagtgtgtccttggagatgtgttggaaatattgaatgaacttcaaaaattaaaattgtgtggggcatggtggctcacacctgtaatcccagcactttgggaggccaaggcaggatcgcttgagtttgggagttcaagaccagcctgggcaacatagtgagagctcatctctaccaaaaaaagaaaccaaacagacaaataagagttgttgctgtgtggcccaggccagctttaactattggcctcaagtgatcctcccaccttggtttcccaaagtcctgggattacaggtgtgagccaccacgcctggcctgggggagggggagtgcttcagtttctctctgagaagtaaatcctggaaaatcctggaaaaactgaaattttacttaaaatgactgaagatatctcaaaacaactttgcaaagaacgtgttcttaaaaataggacaccttaggctcctaccgtttgttttaatgtttgtaaaggctcttaaggatcttttttgttttagaagaaaggaatctggggaagcaggttagattttgctgtgcatgtggagccgtgttcatttctgttttacagctttcattcagttgttgatgaactctcttctgtgtacaagcctgagccctggggggacacagattggactggagctgggtccttgactgccagcggggcagtctgttgagaaagacaaaaacagatgattacagcattaggaaacagggagtaaaagacttgccctccttctatgccattgactgtgctgttgataatgcttttgttaaatatactgttagcctctaaaacagctgtctcctgaagaatgagagtggagcatccgtgtgtaccgtgtacagccagttagttactccaggctcagcactggattttcattgctgctggacagcgtgctaagatgctcctatgggacttgggtgttattctttacagcttaaggaagtaacttgtcttttatatacttcccacctttcatgaaaataatcatttttgtctttttaggtcgtgttttgggaataaatcaggataaagataactttaaacactatagtttcagactttgaaacttcatagagcctgttttttccttctttccttttttttttttttttttttttttttgagacaggatctcgcgctgtcacccaggctggagtgcagtggcatgatctcagctcactgcaacctccgcctcctgggttcaagtgattctcctgccttagcctcctgagtagctgggattacgggtgcccgccatcacgcccagctaatttttgtatttttagtaaagacagggtttcaccgtgttggccaggatggtctctaactcctgacctcaggtgatccgcccgccttggcctcccaaagtgctgggtttacgagcgtgagccaccgcacccagccaaacctagtttcctatattaaaaaaatgtttccagccgggtgtggtggcacatgcctgtaatcccaacattttggtaggccaaggtgggcggatcacaaggtcaggagattgagaccatcctggctaacatgatgaaaccccgtctttactaaaaatacaaaaaattagccgggcgtggtggcgggcgcctgtagtcccagctacttgggatgctgagggaggagaatggcatgaacctgggaggcgtagcttgcagtgagcagagatcgcgccactgcactccagcctgagtgacagagcaagactccatctcaaaaaaaaaaaaaaaattctttcccctctgcctgaacgtttctacttttagatttattaggataagcttttaaatgtgaaacattccaggatatatgaaagaggtatcacttattcgctggagtgaattaaatcgtgatttaccctatacactgaatccacactgacacaatggacgtttttattgtgaagagggtctggggtaggacaggcataggaagatgtctcatacttaggagaggtgatgatgaggggtcactgagaatctcgctgggaagtagagaaggagtcaaaggataagagccactaggttaattttactgttaacaatagcgaaatttgtcattattatttttatttttcatttttttgagacaaaagtcttgctctgtcgcccagactagagtgcagtggcgtgatctcggctgactgcaacctgtgcctcccgggttcaagcgattctcctacctcagcctccctagtagctgggattacaggcgccggacgccgcgcccagctcatttttgtatttttagtagagatgggctatcaccattgtggccaggctagtctcaaactcctgacctcgtgatccacccgcctcggcctcccaaagtgctggggttacaggcatgagccactgcgcccagccaccaaatttatcatttgcatatatattcaataggaatatgcactggtagaaatccatgagtttgcaatctttgttgcaaagatgtttatatttagcaatgtatcttagaagctgattttaaagttttggatggggaaacagaagtcgaacttatggctgtacttgaacacaggaattttaaaagtttttataaagagtgatactaaaattgggctgggcttggtggctcacgcctgtaatcccagcactttgggaggctgaggtgggcggatcacgaggtcaggagatggagaccatcctggttaacagggtgaaacccgtctctactaaaaatacaaaaaaattagccgagcatggtgtcgggtgcctgtagtcccagctactcgggaggctgaggcaggagaatggtgtgaacccaggaggcggagcttgcagtgagcggagattgcagcactgcactccagcctgggcaacagagtgagactctgtctcaaaaaaagaatgatactaaaattttttttaatccaaatgagattggcaatgatattagagtaacgtcatatttatgtaggtcacaccatattttttctgtctcaggaagttcgtgacattgattatttatttgcgcttaccgtgagaatcaatcctaccatagtaaatcaaggttattttgctcatttttttttttggaggttttaaataatgccatctaagtcatatgttcacatattgcctttttttttttaacacacatattgctttgtaaatgacttctctctaactgtatttttgggtttctgggaactggacttggcttgtttttttttccctgtattgcccacagtctagtacagttgttgaaattatcaataagtgattctattaaaagggagaaaagaatttttttttttttttgagatggagtctggctctgtcgcccatgctggagtgcagtggtgcaatgtccgctcactgcaacctccgtgtcccaggttcaagtgattctcctgcctcagcctcccgagtagctgggattacaggcatgtgccatcacgcccggctaatttttatacttttagtagagacgggacagggtttcaccatgttggccaggctggtctcgaactcctgacctcaagtgatctgcccacctcagcctcccaaggtgctgggattacaggcatcatattccattctcttgagcagtttattttctcttaggcaccatatcattaaaaagctggaagtgataagggaaaaattgcatttcctggtttataatggattccatttccaacttaaagtgtggaaaattaacaaaaattgaagttaatattataggtggtagtggtctttggaggaaggactgggtctcatgcagtgggtctgccttgtatgtctgaccacaaactttgggctcccaattccttgaaactagttgtcccatattcctggtctttgtcctatcacctgatagagccatgtatgttatgttgctcttggccttagatacaaacctttatcaggtttgaagtgttcgtgttttgtttctttaagtcctaggaaagatgtcttcagtgttctgctgtgccacagctagcagctgaacttggatggagaaccagcagcagtgctgggaagaagctgcctggcccttagtaatgcttctgtctcttcatttcattgcagaacaaagagtagaagatgtccgacttattcgagagcagcatccaaccaaaatcccggtaggtagtctcaggcctcggtttcagtcatgaatgtacgcagaggagagcaccgcataagtgcatccacttgacgggtttttacaggaatcaccagacagccaaaccctgggtgtcagtttcacaacctagagagaggtatcctttttttaagagacagggtctcactctctttcccaggctggagtgcagtggtgcgatcgtagctcagtgcagtctcagccaccttgtgctcaagcagtcctccctcctcagcctcctgagtagctctgactagaggcacacaccactacacctggctaattttttaagttttttgtagagacagggtcttgctatgtttaacaacccaggctgatctcaaactcctgggctcaaatgatcctccaccttgacctctcaaagtgttgggattataggcatgagccactggctggcctcaggtgccaagatttctgtactgcctctaatttctgctaccacttaaactcaggcaggtggagcctacacactgatatttccttgtggatatcacacttcagaacgtgtccgctagataaagctctcaaacttaccaaggaaagtgatgacagcttgactcggccttacacagaaccctatgtaggtctcacacaatagaacaatgtacaaataagcatttttctttcccaaagaagcatgtaaagatttcccattcctgccactcaacttctctttgttgtgacagggtggaagaattactgtatatagaaaagatgtccgcagcgttcagtaaacacagacactaatgagactcagaggctcatctgtggtcaggtattataacagcttaaaactaaaaaaaaacaaaatattttgctccatggaaaggaagcatagtgaggagccaatggattatttatttatttatttatttattttgagacggagtcttgctgtgtcgcccaggctggagtgtagtggcgcgatctcggctcactgcaacctccgcctcccaggttcaagtgattctcctgcctcagcctcctgaatagctgggactacaggcacgtgccactacgcccagctaatttttgtatttttagtagagacagggtttcaccatgttggccaggatggtcttgatctcttgacctcatgatccgcccacctcggcctcccaaagtgctgggattacaggcgtgagtcaccacgccggcctgatggctttatttaaattcataatatgaaactatatgtgttccctgtgtagttcaaatacgtgtgtgtgtgtgtgtgtgtgtgtgtgtgtgtgtgtgtgtgtataaaattttttttttttttttgagatgcagtctcgctctgtcacccaggctggagtgcagtggcgtgatctcggctcactgcaagctccacctcccgggttcacgccattctcctgcctcagcctcctgagtagctgggactgcaggcgcccaccaccatgcgcggctaattttttttgtatttttagtagagacggggtttcaccatgttagccaggatggtctcagtctcctgacctcatgatctgcctgccttggcctcccaaaatgctgggattacaggcgtgagccaccgcacctggcctcaaatatttgtatttttaacctcatttaaagaaatatgttatcagaatgaaagtaccaggtcattatgcacaaaactttgtctctagaaccagctaataatggactctacttgccttgtcaaatataattttttcatgtcaactagacagtctctagtgtggaaaaacattgagcatattactataattaggaacttacacatttattaaaacacaggcatttactttttttttttttttaatggatgaaaggtttttatgtttcccaggtgggcctggaacgcatagcctcacctccttatgcaccagaacaaccagcctgagtcaccgtggctcccaaaacacatgcatttactttcattagaacttcagctggccggacgcggtggctcacgcctgtatcccagcactttggaaggccgaggcgggtggatcacgaagtcaggggttcgagaccagcctgaccaacatggtgaaaccccatctctactaaaaatacaaaaattagctgggcgtggtggcgggtgcctgtaatcccagctactcaggaggctgaggcaggagaattgcttgaacccgggagtcggaggttgcagtgagccaagatcgtgccactgcattccagcctgggcgacagagcaagactctgtctcaaaaaaaaaaaaaaaaaaaaaaaacttcagccatgtctcaggatatggtagttttggaattgagagtttcagatgttttgtgcttgaagctggttcccagcctctctgcctcggtaaggcttgaggtctttttctgactaggtatgtatttttcatggttccaaaactgaaacagaatgaaaggatacatagccaagtatcttcccccacttcctacctgacggcagacatattgtctctcttgtactatattttgtaaggggtagatgtctaagctagcaaatgatcactcttcacaggagagctatgaggaaactagtgaatgtgctgtttcaaagcccattttggcatgtgccagttagactgtaggaggcattttgtatatttttaattgttgatgactattttatttatttattggagacagtctagctctatgccctaggctggagtgcagtggcgcaacctcagctcactgcaacctccgcctcctaggttcaagcttgtctcagcctcccgagtagctggaaggcattacaggcacctgccaccacacctggataatttttgtatttttagtagagtcggggttttgccatgttgaccaggctggtctcgaactcctgacctcaggtgatctgctggcctcaccctcccaaagtgctgggattacaggcatgtgccaccatgcccagcctgatgacttttttttttttttgagatggagtctcgctctgtcacccaggctggagtgcggtggcgcgatctcggctcactgcaagctccacctcccgggttcacgccattctcctgcctcagcctcctgagtagctgggactacaggcgcccgccaccatgcccggctaatttttttttgtatttttagtagagatggggtttcaccatgttagccagggtggtctcagtctcctgacctcgtgatgtgcccgcctcggcctcccaaaatgctggggttacaggtgtgagccaccgcgcctggccctgatgactattttaaaatcacttctggcttcttttccaggtgataatagaacgatacaagggtgagaagcagcttcctgttctggataaaacaaagttccttgtacctgaccatgtcaacatgagtgagctcatcaagataattaggtattcagtcacctttgtttcataatatatttcctttgagtaacttcttattctttatgaaacttacagttaaatctttagttctggttaaaatctttaaaaaatatttttcagctgaattcagttctgattcagttatgattaaaacaatttcaacttaaactataaaatgtttctttttttgaggttttatattacttgctagactgcagagcccgtttctttcatcataacatcgtttagatgtttcctgtttaaaatcagtgttacaagttattaaggtattgtacagcaaagctagttaaagagaatgtagactctgtgagtggcagtaaatggcacaggcttagatcttagaatagttcagaaactgtatttgaactgctttcttatattagacagtttaacagctgttcagacagtatactagtttaaaatcagcctaatatgtaatctttcagtgattatagctcatgtcaatataatcaaaggaagtgtcctgtgctttatgagaagtattggattcaagagcatttagaacatttttatattttaccgatcagagtgggtgatattttaacacatgcttcatccttcttgtattgttgtcaatatttcttcacgttgttttctttcaatagaaggcgcttacagctcaatgctaatcaggccttcttcctgttggtgaacggacacagcatggtcagcgtctccacaccaatctcagaggtgtatgagagtgagaaagatgaagatggattcctgtacatggtctatgcctcccaggagacgttcgggatgaaattgtcagtgtaaaaccagaaaaaatgcagctcttctagaattgtttaaacccttaccaaggaaaaaaaagggatgttaccaactgagatcgatcagttcatccaatcacagatcatgaaacagtagtgttcccacctaggagtgttaggaagttgtgtttgtgtttcaagcagaaaaactgagctccaagtgagcacattcagctttggaaactatattatttaatgtaggctagcttgttttcaaattttaaaagtttaaaaataaaatactttgcattctaagttgccaataaaatagaccttcaagttattttaatgctcttttctcactaataggaacttgtaattccagcagtaatttaaaggctttcagagagaccctgagtcttctcttcaggttcacaaaacccgccgcctttttgggtagaagttttctactcagctagagagatctccctaagaggatctttaggcctgagttgtgaagcgcaacccccgcaaaacgcatttgccatcacagttggcacaaacgcagggtaaacgggctgtgtgagaaaacggccctgactgtaaactgctgaaggtccctgactcctaagagaaccacacccaaagtcctcactcttgcaggggtagacatttctggtttggtttgttctctagatagttacacacataaagacaccactcaaaaggaaacttgaataatttataattttgatcgagtttcttaaaagaccctggagaaagagtggcatttcttctgtttcaggttttgtctgagttcaaactagtgcctgtgttgttacggaaagcagcagtgtaccagtgtcactctggagtacagcgggagaaacacaaaatagtataactgaaaacattaacattcagacacactcccttctgccttccggcttaaagctgtggatgatccacgtttttgtttttttaatgttaaatgtgtaactcagtattactgaaaaggtacccacattttgaatagtagttatcactcttaggtcagacagccatcagaattctcccacaccaagtgcatgtcagttgtggagaaaacatagcaaaaagagccgtacgctctttacagatactaatgtcaagagttaaacctcctcaggttcaacctgtgataaaagactagtgcttcccagtacttgcatggggttcactatttatagttttcttgggagtatcacaggaaaatcacaattacaccactttagaccctatgtgtagcaggtcacaacttacccttgtgtgtttagatgtgtatgaaatacctgtatacgttagtgaaagctgtttactgtaacggggaaaaccagattctttgcatctgggccctctactgattgttaaaggagttcctgtcacctgctccccccacccccgcatgcgtctgtccacttggctaacttttaatatgtgtatttttacattatgtatattcttaactggactgtctcgtttagactgtatacatcatatctgacattattgtaactaccgtgtgatcagtaagattcctgtaagaaatactgctttttaagaaaaaaaataacatgctgaggggtgacctatatcccatgtgagtggtcactttatttataggatctttaaaacatttttaatgaactaagttgaataaaggcacaattaaaaactgtcatc

SEQ ID NO: 37060 - DNA, 40784 bp, Homo sapiens
gctttctttccgtcgcagagagcatcggccggcgaccgttccggcggccattgcgaaaacttccccacggctactgcgtccacgtggcggtggcgtggggactccctgaaagcagagcggcagggcgcccggaagtcgtgagtcgagtcttcccgggctaatccatgccgggttggaggctgctgacgcaggtcggcgcccaggtgctgggtcgactcggggacggcctgggtgctgccctgggcccggggaacaggtaggaaggtgtgagggtgtcctacctgcacagttgcgtcctgaagcagtggaatggcctggtgcagttgggcctcccctgggtggaggaggaaggggctctgttgagacgtgggacacagaagaataagggccgttaacctaaggaagcacgttctaaggggattgaagtggtgatttttaaaaaacgcttatgagccagccactagcagcgaacgctattaacagcaatcatatcttacaattagtgagcgtttgccaggtactaagcgctctgctaagtgtattaggtgccttatgtagcctcacgggagcaaactgctatcataaggtttacagataaaactgaaggttagggaggtgagttaatttgcccaaagtcactcaactaataagtggaaaattaggaatctagcctgaatttatctgactacaaaaggagagtagactgcagaaagctttacttctgttctgaccctccatgcaagaattacaccccttcttcctgacctccgcccactaaggtctttcttggtatgttcacctgttcagaggtcatgccttttgtggatcttttaactttgcacacccagtttcttcacttctctgaacctaggccatgtcattgcagggaggaggtgagcttgttagacaaagatcaacatgccaccttctgccacctccactgaatgtaaaactattaaggtacacttccaaatgggttagtggcttttcatgtctataggtaggactgttttttggggaatatgtttatctgcgaggagaagatgaatttttttctccagggtaacgactaacagtttaaatgtgagccttatccgaaggaatgtggggagtgaggaaaaggttggagacctgaaaaaaaggtatacagaatccaagccctttcccaaggccctgactacactttccaatttgtgacttcccttttctatattaagtggaggaagtttttaaattgtggtttggttttatttattttttctttttatagaacacacatctggctttttgttagaggtcttcatggaaagagtggtacatggtgggatgagcatctttctgaagaaaatgtcccattcattaagcagttggtctctgatgaagataaagcccaattagcaagtaaactgtgtcctctgaaagatgaaccatggcctatacatccttgggaaccaggtgattattttgtatttgatgagctctcatttcctaattactgtgtggctggacacatttaaaatcatagtgactacttgataatttatcatttcttgaatttatttttcatgtgctgcgtgtgttttattgtggtttgttttgcatgtttatttccaacttcctagtctagttttagtgaatgtctgatgataataaagacctccttgagaagctgttttataggtgaagggagaatcattctgcatagattctcttgtttacttcagctaaaaagaatataagtcaggaaagaaaggctggaagagtatgatgtaaattgtaatgtgttgcatggatgttcacttgggatgctctagcactgtagatttgggaagcataacccctggatcagctctttgtgtctagaaggatgctaaacccatgtgtggccagaccaagaggaataaggccttttctattaagtgtgtggtccctggttagggtttattgtgacagtcgaattggatagttaccaaaacttcttagtgaggcaactttaccagtttatgcaaagaatctaagtgtcttgttgtagactgacatattttagcaatgtatgaccagttgtggcatctctatagcctcagctaacttctcagagtttgagtgatagatgttttctaatgaataaagttgggtaagaattgatactaggaaagcaaaatgatggatttatcatgcccattatttaaaaccagaatatacctaacttatctgttttctttatttcatatatttatgtttgttcattttacaaatatttattgagcaccaatatgtcatgccaggcatggttgaaggcacttatatctgtaaagaacagtcctactttactctgtgaatatattagcatatttcttacgtgcctgctcctcatacggaaacctgattttaggaaaaacgatttcataatgttggtgaatgttgcaaaagcttttgttcacattgctttggttttaattgccaggttcctttagagttggtcttattgccttgaagctgggcatgatgcctttatggaccaaggatggtcaaaagcatgtggtcacattacttcaggtaagagagaaacagaagacgtaagagatatctatgtgtttcaagatctgtttgtgcaaaccttaacaagaactatttgtgtcctgaaacatggaactgtatggtgaagaaaggggtgatgttgaacataaatagtattaaagaacttatggtggtttcaggaatgttctcactcttgcctgagcagtggccttctgatactggtattgggataactggagcaatgaatttttttttaagtataacctagccttttacagatccccttgtttacttcataattggaaaaaaatctcaatcccattttgtttccttttatggagttctttcaactccagattacagttttgatctttttgctaacagaatataatactcttgtctggtgaggctgtattttgttcactaaggtaagctatagtctagtgggtaagaatgtgtgtcctgagaccagaatacctgagttgcaatcttgattctgccacttactagtgtgttccttggagcactgtgcctcatctgtaaaagatactctattctgtaaaagaaataattgtgagctacttcaaaaggttattgtgtagattgcaccagatgataaatgtcaggcacttgaaacaatgttaagtgtccactaaatattagctactattgtctttatcattatcattgttgttattattattattattattattatagaaagatactggtaagagatcatcactcccccaatcactttgaacaactcagttgatcttggggcttagtcttaggcaagtaatgatacaggtgatgtaaagtaacagctcatgcacctaagtgcttagagtgctaataaggctcaaagagtctatagatcctttgcaaattattattggctctgaatgatcaagtataagacaatagttttgtgaactctgaagaaactggcgggggcagggggctttcagtaatggctggtgggattgtaaattggtacaaaaccattttggaaaacactttagcattatgtggcaaaattaagacgagttagcctgtagtctagcaattccacttccaagtattactagaaaacttgagcagcagcatcacacttaacgccaacaaactagaaataacccaagtctctgtccacagtagaacaggtaaacaaatcatgttatattcacataatgaaatgttgtacagcaatgaaaatgaacagaatagagctacacacaatatagatgaaccttacaaatatgttaagtgaagtaagacatggaagagtacataaaatgcataaaatctgattccatttatataaagtttaaagcaggcaatactttccaatatagtaattataaagaaaagtaaatagttaccataaatgtcaagagttatttctagggcagtgcttctcaaactttagtgaacctcagaatcacttagaggtcttataaaacacaaagattctgattcagtaggtctggattgaggcctgagaatcagtgtctttattaagttcccagggaatcctgacactgcttgtctggtgaccatacttttgagaactcctgctcttgggtaaaaagatgaggaggtgattgggaagagacacacacgggcttttgggattctacttcttgagctgggtagtggttacatgtatattttgtttatactcattttgttgtatatgttcttttctgtatgtatttaatctttttttttttttttttttttgagacggagtcttgctctgtcccccaggctggagtgcagtggcacgatcttggcttactgcaagctccgcctcccgggttcttgccattcttctgcctcagcctcccgagtagctgggactataggcgcccaccagcatgcccggctaattttttgtatttttagtagagatggggtttcaccgtgttagccaggatggtctcgatctcctgacttcatgagctgcccgcctcggcctcccaaagtgtgtatttaatctttttttttttaatttatatttttaagattgtggttggtgttagaggaaagatgaggtaagtaactgtagggaattcctatttgtcctaaggtctcaatggggctggtttgtaatgttaaaatatatattggcacatgcttagtttttttatgtttgtttttttaggtacaagactgtcatgtcttaaaatatacgtcaaaggaaaactgtaatggaaaaatggcaaccctgtctgtaggaggaaaaactgtatcacgttttcgtgtaaggatgtattttcatagctagaatactgcatttttcatcagtttcaaatctggatgagtttatgttttgagattgttccacagccacaaacttgcatttgtttgtgaggtaaattgtgtatttgggggaggcagtctggcacagccattttgcccaggagtcttggagactcttgagtttgttctaatacctctccctgtatctggaacaagtaattttacctctctaagctgtagtgcttgtatatctgtacaatgggaacaaaaatactacatacctaatagatttatcacaaggattaaattaggtttttcagatgtgcttggaatataacagacactcagtagatttggttattttgttattgttttatgtttcatttcactttcttcctatggaaaattgtcttaactcttgacaccaagagcatgtggaaattaattttgtgtattctggaaggagctttcagtgtttgggagaaagctgtataagaatccaaatcagattttttttaataaagcatttttttttaagtagagtactgagtttgtagtttaagtttggaaaagctgcccaatgagtatcctgtattgaataactaaaaccagaaaacctttctcaaaatggtgatggttttcagtaaacatctttaggtttactataacacattgcttatctctaagacaaacttttttttcattgtaaactgtttatgaaatgaacaaggcagaaattaggatacaacccatactctctgactgtcaaaactatcaggtgtttatcctactaactactctattttctgatagttaacttttattgaacatttattacatgccacgtgcataagcattacgcttttttcatttgttactttatataaacttttcagcctctgaggctaacgcagttaactaactcattcaaagtcacccactggtaaaaggtagagcgacagacaccagagccttacttaactgtgtcttgatatctacccactgggagctcataagctagtgaggaagttacacaaataaaccagccatcccagtacaatattataaatccaaggagcacagaaccggagacagccaattctgccagggaaaatcccaggaggtttcacagggagaacagaaaggaaaatgggtgttacaggcatgccagagagaatggcctctgcagaagcagagacaacatggaagagcatgtgtgcttggggagagaagtgtaatgtggctgcattttagtgtgcaggcctgggccagtgttgggagggtggtgaagctgcagctatcaaggtagtgtgtgaggtttagacttcatcttacggactttgaggtgctttctgaattctttaactaggtcagtaacttgttcagattgttaaattagttaactaaaattttaaaaatctgatagaaggaaagagtttttaggagattgttttaagagatcaggggagagttgataagagcctttagaagcaaggcagttgcattgagattggaaggggcagggattggaaaggactaggtgggaggacacaactaggtcagtgctgattgcatactctgggataggaacaaggaaaagggaagctttggaggaaagatgtttgagatgttcacaggaaatcatagttctataaatggtgagaaatactgattagtcaataagtggtggtggaaatcactgaaatctgtgacatggtttattttgtttcgtgttagagaagttagctatttttgaatattatggtagcatactccatttatttttctttaaagctttgtcataatatctgtcctgctattcttaacagtttattgactaacaaatttgggtttcatataactccatagtaattatagagtacaatgagatatttatgggaactttttaaaaaaatcaagtgtttgactttttaaaaatttattatgtaccagccttcatatgagtaattctttggtttgatagatgccactgttttctacttgattgtacttctgtgtttttgtaatgactagcatcatcatcttcattttcattacaagttttgtaaattgatgccttcatggcctggatatttgtaaatcaagcatgctagggtaatcccttctgccccagccaggtctgtgaagattgcttcctctgaaatatgaggtagtgagaaaacaagtgatgtgggatcagaaaagttgagttctaatcctgatttctacctttaggtcccctatactcaccttttgaacatctattttcttacccataaaaacaaggaatagtacttgatggtctctgaattatcttccagttctgaaagtctcacattggttctctgaatattttaattctcaagaaaaaacaagtttggagaaaaaaagtacatgggagctcaatttattctattttacttagtgataaagatgtgttataatcaaaattttatgaaagtaatactaatagtattactataacagtactaataattaatattacagaatgataggtattgcatttcatagtcgaggctgttcacacatttttttctctttagcttattctgatagctttattctcttcagtggttacatagcacagcagggtgatttggatgttgtgttctaatgttgtggtggattttgacccacttaatttacgtaaactttgaaaacttcacttctctagcatagaaagtactgcgaaggaccttctttcttcaagatataaaatttcttcaagatataaaatttctaagtccagatgacatttattacaataacaagaaaaagctttgtctataaaatgacctttcttcaaaatgaaatgtgaaaatgaagttttagaattctttgtaaatacatcatttttgtttgaaaacaaagatttttgaaactaaaagtatccagacttccatattatagctctcaggaaaaaatgcaaatcgattgattatagaggattttttaaaaaacgaagacctatgaatataaaatttcatatatctaaacatttggaaattaaatcactttataatagtgttagaactgttttcttttaatctgtaaagaatttatgcctccaagaaattagactacgttgcctttttgttttgtaccttattataaataaaaactgaggtagtacatagtgtttttgaatgaggaagttaagtggccttaaacattgattaaatcaattcatcttaggaggagaggcattttcattgtgggaaggataattgcagagaactttgaagtgggggaaaagaatgcaacctcatagatgggattatccaactgtgacagtactgtcagtcttttaaattgccttttgaaatcatttacttatttagaagtctgaaaaaaagaaaaaagtcttttacattgcttctggttttaactctacttgagcatttggttttcctcctgactgagacctaattagttttataatattttgattttaaaagaaaaaagtatttactattagtgaaattggatgataatcgagaagtatgttttaccttggttctatttatggtttagtctaaaaagttacttaggatgaaatgtttatatatattgtctgttttgtattattagaatagtaaaggattttcctcagaagcttccagatatgcttaaaaagctggcattaacaaaataatatgctttgaaaatcacgtggaataggtgaatgtcaaaaataaacttgaagtccattctaaaatttaataaatctgaattttatacatcaggaaaataatttaaaggagccatactgttaaatgaaaattttgtgtttgctcttgttgcagaagtgagtatgattgaagatgaaaagcaggggacttgataatagtggtgttgggtgttagtgttaatttcagcgtgtaggaaataaaataatagagaatgattggaatgaatttgtgttatcactcttgtggaggaaaggatagcttcttgagagaactcttgtgaggtatagaacagtcttcagtggacatcaaagtagagcttcttggcatttgttgtaggctccactggagagccccagggggattcctggtaagttgtagactgatccaaaaattaaactgtgtgcttacaggccagtgccacccaatttcatgtcaactataggcaactgagtaagttataagtactaatggtttacattttaaactgaacaagtaactaaagtttgctaagtattcacatattatattctacaaacaagtctgactctgcaggcacttcattggaatttgggggaaggatactttgttattatcagtgtcatcttgagttggttagggttttttagttgctgctattcttgctttttgaaaattacaattactattggtttggttttataatagtttcttgctgatttgttcgtcctcagagcaagtcatgatatatctcttaggcctatacttttacagtaactagacctgaagattgaggccacaaacacagtaacgtcgtgttccaagaactgatggagcagaagagtagaaaagtgggaagagttagacaaactttatacccagatggttgcctgtcctttatcttctgtttcttttcatcgttggtttagcccacttctttattgtctaacttgccactgtgcttagctgtaaagttagagacacagatgaataaaaaacagcctttaccatccaggtgctcacaggtcagcatgctgaccaacatttgagtagataagtgtatggtgatatggacagtaattgagatattccagtgtctagtgttggcatagacaaaggagcaatgtgctctggtaaggctgctcagagagggatctggataggaaatataactgaatttagtactagagacatgtacttatatttcccagtgtgaagagtgcctctttcaccagaataaaacgaacacagatacatctacctgctgttccctcttcctcaactttgaagctttggagatgcagggtagggaggagatcacagatgaagagagtggtgcagacagattcaggaaagcatacatagagtaacatagccattgggggcctgcgggttcttcatttatggttagaaagttgagggagagcgaacagcaggaaaatagatgtactatgttatattgtgatgaaagaggcactcttcacatcaggaaataaaaagtggcataacttttttgtcaagtcctatagcaatctatatcgagtcttaagaattaaggtggggggaagacccaggaattataagaaaataagatgtccataggttttgtttttagtgacactggttgtagtgatatttacaatagcaggacagaaggcaggagtggagagcagacagcaggttctaccaggagctggggatatagcagcaactaaagcaagtctctgctttcaggaagcttagatttgggtaggtttgggggtgaaatggggaggctgttacatagaacaggggtccccatcccctgggctgtagactgctctgtggcctgttaggaatgggaactgcacagcaggaggtgaatggcaggtgagtgagcattagttaccacccgagctctacctcctgtcagtcagatcagtggcagcgttagattcttataggagcgcaaaccctataggagctgtgtgtgcgagggatctaggttgcatgctccttatgagactctaatgcctgataatctgaggtggaacagtttcattctgaaaccatccctcttgctgcctccactggtctgtggaaaaatggtcttccatgaaaccagtcgctggtaccgaaaaggttgggtactgctgacatagaaacagtaaaaaatgtgtatcatgacacatggagataaatgctttgaagggtaatactaaaaatataaaggatttttctcggaagcttcctggtatgcctaaaaaactggtattaataaaataatatgctttaataaaataaaagtaggctgaggggataagtgacaaaaaatgatgctatttcagattgagtaattagacaaggtaagttgatattttgattgatacctgaataagtaagggagccagtcatgcaaaaatatggcagaaaagcattctagacagaggcaataggatgcgcaaaggtcttgaggctagtgtttgatgtgttcttgggccaataagggagtgcattttttctgaagcagggtgagtcaggaggagagtaaaagatgaggtcagattgtgtagaacattttaaaccatggtaaggacttaggacttgattctgtaagaagtagaagccactgtagatacatgatatggcttgagttttaaaatgataatgccagcctgtgaattgagaacagactagagagtcggaagggtggaagcttggagaccagtttggaggctattgaaataatccaggcagaagatagtggatgaggttgacattgggatggggtggtaagtggttggcgtgggctatatttttaaatagtctggaggaattgctgatgaatgggacatggaatgtgaagaagaaaagaatcaagggtgaccataagatttttgacctatacggcagcattatggagttgccttttttattgagatttggaagaaggcctgggaagggcaggcttggtgaagggagttgagttcagttttagacacgttaagcttaagtttctatatgacattgaagtggagataatgacttggcagttggacatgtgaatgtatagttcaaagtagaatttggaattgaagttagaaatgtgcagacattcacatatatgagaaccgagagagtagtaactggaagccaagagaaagtcttccatggagagagtggtcacctgtgttaagcattgctggtagattcagtaaaatgagtatcaaccagtgtggttgaccgtatggagatccttggtgaatgacaagcactttgcattgagtgctaggagctgaaagtgctgattaaactgggttcacagaatgggaggagagaaagtagacttggcaagtctttccaggagctttgctgtaagggggaacagaaaaattagctaaagaatatgtggtcaagaaaaagtttgttttaatatgtgaattattgtgacatgttatatatagtgataggaagttccagtagaaaggggaaaaaaatgaagatttcttagaagagagtggggacaatttcaggaggaaaccattgaataggtgagaaggggtgggaattagtgcttttaataaaagtatggagagctcatctgtcagcatgatttccagccccagtttgacatagaaatcatgtgaggtgcttgaaaattagcaatgcctagaccccacactagacagtgaaattacaatctctaagcagagggcccttgccgttggcattttccagaagctctccatgtgcatctcatgtgtaacctagagtggggtgggaggatagtactgttaatatattagtgctggtatagacaatttggtaaaagcatggagaagttctcttaattcttttatttgatcaactcaaagggaggaagaggaaacagtgctgaagattttagaaaaggatgtgacttagttttcttatagagtgtgaaaatgatttaaccagagatatgtaggtatctctagatataagcaggccacatttgagattctgaagtttgtggtcataacatttaaatgtaacataccgtgttttcttccagtttagaataagtgcagaataggcagagttgatttttcggggtttgggttcttaattcagacagtctccagtcagaatttaaatatgagcacaactctctattttcctgcagaacagaggtctttcccagtgtgctatatttgaacactatgtacatgattggaatctaaatagtaagattattcagagatgtaataaaatatagctataaatctcacctcccttaaataaggggaattgggtgccctttgttcattaaggaataaggtatgctttgatttattttctggggtgttaataacttggtttagatctccatgcatttaattccacttttaatattcaatgtattacttatatgtgctgcttttcctctagaaagctacatccatattggaattttaccgggaacttggattgccgccgaaacagacagttaaaatctttaatataacagataatgctgcaattaaaccaggtaatttgaggttggggagaggagggaggtaaaaatacccaaatatgcaatttgtttaatgtcagccctttcaataaagctacatctaaaatgcaaagtctcaaacacttacttttaaatacaaaactgtatctcattttgtttttttttttttttagtggaaaaacctgtagataactctttgctttctgtgagagagggaggaacacttttgtttttaatgtagagagagtttaatatttgaaaaagccacctcaaagaaatacactaacttttaaaattcaaagatcgttgttcacaggctggcattcatgaaaaatagccaggctcttgcttaggtagaagaactggagaaaatataataacagaagggaccgaccatagcacctcaatgtaaagattcttacttaaaatttccaagatattttgcctaatccgtggactgtcaaagagtaaagatttggcatatgattatattggctcatatggttagcaaaatataacattttgatgtctgaacttcagaaaagctccctgatctctgaacttgagttctgacaagaagacagtagaatgctgctttaagatttggtatttaatatcggaactaaactgctttaagtaaaatacagttgcagtaggcttttattggtgtgacagagggtcagccttgatacaaggtagaattaaaagtattctttgaagttaagattttgcaattttaaggcaaggtaaatggaattaaacaaatataaaaattagtagaagtacttgggccattgtatattagaatagtttataatggaaatactttaaatataaagggatagttctaaaatatttggttgtgtagacagttctgaagcactttttaatattctctttggtattaacacatctaactttcttaaactctttgtttatgtttatgataaagataaaattaagccacattaacttttgctgtagctcaaatcatacaaaattgtttttggggtcaaaaatggtcaaaaatcagcaattcagcctcataaaaggtcacttaatttctttttaaaaaattaatactattttttgattgacaaatcaaaattatatacatttatgggatacagtgtgatgttttgataatatgtagacaatgtggaatgattaaatctctatattttcttcattcaaggtttttctctgcctatataaatccaggttgggttataacttaaaggaagttccccccctgcaatcttacagcactttgctgcttgtattaaataaactataactataaataaactttcagttacattctctactacagtggtttctgccatttaaaaaaatgtatcttatttgatgatgttaatgtttattcttcaccaagataataaatttcttgctgtcaggggccatgtcttatattcttatattcttgaatttctagctgcacatatttgtaagtgccctataaatgtttgctaattgattgccaaatagttcttataaatgttactttcaagtttatgtaaacaatattatgaagggctttgattcatcacaaaatttaaaactttttaaaataacatttcccaagtacatttaaagtaagactttatttgcatacaactagttttgtaaacgtttctatataaaatttaataagtatctataaaggcaattttttgctattctaattatctaggcatgaactggagaactatagtttattggtacaatgaagagttcacccaaaatctgatatgtagaggctttatatagatgtcatacataccatgatcattacacaccatatgagggacttgggttcaagtaattgtttcctgtttgtccaatgggtgcaggatatttaatgaagccccaacattttttggttattcttgtttttgttttcccaatgtgaagacaagaaacatatcttaatttagtatactgttattcactaaaacaaccaagaatcatcaaatttatatgtttgacagcaagaacactgtgttgtcatgggaatcactcatttcaaacagcaccacttttggtctctgtgaagtcaatcaaaagacatatttgttgaataatttcattgtttggatgtttctaattgcagaagagaatctcttaccatttttgaaatcagctagaagccttcctggatatagtttatgttgaataaagttgtttctgtgctgtcaaatttcatattgatttttcattttcttttcataaaggcactcctctttatgctgctcactttcgtccaggacagtatgtggatgtcacagccaaaacgtaggtcctcatagcgagttctcttttccttttgttttcatctattaaaagagaatagaataagtgaaagaagtacagtctttcaagtcagtgaataaaggataaatatatttctcattctgaattcaaatctttcatgttacctacactggtttttaaattgtgccaaattaattgtatgtaaagggttcacatcaggttatagcttttatttttatttgttttttttttattatactttaagttctagggtacatgtgcacaacgtgcaggtttgatacataggtagacgtgtgccatgttggtttgctgcacccatcaactcgtcatttatattaggtatttctcttaatgctatccctcccccagcccctcaccgctgacagggcctggtgtgtgatgttccccgccctgtgtccaagtgttctcattgttcaattcccacctatgagtgagaacatgcggtgtttggttttctgtccttgtgatagtttgctcagaatgatggtttccagcttccatgtccctgcaaaggacatgaactcatctttttttatggctgcatagtattccatggtgtatatgtgctacattttgttaatccagtctatcattgatggacattcgggttggttccaagtctttgctattgtgaatagtgccacaataaacatatgtgtgcatgtgtctttatagtagcatgatttataatcctttgggtatatacccagtaatgggattgctgggtcaaatggtatttctagttctagatccttgaggaatcgccacactgtcttccataatggttgaactaatttacactcccaccaacagtgtaaaagcgtttgtatttctccacatcctctccagcatctgttgtttcctttttaatgattgccattctgactggcatgagatggtatctcattgtggttttgatttgcatttctttgatgaccggtgatgagcattttttcatgtgtctgttggctgcatagttgtcttcttttgagaagtgtctgttcatatcctttgcccactttttgatggggttggtttttttcttgtaaatttgtttgagttctttgtagattctggatattagccctgtgtcagatgggtagattacaaaaattttccagcgcaccagcatggcacatgtatacatatgtaactaacctgcacaatgtgcacatgtaccctaaaacttagagtataataaaaaaaaaaaaaaatttttctcccattctgtaggttgcctattcattctgatggtagttttttttggtttttttttttttttttttttttttttgccgtgcagaagctctttggtttaatgagatcccatttgtcaattttggcttttgttgccattgcttttggtgtttcagtcatgaagtccttgcccatgcctatgtcctgaatagtattgcctaggttttcttctagggtttttatggttttaggtctaacatttaagtctttaatccatcttgaattaatttttgtataaggtgtaagaaagggatccagtttcatctttctacatatggctagccagttttcccagcaccatttattaaatagggaatcctttccccatttcttgttgttgtcaagtttgtcaaagatcagatgtttgtttcttcaacataaatgataatttcatttcttttgatgcctcagttttctcctttttgttgcatgataattctgcagggattattctgactaggaaccctctgaaaaatatgccattgtttacagatgctctgggataagtttgtaatcacagagattgagccagagcaccttttatcaaaagaaactgggggagtgctagtatcactttccttcacatggttaagatgcattcttcctagtttcaaatataggtcattgcaaaagctgctggctgctttaataaccttcatttcgctatttagaaatgaaatgtgggatagattggtaataagatgagtcttctttttaaagagattgtaaacctgtcccccttttttttttcctgcttcctgattatcgtgaacttgttcctagttacaagaacccctgaaatcactggttccttggtaactctgttttgcattcctttggcagaactcaaaatattggagcttaaaagctttgatttggttagttggggaaatatgtgtgttgtaaatcagattattttacttgttaatttttgaattattgcatataaaatgccacatagtaattttgttaatttacacacagttaatgttgtgtgaattccattatgtattttatacaatatgggatattctaagaaaccacgcaaagtcagaggcctttgttaacatttgccttgtggctggacttgtgactaacttggattagagtctagcttttcaaatgcctatcttcagtgaatgctttcatctcatatgcttctgtttggtttccttggcttctttaaagtgatttttaaaacttcagctgccttcttgtaagcataaagtaaaagaggaaaacttttgttttttggttttttgtaagatcattttcatagaaaacaagattatgtaaagccatgcaccagcttcaggattaaatagctggtaagagttgggggaacaaccagccctggaatttaaagtagtgatagtcaactctggagaagtgaggacctccatttgagaagatcaccactgttatatgggctacaatacaatattctgtttaacttttactgtattaacagtggggcagggttttcctcgcatgtgtgtgtgcatatcttcatgaggtatttattacttacatgagaatgaattggactttatttgaccttttgctaaatgttaccaataactatagctcttgtagctgacatcttattattgctgtaaggtgcttttaattttaaatgcttgtaaatttataggattcgttgtccttctcatctggaactgttttgaatttcctgagtgcagcattgtattcccagctgcatacagccctagttgccactgcctcttctctctgccactgacttcccacgtctgtacatgtacacatacatgtgcatacctttgtttaactttttttttcttttttaaactcctctctctactttccttaatgcattttggaacttttcggctctatcttctggatattaatcctgttggaagggtgaacactaggggaacaatatgtgcagtgccatggttaagggagtgatgaaaggacatggatttataggctggagcagtgggtctcatgcttgagtaggctttataatctcttggaggtttagttgagcacaaattgatggaccccacccacggaacttctgattctgtaggtctggggttaatacctgagaatttgcatttctaccaagtttccaggtgatatagatgctgctggtccggaaacacacattgagaaccactgggctggaaaatagaagctcatcagttaaaccacttttcctcctcactcctctacctagcacagaattcagaatgcctttctttccttaactctgcttgaattataacatacaaacatctgtttaaaagcaagcaagtttaatgtaattaaaataacattgccaataaaagtgagtatttattacattttagttagcataaaactgaaaactagtctgtttagtaattggcttcattatcttttcattagaaaagagaaaaatctcaatccctaatttcttaatttttctcatgctgtaatgtattttaattatcaatcttcacttatatttttagtactagatttcaatgtttcaatgttataccttcaactttaattgctgagttaaatgtactttagaaataactaagaaaattttttataggaacaaacactgtctgcatttcaagaaaatagtgtgagaagtatctgtctacctcaggaatgaaattgtctgcagacagttttttaaaaagtggccagtaaccaacagtaacagcttcttgacgatatacttacaattttaaagtgttccttttaaaataaaattttgttaggaaacttgcttacatgaaagatacattgtgtttacctatactgatgttggttataattctctagataaataggtaaatttaccagtgtcacgttagggtgtgaggtgaatatataatttaccagaattcattttaatttttacttgtaatatcagcaatagtttttcatcaaaaggatgatagaagacaaattttatttagattgtatggggaagatttttacatctaataaataaaactgcctagcagaacatttttacatagttttattatactatcaatagataatgaagcccagtctttgaaatatggtagtttatgtaattcattccaaataaaatctttaaactagcatgtatcatgatgtcttttctccctgcccctaccctgggtacatttttaaggtttatgttcttgctctatagtagcaattatattccattgtaactttgaatagatgatggtttagagtctaacattttcccattctttcagtctcgattttgaagagggaacagctataatgtataaatagtgagtaagctgaggtatgactgttaattctatcctcagcataggatgtttagcccattttttttctgttgaattctggtggtgcttattataacttgtaaaaaaaaaaaaaaaaagaagaatgaaacaaagaacaaataaaaagaaaactaaagatgctttctgctgtggttagggagcagtgttaggtatctgcctgaaaggacttgaaggacagagatggtagtgatgcattcgtaatagcatggagagacacttcctgctaggtgtcttgttgaactttgaattcatgacagtgcatacctgaagtaattttccttctggttatctgtaatttatttatttacttaaaatttgaagtcagaagacttcaggtacttaaaatgtttttttctttctgaaagaaggataatttaaaaatcatgtctagaagtctgggctgattaaaacaactcatattttcaggaataatcttactactttacagttgtcagtgtcctttaaattctcattaccctttggtctcaaaacagaaaaataactagttgacaatgttatcttagtaataaaatttttttttttttttttgagacggagtcttgctctgttgcccaggctggagtgcagtggcacgatctcggctcactgcaagctctgcctcccaggttcacgccattctcctgcctcagcctcccgagtagctggactacaggcaactgccaccacgcccaactaattttttgtatttttagtagagatggagtttcaccgttttagccaggatggtctcgatctcctgacctcgtgatccgcctgcctcagcctctcaaagtgctgggattacaggcatgagccaccatgcctggccagtaataaaaattaaggggaggggggtggaggagattaggtattggagcaccttggcacatttattgagattcagttagtttggatcctttcattcaaataccaaaatgtgtaaagaagtattgttgcctaccaaagtcaaagatgtttaaactgtcaacatgggttcttaaaagagtaaagactttgtgggctgtatacctagcccagtacactgttgagtgaagagtgtctacatactgtcagaaactctgcccacaagctcattgttctaactggtagatgtttgttgtaaactccggaaggagaaagcaaggtatgtgctgccttcaggatacagttgctgtgctgtcctgtacattttcagttttatttcatttttaacaagtaactttatgtactgggtattcaaagcagtacgtttttaacgtattagtgaaacaattttcaagatgagtgattaaactatagagagaaataatctttgtaaaaattaatccctcttaaatcagtcaaaatgaatgattggagagcagtgtgttggggttatatttagttgttgggttaaaaattttattagtggtcatctatagttgcctccttatttacaaagcagcatgtttttactcaagctcagcaaaattaaggcctaataagaggcaatgtaaggtggtggctaaaagcatgggcctttcagtagctctgtgacctagataactttcttaatctctttgctgcttcatttttaacataagaataattgtaaatgtacttcatagccatattacaaagattgaatgacagtgcatagaaagctcttagctcaaggcctggcacataataaatgctcaggagtattagctactatcactattattgatgttgctgctttgtaattagtttcaattttaaaaagatccatgttttcctgaatagaaaatatctttcgaaatgaatagaaaacatgacattattaggaattcaattctggtgttttccaatacattaagttttgcctttatattttatgtaacaaagtaatagctttacaaaacactctaggtaattttaagatcacatactatctattgtatctggaatttgcagagtaatgaggatgcccttgaaatggcttcatacctctccgatttgctggaatattttaatatttttcttctaatctgtttcttgagaggcactatgacctgggttgaaagcgtggctggatgtttccatttccagcgatttgattttgggcaagtggcttaacttgtggggatttcgatttcattatctttaacctgagggtctgaggctaaatggtttctaaggtttctttcaattctaaaaatctgtttccaaaaaataattcctcagttttccaagtggcataactcacccttatctatactaaagaaataatacatgacagtagattcatagctcatggcaatatggctttctaatctattgaagaacattatgtggctgaagaccttcagaaaatttgtgtcctttcatgatattgtagaattgtttatttgtgttttcttttttgagaagaacagagtgtgcccaggacagcaaatgtggtgttctgggtttatttagtgcagttgggaaattgaaggaatcactgcacagttgactctttgtactattaaatgagctagatttgatgtcagaaaagccgtaagcagtgcactccttgcactcttgttgataaaaatgttcccagttattgatgggaagtttatggtttttagacagaaatcatatacctgcatttcaggtcatgctgtcacaaattcgtcctaaagagttaacagctatattgatattccatgccaccttctaactctatgtgaatggaacaccaagcaactggaaaattccaccatgactgacttgtgggctcagcacctgttcatcactgatcaagtaggtttagacagcaacactgaattgggtagaaattgactgccgcactttacagggatcttcagtagagatgctatgtggaaatgcaagtaagtaggaaacatctgagtgagtttgctgaaatgaggagaagctatagtaaaagattaaaatgtttgtgccatattagttcatcatgagttaaaagctaatcttgagggagattgtcagctagctaataagccttttatatacatgtaatatgttttggcaaaaattaattcttttttgtttattagaattttttgtttgttttaaaactaagaacatttggatagtttgaatctaaagcatagtaaagtgattattatatcctaccagaatttcttttgatgttgatttagacattttgcttttatattcagtaatactttatcacagttaaaagattttatcttaattcttttttttgagacggagtctcgctctttcgcccaggctggagtgcagcggcgcgatctcggcttactgcaaactctgcctcctgggttcatgccattctcctgcctcagcctcccgagtagctgggactacaggtgcctgccaccacgcctggctatttttttgtatttttagtagagacggggtttcaccgtgttatccaggatggtctggatctcctgacctcgtgatccacccgcctcagcctcccaaagtactgggattacaggccgtgagccaccatgcccggcccgatttcatcttaattctaatctgttttataggttcatttcagctcagtgttgattttagctagaaacccaggtgaatctccattttcctgtgaatctccattttaccataacagagaagctgctttttaaaccagtaatttcttcaccttcccacccccacttctatttattaaattttaaaaatgtagcctgatttgggtgtattcttaaagaagtcaagtgtcctttctccatttggtacacagttactggttttttgagtgatatatgtacaagtcacttaaacttcttagagcataaagagagaaagtgaaaacttaatttggagggcatactcgtagaccttgcctgactgtgctcatgtccaggcaggggggacagtgtatgcaagaataatttggagttcctgccagctctaaccagcttcatcagtggctggataaattgcaggactctaaacatttccctgaagaaaaaaagaaaacttaatttggaaatggttctaattgaaaaacctctacttagagtatggattttgatttttaaaaattaaaaatcaaatattttgggctgggcatagtggctcacacctgtaatcccagcactttaggaggctagagtggacagatgacttgaggccaggagtttgagaccagcctgaccaacatagcgaaacttcatctctactaaaaagacaaaaaattagccgtggttgcaggtgctacttgggaggctgaggcctgagaattgcttgaacctgggaggtggggcttgcagtaagccaagatcacaccgctatactccagcctggtaaacagagcgagagtctgtctcaaaaaaaaaaaaaaaaaatcgaatatttcacaggtgatgcaacttgatattgaatacttggttgttttttcatgacaatagtgggaagatagacaatgtagtatgaagggtgtttgaggcagaaggaacaaaatgaacaaaggcatggaagagtggcttatttagggactcatggagtaatctgctatgactaagatttttcagtgtttggaagtcaggttggatccagttataaaaaaccttatatattctaagctaaaaatattactagggaaccatctaagtttgtttgcttgtttttttttaaagcagagtacaaatttatgtgattagattaccaccttgggaattctgccctgtggtaggataacttgaaggaagagagatgtttggtttgtttcttaaacactgcaagtgaatggctgaggtacttccagttggatatggttggtacatctgtagaatgggatcatggcaaaattcttgccagagtgcaagattatggaactccagcttattactaataacttcaggggtctaaaaactttttctcaaagaatgggaagtaaatatcttaggtttgcagacattatgttctctcttgcccatgagagaactaacttattctgccattacagctctaaattggagataggcaatatgtaaattagtgtgcatgactctatcccaataaaactttatttacaaaaacatacggccagcacaggccagtttgccaacccctcttttaaaccttagtgagaagagaatcagaggcagcaagaggaaagagatttctcaaagaacattagggaagcaggaaaatagggaggaaatgatgacaatggaaaggagcgggacgttaaggggtagaggaaaaccctgtggagagattctattttaaaagatcctatagaaatctaaacaccgatgttaagaaattactaaattttttaggttgtgataatggtattgtggttttgttcttcaaaagtattcttatcttttagagatctctactgaaatatttgtgaatgaaatgatagggtatctggagtttgcctcacaataatctattggagttgtcagaggagaggaacagatgaaaaaaataaataggccttgagttgattattgttcaacactggatgatggatacatagggatttattgagttaatctctctgctcctgaatattccgtaaaacttccataataaaaaactgttttagtaaaagacttggatttgggatttggggattaacctcagagtgaaatccaaagagtaattggagaggaagatggattgcagagagtggatggttgatgagagaaggagaagcagtttgtgttccagtgaaagacgaggagggatatgaagggaaaagaaggtaggagaatccagtggcttctcaagggagatactcaggggatgggaattttagaggaagttctcagaggacacagaatggatgggtttaaaagcaggtatatggtcattcttcaccttatggacatttcgttttatccccatagacaagtatatccagaatcatgcaatgaaaggcagtttctcacaaagtaaagaaatacatgatggatttatattaaaacctgtgtgtctcttggtaggcatttgtcacagtatagcaagggaatacaattctcatagtaagaatctctagagatttatagaattcagcgggaaacattaaattgtgcattcccttctgcaggattattagccatacctttaagcttctccccttttcttcaaaccatcttttcaaactaaaaggcatgcccattatacaatacttggaaactgtaggacagaagaaaggagacttaatcccctgtcttccctggacacagctatagccagtaacaaattttactctgcttctctagactgggcactacagctaaataatacacagtttctacccttcgtgcactgaaagtgtactgaggggaaatggactgagaagcaaggacaataatgtttcctagattaaatgatacatctgaatttctatattttagtatagatactctaaataaaatacatcttttatgtcttcttaattttcaaatatatctaactaaaattgggatctctatgttctttccactttaagctttcctctatttgattttttttctgctatcattaattaaaaactaagcagaaaatgggtaagggatataaaatataaagtatgttgtatattatttttagtaaaatgaagattttattttatatgacctgtggaaaccttttacttgaaatgtgtctggctatactaagtatagattagttcatttcttgcttttgttttatttttgttctcaagttgagtgacaactgagagtagtatcaatacctgtacctcccatggatcaacaggtacactctgttctccctaatctgaattcagccaataatttgtcatgttatttgtgttttgttcttttgtttaaaggttactgaagaggttctcattgtacagagtataactacatgatgtattctagagctagattgaaaagcaatctgtaattagccaacagataattagcactttcaggataccacttttatcttataattatttactcttaaaatgagctaagttatcttctgtagttcacctggcatgtgttctactggtgcatgcactcatgctctctttttaagtaagagatcatcagttttaagaacacagaagtaccagtaaactttctaccaagaatggccagtgtaacatgttcatttagattagtgttgccagtctctctgtctccttttctctttgaagtgttgtttgccaaatgatatggtaagttcaaattactctttaggtatttccttttcatttttaaattgccaagcactgtactttccaattaggttctaaaattcaatgttaagtggaaacatttgttaaatttctaaagcataaaatatttgattattctcttcttagatgttagtttacataattaatagtgggtttttatttaatatgtgttatgttttagctctttgatcaggtatacacattatcttgagttttcacatccaaaaaattatatacacactgttcacaggcttaatgtgaagaatgtgatgtaagctatgtttaaattattcttataaaagtgacttttgacctatgatttgatagtattcagctgttaagtcatacatgtaatgtatcatttttgtttttaagtttgaggtctcactatgttggccaggctggcctcccctgacctcaagcagccctcccacctcaacttcccaaagtgctgggattacaggcatgtgccaccagacccagccttatccttatttttagagtggatttttgatgtattgaaaacaaactgtattattcacataggctttcttcaatccattgctaattgtttgctgaatgcatagcaaagtccttgtggaaataagtttgtttttataatctttttctttttgtcctctttgtaaatggcctgaacagtacactatataataatagctaacgttggtggggttagggaacactctgttaaaaatatgttgatgtattatctagtaaaaggtgagaaaaatcttcattttaagagtaaaaatatgtcacatgcctggcatggtggctcacacctgtaatcccaacactttgggaggcccaggtgggaggatcactcaaggctagaagttcgagaccagcctaagcaacaaagcaagatccctctctctaccaaaaaaaattaaaaattagctgagtgtggtggcatgcacctgtagtctgtagtcctagctactcatgaggttgagacaggaggattgcttgagcccaggagtttaagactgcagtgagttatcactgtaccactgcactccagcgtggttggcagagtaagaccctgtctctttaaaaaaaaaaaaaaaaaaaaattaaaaagtctagtacagtctgagaattttttccagtctttttattgtgtcatttatactgatataatcaaagacaaattttatttctaattgacacattgcagttgtatttatggggtacaagttgatgttttaatatgtgtgtatattgtataatgatcaaattagggtagttacggtacctgttacttcatgcatttatcatttttttgtggcaagagcattcaaaaccattcctagctgttttgtaatatataataatttactgttaaccatagataccctagtgtaccatagaacaccagaacttattccttctatctacctattaaccaacctctccccatcctcctcattcccatccccatcctctccccagtctctgggtaatcactgttgcactctctacttctatgatagcaacattttttagattccacatgtaagtgagatcatacattatttgtctttctgtgtctggtatatttcacttaacataatgtcctccagtttcattaatgttgttgcagatggcaggattttattttttatgacagaatcatattccatgtgtatatgtgccacatttcctttattttgtctgttattggacacttaggttgattctgtatcttggctattgtgaatggtgctcaataaatacaagatatctcttcaacatgttgatttcatgtcctttggatatctaccccatagtgggattgctggatcatatggtcgtcatatttttaatgttttgagggatgcttccatactgttttccatagtggctatactaatttatatccccactaacagtgtatgtgttctcttatccacgttctcaccaacgcttgttttcttttgtctttttgacagtagccattctaactggaatgagatggtatctcattgtggttttgatttgcatttccctgataattagtggttttgaacatttttcatatacttggccatttctttgtctctttttgagaaatgtgttaagatattttgctcattttttaattggattacttggggtttttttttagttgtttgagttcctttgcagttattttaggtttttttgcagttcttttagtatatattttagatatctcttgtcagatgtagtttgcagatgttttctcccattctgtaggttgtctctttgctttgtttcttttgctgtgcaaaaagcttttgagtttgatgtaatgtgtcttttcttttgttgcctgtgcttttgaggtctcatttaaaaatacttgcccagcccagtattatgaagcatttcccctacattttcttctagtagtttcatactttttttttttcattaagtctttaatccattttgaattgatttttgcatatggtgagagagaggggtctaacctcattacatgtgggtattcaagttttccagcaccatttatagaagagactgtgtttccccagtgtgtggtattgccacctttgtcaaaaatcaattgcccgtgatgtgtgaatttctgggctctctgttctgttccgttgttctgtgtgtctgtttttatgccagtagcatgctgttttggctcctatagctttgtgtagtatgttttgaagtcaagtagtatgatgtctccagcttttttattcttactcaggattgctttggctattcagtgtcttttgtggttccatatgaattctaggattattttttctatttctgtgaagagtgtcattggtattttgatagaggttgcattaaatctgtagaccactttgtatagtatggccgttttagcagttcttccagttcatgaacagcagatagctttccatttacccacatcctctgcagtttctttcatcaatgttttatcattttcagtgtagaaatctttcacttccattattaagtttattcctgggtatttattttttcgtagctattggaaatggaattgttttcttgatttttttttcagatagttcactattagtatttagaaacactaccaatttgtatatgttaattttatatcctgcaactttactgaatttattctaacacttttttggtggagtctaggatttcctatatatgatatatcatctgcaaatgggacaacttcttcctttacaatttggataccttttatttctttctcttgcctaatagctctaagacttctagcactgtgttgaatggaagtggtgaaattgggcatacttgtcttgttcctgatcttaggggaatagctgaaagcataacatcagtatgtttgtcatatatggcctttgttgtttcaagctgcatactttctatacctaatttagtgagcatttcagaaacaaactttaataattctttagctttagtgttgtttgctttctacctggatcatggggttaacagaatttgaaaatagagtgatttcattttaaaaggagattttagattagtaagaaattgttactctctgattttatttctccatttgtttcttctcaaccctgagatgaagatccttctgatatcttctaagataaaatttgttcagcatttagagcattatttttttctatttagtcctctattgtactagtacctattgctgcctaacacattatcctaaaacttaatagcttaaaataacaaacatttattacctcagtttctgtgctcagaaatcccattgtaacttacctggatgcctctgacttggggtctctcccaaagctgcagtcaagcatcagccagggctgtagtcatgtcaaggttctaattggggagaatctgcctccatacctactaatagtccattggcagacctcaggtccttcgttaatagctggagacatccttgcagcatgtctctccataggacagtttacactagctgtggaagttggcttccttcagagcctggcaagcaagagagtaccaagatggaagctacagtctctttgtaaccaaatctcagaagtgacatctcatcactcttgccatattttatttattagaagcaagggactaggttcacccagactcaaggggagggaattaaacaggagcatgagtaccaggaggtggtgatctttgggttccatcttaatggctgcttgccatatctgctataagtactttgaaacttctagagcttttccatttttactgtgtcatcttcacagaattaggatgataaaactcctgttcagataaaattccctgtgcttagcttgctggtgtctcacaatcttgaattaatcattttatatagaattagactccaggaaggggtgcagaccaagacagagataaaggaatatttatttgcagttttagttgtatagccttttctagttatttaaataagaagctttgttaaaactctaacaagaatgtgtacagttggtactagaaagtgtacaattgggaatggtctatgctcttttcattatgtaaattctaacgtttgttttgttcagtattggtaaaggttttcaaggtgtcatgaaaagatggggatttaaaggccagcctgctacgcatggtcaaacgaaaacccacaggagacctggagctgttgcaactggtgtgagtataactagtgaagctctttttaatgctaaatattcaacttctgcacatgtagtcctcagtccgtccttgatatgaagtcacataattttagtctgacacaaggggactccatgtacttgtcacccttttatggatccttgcccctcactcatttcccagagccagactagaattagttatattccacaaggttagctgagcatctgtagtttggctgtatataccctgagtctaaatttaaaatgtactttgtgcaaatgttgaattcagtttgtcttttgaattagtatcagttaacaattctgaaataattttctgtgaattgtaggattgagtagataagtaaatgtattgataatggagctaggtttctcactgttggaaaagggcgttaaagtatgaaaatgggaaaattaaaatgaaccctatagtgttgaattcaaactataagtatgcatatactgtttggtgggggaggggaatgcatgcatgcacacaaggaaaaaatgtagcacacagagaaacagaggggtgtgtgtgtgtgtgtcttagttctgtctactggaacattgtagtcatatataacggaatatatttgtagaatgaataagagtgatacttagtctgtaatactcagaattgtcttttaagcctgttggttacatattaaacatatctaatgccatgatgaggtacttccactgagagtttcacctgttaatgtgagagcagctgatggaaaagtgtttatattgtgagaattcatgtgttataagaagctgttccattttagtcataattcagatttgcttctttagatgtagaactattacccgttatcagagccaaaatcagagactgttagatttatgtaaatcagagaaaaccagggctagacaaactagtattctgataactaactctgtccttgaataattttggtcaaggaaagtaacatctaaagcaaggagcagtaggaccattccagcaccagtggtatggatgaagtccattaagtcagttaatacagaagatgagttcaaaacaggcctggcagtccattttttttctttgaatgatggtgtcggtgtgtctgtatgcccttgtccttttttaattcttagccagtattaggtccgttgttgctgagtttttctcctaaatctgcttcttagtctgtatttattttatcattctagtctcattagaaaggaaatcctctaggagtaaatatgcctaaatccatatttagttccttacttgggacctagcagaataggggaaaaataaaacattttaataatttatatttttagtttacattgtggtttgatcagtgctgtttaaaattgatagtacttaaaagtgttaactttagttttctcatttaggatattggcagagtctggcctggaactaaaatgcctggaaaaatgggaaacatatacaggacagaatatggactgaaagtaagtgttacaagtggttctttttaggaacagctaaattgtctaaatgcaaaggcagcagaatatgtatttaatctgtgtctgtaccattgttctaagaggctttaaaattattgaggaaaagaggatacatgaattgtgtgtgtgtgtgtgtgtgtgtgtacactctagttgtagtaatggtggtagtaatgatagggtatatttcaggccatgaaaagtgcagtcattaaagagacaaaattagtagtccactcttggacctggaagatttttacaagatattgttgcatgaaaaaagtaagattcagagcattcagtataatactctttattgagtaaaagatttaacaaaagctctctacgtgtgtatgttgctgtgccatcatataatcacagaagagtggaagggtatataccaggttcttggattatatatcaaatgtgtgtgtgtgtgtgtgcgtgtgtgtgtgtaagtgtaaggaggagagtgggaggcaatcaaaataggaggaaacaatagcactacaaaaggattatgatatacatccgtttttataaaaaatgtctgtgtatatttaaaagagaagttgaattcaatctctaccaatgagaaatgtacctaagtaaaactgagttatactataatggatgctgtataattatatttctgttaaacaactaatgtttatatttgtttgcatgtatgttttaaagtgtaggaagtacaaagaagaaaataagccaccaataagaacaatacccaaagacaatcactggaaacattttggtgcatatcctcccagtctctattctgcataccttttatatataaattttgaccaggagaagttttcaaattttatataattaaacctaagattttttttaccccttctattacatttatacttatcagagaccatctatttgctgtattttcttcgtgtgtgtgatttcaatttttgtaatatttaatacttattcattattagataggagccatgggtcaaacttgattccttatccaaatattttattttctcagtaccattttttgaccaatcattctctcccatttatgtacgttttttctccacatgaagattttttgaggaccatctactcagcccacttactttagaaattagaatcagtgaggttgtggcttctccagcctctagttacagcaagctagtattaactaaaaataaaataaaattgaatttccacttgttattgttaatggtgccaacagagtcctttgaaatatccaaatagtcttgatcattcagtcacatctctatttaaaatgagagttttctactacttccataagatatatttgctatggtcttctattacaagtcatccataggacttgaagtttttcagttcttattcaacattctgaagtactggtaataatcttttattactttacaagcaacttacatcctcagcttttagtaacattgttttaatacaagtatatcctaaaatttttggttttatttcatgctttaggtgtggagaataaacacaaagcacaacataatctatgtaaatggctctgtacctggacataaaaattgcttagtaaaggtaagtataagtgtcttctttttttttccttttttttttttgtttcttactcgcaagctaacaaattactatctttattttctattgtttatatatgtggatatttgccataaagtctcctttttctcatatatgtggcttataaataaatggctgtttttccacatgttctctcctgaatctttctgctttttagtagcacctgagtgaaaaaaatgcacaagataacctgtattctatttctttcaaaccaagaacctgtaaaaagggtaaggctgtgtattagtccatcctaatagaatggatggactcctataaagaaatacctaagattgggtaatttataaataaaagaggtttaattggctcgtggttccacaggctgttcaggaagcatggctagggaggcctcaggaaacttacaatcatggcaaaaggggaaggagagatggacatgtcttacatggctggagcaggaggaagagagggaagggggaggtgctacacatttttaaacaagatcttgtgagaactcactatcacgagaacagcaagggggaagtctgcccccatgatccaatcacttcccaccaggcccctcttctaacattggggattacaatttgacatgagatttgggcggggacaaaaatccaaaccatatcaggccagtaagcagaaagatcttcaggaatatgagaaggatatttggaaaactattgccaaaataccagtatatctctgtccttccaaaaggaacatgttagctttttaaagtgccccatctacaaatgaatggataaagaagatgtggtgggtgtgtgtgtgtgtgtgtatgtgtgtgtgtgtgcgcgcgtatggctgaagaatattctagagaatgcacacacacgctagaataatcttcagccataaacagaatgaattgctattgtttgtggtgacatggataaacctggaggacattatgttaagtgtaataagctaggcacagaaagacaaatattgcatgatctcacttttatgtagaatctaaaagttgatttcatagaagtagagaacagaatggttttaccagaggctgggggaaaatagtggggaggagagctggcggaggtggtctacaagcacagagttagttaggaagaatacattccggtattctgttatatagtagggtgactgactatagctaatagtaaggtatatttcaatataggtagaagagaggattttgaatgttatcaccataaaagaaatgatacatgtttaaagtaatggatatgctagttatcctgattttatcattatacaatgtatatttattgagacatcacaccatacatatatatgtacaattatgtgtcaattataagtaaaccctgcccccacccccccccaaaaaaaatgctttttggcttttaaaagagttactttgacaaaccagaaatacatgaggtaaaaattggaatcatcaaaagtggttaaaggtagacatttgagggggagcttttttattattactaacaccatgctctgattatatcttttaagtgtttttcttaaaaaaaagaaaaaagtaaaaaatttgtaccgatagctcagatacattttaataaaaactctttaagttctcagagacttacttccataaaatagaaaataaatattctgcctggggtttattccaacctaatacaaattttcttacctctgagttttgaatcttccatgctgaaaataagtttgtattagaagttatgtcagctgttctccagagtatactcttcattgattttccaatgatagcagcaaagaaatagtgaaacttaatcctctgattttttaaactcagtgtttccttatatattttttttcatttctaggttccattactagcatagggaataattttttgaaatcttgcaaggaataagaattttgctttttaaaattacctttctgagacacttcacttactgactggattattctcatttttgttaaagaaaaaaatgcatttaagccaggcctggtggcttgcatctgtaattccagctactcaggaggctgaagtgggaggataggatcacgtggcctcaggagttggaggctgcagtgagctgtgatcacactattgccttctagcctgggcaacagagtgggaccttgcttaaaaaaacaaaaaaaaaaaaaaaagagagaaaaagaaaaatgtatttgatgaatttttgtaagttttgttttttccttaagtttgcaggtttttaagtttaagtaggtttctagtccccaagtaaggcagtcatacttacaatgacagatagttgaagccagagtattgtcattgtacttcccgtggtattttgtcttcataattcatgtgaagacatatcttcatatccctagccccacatttcagatcacaggttataaatagcacaacctgataaaggagaaggattattttttataataaaagtatactggacaccagattaatttttaaatgtcaaatcctccttttctgcctatttttctacatacatgattctaggctggttttctagctgaaccttaccattaattgctgtgacttctcaagtactactacaacatcttctcaagtacttctacaatatccctgttaccagcagagatgaatggtcaattatcttgaaaaactgtagtacatacaatgacattctgatgtagttgtataaatagttgataaccagtaacatttattactcagatttatcgcctacttcagtaaaagattacttccaaaaactctattcactctcaatcgataatagtttgccatcactgaagatactcagaagatacaccaaagagttctgaaacgggagtctaaatacattttgagaaactggcatcagaacaatgtctagtcccttttgaactattaacacactagtgaatatatttccagcaagtatatttgtataataaacacgtcctttaaaaaaatctttgaaatatggtgcttaaataactttcttttgtaaccttaaagtatctgcccaggcattaattaaggtatgaatttggggaacattttataggtttgtgttttaaatggtaaaacttgctatgtcctttcactccattatttacgttcttccagtgactccgtagcaggtaaattagtccttccttgcctatgggttttgagccacttcctagtgggcagccaactttgttaacatccactcacttcttgggagcttttgtttcctcagagtacagggttaccaataacttttttttaagattccaaagttagtaaagatagtcttagagatgaccaacctatttaattggcattagctttttgttttgctgtttggattcactaaatgtattaatgaagactaaagaactattgtttacagcataataagtataaatgtatgttctaaagtacggttcattcgtgttcattcctgtgtcctatatatcatttattttcagatttgcctggcttttgtctgtccttcccccacattttcttaaaagatttagactggtttgctgatagacataaaaagaatgaggtagataattgagggagtcttggtgcaggcagggaaataataaacctgaggtaagattaaatacacaaaaatacatatgggctgcagacctttggccctcaacttttgcaccactaagacaaaaatggttgagatgtcatttacgtttcagatccatgaattataatacttagattttacaaacagtgattccgtcgtctaaaatatttctcaggtataatagttctataaaagtgtgaaagcaactgagagttatctctttgggtcattgatgactaaatttttatttctcaaattagcacagaaagttttgttgtgattggttttattgttttttttgcttgggttttattttcaatcctaaatactgagcaagtttaaattggtaagaatatgactttttcccttcttaaagttcaacctaagattaatggattggggggacaaaactaaacaagtttactttcttctgggtaatttactgataatttcttgaaacaattttaataagagggattaaagtagatctgtttttctgtactaagctgttcctagcagctgtgtactttatttcaaccaaattattcatttcttattgctaaagtaattatgcctcattttactcgtgtatataattacatgtaatttttttaaaaactttacttatgaatgaaggctgtagaatgagtcagaagttctgaagaatccaataatgttttccaaaaataaaactcaacattttagatcacatcagtacctatattaaaattcttcagtctgtgaattcacagatataattagaatttttgagaatatatagagttaacagagctcttataaagacccataggtctgttattgtttttgctaaatattattctgtctttaacttatcaataagaatgtatgctctgacatacattgtgctgcatttgttgtatatgaagataggattggttcttgttgctcacacctataagcagaaaaatgcactaaggccatggaagtattcagtgctaaatcaagaatgatataaaatagtctcaacttaaaggcccttacccaaatttgaaaatgctgaagaattaactttaaattttccgtcaatacaggacttttttttttttttgaccatgtgacatagaaatacaatcttgtttgttttatttgttggagaaatgactcttttggtaggggaagaaaaatgtaagctgatttccttaataagaggtgatatttttgattatgtgctcttagagttaagactaacaaaaatgctagtttgtcaggtcattatatttgaaaatgaatccatataaatgaaattcaagtagtaattttagaatgtgatttcatcctgtgggcaatcctagagattcttacaagttaagatacaaagtaacaattggtgattttatccttatagcttcttgagtttctgttactggattagtcaaattttttagaattaaaggaaagcattgactgagttctttttactctatttatgtaacagttgtgttattcacattagaaaatgtagtagcgagtatttctttgattatgaataatagctgaaaagtctacctttaaagaacttaattggtttcactaagatttttgccttctctcaggtcaaagattctaaactgcctgcatataaggatctcggtaaaaatctaccattccctacatattttcctgatggagatgaagaggaactgccagaagatttgtatgatgaaaacgtgtgtcagcccggtgcgccttctattacatttgcctaacatctttggacgtggcagaaccttacatattctgtgagcttcgatgagccagagtgatatcataaccaccagaaatcatactctcctttcttagtcacaacaaaatcacacatgtcatctttgtcaagggcataaatatatcattcatacccccattaaattttgttagaaaaattaccacattaaatatatgagttaagtagattggatttgctgaaattggtgttgggcatattagcaaaatattcttaatttgtggactcgattcttttttactacatatttcccaagttatcttaagatgtctgtaaatttaacttttattaaagttttgtcaatctttgtgaaatagtggttgtggaacagtagaaaaccatatggggactatagtgcaacctatttgggtaaagaaaccatttgctaaaatggagaaagtaaatagatttttatttaaattacagaaacatgttaaaggccggacaaaggaaagacaataaaatcataaattatcggtcctgttt

SEQ ID NO: 37061 - DNA, 81752 bp, Homo sapiens
aggggccaaccccggcctaggctctccaccgcatcggattctggaatttacgatcacgaaagttctattgtcccgcgattggctcccgggccgcatgacatcatagcgcttgattcatccttcgggtcccgattggctggccgcgccattgtgacgtcacggtcagcccacgttctgattgtagatagccggcgccttcctcttcccatcgcgcgggtcctagccaccggtgtctccttctacatccgcctctgcgccggctgccacccgcgctccctccgccgccgccgccttgctgctgctcaaagctgctgccgccccttgggctaaaaggtaaagccgtcagctccgggaaacttcgtcgggggccgccgctcggccatgacacccgcgcgagcgcgcggccgggaagcggtcagagagaactgccgttaggtctcggacctggtgccgagaaagagctgccggggcaacccgcgctccgcccgcggcctccagctccgccggctccggggtacagcccggctcctcgggcgcggggaaaggggtgcgggtgcgggcgcgggcggctcgccccacgccgaggctgaggcagggcgctcgggagcgttctctgtgctgcggtcccacctgtgcgcgctgacaggcgccgcggggcacgacaccgtgcccacaccagacgcggagggatggatctgtccgcctgggtcctcccgccctgcgggccggagcgcgcggcgggagagccgggggagcgctctcggagggagcgcgctttctttggagtcggcgaaacccgggtgagttcgaagagcctgtgcgagggtctgcgggcaccgggcgccgctggggggactctccggcctttcctttttgtcctgttctctccgcttccgttaaccctgcggaccttccgtccgcccctcggagggaagcctgctagctcgggaccgcttcagtttttattgaaaccagacaacggcagcccttggtactcagggagggatgaggctggtgggaaagcgagagggcggggactcgggggcgaccggggcggccctttctgggagcctgatccctggagaggcgggagcggttggctgcgagggaggcgcgcggcgggggggcggttgtgctctgcgccgggggagctagagtgtgtgttgtcttgcgagttgtaaggaaaagtgcctttttactgtttccacgccggtaagactctcccaccccaccacctcgggtcgacggagcaatgcctagagcaagagttgttcttgctgaactgcgtcttgcaaccgttccgtgttcttgcacttggcggttccccccgccccatccacaattgtgaattaagctccttgattgcaaatttggagaatgcatttggccagttatgcaaagtggcggaggtggcggggtcgggggcggggggtctctttcggaagaatccagtgcatggtttattagctagactgaggaaccgagaggtgctagatgggatttgtggggagcgagcagcctaatttgttttaaatagcgggacccgtggcaggaagtgcttcatagaattgtacggaagagctgatgttgcttgtcaggttttgtaactcattctcctaaccgcttggcagataacctgttggtctgcacttgttttgcttgcacgtctcagccaaaagcatttcgtgcagaatctacagatagaaacaggcggttttgcattagatggccgtggacaaacattttagccttccatctgtgattggggacaagtgggttacttttctggtagctcagacactgcctgggattctccaggaaagctctgcacttgaaagggaaatgttactcattttccttttagatttttaccctagattctaacttcttattgccaggaactttttctgtactgtttctctttttgcattttcgtttctatttctaattgaagacaaaggggaaatttttattgatagttacagataggtaatgttacagaatgtagtacagaactttgctgaaaagcgacagtagaaggcttactaaaatttgatgtttttcaagaaaaatatcttgtaacttcagatattgacctcacctccttgactcaatttccttgtctatacatggggattttatgtggcaggatcattgtggatttcaagagataatgcaaatgagagcccagcattgagtctgccaaatggtggtttgaaaatgtttccttcccattccctgaaatcaacagcttcttcttggttacagaccttaatttttggatgttctgtttgcaagaatctttttttccactacctcttcttttgctccctgcataatggttgcttgtcttcctgcttctagaggtgagcatccatccttgggtgtcttatttccagcttgaattacacaaatcaaagcaaaactgtttacttttcttgagggtaactttggtgcctaggtgggtagttagtgtgaagagagagttttacctcttgctttcctggctacattcttctctcctaaaagattttgtaatttttttttttaattcctcctctttgcctaccagctcttctgttatcaaaaggctaatcctctcattagttacctgtaaataagtctttccttgaatgctttctgtgtcaggtacttattaatacgcacatgtacataaacggttgctttccacacgtaattcttataacacctctgtgaggttttatcccccagttgttttttaagaattgaggagcactatgaagacacatgcacacgtatgtttattgcagcaccatttacaatagcaaagacttggaaccaactcaaatgcccatcaatgatagactggataaagaaaatgtggcacatatacaccatggaatactatgcagccataaaaaagatgagttcgtgtcttttgcagggacatggatgaagctggaaaccatcatcctcagcagactaacacaggaacagaaaaccaaacactgcatattctcactcataagtgggagtcgaacagtgagaacacatggacacagggagggaaacatcacacacccgggcctatcgggtggtggggggcaaggggagggagagcattaggacaaattcctaatgcacgcagggcttaaaacctagatgatgggttgataggtgcaggaaaccagcatggcacatgtatacctatgtaacaaacatgcacgttcagcacatgtatcgcataacttaaagtggaagaaaaataaaaaagaatctctaggattaaggcctagagatgacaagtgacttgtccaaattcctatagctctgtctcctgcaacatctctgctccttcatatatccctgtgctgccaggattatttgcccagtgggctctgtgccattatgtaacactgttactccacaacttaaaaatctaaccttgtgtttaaaggttcttgttaatccatccaagactaacaatttattgtctcttaaatctgtctaaaatctgttcccttccttgtagcccacacttgattcattttttaaattaattcattgacttctcagttactgattttgggtgtgaggggctggatacaaaaatgaattacaacagttcctgattccagagggtttcctgatttagtatatactttaagcctgtatacacatacttaatctacaccttggaccaaaagagagtcagaagcagatttctgggacacttatatctttatatctgagaaagctttatggcagagctatccatgttaagggcctagcattcctgaattggtcaggatgcttttggtgcaagaaacagaaaacccaactgagacctacctgtgcatctgacctgaaaagtcctgagggcaggacttttgctccatttctctgaagtcccctcagatgtctgttatgtcctagactgattttccaagatgactgacagcagctgccaccataatctcacatggggattccctgacttcctgccaccctccaaagagtcctttaccttaaggtgattgacttaggccttggttacttgaagcaataactggaacagtggacatttgataagctgggggcccatcccagaaccagggaagtgaagttaaatctcctcagctagctgcttcacctttaagaagggcctgcagaacacaggaagtcagctacagcgtctgttttaaggaccgaatggatgattggattaaactaaattgacttgaattaaaattagaatttagccttacattttgtaaaggactcttagttgataggcaggaataggaggacatgcgttctaggcaagagggagtttggagagtaagcgagtgtggaatcattgggcaaaaagcaaatagcacaattggcagaagctggtttagaaggcaggagtggaagaaaaggtgagaaaggcaagttattgatgtaataataatggctaactcttactgagctattgtatgtcagaccttgcactgagcccctcacaaggacttatttctattattaatggatgctacagcattcccattttacaggtggaaaaaggcccagagtttagacacttgatttggggtcacaaagcattccagctcagatcaccttgacaccctggcctgctccgtctcctaaggtgtttggtagaataccaccaataagcttttgaataagaatgaggacattatgagtgctgtgctccagaaagacagtcttgttagagtgtagggtggattgttgtgggtttgttagagatggccagggcagtgaaaaggcctgacctgaagccacagccatgagcacagacttgagagaggtaattgtgagagactgtgtccaggataagacttgaagaccagttggatttgagggccagcaagaggagggatactcttccaaagagaagagggagctttgtgatcagatggaaatagccccacagcctagatagatatccagactagctgtttcttccaattcctcctcttcacggccaacctttgtcttagctatttttttggttgcctttctgcaagaacatgtttctaccacatttcatctattgtcagcttttcacatttcacatctgggtagagatggagcttataatcagtggcatcttaaaatcactgcaggtaactttccacattttaatattacagaattgggatgcctcctacacttttccctggtgagaaaaggaaagccccaatgttaccaaaggtggtgcagccagatgctggcagagccaggcttctgggcttcttccaccagctgggttacctctgctcccatgatagttattaaaacacatgtagcttcacgttacaggtttatagtaaagtacatacatgtttgtgtgtttattaaaactgaagtaatttgagaagattggaaggcatgattgtttaagtagggtgcctcattcttgtatagaatctggctgccttggtttcttgtcctaacttgaagaaaatcaactctgagcattggtctcttttcctttaaaatgaaagattaaattttattttcatttttgcctagagcaaattttattttttatttttgttttgtttctgtttggccagggatagagaatgaaagtgagatcatttagatcttagaaaggtagatgttggctgggcacggtggctcacacctgtaatcccagcactttgggaagccatggtgggcagatcatttgagctcaggagtttgcaaccagcctgggcaatatggcaagaccccatctgtacaaaaaatacaaaaattagctggatgtggtggtacatgcctgtagtcccagctccttgggaggctgaggtgggaggatgacttcagtccaggaggcggaggttacagtgagccgtgattacaccactgcactccggcctgggtgacagagccagactctgtcccaaaataaataaagaaagaaggaaaggagggagggagggagggaaaatgtcagaacagttgatggagattgcagcagcagcagcaagctgctggttttctctttatgagattaaaacatcactgctggagatgttctggcctatcctgacctgattttcagtttctgcaataggaaccctcaccaccaaccccagtttcaacccgtaaatgttattaccagcctttttggttcccactggcgtgtttgctccatggtaacatttttagtggacttgtaggcattcacttttagaattgtgtagtctctggatttaaaatattcatacttggtgaccttttagaaagactaaattcccactcttgctcctccatcctcttctgccagttctgtgtgaagtacagttgtaattgcattcaggcatgagtatgtcttagtattccttattattagattggacttttttaccttttatttgatgtctgctggctgactgggatttagggaaaaatttctgatttattttaagatttttagtgctgatactggcatgctttctctaattgggagaataacaattttattgaaatatacctgtgattttaaactgtaatctttatggttatattaggtaggcaccctcttgcgagcacaggttccatctctgttaagttccacatttaccccatccttttcctcatgtcaacaatttcatcctgtcagaattaatctcttataagcccatgctgaacagacctaattgaagccatgctggcgaattggccactcaggtctgtgttttatgagtttctgaaccccagagtagtacttgttcctctttggtcttggcacagcaaatgctacaacaaagtgagtgttatgaatttctccttccctgaagaatagttctcatgataccaaattcagtaattattcatttgcttccaggggagtttgaaatgtgatgtatctccctaggggtagtattcagggtacttctgcttcagtctttggcagaagaaataatacttcaatatttacagaagtcgttgacgcctccatcagctgtatttgttagaagcatctgtgtgaaaatttgagtttgcttctgtccgaacttctgcatattaatctctgtgatggatctgaggtgcatttaaaagaatacctcctgtacttcttttaagtaaggacagctgtgggaagcagattgggttggcagcctgcacctatgcggggttccacctctgccacttaacagctgcgtgggcttcagcaggtaagtcactctacctccttgagaccctagaatctatgtagaacttggaaggtgataatcctgtgcctactttggagggtattaaaactatcagtattgtacatgaaagttaggtggggcactgacttaatttaattagcatagtaaaaacgtctctctgttatataggatgtttattgaagcattgtttctaatagcaaaagattggaagagttagtagactaaatgtccttgaaaagaataaatcatgctacagctgggcaacggaatattctgcaaattttaaagagaacaaagctgttctatgggtactgaatatagctgcttggtaccacataataggcacttttctgaagtgttcaacatgtattaattcattgtggcttcacaaaagcccacgaggtagggaccccaattttacagatgaggaaactaagataaaggttaagtcacttgtccaaatatccacagctagtaggtggcagaggcaggattcaaacccaggcagattggcttaaagactctaatcttggccaccctgctgtgctgtacacctgtcagacctaagtagtgatctttgtatttgcagctttagatacatgagaggaaacaaggttgagtttcttattcatcgttacattctgggaggctgacggtataatcaacatatagcttctgttgacagtaactaaataaaggtttagataaagaaagctaatagggaataacatttatgatcaatacttgaaagggtgaccgtttgtttcttccattactccttattttagatattttgaacttaaacctcttttttggggaaaatcagaagcgtacacactgaatagcttacaattgttagtgtaagaaatcagtgttcaaaagcccagttgagtcagtgttcactagcctgactggtctagtgtggctggattagtatgactggccaagggcatccagcattggtttccttacccggtcctagccccatctggtttgatttacaaggtatatacgctcagagaaatgcagacgggagggaaagacactcacattctttagggagcctctatctccagattgcctgatctcccttgggtgaaaatgtaagtcaggtgtacaagtcgtacaagtcatgtatagcttgacaatgggaatactttttgagaaatgtactcttaggcaattttgttgttgtgtgttcatcatagagtgtacttagacaaacctagatggttaccacatacatagggcatatgatataccacattgctcctaggctacaaacctgtacagcaagttactgtactgaatactgtagctagctgtaacacagtggcaagtatctgtatatctaaatgaagaaaagatatagtaaaaatataaaagataaaaaatgatacaactatgtagggcacttgccatgaatggagcttgcaggactggaagttgctctgggtaagtcagtgagtggggagtgaatgtgaaggcctaggactttactgtacactctagactttataaacactgtatacttaggctacattaggtttataaaaaatattttttgattaggtgtggtggctcatgtctgtaatctcagcactttgtgaggttgaggtgggaccaggcatttaagaccagcctgggcaatatcacaagactccatctctacttatttataataaaagtttttttaaaaatatgtattattttaatatatatttttcttccttaatacataaactgtagcttattgtaacatttctattttataaattttttaaacttttttactcttttgtaataatacttagcttaaaacacaggctgtatggctgcaaaaaaaatattttatttcttcgtatccttattcttcaagctttttttctccttttaaagttttttaaacttttttgttaaaaactaaaacaaacatacacattagcctaggtctgtacaggggcaggatcatcaatgtcaccgtcttccatctccacatcttgtcccactgaaaggtctgtaggagcagtaacacacatgagctgtcatttcctatgacaacaatgccttcttctggaatacctcctgaaggacctatctgaagctgtttcatagttaactttttaaaatatgtaattagaaggtgtacactcaattaatgataaaaaagtatagtataccaaatacataaaccaatgacatagttctttatcatcagcatcaagcattatgtactgtccataattttatgtgtgatactgttacaggtctagctatgcagtaggtttatttacaccaacatcaccacaaatgttttattgtgctatgatgtcactaggcaataggagtttttcagctccattataatgttacaggagtatcattgtatatgtggtccattgttgatttaaaggtcattatgcgatgcgtgactatattttgaaaacattctgatagagaatgacattaagtcattttgatacaaggccccattaagggccactgtgctgggccatggtgttcaggctatagacaagtctgccaccaccttcagttctcttaggatccttagactctttcagaactgagttttctttctgggtgtgggacactaggtttggcaacattgtaatggctataagtatcagcattcctaaaataagagaatcacaaaattcatggggtggcttatatattcacatggaatctgaacaggtgataaaacaactgttggtttcagagacatgctatagaggagatgaatacacagttgctagactgtgtgtccctttgaaaaatgctgtattgtagcaggattttcccccattttttacacatttaactttgcttctccctctcctcactcaccctcacacccaaacaacagttataaaatgtgggcgtgtagattgagttttaaaaaagaaatgtgtttttgtgttatatgccttatttatgttacacaggcttgaattaaaatcttttaagacattttcgtttggggggttgcataactaatctttattatgtttctccaccgtcttttaatttcagcttaaggtatcactgcctttgtatactttgcacaaattaggttggagaactcaattgataatttcctcaaatgataatttattttgaatattcaagtaatcacatcagttaagagactgcactcagataagaaccatcagcagttgcctgtagcagaaaatgttgcttaaaagccttttgaatatttgtctccctgttatttgcaattgcagtcttttggtttagatgtttagaatatgattgaagtagagcccagactgcttaagctcaggctttaagggaaccattagaggcgtgtgtagtatcttggtgtctgttacctaccttggccattgattgtcttctctacaagatgcttcatccaagaaggaagttgccctttgaaacaggtgccctttgagcttctccagagagacccataaagacattatcccaggacctcatgtttctaggagaatgtgataaatattgtgatggtttcattttcagagcagctgccttttcttccttttgcaaggagtaggaacaaaagcagcttctttttgtttcctttgcaagggcttagaataggctcagtgtgacccaagggaagttggatgtgacaagtgacagtaaggtaagtacttttcattgaccccctggtacagagttcaggcttgaacttaccatctttttaagaaatgggactggcgtattaaatttaaaatgtaggcaaacagttgcaaagtactgtcagaagaccaaatctcattgcatgatctacttgccccatggattcaaatatccatccacccacccaccatccacccttagatatttatttctagcccatctatttcttttgagctccagactcataacttttcatcgttgggtgccccacatacctcccctgttggccaacgtagtcaggagcaccatcctccgccagtttgcccaagccattaagctggaagcaatgcttgtgttctcctctctcatcaaccatgcttttaccaaactttgctcaactgtcagtcaccaagtattactcattcatactctctgtccttctaagcttattccccttccccacattgccccagccttccatagcatgtcagatccttcctggacaactacaatttctccttggctccttgcctctgttttcttgattcctaaaaattagatgaggttgtacctgtatagtgctttgcatagtgtctgccatgtttatctggcacatagtgtaggtatctagcaattacgtgcctgaatgtttctctaaatacatatgtacctttcaaatataaccagtcctataatatgtgctaatggctgtgtgaagctgagtatgccttgatagcctgagaatacataatgtttcacaaatgaagagcttacctgggcaggagactttagaaggccagttgccttgcttccagctgaaggagtagaacaccagcagctctcagaccatacaaattgctagacaccttttcctgttgtggcatggtgcaatgaggagctcttacctatgcctggagacatgccatctaaggactcgttggctgcagtctgtgcagatcttcacatacaaggagatggccatagctgtggtgctctgcagatgtggcagtggcttcatcaggatgaacgaggggcccctggagatgatcaagctgctcacactgcaatacaagctactggaattaggtctgcttctggacaaggaacagcttgctggaatggacatccatgttcgtgtgaagggtagtggtcatgtggttcagatttatgctgtccttcagtacatctccaaagccctggtaccctgttacccaaaatatgtagatgaggcttccgaggagatcaaagacaccctcaccagaccttgctggtggttcacccctgttgctatgaatccaagaaatttgcaggccctggtgcctgtgctcactaccagaaatcatagcagtaagcccatcaaaaagatcaaggtttacctttatagtaaacaatggttgaaggtctttaaggttaaaaaaaattgctagacatcccagctgccctagaagcagagatgacatgtgctgttattttaaagggccttgcttacctgcatattacctgttagggctttcaggtagaatataccaatgatagaccagtctggtggcactgttcccaaggacggaatagggtgaactttgatgtctaggcactcaaatactccataataaaatgatcatggaaactggcagtcttactccaattgcccaggatggagtgcagtggcaccatctcagctcattgcagcctcaaatttcccaggcccaggtgtccctcctacttcagcctcctgcatagctgggactacaggcaagcaccaccatgcccagctaattttttatatttttggtagagacaaggtttcaccgtgttgcccaggctggtcttgaattcctaggctcaagcagtctgcctgcttcagcctcccaaaatcctgagattacaggtgtgagccattgtgcctggcctggccctcttatttaaccttgttttggttggcagcaacattgagcccaggctaaagtacaccatacatgtcggacagagcttatctgcctcagtagccacttggtcagtatttgttgatcacttaaacccactcagtgttggtcatttgtctgtgttagcctctgctaaggaatgtggaccctacacgtgacaatacagttaccagtaaaaagactcagtaggaattatgaggtatatactcgaatcaacaggtagtttattattatactacgggtatggctgtgtatgttgcagttaggttcagctgcagcgatggacatgccaaaataatagtggtttgaataatggtatcccaaaacaaagtagaagtgtgtatctcttatgaaaggcagggtggatggttcagggctagtatgaccctgcgtaaattccttgctcatcatacgtctgtcaggcttagtgtggcctcagtcttccgagcagcaggatgtaagaagaaacagaaagtagaagcgcggatggtgctttcttttatgggaagttcccagaaacagcctccagataactttgcttacatctcattggctagaacatcaccccgtggctgcaggtggctggaaaatctcatctttattctgggtggccatgtgcagctaaaagtactgctactgtttatagagtttgggcaagaaccggctgtctgtgccatgggtggtagacgagaccagcagtccccactcacttggaactgagagtctgggggaaggatagtgacaaaataaacagatacttacagtgacaaggcctctgagaggtctgcaaaggtgtgccctgcgagtaaacaggaaggacacctaaatcagactggtggggtgggggaggggatgaggaaacgttgcctagagactaagcaagaatctctctggactgaggaaatgggcagggtattgaagcaaaggctcggaggcaaagggggcaggtagttgggtgatggaggagcatatgaggaacagaaagtagaccagggaagccagagggagacagggttctgatcacatgggccctggggccacagggacaggtttggtcattttccccggagcctttgactggtttctggaggtgagtaacctagacaggtgctttcagggggtgaggagcagcacaagactagaggcaggaaatatccactgggagagagtgtactaatctggttgggaaatgatggtggcttcagctacatagtggctttggggatcaagagaagtggatgcaaatcctgtaaatcccatagagcttggaatttagaaataatttggccttttcacgtaataggtgatgaaaccaagaatgagaatttaaatggcttgcccagaatcacacagctagctgtggagcagcaccagatatcatttctctatctaactctttcctttatgtcactgttgaatgtgctgatttgggagaacagggcattgtgggcattttggagccagcaacaggacctgaatcctggtgtccattgcagagggaggagtccaccctgctttgggggctggattcctggtaaggttatggggcaggtcacagaaatgagggagttggaaggaaaaaccaggtgtgagaagatgatggattcagtttttggtttgttgatttggagattcaggaccaccatctgtaggtggagagagatcagatggaaactggtccttgagattggaattggggatgcaggattgggtggaattggtcaaaacttttctataccctttctttaaatttctccagtgaaagggactcagcaactgtttttgagtccattgtgtcatgtaccttagaattaagagatttttccagtgtttagccctgaatgatttttgctgcaatttgaattctgtgcaaccacagagatttaataaaaataaaataggttaatacttaaaaattagtaaattaaaataaattaagtaaagataaaagttatatggccctcccttgcatattttaccctgtgctgcaggtcttctcaggagcctctctggctctggttggtctcttggtccaggctgtggcctctgtctcttgggttttcatactgtaagatttctccaactgagtttgggaggctgaagccccaaacagaacttgatggcttgtgctggaaaaggggaaatgggttctgcttgctacaacgtgttaaattctgtttttaaaatgtcagtttggcatcaaacacttttttagacatgtttacatcctaaaagtttttggtttcagaagttttttgtccttcacaattaacttggttgcagtgattaaagtatagcctatttcctgggaaataggagacaatttcagagccactatagaccatattgacattagagattgtaggataccatagacagggaggtcaatagacaggcaacgtggtatcatagttgttttatctctccctggtcactgtccttctacctaatgttgtttcaccgtggaatttgagcttacaggtgaaaaagactttcagtgaatactgcaccaagtataatttaaaaattttaaatcctatatagatatggggcatgactaatagagtaatgacttccataaaccacacatgaaaactgctttaattataattatcattacttttattctccagaaagggaaataaggttaaaacaagagagcccattcattctaagttgaccagttaaatttcttgttctcccttccctttgtcctttgatttgataaaaataagatttttgtgtgctaaattgtgagtattcatttacattaatcagtatccctataagacaaagcccctgaaaacataaactgagtgcagcacgatttaaaacagagagggaggagacagtcttggtcctgttcttggtgccctgctcattactaacgtctcagttgtactgtccactataaacagtcatgattttttcccccattcttcagatcaagtcagtttcctctaatgagacagtctacctggttttataggcatttctctgtaatgttttccaaacgaagaaagcaaacagcaagcattttgttgggagaaatctgcaagtgtctgttctgtggctgtgaactaatgatctttcagaggtctagtttaaaagcactgagtttcttcatgacccatgaggatatgtaatccacctttatagcaggtaagtgttgaggttcacacaggattaacactctctttaacactgttctctacaccgttctcttgcaaagggatactcttcccaaccctgaaaggcatgcttggagaggtggagtgtcactcccagattcttattttagagaagggagtgtcatgtaattttctccctaccttatttattcattctctcccctctcccccttgctgacctgcttttcttccttcagccaggtcttcgctttaaggagtcagctgagcttcagccactgatgctgggggcacatagtggcccaagccaccctgtagctgtacccttttggggagggtggctttcgtgtttttgtaaagtttttgaagaacctcttacatgatacagtttgaactgattagcaaacagagccaaagaaactagtacctgatgaaaactgactgacatggtaggcaaatggaaagtttggtttccaaaaagtgtgtgttgtggcaagttgaagtcagaaaaatgaatttttgactttgattctgagtgatcactcctctacgcactcccctttctctttctctccttgtcctctccatttcactccctctccattctctctccgcctcttttccctcctcctgctccgttctgtgtatatgtttgtatgtataacacttcagcatttatgtagtggttgataattgaatacattctatttgcagtactacctaatgtgatttaaccacaggaaacttgcttctctcattatttatgattttaaattttagtttttggtaattaagtctccatgaggagcgtcctcatttggaaggagagttagcatcatgctgtggctaaagaaactcagtttttatgcctaccaataatgtgaaaatcacctcactcctgtttggctgattgggttgaatttctcttaataccatactgaatgtaacttgacgagttagtagggaactggtaacaacttatttcacagagtatttctagttattgatgtagtttgggtgtttgtcccctccaaatctcatgtgaaaatttcatccccagtgtttgaggtggggcctactcggaggtgtttgggtcatggagacgaatccctcatgagtgacttggtgccatctcatggtaaagagttcaatgtgagatctggttgtgtaaaagagcctggcatctctctcttgctcttctttgtcttgcttcctctctcaccatgtgacactcttggtcccccttcacctttcacagtgagtaaaagcttcctgaggccccaccagaagcagatgctggcactgtgctgcttgtgcagtctgcagaactgtgagctaaaataaacctctttataaattaccctgtctcagatattcctttatagcaacaccaaacggactaatacagttacaatatatttagtgtaagatttattcattataattagcttatttccaaaatgaccattttaacaaacttcaaatattttgagtgttagatttttaaactcggtgtactccaagtttcatttaactgctaaaggacaagtttagtcatacactgcataaccatattttggtcagtgatgaactgcctatataatggtggtcccataagattataatggaactgaaaaattcctcttgcctggtgaagtaggggtcatcttaatgtcctagggcagtgtattacttatgtgtttgtggagatgttggtgtaaacctactgcactgctaattctataaaagtatcacacatacaattacgtaccatatacagtgcttgatagggataataaacaactatgttactggtttttgtatttactgtactttttatcatttaaaaaatttttatttatttattttggaaatggggtctcgctctgtcattcatgctggagtgcagtggtgtaatcacagctcactgcaggcttgatttcctgggctcatgcagtcctcccacctcagcttccaagtagctgggaccacaggtatgtaccaccatgcctggctttttaaattttttgttgagatggggtcccactgtgttgcccaggcagatcttcaactcctgggctccagcagtccttccacctcggtctcccaaaatgttggtattacaggcatgagccactgcctgtcattattttaaagagtactcctacttaaccaaaaaataaagttaattgtgaaacagcttccggcaggtctttcaggaggtattcctgaagaaaacattgttatcacatgttattgcccctgaaggccttccagtgggacaagatgtagaagggaagacagtgatattgaagatcctgagtaggcctaggctaatgtgtgtgtttctgtcttagtgtttaaggaaaaaaaaagttttaaaagaaaaattaatagaaaaaagcttacagaatgagtataaagaaaataatttttatgcagctgtacaatgtatttgtgttgtgttaattacaaaagagtcaaaagttaaaatgtaaaagtctgtaaaactcatgaacagtggcatgcacctgtagtcccagctactcgggaggctgaagaggcaggatcacttgaggtcaggagttcgaggctgcagtgagctatgattacacctgtggatagccccactgggcaacatagactctgtccctaaaaaaaaaaaaaaaaaaaaaaaagtttataaagaaaaaaatgttaccataaactaaggttaatttattattgaggaagaaaaaattttaaaataaatttagtgtagcctcagcatagtgtttagcctcaatgtagtatttataatgtctacagtgtgcagtaatgtcctaggccttcatagtcattcaccactcattgactcatccagagcaacgtctattcatggtaagtgccctgtacaggtgtattggtttttattttttatattctatttttattataccttttctttgttgagctatacaaatacttgccactgtgttatggttacctacagtattcagtatagtaacatgccaaacaggttaattgtagcctaggagcaataggttgtaccatatagcctgcatgtgtagtaggccatacatctaggtttgtgtaaatacactctatgatgttctcatgatgaaatcgcccagtgacatatttctaagaatgtattgccattgttaagtgacgcgtctgtagaagttctttatttttaaagtgtatttgggttatttgccattaagataagaagctaaatatataatgtctttttagaaataaaatcgtacagaagaggaaaattctacgtgcagtttttaatacaacagctctcaaactttttggtctgaagacacactattctctcttttttatttcttatttttttctgagacgaagtcttgctcttgtcccccaggctgagtgcgatggcatgattttgactcactgcaacctctgccttctgagttccagcaattctcctgcctcagcctcccaagtagctgggattacaggtgcctactaccatgcccggctaatttttctatttttagtagagacggggtttcaccgtgttggccaggctggtctcgaactcctgacctcaggtgatccacccgcctcagccttccaaagtcttgggattacaggcatgaaccactgcacctgaccgacatagtattcttagacaaagtggcttgagagaaaaacatttaaaaaagcaaaaggaaaaaaagataagatttgcgctattaaatgttactgagaaactcaaagagcttttgtttatgtggattatatctattagtatttaccttattagaaaccaattttaaattgttttaaaatataggtttaaaacaattatgaaaacatttaaaaataactaacctactgtatgataataaagtatatatttttcaaaatatatttcaaaatataaaaacgtatttttcaaaacttttggtgacagtgaaaaagtaatctcgtagtagcagtagcagtagcagtagcagtagtagtagtagtagttagttatactttatatatatagtactaaaagtactttatatactacttagttataaaaacatttttccttcttgcttcagcagccattgcctcctgtttccttctgcctaaataaattctgtgttttatgccacaggctctatgtgtgtcaccttcacatgtgaacttcaccaggtgggctggttttggtctttttatcaaatgaacatatctgtaaggtactttttgtagacaggacagtatttaaaagcaagcttatgtccacttaacaacactggttgcttgctttagtgctctgtggtaaggctgtagtggtcagtttttaaagtaaaaacccaaaacaacaaggagtaaacgaagagattaaggtctcagtgtagcattaatagctttttagatgttcattttattttttttaattcatccctttctctttgctatctatacattacagtatttaggcttccagactagcaaccttttggaatagttttaaaatagctgatttcttttttgttcctgtctcttggatagatactgcttgacctttttttaactgttgattttggataatgcctttgttttaataaaaaattgctgcatcatgtcccacatctccatcttgttttatgtaaccatttaacctttaattctatgtgttacaaaaagatttcctctggccttttgtgtataatgtcagatcaactagagctctactttggggactgtaaatagagcattagcctcctcttgattttactctaaggaattcttttaagatttttataacctcagattctttgatacctgaatcaggtaccagtacagttgagctactgtatttccagatgctcagattttttttaatgggatatattttgcactatctaatatagtagtcactaactactactagtttttgagcatttgaaatgtggttaatacaactaagaaacagaatttttagtttttcatttcagtttacttaaatagctatttgtgcccttgtctgtctcattgggcagtgcaatgccaaaggtatctggcagtttctttttaaatttgtaggttcattcattcattttaacaagagtgtttttttatatgtgtggtagccggtaggttttttactatctgtggttgtcttattgctggaaacggaactagagggatacaggaggtggaaaagtggaggctattgataattggctgacttttatggggtcttgggatcattgtagatgagatttgaggggaaaataaagttcagggaaggacttttaggttgaacactggagctgatttgtcagcagaaaaaaagcatccagtcgagagaggaaatggaaggtaaaaggcagatgggagatgaataaattcttgaaagaaacgggaaaagatccagagtataagcagaacgatggaaagatactgtatgaattggaagggtgaagagggacttttaaaaaaagttatttgaaatttttcaattgaagtgtaatttacattatataagccatttttaaatgttcaactcagtggcatttagtacatccacagtgttgtttgccacagtcacctctaattccaaaacattttcacatccccaaaggagaccactgccagttagcagccacttgccattctcccctctcctgagcccctgacaaccacccatctgctttctgtctctgtagatttgcctattctgaatatttcctataaatggaatcatacaatatgtgacctcttgtatctggcttctctcacttagcataatgttttcaagtttcatccacccctgctgtagcatgtgaagagtgaccattgaaggaggaggacttttaagggattcatagggactgtccagatctcagcaaaaccatcaattctgcttgttggatttacctagcagtgaggcaccacaggggtaggttgggcatcaggagtatttgtgactatagcttccagcctgagtaaggagggtggggacaaagatctgctttggtgatggcagattgcctactagggaaggcagacaggaggagtgagtggatagaaacttgtcagaagagggagcagaatatcctgtttcaaaggatttgggtccatttggggtcctaagttagagaatgcatgtggaaacatgagctcatctaaagtagggtcatctcatctgtttgtaggtcagcgtcacccataactgtctgctgcactagtggtggacacacagtttctaaagttgcaagcaaggtgaaaagttctgtaatcttgccctgctgggtaatggtgccaagcgcctgttgtgagtgcctcctgctctgctggaagcatggtgagggaaagcagaccttgggtttttttctgctttctcgtgaaggccggtatggctgagtcaccgtacttgctggtgcctagggcaaaactgctttccaggctgctttccagcctcacagtcatcccacagatacataacgcctcaaggacttagatgttaaccacaggttaaataatttgtatttggagtatgattagaatgtacagagagggacctaacctagtctggggctctgcgggaggaatcagggaagatttctctggtgtgcacagatagaggggaagtgggacaggcgggtaagggagctttccctgcttgggagctgccggagtcaaggacacactgcagaatgtgaaaaggaaacgggtggggttgggggcagtgagcaagaggggacggcagaagttgggctagggaaagcaggtatgggcctgggtgtgaaagggcctctaagccaagtgagggattgtaggctgtatccagagagcaaggtgacaaaaagcttcaggcaagagtggccccactgattttggtggttaaaaagaactcaggtgcaatgtggaggtggatagaaggaggcaagaatgagtgcctgaaagccagctgggagtccacaggaaagaaaatgggccttggtggtgcagctaggaagaggtggatatttataagatgctcaagacgatggcttcaacaggctaagagatgactgagttattctgataccctaccctttctgtctactgtgtcctttcacacctctatatctcttcatgctgtgccttcgcttgaattatccaccaaccattgtgcctcctaggccttccaccctgcaaagtccttaataacctggccaaatgccacttgcatgaagtcttccctgatgctctgtccagagttagttcatttaacaaatatttatggagcattcacgttttaatgtgccttaaatcattgctgacttggttttctggtcgagtggaatgtttaacacatgccagccaattaacatggctgcttaataaagtcgaggtaaaatttgagacacttttccggcctaccaagtgtcacaattcttcccagattgtggcagcccactcctgcctccacttcttgagtagcaatttccttatttctttcccctgctccttggcctgcccaaacctaccagtcttttaagtgacagtggaagtccccctcctctggtgaagcctctccctttgtcccaagcctggatcttcctcctgagcaaagccctcagccctgtgactctctgtctctgactgggtgctagtgggaaatcaacttttcatgtgagtctagttgcttcggtcattcagaaactctctcaggctcactgcatccagaagagtgcttatgaatacttgacaggcataaatatctacagggtgcggtatcacatcaccttcatggtgttccataaatgataggtaagatacgggcacttttttaaaaaatgacatttggacataagtatcagatatttggcttatgacacagtaatgggtatcttaagcctagaagttgtgttttagattgaagaatcatacatgattctctttggctgtatttatccataaattgtcctgtccttggataggacatctagacacttgtgaagtggtcattagtaaattgagtgtgaaacatggcattttggagaataaattgtgaagcaacctccctgaaaacttattagtaggataggacattcatgttagcgagtggacctagggtgttgggcagagtcagggagaccaggtgacttttagcacagtgcttttctaccttgtttcggtctagatggaacagggttatcagtgtccagaaaaaaagtctttggcttccggttaatctgtccgccccagccattgaagagagtggggtacttatttatgcaatatcaccctaggccttttctagtgtttgtatatcatctctctgcaagtttcttctgtcaaacctcaagctaattcttttcctttttgatacactttggagatgaagaaattctgatttttttttggtatgatagcccattcctctgctttctctccaaactaagactaagtagttatcccagagtcgttgctatagaccagtattctgccctccttcctgattctatttcttttcctttttttttttttttttttgacaggatctccctcttgtcaccaggctggaatgcagtggtgccatcttggctcactgcaacctcacctcatgggttcaagccatcctcctgcctcagcctccagagtagctgggaccacaggcacacaccaccacacccagctaattttcctattttttgtagaggtggggtttctccatgttgcccaggctggtctcaaactcctgggctcaaacgatctgcctgtcttggcctcccaaagtgttgggattacagctgtgagccactgtgcctggtccccaattcttttaactctacttaatccatgtttttaaatgttacttttagttatataaacttatgtaatcaatatccatagatagagatctgtaactgtttttcttttcttttttttctttttttttttttttttttttttgaggtagagtctcgttctgtctcccaggctggagtgcagtagcacaatctcagctcactgcaacctccgccttccaagttaaagcacttctcctgcttcagcctcctgagtagctgggattacaagcgtgtgccaccatgccgggctagtttttgtatttttaatagagacatggtttcactatgttgaccaggctggtcttgaactcctgacctcaattgatcagcctgcctcagtctcccaaagtgctaggattaacaggcatgagccactgcacccgacccataactgatttccttaaattctgcatatccgtattttaaaagggatatgggaaaagcttgttacttatcctggctttagaaactgactaatattgggccgggtgcggtggcccatgcccgtaatggtcgggcatggcccgatggtcggtcagatggtcgggagttcgagaccagcctgaccaacatggagaaaccctgtctctactaaaaatacaaaaattaaccaggtgtggtgatgggcacctgtaatcccagctactcgggaggctgaggcaggagaatcgcttgaactcgggaggcggaggttgcggtgagccgagatcacgccactgcatttcagcctgggcaacaagagcaaaactccgtctcaaaaaaaaaaaaaaaaaaaaaaagctggctagtattggacgtggtagagccatttctcattccatgaagtttctatttgagacttttttagtcatagcttcactgagatcatgttatcactgtatttgcttttatgtcatgtctaggcaggcctccttacctgagaattaatatgaccacgtttatcctgttcctaggatgccaaaatctgatgattcatttgaatggggaagaaaaaccaaattaagtgtcacataaacgttgtaattaatgtaaccattgactcactgacattctatattttacaccattgtcttggtgttagattgtcttggacataaactgttcctcacctaaatcttagactactacttgggacccagtagtgtgttacaggtatctgtaggttgctagtttgatgcatttttctattttcctgacagttaaatttaatcttaatatgattgacagttaaaagtgcaggttgtggagccaacattcagggtttgaatcccattttccaacaagtgcaggctcggtaactgaacttactgagaagattaaattaaatagtgcatgtgaagtgcgtggtacgatgcttagcacacattaagtgttcaatgttagctactatgattattatccttggtgtgttttctgtttttaatggtgttatgatcctgaagcaagggactcaataaaggaagaatattatggtttcataatgaaatcctcttaactcattagtgaagcattgcaatctgtaatgatgcaagctttgtttgatgctgtaacaaattaggccagagttaatgccatttcctgttaaaccttggatagcttatcttagtacttgaccaatgttttgctggtggagtcttctttttcagtgtgacataattcccagatagtgggctggttgtcctcgtgaggattttaatgcccaggtaggagttggttgattctaaatggaagctgttgtgttttatgctgtttgtttattctaggtgtggtgattgagccgaaaagtgcaggcaagaggagtctttggggtttctcatttgtgtcctgtgacatgagtatgaaatctctctgtgagcaagtaaaaatatttttccaactgctcacttagtgcctccgcatgggattggaaaagtcaagctgttttatactgctttattgacagtaatactaataacataaaccaaatttggctgactcagctactgattagcaaaaatagcctgtcttctgcgaaacgttgtatatataattaaaaaaacaactggaagagtcttcttacttcaagttcttaaatactttaaaaatttggcttttttaaaggtagttttgtgcctctctcaccagaagtgaattttcccttgtttacggggttcctgtaaagctgtggatgggtttgtagattcagttttttaaatgacagtccatgtccccagacagaatagatatttaacaaatgcttgaactgtgctttttaaaatccatacttgttctcaaggattgctgttgtttatgtgaagcataatacttcttagaggttttaaaaattggtaactagacttagctccttggtttgagggggagtttttgtggaatgcagacagttctatttactgtgtactaataacctgagagaaagaaaggctcctaacatgggtgacctgttaacaaataccagcttatgttcacaaattaatccttaggcaagcagagcacacacagcatttgccatttcacttttctcttaccagtgttagccgaaatggctctttacacaaattttcagtgtatatatttagtgtttatttattcagctgttggaatttcggtatgatttatatttctgacatactagtatagtgttttacattagactaaattaatgaagaatttttttcttcatgagattgtccagttatggcaatggttgcagttataaaggctgtttacatagaccttgcaagtgggaacattaatacataaaaatgttttgaaaaggaatttttcaatgcattctaagactcttcgacctaattggccaatttctgggagtctcacccatggaaatactttaatatacagctaaagttttatgtgtaaagatgtttattgcaatattatttgaaaatagtgaaaacttggaaacattaaatgtctaatattagaggaatacgtaaaagtgtttatataaatgttgcttcagaagtcaaattaggttcatgaaaatgattgctggcagccttcatgcaggtaaatgatccaaatgcagaaccgtggatggtgatgcgcatgatgtctgcaggactgaccctgcttgtgggatttaacccttttgtcacaggtaacgttatttggaaatgtctctgcagtacacatactctttggtatggcatgggctgtcaattgcgagtatgacctcttgcttcatacccaacagaacatcttacgtaaggaagaaggcagggatctcttgtctggtgattatcacaagcatggatgagcttctgcagcagttcatcaaagaatccagtgggtggaaggattcagttggctgttgccattgtaattgctctttccctatttttctcatgggtctccatatacataaataaggagaggtgatccttctggccaccttactgcaagacagtagtttaaatgaattcaagaatcctgtttttaaagtgcatattttcagtcatttaaaaaaaataaacattgggataataagccggtttctaaggagttaatttctggtaattacagcgaatactagagatggtttgttttttcagtcctaagaactttttaaggctgcctgcaattcaatatatgattgggtgggactagtaagaggtggggcctgatattctgtggaaggaagccttttctactatgctatgtcctagcatagtagaaaagacactagaacaaaagttaagaaatgtggggttttggccgggtgtggtggctcacgcctgtaatcccagcactttgggaggccgaggtgggtggatcacgaggtcaggagatcgagaccatggtgaaaccccatttctactaaaaatacaaaaaattagccaggcgcggtggtgggtgcttgtagtcccagctactcggaggctgaggcaggagaatggcatgaacccagggggaggagcttgcagtgagccgagatcgcgccactgcactccagcctgggcgacagagcgcaactatgtctcaaaaaaagaaaaaaaagaaatgtggggttgttttgtttttgagacagactcattctgtcacccaggctggagtgcagtggtgcagtcttgggtcactgcaacctctgcctcctgggttcaggtgattcttgtgcctcaggctcccgagtagcaggaattacaggtgtgcaccaccacacccagctaatttttttttatttttagtagagacagggttttgccacgttggccaggctggtctcaaacttctgggctcaagggattcagactgcctcagcctcccaaagtggtgggattacaggcatgagccactgcacctggccagaaatatgagttataatcaatctagcttcatctctatgtgacttgggcaaatatataaacctggtagatacataggattaaaaccaaaccttcgtcttacttacacatttccaaggatcaaaccagataatatgagagtactctgaaaatataaagtgtttacaaagatgacaaagggctgcacacaattaaaatagaggagagcagggtttgagtaatatattgaaatataagttcaagagagggccctagccctgaactgatctcattataccgaaccagcacagtgcagtgaactaaatgagaactccagatgaaccaaatgaacaggcatgttgtggaaagaaaaggaagttggatggaagaaaggaatttgggaccaatcaagaaggaaatagggaatattaattatattctaaatgagaaataaagccaacatccatatacattttttaaaactgaatgtctaaagtaaccctagggaggagagcattttagagctgcactctcagttatggtacctagtagccacatgttgctcctgagcacttgaaatgtggctggaatgactgagagtttctaattttttattgattttcaactattagaaaacttttaagtgtttgaaacaacttgagtatgtgaatccactttcacagttgcaaatcttatgagctctaaatgcagatcggatatttcctttttctttctttcttttttttttttttttttttttttttttttttttttttttttttttgagatggagtctcgctctgtcgcccaggctggagtgcagtggcgggatctcagctcactgcaagctccgcctaccgggttcacgccattctcctgcctcagcctcccgagtagctgggactacaggcgcccgctactgcgcccagctaattttttgtatttttagtagagacggggtttcaccatggtctcgatctcctgaccttgtgatctgcccgcctctgcctcccaaagtgctgggattacaggcatgagccactgcacccggcctgcagatcagatatttccaatgaaaattgagtgtccacatgagtggactataaatgtaaaatattagattttaaagacatagtacaaaaggaatataaagttatttttatgttgcctacatgttgaaatgataatattttagatatattgggttaaatcaaatatactattaaagttgaaaaaaaggaaaatgactgctttagtgttgaaatttaagcttacgagtatgtgcttttttgttttattttatttttatctttttgagacagggtctcaattttttgcccaggctggagtgcagtagcgcagtcacagctcactgcagccagcaccgcctgggctcaagccatcctctcacctcagccttctgagtagctgcagccacaggtgtgcaccaccactcccagctaattttttgtagtttttgtagagatggggcggggtctcaccgttttgcccaggctggaagtatgtgcttttttaaagcatagaaaaaggtagaagaaataaaattatgtttacttatgtaaatatatttatgtaaatttatatatgctaatagcaaagctccatgctaaatgctgtacatgaaccatctcatctgattaggtattcatgttattcccatttgaagagaatattccaggtgaggagattgaggttttcagacatgtactcgcccaggatcactccacttaatcatagatggtagaagggttaacgtggattcagctatactcttggtagctttttgtttttacttcaaaatgagacagatattttttctctactttccatattttctataggaaacatcattttactatagaaaaaaatttattgtaacgtggggaggcagtagaatgtagtggttcaaagagtaggctctggagtcagttggcctcctctcagtgtaaccttggacaagtgacagtggctgtctgcctgggtggactcatctgtgagagggctggcatgaggactgagattatccttgtaaatatacagcagaaagactggcacatagtaaggatagagtgagtattagttgctattatcattattatgttctgcaaagaaaaggacttgaaaataagggggaaaaatccatcatttgaaatagtgggcgggattaggtttttattttattttattttattttttttaatttttttttgttctcatctttttttaaaattttattattattatactttaagttttagggtacatgtgcacaatgtgcaggcttgttacatatgtatacacgtgccatgctggtatgctgcacccattaacccatcatctagcatcaggcatatctcctaatgctatccctccctcctcccccgaccccacaacagtccccgtggtgtgacgctccccttcctatgtccatgtgttctcattgttcagttcccacccatgagtgagaacatgcagtgtttggtttttttgtccttgcgatagtttgctgagaatgatggtttccagtttcatctatgtccctacaaaggacatggactcatcatttttatggccgcatagtattccatggtgtatatgtgccacattttcttaatccagtctatcgttgttggacatttgggttggttccaggtctttgctatcgtgaatagtgccacaataaacatacgtgtgcatgtgtctttacagcagcatgatttataactggattaggtttttaaatggttatctggttctcttggagagacgttaatgggatgagagaaatcactttggaaagcttccttataagcattcagtcattagcagaccatttagtgaaggaaatagcaatttgctaaataattcaacctcctgaagtgtgtaattcatgtttgagcatagctggcttaatgttttcttaggacagcaggaatacatgagtccctaagcaaatgtgtgggttaggtcgtagcttaaggatgaacttcttacatttaatactatgaacttaatgtacaatttatctttcttatttttccctgtaagagaacatgtcagtacagtgaatttccactaacttgcactccactaattcaaactatatgacatgcctcctaatcgaacaggttatgaaacatacacgagactataatcaatttattaataaaattagtaaagtgaaggtctaggtgaacagaactttccatattctcttcttgcagtctgcttgccacccctcacacacccgcagcccccatgcttcctcactcactacatggcacccccctccagtgtgagaagccaagagcttggactcccccctctccctcaccttgcccaccctggacatctctcccatgtgacccctgcattccctctcctgctgtgcctttggagggcccccatctctcatctggactcttgcagtcgtttttttaaccaacctgatgctgatctcaccctcttttcagcctctcgccccaactgtcaccccttctttaccaaccccccagtttaaaaacaaactctggagctcttacctccttctccaacattgtttttcactttttcatctctgccttctgtctgatccccactagcaagccttaaatattactctctttgcagagcttcacctgacccactggtccccatacagaattgactgctctgtattaatccccccacccctacccatccttttctcctgtacataccttgtcatggcacatagatcactttattacagttatttactgtttctccttcccttgctagagacttttgacctttctgaaggcagatttgtggtcttgtggatttctgtgtctccagtgcctgtgacagtgtgttaaatgtatgtttgatgaatgtgtgcttctgatgatgataaaaatagctgccacgaattgaggtgtttgtgcattatgccaagcacttcatacaattttattatctcatttaatcctcacagcaactccatgaggtataagcattattgtccccatgtttatgagttgggaaactgaggtctatatagttttagcagcttgcccaaggtaatattacagtgtatgctattacagtatagtttcagagcctagagaactctaactgaaattatgcatattacagattacatctttctcatagaaatggtgagaatctagtcctattgctgccacttcattatgagttaagtaaagtattttagggctggtctggagatctgtcctccactgacagctagggtttttaacttggggactactgggatttgggcgaccctgtaaatgtcagtcagtttaatccaaactctctgtcattttgagatggagagaatttcccttttgctttaatcagattttcacaattgatatggaacccccggaaatttaagaacaactaatataacatttctccaaaaaattattttccaaaggccagatgactaatttacaatagtacaaccctttcataaagtggagattatgtgttttgataacttgactatatgaatgaaaatgattcatcttagatactaggttttttaaaagtgtcaattttctttagactctgtaaacagtcattcgtttatctcttaaatggaaaactgcttctctgttatggaccgaaggtttgtgtccccccactctcaattcatattttgaaaccctaacccccaaagtgatgctattagaagggtggggcctttgggaggtaattaagtttagatgaggtcatgagggtggagtccctatgatgggatcagtatttttataggaggaagagggaccagtactctctctacccatccccatgtccccaagtccccaggaggatacagccatctgaagccaggaagaggacccttaccaggagcctaatttgctggcaccttgatcatggacttcctagcctccagaaccctgagaagtaaatgttgtttaatctagcagcatgtgctattttctttatagcagcacaagctggccaagaccctctccttttcttctccaacccagttgcaatttattaaattgttcatgtatgtgaaaaaaatcattggagaaaaacataatacattttaaacatgtcactgcttctgtagttacattaattttcttcaaataattgttttcattggattttgcataggaaatatgtgatagcttttccaaatcaaagtaggatattatgtactattttatatccatcccctagctcctgaccagtaaaatgttcttgcctttcaagggtgggtgtgtgttaagctgttgttagtttgtgctgatttttttttctttttaattttatttttttcactcaaattatgacataagacatcaatttctgtgttttgaagtgaactgaaaatatgggtcatgactggaggaatagctagatttctgagctgaagggaaaggaccaggttctctgtccctaccacttgccatagtgccttacacatttggtgctcagtaaaggcatattgttaaacgattatatatgccattttacaatctcagttcttttcctaaaattttcatatgattgacttctccaggaatgcatttctataatttctatacaggaataggtatttgtttctccttcactctgtccttaattttcattttggaacctgttggtgtctctcccttggtgttctggctgtaggtgggcacctaactgacttcatgttaatttgatcactggctttccttcgttttgttacagctaaatggctctatgacagcctagagttgaattttggtacttgcagagaattgaaatgaaggaaaaatcatattagccagtcggaatattcagttacattaacatgacttgctaaaatccttgcagttccactaaaatgtaatcaccttaggacccaattctcaatatttcacctttagtgattatcaaggaggttttaaacacagtggctcatttgttgaatgtagcacttggtgaaaagaagaaaagcattgccaagaagagatctaatcttgctggataatttccaaggagggttacagaagacgtcacctcagccttttctgggaaacatccactgtgctctgaagagctgtgggggttgaacagctctttgctaatggcaggcagcaaaaagcccagagcagagcacaagcgtggtggcatcactcttcagtaagctatagtcacatagtgactgcacattgtaaaagtgctgcttaacccttttttgcttctcagtgcattgataagaaaatgatccaaaagatggaagaaagcacagtttttttgtttttataatatggtaaacttttattatttttcattttcaaaaacatctggaatctgacagtctaaaactaagtttttagccaggcatggtggctcatgcctgtaatcccagcactttgggaggctgaggcgagaggattgcttgagcccaggagttcaagaccagcctgggcaacacagcgagactccttctctacatttttttttttaattagctgggagtggtggcacatgcctgtagtcccaagctactcaggaggctgaggtgggaggattgcaagagcccgggaggttgaggctgcagtgagccatcattgtgccactgcactctagcctgggagacagagtgatgtcatatcttagaaatgaaataaaactaagttttctatgtaccatgtattaaaaggaaaatggcaaggaaactaattgcaggaacttatataaagcagtagagtcataataaatttataaacttttatcccaattatctgtgcctgctcatctacagtattgtaaagtgagatttggcatttataattctgactctgagatacctcaggatcacaaaatgcctctgaatcatcaaagattacattttaatcaggaggattttatttggtatctttcatgattttcttactgtttgacagcgggcctctttgtgagatgtatgattcctcgaagttaattagatcattgggttgatcaaaacagtatccccatcacctgagtagtctgaataagaaaatgtttactgggaagcttcatcagaccactgtgaaaatgagtatttgaaacacctgcatttaggtaaagtcttaaacttttgtgaatggagtcatagttcagactattccttgccaacataaaccttcctttacagttacaggtgccaaaaaagtcaccaccacatgtgattgggttggggaagttgattgaatttttaaaaaatcaaatgctcagcctagtttgtttttctcatggtcgtagatttttttaaaaaattgaactttttgagagaattgtagattcatatgcagttgtaagaaataatacagagatcccaagtactctctaccctgtttcccccagtggtaacattgtacaggactgcagcacaatatcacaaccagcatactgacattagtacggtccagatacacaacattgctatcagcacatgtggccttcataaccacatcctcttccatcctgccttcacaccctttgtaaccccaggcaatttgttaatctcttttctatctttatagttctgtcatttcaaaagtgttttataaatggatggcccttttcacttagcttaattctttagagattcattcaggttgttgaatgtatcaggtttgttctttattgctgagtaacgttccgtggtgtggatataccatggtttgttttaacaattcacctgttggagagtatcttgtttgtttctagtttctagctagaataaagctgctgtgaacattcgtgtacaggtttttatatgaacataaagttttcatttctctaaaataaatgcccaatagcttcatttgaattatggcatgatatttaattatattcctatactataatttctgtagcagaaggttacttctaggttacggaaggtttcatctagaaggttacttctagatggatacttgaaggctaaccacctttcagtttttgttacaaatatcactgatgacaatcataagtcaatcttagtgcacatctgcttgtatttccttagtgtagattgctagcagtaggcttgagtgtataaaatattaaacctttttttaaagtacctctccttttcttaaagttatttttaatttttaagtatatctaattgcagagcattgtcattaccttagaaagaaacatcataaacagtatcggtcacttcccattccttcgtttccccagcccctggcaaccactgatggatctgcctattctggacatttcatatgaattgaatcatctgtggccttttgtgtctggcatcttccactttgcataatgttttccagattcattcatgatatagcaaatgtcagtactgtcttccttttaatggccaaataacattccattgtatgaatgtacaacattttgtttattaattaatcagttgatcgacttttgggttgtttttactttttgactgttataaataatgttactatgaatatttgtgtacaggttttagagtgaatgtgtgttttcatttctttgggtatatacctaggagtggaattgctgggtcatatggtaattctgtgtttcactttttgaagacttgccaaactattttccacagcagatgtaccatttgacagtcccgccaacagcaagcgcctgagtatttcactttctccatctacttggccagtatttgttattttctgtttttatgattatagctaccccagtggttattacatgggtctttttttaaaaagagctgttttggcaacactgccttgcttacctaccaggtaggacagccacaggagcgctgtttatgttgaagtttccagtggtgtcagttggctgtctctaggcttttgtggaagagaaaattgtgtaactgcctacctctcctgccagagcaccagacttgatgtgaagttctgtgaagagcccacccagtcacctgtcagctcatttagccacactggagagtctgttgaggtacagaggggagttaccagtgtcgtttgtggactcagttgctattttggaacagaaatttgcagaatcctttaagctgaaaaatttccatgctagtatgtatcatatgaatagcaattatttaccctttcacagaaaaaaccaacggtcttttctgtgtgtattgtgagataaagtctggaggggtttgtggttttctttttagtaggtaacagttcgaaatttgttgcagatcataagctgccaaataatagctttaagatgtacttttaaaaatcaactgtgtgattggctgggtgcagtggctcactcccgtaatcctagcactttgggaggccaaggcaggcagattgcttgagccctggagttgaaaaccagaccagcctgggaacagagcgagaccctgtctccaaattaacaacatcaacaaaaaaatcaacttgtgataattgtaaagagcacaagttttggaccaactacaaatttaagtaacttaactttgtgagctacttaacagtaagtaatgtgattaagtcttcccagtgtgcccgaaaattttttgattttagcactgaaagccttacatcccggaaaatcccccaagaaaaacagaacagttgcctaccctaagccatataaacctagagttaactacttaagatctctgaactttagtttcctcgtctagaaaatagggatatttccttagtgagtctttgaaaagccagctacgtagtaggctcttagtaaatgttagatcccttgtctcaggctagtaacaaaagtgttgtattgttttcctaaccaaattctatactttagataataagccttttcacttctcttcccagttccagttaaatcgagggggagggtttatattttattaggccgtgcttgtaattggtgccttaattatgtgtggtaaccaaaaggaaggctagcaaggggaagtagagttgtcttgtaagaacctcttcttccagccccactgaccttgttaatttctaaggcttttatctattgttaacaaattacccccaaatttgccaccttaaaatgcagaaacatttactgtcacacacgttttctgagggtcagaagtcccagcaaggcctacctgggtggttttgtctcagggtctttcatgaggctgcattcatctgaagctgagcaggccagaagatctgcttctgagctcattcaggtggctgttggcaggtggcctatttcctgccacattgtcctctccctaggactgtttgcagcatagcagctggcttcccccagagctagtggtcctagaaacacagacagaaacatgccagctgaccaagatagaagccacaacatctgttatcacctaatcccagaagcgacataccatcccttttgctttattctgttggtcacacacacaaccctggttcatcgggaaagggcactacataagggtgtgagtatcaggtgtaccaggatctttgggggcatcttagactctgcctcccatagataccgtatttacttgaagaaagcttgaggtcctgtagtctaggtaatgaaacgaatataataggaagcagctcagtttaggattgatgataatagagccagagcccacgtttctcaaccagtgttcaggttcttcctatcacccatcttgcctccttccaaggaatgtatggaattgtccttggccaaacatttgatttggcagcagcagcagcagcagcctgtcagcagtgttccatactgccccagttcaatatgatgaaacagggagttactaaattcctttctgtgtcccaagaacagctactagggattacaaggagcaagacagatacgttccttgttctcacagagctttatagacttggccactgttgactcctggtagtaatggtgttatggatctcctctactgatagtaatatttctgcaacagcatcccccaaaaaagagcttaccggtaaaaaatccatcaggtgcaggatggattaatgtatgcttgttatgtgtgatgtgtaccatgtcacacagtgtttgaaaaatatgagaactgatctctatcttgatacgaggttttatttcagcttgagagatgtttgaaaaaatatgattgcctccccgccccccgccccacctgcgcatcccctccccccagctggtggaattagaggaaacagggaattgctgcagaatttgttggaataaaaaataacttgtccttgagaccatcatcctagtctaggctctgtctctgtaatacagtgtatggataccgtctgggtgataaaaattaaagggtggcaggggattttagtaagagtccaaaacttaattgatatatatagcagtggttcccaaagcaggctgtttcccagaattacctaacgatcttttcaaaaagatatttcctagcatctattgaattagaatttctaggattggatcccaaaaacctgattttaaagctgttaggtgattttaagatgcaaccagatttgagagcccattgatatgaaactctagaaagtcattcattcattgatccactcattattcattcattcactcttagtttcaatgagcaatcaataattggtcaggcacagatccagacactctagcgataaaatgggaacaccagaggttctgccgttgaagagcttagagcctaataggatgtggacagataaacagataattacagtataactgataatcacagcacttaaaaaataagcctgtaattttatcactgattgagatacagtagaagtgatgatgaagagtatgaaaatgaggtcagggaggattgctgcccctttacttcccatctaggtcttaattacagagatcttaaagaactctgttaccaaacatcttcttccaaacaacttttttttttaacttgataatgttattttaaaactacatagttctgtatctttttctcgtaaaactatatgaattcaggcaatactaacacatgtcaccatcttttatgtaaatacatgaagatgtcctcttgagagactgcatggggtattttaagaatgataggcaatagagttggagatgtggttcaaattctggctccacccaacctctgtgactttggcaactcagcccccttttcagttatggtaaatgaataagtttattggccatctatcatatgctagttgccaggagtacaaaaaaaaaggcttatcagatgcagatttatttctgctctgtactaaggttgggatagacactggcctgctcttctactcacagagaagtcagtgaccagcatctccttgacatttcagaggaatttatctagagtcttttataaatccccagattcacaagtatcatttgtgagtccatgccaaatagaaaataacagagctgtgaggtatggatgtgagcatgtttcactgccatggaccttgcagggaactccagtttatgccttagcaaaactcttccataaacattgaatatgaaactgatcattgtcaaaggtctctgtaatgatgataataatagaaacatttttacggtacttgctgtgccacacactattctaagcatttcacatatcttaactcatttaatcacatgaggaagttaatgtaattaccctcattttacagtctaataaactaaggcacagaatgttaagtaacttgcccaaggttacacagctagtaagtggtgaagcagggatttgaacccaggctctctggctccaaagtgtatgttcctaaccactaccacccaaaagtggttgagccacagatgtctttgcacactgcttactaatttgtactgtggcagaggtcatgtctgtctctgtcactttcctgttcctcacaagcaatactgcttgacacaaagtagacactcattaaatagtttttaactcagtgagtcaactgcctttcaaatggctggtagcctgaaaagcagtcattctgagaatcattggacacacagaaataaaaccagtcaggaggatgactaactcctgcacctgatggatttttttttaccttgcttcactgcagccttgtgggcattaattagttactgtcagcaaagttctatgtgaaagtggagttctaagtccaactgcagcaatctggccttcacccaccagcaaggagcattctgtgtgtgaattatcgttgtctttttccaaataacagtgtgcttcactcaattaaaagttatcaccacttcttcttctagtttcaaaagaaaattaagttggcagctttaagatgataaaactctacaagagtaattttctacagtggtgaacccttttctgaatgctcgtttgttgtgtggattgttgtaaatggtccttgtcttgactctgctgagaactgggggaagaactttgaacttgactgtacatttcttctttagctgtgaataagaattcccctagaataaagttctaaaatcatgttaccctcccgctaccaactgctgaaaaaatgttctatatctgagtttttaagatcaagtgtatttgtgtgttgcctttcaagactagaatacatctttgtctcccagtggggaagaaatttccttgaatgtttaagaggtgtgtgtgtttgcccctctcccctctctctctcccctctccctctcccctctctctctcccctctccctctcccctctcccctctcccctctcccctctccctctcccctctcccctctcccctctcccctctcccctctcccctctcccctctccctctcccctctcccctctccctctcccctctcccctctcccctctcccctttctcctcccctttccacggtctccctctcatgccgagccaaagctggactgtgctgctgccatctcggctcactgcaacctccctgcctgattctcctgcctccgcctgccgagtgcctgcaattgcaggcgcgcgccgccacgcctgactggttttcttatttttttggtggagacggggtttcgctgtgttggccgggctggtctccagctcctaaccgcgagtgatccgccagcctcggcatcccgaggtgccgggattgcagacggagtctcgttaactcagtgctcaatggtgcccaggctggagtgcagtggcgtgatctcggctcgctacaacctccacctcccagccgcctgccttggccccacaaagtgcggagattgcagcctctgcccggccgccaccccgtctgggaagtgaggagcgtctctgcctggccgcccatcatctgggatgtgaggagaccctctgcctggctgcccagtctggaaagtgaggagcgtctctgcccggccgccatcctacctgggaagtgaggagcgcctcttcccggccgccatcccatctaggaagtgaggagcgtctctgcccggccgcccatcgtctgagatgtggggagcgcctcggcccagccgcgaccccgtctgggaggtgaggagcgtctctgcccggccgccccgtctgagaagtgaggagaccctccgcctggcaactgccccgtctgagaagtgaggagcccctccgcccggctgccaccccgtctgggaagtgaggagcgtctccgcccggcagccaccccgcccgggagggaggtgggggggggtcagcccccgccaggccagccgccccgtccgggagggaggtgggggggtcagccccctgcccggccagccgccctgtccgggaggtgaggggcgcctctgcccggccgcccctactgggaagtgaggagcccctctgcccagccagccgccccgtccgggagggaggtggggggtcagccccgcgcccagccagccgccccgtccgggagggaggtgggggggtcagccccctgcccggcgagccgccccgtctgggagggaggtgggggggtcagccccctgcccagcgagccgccccgtccgggagggaggtggggggggtcagccccccgcccggccagccgccccgtccgggaggtgaggggcgcctctgcctggccgcccctactgggaagtgaggagcccctctgcccggccaccaccccgtctgggaggtgtacccaacagctcattgagaacgggccatgatgacaatggtggttttgtggaatagaaaagggggaaaggtggggaaaagattgagaaatcggttggttgctgtgctgtgtagaaagaagtagacatgggagatttttcattttgttctgtactaagaaaaattcttctgcgttgggatcctgttgatctgtgaccttacccccaaccctgtgctctctgaaacatgtgctgtgtccactcagggttaaatggattaagggcggtgcaagatgtgctttgttaaacagatgcttgaaggcagcatgctcgttgagagtcatcaccactccccagtctcaagtacccagggacacaaacactctgcctaggaaaaccagagacctttgttcacttgtttgcctgctgaccttccctccgctgttgtcctatgaccctgccaaatccccctctgcgagaaacacccaagaatgatcaataaaataaaataaaataaaataaaataaaagaggtgtgtgtgtttgtgtgtgtacatgcattttttgtttctgtttttgttttttatgggctcacactttacaaagtgtctttactgatcatgtagtagaagagaagagagcacctctgttagagttccagataactagcactgagaaagttttccccgaggaaatgccatctgtaactaggatttagtccgtgttttaggatgctgccattgtggagtcaggtgtgccattttcttttctttttattttgtaataacaggtgtatctcctcatttatagtatcaccaatagataattattatactcataggacagattggagtacttgccgttaaagagtttggactctaaggagttgcagagtttgttcccataatacctgaacacagaagtatctagctcatgtaaaagttgaagttgctgtatactaaatgagttgtctagacagcaacaagaggggcagtggagtggaagtaggctttgtaacacctaatctgggccttggagaaagggttggaaatgaaggcaagaggacagggaggaaggaccacagataacagccactggtgtgactctccacttgttagaaggatgttagaaggtgttagaaggatgtccttctccagcgatggttaaaaagtgctttttaattaactagtagcagccaaggagcaggaagtggaggcttctgtgttgaccctaaacgtatttttgtacaacaatttgattgttgcaacatttaaaaatttcccctccaattatccattataccggaatgaggttgttctgccttcttcagccgtggagctaacctgtggcagtgctttgtagaatctatcagtgccccagttttgcagttactcatctaaaaccccaaatagagctgtgttttttgccttcgtgtatgatatatggcaggaaaaatgactttatcagagaattacaagagtttgttacttccttagaatggaggttagaaagtataggaattctgcagggggaagaaagagaataagcatagattcagagtgttaggatgacagtacacaatcagatgtaccactgttggtgcggtagatatttttgagccaagatttaatccagagttatcatttatttaaatgccaacactttaacatgaattctgtcgtcaagttactttcatttctaaagcttgttagtacttggatcttctttcctttatggtcttcacgacattttgaattttaacattcctcagcaaggtgtggttttatttgggaactgattttcccaacctagaaaaatctttttaaattctagaatcagggttgtgactaccaaattaaagcaccatttaatttttcattctgtgtaactggcagccaacttgaagaatgttcccatgcctgcctaacgttaacgagttgactgataaaagtgatggatgggaatgagagaagagaaaatgcaaggaaatctcagtctgattccttgcagcacatgggtttgtaaactcagctgactcatttttaggtgaacaataaccgttaaaaaaaaagtaaagcaggatatgatgaagttaagctagacaatagctaaacgtttttaaatcaaaaggaatgtgacttgactgataccacaggaaagggagctttcaaagcaagctgactgctgccttagaagccagacaaaccaagacttggccctaaaaatatctttactgttttagagtcagcaaacagcctggttgtgggtttaggaaataaacttttctttaatataattcttataccaactctttactataatgtatatttttaaaaatcttgataccttttaaaacagatttgccttaagatcccagtacttttcctttgctgggcagctttgtcactctctcctaccccaggtagaaatggccaagatgcttaatatttgcactctccttgagacgtacttcatcttgagaattgtgactgtgccttctcctcattaaccccaaccacctccttccgttgttgccacctacccccatcccctcatgttctgttgtccttgggagccaagtggaaaggaggtggagggggactgatttgctgtaaagcttattgtagtgtcttttttcaaacatgcttctagcaactagtttgattattagttcaaagtgagcactgatgttgacttaacctcccacacgtgattcacctgggcatatacttgcccctggagggagttgaacagtggacagatggattttccacatgagcaggactctctttagggctttgggttttgttctttgttctgctcgtgttagtatttccaggtttttgtattccaggctatggtagttccagtctttctctcgaattcaggcccaaggatcctaaaattctacaacacttagtatagtacatggggagggaactagccaggagcgcagaactgatccatggtggtgggggtgagtcagacgaaggtgtgctgaactccctcacactctcttgctcctttcagctgtatctttaaatatagggtagtttataaagagaatggtcagctccagtcagttttttgtagtgagatacttaaaatgagacacaattataatatagttgcatggttaccaaaaacactccagaatcttataatgggaagcggctttttaaattaggagtgtcttttggaaaatgtgcgttaaaaaggaattctttaaaattggttctaatttacctgcccgtaatccatttttactgtcattattttctgtgtgtggctcttgaactagtgaatagctttggaagactgttttcattgggactttttttcactgggccctgttactactccctgttgtaacctgtaattctgggaagccccctaggttgagtgcaggtcagagactcctggttaaagaggatgggaatcgatgctttggcttggtgtcagcgtggtctttttcctgggaagtgctggccactcccagccctgtccattttcctgtcagtgtgtggggaaccagccagatcaaagaatagcttattcttttgctgcatgtaggactaaagctccttttccatggagcctagtgcctgggcttggtccctgctagtacaattgtacagagcagctgtgttcccacttgacccagctcacccaggctgcctgtagtgtgattcgggttattgagaagttatgtcattggcccaccgtagctcagaagataggaaaccgcaccagtgaggccaaccacagacctggcagtgtgattgggcatcttgtgcaaagtaggtcatgccgttcccataaatccagattactaggcaaagtgtcaagacttttgcatagccctgtgcctcccattcctttagtacaaaagagtatagctcagcccacagaccactcagcaagtgcccaatttacttaacagggcaggccagcctagcctggtgatgaagaattcatttgctgagacctttgtactgttcatgtggcatagcagatgaggctcagcaaggaagatgggaatgaaaagggcacgttgctggcaggagggctgcaggaaggagggttaggagatggtagcagtgtgagcagataaggattggcaccctcttctgttcctagcccgttggccacaagctctctgaaaggtctcaagaaagctctcatgactgacctctgtctactgctgagcaaggcctgggcaccagacggagtggaggacagaaggcctcccattgtgctgcccactcctgtcatggcttctggtccttgtgcatgccagcctagccctgaccccagggccattgtgctcatttgtgcctctaaatggaacacccaccctttcccttggtagatgtgtggcttgctgtcaccattcaggctctgctctgttgccaccttctcaggctgccttctctatgttttccaaaataaattcccactccatgattccagcccctttattctgctttattttttttgctaacagttattttgcatatcgtattgtacgtgtgtttctgtctgtaattaatatatgtttatggtctttctcaccagcctgcaatcccagggccttcaggtctccgtgcctagcatgtggtaggcactcggtgtgtggtatgaatgaaaaatgagtacatggtattgagggacactagttatggggctgccttgacaaacatgaggttgtattgagtaaatgatgaagcttttggtgaaggtgtctcttagtaacctgtgcagaaacaaacagccttgcctgagaagattacagtatatatccaattgtgggtgtggtaggggagagtttgggggaaatactgaacatgccagagtccagcccaaaatcaagcttgggatccacagctcaggactctcctgattagggcctgttgtccagggcctacctctacctgccccttctcccttttcactgtagtcatttcagaaacaataagcaggaacaataatttgaaaattattatcatttccccacatgtatctgttcttttagagaatgttttgttggctctttcaatatattcctaagtttgattgtgaaaagttctgcaaacctaggagaaaaattctcaagccgagaagaaatgcagtctaagaacagatgtaccgtttctgacaaaaatcgtttcttgcgtgtgcttttgtagagaacacatttcattttataaagatgaaagagtgctcctgtgcctgccagcttccacagggcctcttcaagatggtttagactcagattatttgggacagatggcttgtaacaggattcttcaatatctccaaatactaaattccacagtctcttttggtagcctgctgctggttcagtactcttggactgaaattttaccttatgtttaatcaagctgcttttctgttgccgtgatgttagcctagattctcaaattggactatgtcctaggcatttgtccttatagtaataggtcatttatcgcaattactgggcttcatatttttccggggccactactgttaccctctccattcctgccccaccaatctgtattttcactttgaaacatttcttcactcttgtttccagcttctttatttcctcattacatagaaactgaccctgactacagccctctgaaagatctaattaaaaagtgaaatgattgattcccttatttttgttagacatattcctcctgtttgatctcagaatacttttgtttgaattttgttacagcatggttttgaacatatattcagcttatattcatatcatcattctactgtctgctcatttgcaaactggattttgtttttgctttactatatctggatccttttccccattatgaatgtctcattttttctaggtcaccaggtatgctcctttatgtttatccctattttggcaatcctttgtattaatatacagtaggtgctagatatttgtgtatttaattagtacattccttttagttttgtctttcatgtttgggtaatatctgtttctgacaagttcctctcctgatatattatcaactccccccccccgccttgcccccaccttctcttgctgtctctctaggggtgtgttagggcttacaagtggacattgtgggttgtcagaatgattggagctcactgatggcatttagtggacagggaccaaggacaattaatgatccacaatgcacaggacattgattgtttccactgtaatgccagcagtgcccctgccgagaagcagagacagccgtgggtggttgacagtattcatcatggagccaatcctgtggcagacatacattcagaaacatctattgggggcttcctacatgccagacactgctctaagggccttatttatattaccttatttaatcttcttaaaggcagttactttggtcttttccccgtttttcagaaagattaaataacttgtccaaggtcacattgctaataagtgaaaaaaaatggggggtttcaaaccctagtttcttataatctagcaaaagtccgttcatgcttaatacctgattattgtacatttaatgtgacccataagtaagtaagttaatattacccattaggtaatagaatctaggttttaaaatgccttggaggaaggtgtctgtccccagtgagcagcttgtccatcacttattcaatccattagtcatagcctttatgaccttgttcctccttatttcctttcatttggctgtttgggatgcagcctagtggggagcagggaaccctgtgacctccatatacatggcccaccatacatcatagatgaaattaaattgtgttagtgtgatttcagtgtcacaaaatcatgatggttgtctttcaaaacttggattttctagatgattttcagtagatgttgaaaaaatagacacagccaaattgtcttttagccagtgctcttcctgaacccaccttgggcagaacttttaatagcctttaatagataaaacatttcttatttaactgtgttttaaagaggaattctctttacgaaacataaggctaaacctattctcttcagcaccaggattttctagaatttcttgtctctcctgaagtggttcaatctagggcaggaaagtggcttaggaccaaaattgcctttcttaggaatatagtatattagtaccccctcatcgtcagggagtacattctaaggcccctagaatggaagcctaaatctgcagatagtaccaaacactatattatatatagtggttttttttcctatgcatacatacctataataaagtgtactttataaattaggcaaagtaagattaacaacaataactaataattaaatcgaacaattaagtaaagtaaaagttatctgaacatgagcacttcgatcctgaggcagttgatctgataacccagaaggttacaaagtgactcaagggtgaagaagtgtctacggtgaggatacgctggacaaagagatgattcccatcccaggcaggatggagtgggactgcgggagattttatcatgctactcagaactgtgtgcaatctacaacttatgaattgtttatttctggaatttcccacctcgtattttcagaccatggttgatttcaggtaattgaaatctcagaaagcaaaactgtggattaagaggggactactgtatgttaaaatcttaattgttggattgcagaagtgaccttgtgctaaggttttgtaactattgaggggcaaaggtggctgacctggttattggcagatgggtatggggagctggtgccttcggggagctggtgccttcagggagctggtgccttcgtttccagccatgaattggtgtcagcagcctccccaatcacccttgggcaggaaagctgtcaggacagaaccctgttaactactttgaaagtgtcattgatggctcctcctatctctacgtcccatctcatctggattgacttaattgtaactactacaaccattagatgatttcgtggataaagtagtttatcttaaaattagccagtgaatacataacgcttcagtgtggcaagccaaggaagagaagtattgctaaatgattaacagcttagttaataaaatcagttctgcctttgcccttggacgttataatattgatgattattcctgtaagaagaatggccaggaaagttggaaaatctagtcagtatgcatatgaaaagttgattagctaccctctaaatgtaaatcttaaattggggaaggtagggagctatagaatcttagaagatggaggtaaatctttaactggtatctcaagatgttttattaagtgaaaataagcaagtaatatatacacacttctatatataatagtgtttttttagttttttttaactgtgatccccacagtaagaatatattttacatcacagctaagtacattatacttataaatatgatataataaaactaaagttttataaaactatattcattctcactgagagcaaagcattctgattctctactatgatcaattattatttttaatgctaagttgacatgatcatctactaatggtagatttcacccacaattgtgaaaacatccatttagcatgacctctttgtgctcaaaagaggagaaatctctggaagtatattgaagaaatgttaccattaggttccttgtgatgcgtggcttggggattgaggttgagggaagtaatgagatttttgccccttttttttaatttttaatacttgaatttttttttactgtagatatgaagtactgtaaaataataattgataaaagtaacaagcggaaaaaactgtcttgtcactgtggcattctgttccctgatatggctcttccttgtcttacctcaagtcctcagttgttgcccagacaggatctcttcctgtctgccacctctcattccagttagttccacttttttccccactgagatttcagcttcacggaaagagtttttatggaactaagaaaagaagttcagaaaactggcacttcatttataaagtgaactcacagaattgtgtctttccttttgatcttcaagttagatctagcacagaagtcacttctgtgaattaaattcttttaacctaaggaactgaacttaaccttgtctgtagcatattctttgaaaagaatttattcttttatgaaaaaatactgtataaaaaacattttgagtagagattaatcagtatctttttttttcttaataggttttcaaatggaacattttgatgcatcacttagtacctatttcaaggcattgctaggccctcgaggtaaggtggtttttggttttgcttaccttctgcagcatcactccctgcctatagtcccttgtaaatattgcatgaggagatagtagaaaatgttagcattttctatgataagtctaaaactttatcctggataacaaggaatttggagaagtctctgacagagacacctgctgtgggtggtcctccgttgactttaactggagtttaaaaatatgctgtaaagcttgtagcctgagaatactatagatttcaccattatcagtggcatttttttctcaattcttggcagtctttaagaaaaactagtttccaaaatgcagtgttgcaataggagtttaaaacctttccccttttacaattttaagggctttttaaggtcttctcattttgtatcatgttaactcactggtaaatatgcacctgaaccttacttgctgtatcttttagaaagtaaatcagcttcatattgccttcttttgatgtcatctgtaaaagtcttttaaagtcttttgtataaagaacttcttaggctcacagaaaaactagaaatggcttttaaacagacaaaaagaatctcagtttctcatgatttttaaaacacaaaagaaataacaaaaggacttagtctattaacatggcagagatgaaataataggtttcatgtcacctatgataatagtgataatagtgaaggcgtggagaaagagtacaacctctctgaaaggctgttttgccttctgttggaattaaaatgcacatgcccttttgcctagccattctactcctaatactttatcctgtggctagccttgattagttatgcaatgatacatatcaggatgctcattacagcattgtttttcaaggaatcatctggatgcctgtcagtaggggagaggttctgtaaattagtgtatggcccattgaaaagaacaaaaaagaataagttagatccatctgtatgtgcttgggttgggatagtgccttactttagctgtaagggacaaaaaatccaactctaaatggctaaaataataataataattattagcttgcattaccaggtggagcaattccgtagttatttcagggactgtatgatgtaaccaaggatccttgttcttgtcattttctactttgccacttccaggtatcagcagctctgtcctcagaatgggtcccccacttcacacagttgtaggatggctacagcagctccaagcagcacattcagaggaagaagaaaaaatgtttcatttgtgtggttttaagcataaagaagttgtttcccagagctctttgccagctgtcatccctcaaaactcactggccacaattgcttcacatgcccctgcctgaaccagccaccagagggggttaggaccaccacagattgactagatcctaaggattctctacctggggctggagttcgggtcaggtgcccgggaagcactgtgcggtgtgggaggatgaatatgtgccaatttggaaagatgagtatttgtgggaaaatgaataaagcaaagtgtaaatcagaggtttaagttaaaatagggagatttgtgtgtatttattgtttgtgatatatatgttcatacaaaataacagtctgatgttagttgctaagtgggaactggttttcttaaaattgacagccaaggcccaaagctgagaacaaaaggtgttaagcatccccttaaagtccctggggccagccatttccctgaatgacttctaagcacaaccagttctgccggactgacagtaacaccctccgtgaccatagcataactagtggggagggtgtggagggcatgtccctctgaagccaaagcaagccagccatgagagaaatgctgggaaagtttagtgtgtacagtgcaagaaaggaagactgactgacagttccccacgtggacatatgctttattgagcctgttcttgttctgtgaaatcaaggtgaaaacgactggagagagtagcaagatggtccagtctgggaggggtcaaagaaagggcagagccgggtgtggtggttcactcctgtaatcccagtactttgggaggccaaggcaggtgggtcccctgaggtcaggagttccagaccagcctgaccaatatggtgaaacctggtctctactaaaattacaaaaattagcggggtgtggtggtgtgtgtctatagtcccagctactctggaggctaaggcaggagaatcgcttggaccctagaggcagaggttgcagtgagctgagatcacgccactgcacttcagcctgggcgacagagtgagactccgtctcagaataaataaataaatgaataataaaaaaattaaagaaatggcaaaggctgtcctcccaactgctgcttctctgaagacgcagtaggtgaatgctgcatgtgcctcatgttctggagttgtgagccttggcgggtagttaagattgaggagccacaggttttcggggaacatcatagcagggttcaaaggggagcatgcttttcagaggtagcttcctggggtcagccagagtatgaagctgaatctttcaggggacacataacacttaggggctctggctgccaaggagtttcccgccatccaagaagaggttgtcagtttgctgctggcggctgacctgtttccctctccctcctccctgcctaagaaaaggaataggggcaggagaggcccttcctataccagtatctcctctggatccgcctaggtcttcgctctcatgctactactcctcagtttgttaaatactgccctttaaataggcatttatctgatcattgctgcttcaccttcatgttttgttttgtttttattttcatttttgagacggagtctcactctgttgcccacgctggggtgcagtggtacgatctcagctcactgcagcctcttcctcccaatttcaagcgattctcccacctcagcctcccaagtagctgggattacaggtgtgcagcaccatgcctggccaatttttatatttttagtagagatagtgttttgccatgttggccaggctggtcttgaactcctgacttcaggtgatccacccgccttggcatcccaaagtgctgggattacaggcatgagccaccacacccagcccttgttttgtttttaaatcattgtcctctctgctgttgaccattacactcatagcaaaggctgcctttctaattagtgccagtttcactaacgtggctaagcagcacgttttctgagtctgcatgtgctggccacacttgccgactgacacacagctgagatggaggacttcagagttcaatgactgccatttcttgggttttatcaccctatgtgtaatctggtatacctggttaataaatccaattaatgggaagtgtagccttctccttgttttcttcttaagttctttggaaagaatatttgtattattattttactgagcaaaaatcatgaataatacattgttattcagagcatgtaacaaggagcttcaccttgtttgatatgtattgaaaatccatgcctcctctcctgattgctttattggaattaagaacatgaataccaggtgacttttatatcatcatggttagagaaattttttcaacgtttgaaaagttgtgaatgtttttatatatcattaattttttttaatttttcagatactagagtaaaaggatggtttcttctggacaattatatacccacatttatctgctctgtcatatatttactaattgtatggctgggaccaaaatacatgaggaataaacagccattctcttgccgggggattttagtggtgtataaccttggactcacactgctgtctctgtatatgttctgtgaggtaagtcaaaggttaacacagtcttcctttcacataaatgcactcatattgctgtcctaaattgtattcctaaatgaggaaaggtggccgcttggggtgtagagacaactgggcaagcaagtatcttaatgcgttatgagtgtgttttaaaatcgatttttcaaaatgtcagagttgtttgtacaagtatgccttctagaatatctaaaatagaagcctttgttattgattcttctattatgtttcgtatgatattcaaaattaaagtattttcagaaatactctcatgcaagcaaaatacagagtggaaaatgaacaaaatgtgaaaaacacatgtgaaagcattttattattaagcatctaataagtgcctgcttcttgtttgaaggtaggggaggaaggaagtgggtggcacttgtgtttggtatgttttgtggcacatcaccctctctgattggataacttgtcaaatctcagttgttttttaaaagctaagaggagtgtgactggtgagatctgcatttaggttttgaattgtctgtctgagttcaggcccagttattttatatcactgcaatgttgaaaatcacatttgatgatctcaaaggcaaatgttatagcttaaaaatgaaagaaaaatcagaatcaacccttctcttctccctattttgaaggggtaacactatagcctttaaagctaaaagggggaggaaagcttccctctggtggtaagcagtttgtgtacatttttccaggaaagcctacccacttttcattcttacagcaccaacctatttctaactcttctggagaattaagccctggataaaacctatacaggcactcctgtataggttttcagggtttcattttggttttagttcttcaaggagtagtaaagaagaaggtagaggtgggaggaagaggagagatagaaacatgaatcttaaaattagtgttcaggggtcaaaatgaattctccatcagcctcaggccatgatggtgtctccctgtctacgtgtggtggtgtgcaggagtgtgggcgtgtgcaggcatatttgattatcagaggtgttgcagctgtgggatatctgtgtcttgttctcccatgtatgtttcataagccaaggtacagatattctgaatagaatggtagatgttcctagcattacttttatgcttgacatgccaagaaatgcttacaactcctttttttgcttttttttctgtcctattctagaatgaagtcagtttaattagactccaagatggagagttcaggactggagccaggggaagtgcacaggagtgactcctggccccagcactatgcacatttctgtgttcaagggacaaaaccacagcaagctgtcaggtttctgagtgaactgcttacttttccataattgatagataatacagccatgtctttaagagaactcttacagagtttattattatacatggcaatattaatagagaaaaatatttcatgtgatttttagagaacttaagcatttgccttaaatgtttcttaagccctagaaatatagctataatttcattatttatcctctcttaaacagatgattccctggtaaagagaagaaaaacactgtataaagtacagctgtgtgcatctgagtggatgtggggggttctgaacacattgtaatagaaggtacagattttcctctgatagcttggtgagaagagaagactttgagcagtgactaagcactgaatacagaaatttaagaaatatacagaatagggaaactacatttttaactcacagtttagagtacatagagaggtaatagacaaagaggcaatgtttccttaaattaaatcaagtttacaaaaagctatccaggtcagatatacccaagttgaaaataagccctagtgctccaagttgatggtattcacatttggtttttgtccgagttttctcctgtacatattgtaaaacccatcaataattccattgtcatgtgtcctttttcaaacttcaaatatcattttagctacacgtttttctgtttgtttgttttgagacagtttcactcttgtcgcccaggctggagtgcagtggcgccatctcggctcactgcaacctccgcttcccaggttcaagcgattctcttgcctcagcctccctagtagctggaactacaggcatgtgccaccactcctgtctaattttttgtatttttagtagagacagggtttcaccatgttggccaggctggtcttgaactcctgacctcaggtgatccacccgcctcggcctcccaaagtgcagggattacaggcgtgagccaccgcacccggccatttttctttttatacttagcatttctactccattgaatgctaagacacagaagagcagtcatggagttttacaatggaacgaactgaggagatcatgaagccccatggggcccctcattttagagaaatgtcccaggagttagagccattcttctgtggtcacacacctgtaatggtcattattttagtttttatttaccttcctgcttatctgcatatttggggctgtaaagaattttttaaataagtagtctttggtatttttgtttatttaattctgtggcataaattcacagctgctttagcaagttctagattaataaaaataaaattaactgtcacttaaaggagacaggaagaagcggggtttttttgtttgtttgagacagagtctcactctgttgcccaggctggagtgcagtggtgctcactgcttctcgcctcctgggctcaactgatctcccgcctcaacctcccaagtggctgggactacaggagcatgccaccacgtctagctaagttttgtatttttcgtaaagacaaggtttcatcatgttgtccaggctagtcttgaactcttaggctcaagcaatccacccacctctgcctcccaaagtgctgagattacagacatgagccactacatctggccaataggaagaagtcttgaaagaagggagatgatcagaaggaaatgaaaggaagtcactgaaactttaaatttactagaaggaaaataactaaatcccagttttaaaactgtgaaaccgagtttaaaatgtagaaggaatatagacttgctcatagtttgtgtacttggtagaaacaaaattaaaaggagagaagaggtattacttctatatctcattaactttagtgtttatttccaggaaaaaggtcatagatccctgatttggagcatatttgaattagtggtatgttttaatttgaaagtattggactttatagcaatcctttttgcttttgcttattaggggttgtctaatatcacagtccatggtgaaagctcggaaatgaaattccaggttatagaagagaaacaacttagtttgcattagttacttagctttgtaaaacgatgcccttacagcaaacttaaaaatcttgtgcgccttttagccacccgagattcagggcatttgtcctctgaagagaagcctgattttttgcactatccatgtgtcttttctcttgtctccagtcccaaaattgagaacctctacatacatggtgccaaacggtggctttccctcactctgccttatctacctggttggatcaggtttcccctgacccatccagtgagctatcaaagccacttttaactcctttgttagagtgttacaggtggtttccctcttaggcagatgctctgtcctcatgtgaagccattcaatgtgtctactcttctcctgctgtgcctcagacctcttagaccctaagcagagaggatctaattgtgtttgttacagtccaaaagggagcaaccccgtcgatctgcctgtgcctcacgaactgatccttcgactcagcagcagctgccagaaaacagggtcagtgttgtgcagtgcacatggctttgaattccccaggaacactgtgttgaaaggatggctggctcctttcctcagaaggaggcactccggcctttcttagccgatctgttatgctgagctctactcaaaccccagcaacaccaggctctttcattcttctgggctctaccccttaaaactcccacttctgcctggcagtctccctctcacttttgaggactgtgtggaaggatccaattcctctgtgaagccatgagcgtactaaggaagaggactcaactctagagagtgaatttttttttctcccagcctctttggctatcccattgttcccacggactatgatgcattcctttcaaagtactctcatgatgtgccccttagcatcccatccttgccccactgacactcactggcttaggctagaatgaaacaatgttttccccaccttcttcatcccactgttactatacctgattactccaccaaatggatcctgagtattagaatacaaaaataagcaaatgtcggaaccacattttcaagttatttagtagtcaaagataaatcatgggttacagacaagattattttttgagtatctgtgtatgtttcctcccttgcagttagaactatatgttgtgaatagtgtgagagaatgcgctttaaaatattcagaacatttaaaatgtaattttgaaagaaaaaaatttgtaattttgaaaaagctggatggatgcatctggcttggcataaatccaaacttatctttcttccccttttcaatttttattttaaattgtaattttggaactatttgaaaatatttaaaataaaattatatagatgatatctgtgcacctaacaaatgcttgatttttgtttgtttgtttaaataagaaaacattacaaaaatgcatctaaagtacagtccctttccagacttcttcggaaatttgtacagtttttctctggatgtatttttactacatatatatgtatacatgacaacacatagtacgttctaagatagtttttaaaaaccatacgtgaatggtatactaattaaactctttttcaaatagatttttttcagtcagtatatttttgaccaattcatcttgagtcgtatagatgtaattcattaattataattatgttaattatagttaattagaaattcattttatctgctttgtattatttcagtgttggaatttattacaccattttataagtgtttctttggatggatatgtatgttgttagattgttttttgttgttgttttttgagacagagtccggctctgttaccccggctggagttcagtggcacaatcatacctcacccactgcagcctagaactcctggccttaagcgatcctcccacctcagcctcctgagtagctgggactacaggcatgtgccaccatgcctggctaatttttttatttttggtagaaacattgtctcacggtgttgcctggactgatctcaaactcctggactcaaagtgatcctcccacatcagcctcccaaagtgctaggattacaggtgtgagccactgtgcccagctatgtgggtttatgcaagttgttcaattaacagtgtgccaagaatcttcttagacatatctccttatgcaaatatggtaagttttttgaccagataaatgcataggggtttaatgactgaatccgacagtctcttgtctttaatggggaaatttaattcattttcatttagcatgttaatagttattttatacctcagatattgcagcattagttgcagatcactgcaataaaatgagtattgcaataaagtaagtcataccatttttggtttcgcagtgcatataaaagttatgtttacattatggtctattaagtgtgcaatcgcattaaatcttaaaaaaaaacagtagacatacctaaatttaaaaatgctggccaggcacaatggtgtacatctgtaatcctagcactttgagaggccgaggtgggagaattgcttgaggccaggagtttgagaccagcctgggcaacatagcaagatcctctctctacaaaaaattttataactagcctggcatggctcgagcttgttgtcctagctacttgggaggccgaggtgggaggatggcttgtgcccaggagctcaaggttccggtgagctatgaccacaccactgcactccagcctgggtgacagagtaaaaccctatttataagaaaaaaaagataaattaaaaataaaaatgctcccaggtgcagtggtatgtgctacagtttagtgtagccatgttcgtcagtgatcttagttaaatcttccagataactggctgcagcttctatagcagcacttgctgctacaccttgcccttttgtgttatggagatgacttcttcccttaaaccttatgagctatcctctgctattttcaagcttttcttctgcagcttcatcacctctcccaggcttcacagaattgaagtgagttagtggcttgctctggattagattttggcttaagggaatgttatggctggtttgatcttctacctagaccactcaaactttcagcaataaggctactaatgctttctcatcatttttatgttcatacgagtagcacttttaatttccttcagtaacttttcctttgcattcacaacgtggctaacctggtacgagaggcccagctttcgtcctgtctcagctttccacctgccttcctcactaagcttaatcatttctagcttttgatgtaaagtgagagacatgctactcttcctttcacttcagcacttagaggccattgtaggattattaacccaatttcaatattgttgtatctcaggaaataaggaggccagagaagaaagagatggttagggggaacagcaagtctgtggagcagctaaaatacagacaatatttgttgagtttgctgtcttatataggtgtggttcatggcacctcaaaacaattacaatggtaacatcaaagttcagtaaccacacacagatcgccacaacagatataataatagtgaaaaaatttgaaatattttgagaaatattttataattgtgagaattacaaaaatgtgacacagtaacacatagtgaacacgtgctgttgtaaaaatggtaccaatagagttgcttaatgcagagttgccacagacctcagttaagaaaacctgtaatatatacaaagtgcaataaagcaaagatgaggtatgcctgtactttctgtcaccttttttgtgtatatatgttttctttggccttcttttctcctttactgctttgtagaatttttgtaaccattattttttattgtacttattcaaaagttattcattctgttgagtggttacccatagatgtttaccatgcatttttaacttacgacagtttcagttgagtcagtatttctattctcctaaacaataccagggaccttagaggattctagctgtgacccctcatctttcatgttactgttgtcaggagttatttctacctttttttttaaaaaaaaaaaaagatggtcttgctctgttgcccaggctgaagtgcagtgacatggtcatagctcattgtaacctcaaactcctgggcacaagtgatcttcctgcctcagcctcccaggcagctgggactgcaggagcatgccactgtgcccagctaatatttttattttttgtagagatggagtctcactttgttgcccaagctggtctcaaattcctgggctctggcagtcctcccaccctggcctcccaaagcactaggattacaggcgtgagccaccacatctggcctcacttttttttttttttaaggtcctaaataatcaccattattgccatcagtgtttactgattttctttgctctgtgaaatttattctttcctttttgattcaatttttttcgtaagtagttctttctatgaagggcaatatcttagtctgagtgtcatgttatttgcctttacacttgaataatattttatcaaggcatagaattctagattaacagttatttttcctcagcactttgaagatttattccagagaagtctgctgtggtcccacttttgctcatttgtagggtaatctttttttctttctaggcactttgaaaattttgcattcttccattcactcctacttccttcatttgtttttaatctgtttcatccatctattgtgtttttagtttaaatggctatgtatcttttacttctgaaagttcactgcttgctctttttttattccataacatggaagtattgtcccccccagtgatatagattagatgacagtgatctccaaatttaaccatttgctgtgttgcctttttaagtattctattaaaagcttgcttacagatatatctgtgaggtaatgcctctgggataattattgtctgtgttaaatttctttacctcctaaaacagaagtaaaggtttgcctagtgttctgtgtaagcatcccaaactagtattgttgggggtcatctcaggtaaacatgccttttccacataaagattttggaaggagttgaatttaagctgatttctctttttctaaagaataatttgttgtggggacctccctcgcattataggtaagaattgattgtgttggagtttttgctgtgttttataccactttcctacctgtgtttatagtgagagagttggttctgcttttgttcagtttgccacgttgctagaaccagaagtcagttttttttcctttgaatttgttttgaaaatttgtgatgcttttttattggaaagatgaaagaagttgagcatttggtgactgaatgctttgtttgtgctttctaacctctgtaattgtgggctgtgaaagcatctccccaggctctgggtttgaaggccatctgatggaaccacagagcagttgctttggaaacataatattctaaactggttgtttttctttcccttcaggctttcctaaaatagatacgttattgtgggaaaataggatttggaaaaacacttaagcaacctggcaattgattattgaattttatttgaaaaataactttgtttaccaaaatactttgaaaaggctatttgctgttctttttcccatttagcagaggtatagagcagttgaaacatctggtgaaattagtacttacaagaaatgcctgatcattgcctagaatacttttcactcttagtttccttacaactaaaattccttgctgagaaagaaacttctctcagggcctgaaaggaaacagttagttgtccctagtgtatctgacactgccctgagagaatgcctcacggtagggagaatggagagaaggatgcagctcaaacatccttcattcctcacccacacccaggggaggggaagggaatactttctacagagaggaagccttctggcttgtccagagccaggcctcactcctctaaacttgcccctgcaacacctggagagcttggctctgcagctggtgtagctaggagcacatcactctacagatcctcaactaaagtggacttaactctgcaaagcaggcgtcagtgggtaggctggagaccttcctttaaatgacacaaattatactttggctgggacatccagcaccaccttagccctagttggaagcaaaagtacttaacatttgcctaagatcatagcaaagacagatagtgcctaccttatgtcaggtattgggctaactaatctaatgcttattgcactcttaccatctgctttctacagagggaaagttctgggaggcctgaacagggagaactgctagcataagagggcagggcttgaggattcagggaaaatgccagacatacctgtttcagtttggattgaggacaggctgtttctttgtgttttgttttaaagacttctcaagtgtacagaacctgtcttttttaacttagccaagagtgttacgttcagctataacccaggggtattcctgttcacaaggagaaggaaaaaaaaaaaacacctgtggaggtcatgggtgtgaaattatcttaatgggcatccttatgctctggacatgaaagatttgaaatgtaaaaaccacatgctttgacctggcactccctaatagcactgcgaaaattggccaactaaaccctagaggaaataggtactttcaattttgagtagttcatggttaattttaaaccaaacatctgcggaagaaaaagatgcagttaaaggtctgcttttccacagaattcttcatggacagagtatccctaccatgttcttactaagaattcaaaaacagatgaagaagggcaaagatgcttggaactgctgtttgaggtgcatttggactgagagtcaggattcctttgtgctaatcccagtggtaccaagacctgggccatccttatcacttctcattccctgttttctcattaaaaatacgagcttgtaccagatctaaaaaatacacagttgaggactcacacagaaacaaagctatgaagagggtcaaccctacgtattcttggagattttgcttagaaaagcaccttaggtcctgtgatgtagttgaacttgagtatggatagtctatttttcattactttttaccccatttctgcataggaggtagtaaacatgcagcttcatcaagctcttatcaccagaagcagccagtcttctttggaaaggggttatcttgttgctctgacatcttgggatgctgatgttaatggctgataagggccacccaagatgatgttttcctcctttttctttaagtgtttccagtgaccttgtttcctgagatgtttcagtagcattccagaaagtgccatggaaatggttattatgctaaaggttacaagttgtttgtggttaaatgtgttattagatgggaaaagtcaactcaccgttaaaaatgattcactcctggctgggtgcaggggctcacacctggaatcccagcactttgggtggccaaggcaagcagatcactggagctcaggagtttaagaccagcctgcgcaacatggtgaaaccccatctttacaacaaaaatataaaaattagccgggcatgacagcgtgcacctgtagtctcagctacttgggaggctgaggtaggaggatggcttgagcccaggaagtggaggttgcagtgagctgagattgtgccactgcacaccagcctgagcaacacagccaggccctgtctcaaagaaaaaagattcactccatgaattatgtcatccagaaccaggtgtgaaactcacctacatttttttctttcattgaaaaggtgcatgaaaccatcagggttattgactttatctcatatggagaaaagagcttgtagctaggttttaattatagctctgcacatcctcttggcctaattaaagtttgctttactccaaggaaggaggaagtgtataaagctttgcagtggtactgtttgtatctcagttcctcagaaaaaagcctgcaaataatgcccctgggtggttcttggagttggcagtggtatggaaaatttcgttaggtagtggttagctgtttgtgatggcctgctttttcattatagtatagtcctgtcctctttcgatctgattctcagaagcccaaggtagacagacacctgcccctattttcagtacttcaccttctccagcctactgggtcctctcaccctgtggtgtctacttaacacgcaacttgaagaatttctgggaaattgaccaaaacagctctttggaaagaagctaggcctcagtcccaaagggaaaggtggctgatgtgactttgacttgaggattgtctcctgtgatgtgctcctagtggggctacaggggtcagtcctttgctttgagcacctctgtagtccactacccatggacacattgctatcctctgagggggatggagggagtagagccctctactgctagcccattttatggaggtttgatgagggtcttaggtgaataagcttcaactcaggtccttggtcttggtttgttaaattattctatcctttctgaagccagggagatttgagaatttccatgaccccattatgaaattgatgatgaagagttttcatcttgtgaacagagttcagatgaatatgatcacaaagtcaagcctcgtttaaaatactatgaagctctctttattgctgcacatgaaacattaggcctagatttaggggaaagaattggcagtcttgaactctttgtcatttgtttagcaaatatttgtttgacatctctggtacgctaatccctgtgctggaatatgttgatgcagatgcaggagccacagtcaccacccttcgaaatcttacagaagagcacacaacaggcccattaacaaagggagcatgtgagcaaacagctacaggtcactgcaaggtgagggtagaggaaggagaatagacctcaggctctagtgctcaagggagtaatcatgaagaaaatagaattttaactgaactttgaaggatagataggattttgagagctggagatgggggtacataggtgcagagggcattctagttgaaaagaataaaacagtggtcactgccaacacttatgtttaatcctatgaaccacattgggtgagacaggcattatgtacttcatggtgggagccttatgtttatcccatttgaggactgagaaaactgaagtttaaaatgttggaataccttagctaaggtcacctagcaaaacgtgaaaaagctagggtttaatgggctaatgcccaaacccatgctctttccccttggctactgtgtagcggttaaggaagggcatgtttggagaatgggaagaggtccaatttgtgtgcacgtaggggagaagtgaaagataagcttgggaccacgttgtggaagactaaatacctggacactgcacctaggattcagggtttcattctgaaggcaatgatgactcactggagggttttaaatatggaaatatggaattcagtggtttgaggggcacagcggccccagtggaagtgtggtaggtgtgagtagcagtggagggagtgttgcattgaagcatgacagagctcctacagggaacctcaacaggtggaagaggaatggtgggcctaggtcaagtggagtggcaccgagtgagcagcttcttgtgtgtatacctggtttatgcttcaggagtgaaaaaagttcaccacccaatactgaggtttgagttctttaactaaactccaaagacaacaggtgttttatacatggattcccctgccccatttatgggtggggagagggcaaatggaacgttaggttaactagtttaaagagtcaaggcaatcccacctggatcccttcttaaaaaggaagcctgtgtccaagagtcccttctgctgagttaacaagaccccttcaacccgttctcatctttgggattgaggcgcctgcagaattacaagagaggatttgtcctcctcttctccagagagctaccttgattttccccacccctgccaagatagacattcatgaatgcagtcatccacacctccacaagtgcacacacaccagccatcctattttaaaacagacaaaagcaaaaccaacccaggatgtctctggacaccataaaccaaaatagtcgctggaaaaaacagtgatggtaggttccagatttaagattcataaaatggtaacatttccaaaaatatctctgatgaagacagtcatatgttagtacgtttttaattttgccaagagaggctgctgttttaaaaaagaggatcttttacattgcacgaatttatcttcatgaaaaccttactgcgttgtccttatttttcttattcgcggttgtcccacaaacatttcatcaagaagcaccagtttcctttctgtaccctcaagccacaggaggtagttccttggttccctcctggggtagaaagaagggcagcaaaaagagcactgtgctaagctggcccttccctctccaccccaggtctcaagagtgcatgccagcttcctcccccgacctccaacgcactttggattcagactttgtgtcttgcttcttaggacttctgatcagcctgcatggatcctgcttgactggccatgactttagagagtagtagaagacagaaaagttaatacaccttctaatgaattaccatgtgggtactgatctttcaaagatagtatagaatagtttgttgtgtggtctgtttttaaagtctgttaacatgaagctacagaaatttggaacagaccctttagagataatttagtccaacctcatcattttatagtaaaaacaacaaaagcccacaggaattagctggcttgccccaggtgctgggcctggcactcaagccttcctcctaattccatggctcttcatcatgaactgatgcttctcccatgctaaatccttgtgctcttctttggccatgaaaagcctgttaactctcagtgcttttttatgtgtagaaggtgacaaagcagaaggaaaatggcaagaagaaagataaccaaagaaaaatcagatagaaggcaggatacccagcgtgagtgcagcggctacacccattttttgccatttatttctgatgtcagaccaggtggaaatatcacaaggtgtcttcagatccttgtaatcacctcttgttccctgggggggaatctgtgttgctcgccaagctaaactcttgtgttcaaggacagggaacacaagaattggggtgcagactctacatcacagccctgcagttatcacgggcccattgaggggaggggcccgtgataactgctgggctgtgatgtagagcctgtaccccagttctggggtcctctctgtgacagcatagtgcctactgtgctgcaagtgattctgaggcatgggcacttgtgaagccttcagtttgtgaagcctaattcatggatccggaggattgtacatacaacaacaggaaataatgaagataaagttggactaaattatccctgagcctacagcagtggttctcaaagtatggtttccacatcagcagcatcagtatcacctggaccttgttagacatacaaattctaggcccccagacctactggaacagaaacacccccagggacccatgttttactaactcacccctcaggtaattctggtgctgcacactcaagtttgaggagcactggcttagggaaagcagccagaggcttctgtggggcagagcagggagcctgtgattggcttggtctgggcacttgtgctaggaccaagggggtgacgggctgagggttctgcagagaagcagcgtggtaaaggaaggtctctgagggcagcagcctgggagtgacttttaagcccaccccttaggaaattgagactcaagtcattaaagctttccttttgtttacacttgcctacaattgttttttctcagagcaaacttggctcagcacagcccaaggtaaattatcacagattctgcaactaataaagttcaatgaggactttacatggctcagatgctgttggtgactggctctttcttcttttttagttagtaacaggagtatgggaaggcaaatacaacttcttctgtcagggcacacgcaccgcaggagaatcagatatgaaggtactgtctctttttcagaaactttattattataagtgttgagtttttaaaaataaattgtataaaatacaaaatggcccataacctcactgcccaggcaatccctgttgatatttttaaaagaataaaaaaggcaatatatacacatcaaattaaaatttgaatgtgaaaggtataaaataaaacctaaagcatccccctctgtaaaaataactccggttaacaattggcaggaaaaatcacatgcagtcagtatgttatatttacacaatcaggatcataagagcaatgtcttaaatttttaaaatcattcatccaagtacttttttccgagtagtggtgttaaaaataaaatctgacttccactcatgaggtttgttttaaatcacaggccaacagtcgcagctcagcatgggcagtcatctccttagagcacttgtttgacatgtttaattgggcagagacctgacactgcaggttctgattccttttcttctgtgtcacttatcaggtcggctgctccatgttagtccctgaaatcaatagcgtttttcagatggttttcctttgctaatggctgtgcaggctgcttccagagggaataggcagacttcaaggttttgaaccttgagcctcatgtttttgttagtctcaaagagtgtcagggaccctttcaaaaatattccctgtagtcatttcaaacccctccagctgtcccaacccaatcatgttctttggttaaaggtacttggagagtgaccatagctcccagccactgatggacattaagagctcttggggcactcgggcttctccgagttgacatcagatttttggatattagtgaaacatgtcagaggtgatattccagagaagccgtgaggataagccttaaatctttgaccctttcctcttagattatccgtgtcctctggtggtactacttctccaaactcatagaatttatggacactttcttcttcatcctgcgcaagaacaaccaccagatcacggtcctgcacgtctaccaccatgcctcgatgctgaacatctggtggtttgtgatgaactgggtcccctgcggccactgtaagtattagagacggggacttggggaacaggtgtgagcagggaggagagttgaaactaaggctttcagaaaaggtgctgtttctgtaaatgtctaggtcaggctttcagctttgtgttcaagttgcttttaatgatagtttatgtacctatgcacacaaaacccttttttagttaagtgaactttctgtgctgattgggtgagatgagggagataccactggggacatattaaggaataggtacaatattctctgacttagagggcaactttccaggttctttctggtccttctgtatggtgtggaaggtttgagacgggcaggtgaggaaaataggatcacactgttgcatgagtaccagggagcaaggctcattttgaaatacagctttagctgtcatgcattaggaagtctccacatgttctaacaaccctcatattccctgaagcatggtgatcaaggtgtcttctataacgagcaccaaaacttgatataaattttctaaggttgtacttggtttttggaaagcttgtagtccaaagtttcttataattttcagagattgccaccttcagattcagcctgggagttttagcaaatgtctcagtcaaaagtcccgtcatccaaacactgaagaatttaactgagaacctatgggtctatttatggatatttttttctctgggatagcactgcccttgattacctgagcctgctaagattcacagtgtcatggaattccagagctaggaaaaaaaaaaagctttccaaatacagatcctttgggtttgggaggaaactaagaccacagaaaggtgggtagagttggggctttctgctcttcctcccactgtcagagctcatgatggtggattaactgacctaactttctaatagaaacagcccctccctacatttgaagagtgctttaaattttcagagaactttcaggaggacagatttaatcagctccacttgggccatgagaaactgaaccagggaatggatgtgatgtgtccaaagtcaaaagccagttcctatcatagccaggagtagaaacttccctaacaccaggctgtgcacctgcaactgcacagggaaaagccagatggcttggtttggttgctgactgttggggaggaggacagagtctggaaaaagaactagtggtcctactgaacattgaaaatgatgtgataagatggctcttttatctctaaggagctagactcttgactctattattaataaaaatgtatgacctcagcactgcagtcctgggaaataattagaagatggcttcagagacctctccacaccccagcaaatgtatagaaacaaccatttttgagcatattgcccatcagctgtcttccacagccttcagagagcatatttgggcagttgtgcatgtaaagaaaaacagctgtctctgagagtgggtgggcatctgcagcaaagcctgtaggtgctgggatggcgtcgtggcttcagtgtcagatgcccctctagcagctacagctgacccctgggctcggagcctcctggtggctgcctgcccaagtggaaattgaattctcattacacatccatgcattgcttgctgttgcagtgtttgtcagctccgttggaagtcatctctctttctgattcaaaaagaatcttgtattttttttttttttaccacctgttctgtttaaaacactaatacattctccttcccaaatccctctgttcctgcagcttattttggtgccacacttaatagcttcatccacgtcctcatgtactcttactatggtttgtcgtcagtcccttccatgcgtccatacctctggtggaagaagtacatcactcaggggcagctggtgagtgacttggcctctttccccaggacttacttcctggtggatacagacctcttcctggctttagtgttatgtaatagcatctaagatgccccttctccaccctttttcatttgatgtaattaaattccttgaagtgggtagattagggaattttcttgttttgaactgatagtgaactgtgaccatgggcatacagctagttgaattgtacaaagaggtctagaatctaatttgccaacttcaagttcagctcttctgagtttttgcacataagcacatatgcatgtatgtgtgtatatgtgtgtgtgttttctaattatagtccaaaatccaaaatgaaaattgtatgtttccaggggttttagaaggagctggagagtagtatggagtccagggtatgtgtagcccattactaggcagcaaggatatttgtttggcaggtatggatgacccctcagcccccatgcagtggagcacctgttggtgaggatggcagctgtttgcttcagttaacagctcctcccctggtttactgccagggccaggccacttcacctgatacttctcaccatccttgattaagccttctgcattcatcagtatattataggtaacctctttctctcctctcatgaattcgtctatgaactaattaatactactactgctcatattaaacactgacatttcctaagtgtttagcacatgttgggtactcatactaagtacatgattttacatagattgttccagtagcctgatttcatattattgtccccaagccaggcacagtggctcacgcctgtaatcacagcattttgggaggtcgaggcaggaggatcacttgaggccaggagtttaagaccagcctggggaacatagtgaggccctgtctctaccaaaaagaaaaacacatattattgtccctattttatagatgacactgagtcaataggccaaagctagctgactgaggggtgtggacattaaaccctttgccctgtccttgcattattaacacatttttctaaacacaccaagctgattcagatcccttcaagtcaattatgatttttcaatatttaaaaataacaatctgaaaaaaaagtctgagaaaatcttagagactgaagtgtttgatgtttcattttcacctctctgccagctgctatatggtccttgttaattttttctcacccacctgtgaaaaaggaaaattgttgattaacctccttgttatacttgaggagaaatgatgcagaaattgatttataccacagttttgggtctggcggaagcagaatttaaaagaacagactggcaaagttggtctcccgttaggctctgtactttgaggtggaagattaaacctacccaggttgtcaggatttattttaagcaccactcctagttattcctcagtctgcagtactaaccttaaaaaagagaaggcaaacagccaggcacagtgggtcatggcttggagtcccggtcactcgggaggctgaggtagaaggatctcttgaacctgagagtttgaggccaccctgggcaacatagaccctgtctcaaaaattaaaaacaaaaaactctacatagaaacattggagctgctagaaatacagtgtgcagagcctagccctttttttggggggaggggcaggggttgagctggagtctcgctctgtcaccaggctggagtgcagtggcgcgatctcggttcgctgcaacctctgcctcctgggttcaagcaattctcctatctcagcctcccaagtagctgggactaccggcgtgtgccaccatacccagctaatttttgtatttttagtagagacagggtttcaccattttggccaggatggtgttgatctcttgaccttgtgatccgccagcctcggcctcccaaagtgctggaattacaggcgtgagccaccacgcccggcctgagcctagccctttttaaaacatctttccaccatttctctaaccagttcacatgcgtttcaaggtttattcatcaaaattaatcaatgcacttagtgttgtttgccagtaaaggtttaaatctactcatcagccttcaccaaaccagaagcgtccatggataaggagttggaaggatgtccagccaggtggcacatcctgcagtgatgttatcagtgccctttcaacatacacacttgctcttccttctcaaaaaataaaaacaaaaagtcttggatgtctctatagtgtatccttgaaatttggagaaggtagtttaaatagcttggagggcagaggaagaatatatataagacaaacacacctagagtttaggataagtatagtgtatgtgttgtgttcatgaagtgactgctgtacctgcagcaagggtagtaagtgttaattcagaaatttaggtgatgctggttaaaaagtctgcctggtgtggggcctcgtccatgcactgtccctgttcagctgcatcccctctgttcccctagcttcagtttgtgctgacaatcatccagaccagctgcggggtcatctggccgtgcacattccctcttggttggttgtatttccagattggatacatgatttccctgattgctctcttcacaaacttctacattcaggtaaatctcacccttctctgggacttggaatctggggcctttaccaacaaaggccctcatctatttacttaatgggcatgtggagcccttgctgggtgacaggctctggcctctaatggagtcactatgacaagagcagcccctgcctctggggggctcacagctcactggaagacactagaatcctgttctagagcctgggtgaggaagtcttgggattcccctgggaaatggaaaactgtgcagcaggaccctatgttgcttccctctgacctgcagcagagacgtgagaggtgatttcaatcagaaatctctcagttcactaccctgaacgtcatggccaaatgaaatttcagaagagatttttatcacagtcctcagatatggagatctgcttttttgtcccagctttcttatacattcagtcttcaggtgtgaggattcggttcattcctaagcatatgatgtggtgatgtaggtctttgctcacagaaagatccatttagggcagataatttccagtggagcctgaccacgttgcagccactgctgattctcctgccatgcgtcaccccccagatgacatgtgtcctgcctttgttgccagtgcctggtagccataaggcctgctgatctgggcaaaacacggaggtcaggagcaagggcagaggctgcaagtcccgaggctcagacatttgtcctttcttcttctgtgcccacaagcacctgtgtgtggcatgttgagtttcagtggaagtcatatacttctgggcttcatagtttatggctgcactgtgggacatacaccagctacaaggaaggtgaaaggataggacccgatgaagctgaaatcacatttattctaactacttatagcagcatagcactttgttcatgaaggctgagatagtcgccgaggcagtgaggaacttttgaagacgaacaagggatgtgggtgtcaagagagctgctgccaggtgggaaagaccaatttggccacataacccctgtcatctgccatccagatactaaaaggcaaagcaaagtgtaaattgaattttctatgtgacattttaaatagtatttctgttgcagcctgtgattcagttaacttacctcaggctaagcctcaaaaaaaaaaaggaagaatgattgaaaccagtgacaaaagatttagtcaatgaggacttgacctcaggagtttctccttgataagatttgatcttgaaactaggcctagtgttagggatgcaattctcagtaaagttccctataaagaaaactgtggtcatttggttctcatctgcccttacacattttagacctacaacaagaaaggggcctcccgaaggaaagaccacctgaaggaccaccagaatgggtccatggctgctgtgaatggacacaccaacagcttttcacccctggaaaacaatgtgaagccaaggaagctgcggaaggattgaagtcaaagaattgaaaccctccaaaccacgtcatctgattgtaagcacaatatgagttgtgccccaatgctcgttaacagctgctgtaactagtctggcctacaatagtgtgattcatgtaggacttctttcatcaattcaaaacccctagaaaacgtatacagattatataagtagggataagatttctaacatttctgggctctctgacccctgcgctagactgtggaaagggagtattattatagtatacaacactgctgttgccttattagttataacatgataggtgctgaattgtgattcacaatttaaaaacactgtaatccaaacttttttttttaactgtagatcatgcatgtgattgtaaatgtaaatttgtacaatgttgttatggtagagaaacacacatgccttaaaatttaaaaagcagggcccaaagcttattagtttaaattagggtatgtttcaagtttgtattaatttgtaatagctctgtttagaaaaaatcaaagaccatgatttatgaaactaatgtgacataatttccagtgacttgttgatgtgaaatcagacacggcaccttcagttttgtactattggctttgaatcaagcaggctcaaatctagtggaacagtcagtttaactttttaacagatcttatttttttattttgagtgccactattaatgtaaaaaggggggggctctacagcagtcgtgatgaaacttaaatatatattctttgtcctcgagattttaggaagggtgtagggtgagtaggccatttttaatttctgaagtgctaagtgtttttatacagcaaacaaaaagtcaattttgctttccaccagtgcgagagaggatgtatacttttcaagagagatgattgcctatttaccgtttgacagagtcccgtagatgagcaatggggaactggttgccagggtctaaatttggattgatttatgcactgttatctgttttgacacagatttccttgtaaaatgtgcctagtttaccaaaattaacaaagggggggaaaggaccttagaactttttaaggtaaaatcaaatatagctacagcataagagaatcgagaaatttgatagaggtaacttgtttaatgtaaatctaatagtacttgtaatttctttctgcttagaatctaaagatgtgtttagaacctcttgtttaaaaataatagactgcttatcataaaatcacatctcacacatttgaggcagtggtcaaacaggtaaagcctatgatgtgtgtcattttaaagtgtcggaatttagcctctgaataccttctccattgggggaaagatattcttggaaccactcatgacatatcttagaaggtcattgacaatgtataaactaattgttggtttgatatttatgtaaatatcagtttaccatgctttaattttgcacattcgtactatagggagcctattggttctctattagtcttgtgggttttctgtttgaaaaggagtcatggcatctgtttacatttaccttatcaaacctagaatgtgtatatttataaatgtatgtcttcattgctaggtactaatttgcagatgtctttacatatttcaatacagaaactataacattcaatagtgtgctgtcaaagtgtgcttagctcacctggatatacctacattgttaaatgtctaaacagtaatcattaaaacatttttgattacctgtg

SEQ ID NO: 37062 - DNA, 20800 bp, Homo sapiens
agttctggccgctgtcccggtgcgcacggacgtggctcgagtttcctctgctctccgctctcgcccgctagctctcctcccttccgctcctgcttctctccgggtctcccgctccagctccagccccacccggccggtcccgcacggctccgggtagccatggaggaccccacgctctatattgtcgagcggccgcttcccgggtaccccgacgccgaggccccggagccttcctccgctggggctcaggcagcggaggagccgtcgggggccggctcagaagagctgatcaagtcggaccaggtgaacggcgtgctggtgctgagcctcctggacaaaatcatcggggccgtagaccagatccagctgactcaagcacagctggaggagcggcaggcggagatggagggcgcagtgcagagcatccagggcgagctgagcaagctgggcaaggcgcacgccaccacgagcaatacggtgagcaagctgctggagaaggtgcgcaaggtcagcgtcaacgtgaagaccgtgcgcggcagcctggagcgccaggcggggcagatcaagaagctggaggtcaacgaggccgagctgctgcggcgccgcaactttaaagtcatgatctaccaggtgagcccacagggcggaaggcgcccagagctcccgcgcccggcccgcgtcccctgcctgggagttggggtggggagacctgcccgtggcgctgctcccctcccagcctggcccgggcgcccggcagatccaccctccttccggtgagcgcggctggggtggggttgggtggggtaggatggggtggagggagcggcggactcctggggcgcgtagaggggcgcgctctgcacctcgcacctccccactcagatccttccctcgggtcccaaacttgtagcagaaccgaattagcgggtggactcgaggacgctgcccctcgcagaccgctccctccctaattggctctgtcaaacttcttcctacttgggggaagtttctaggaaagtcaggggtccctcgcgatcgttggggtccgctgtaagcggacactggctgcggggcccgggcctggggcctctgcgcctgcgggcctgatatagcgggtgattcagggctcaggcacgcaccagcgggggctgtgccaagcggggaacgcgaccgccaacctcctccccagaccctgcgcccccgcgcccccacatcggcctcggcggcccacccctgtcccctcgctgctctctgctcctggccaccaggcattttcaggcccttgaggacaccctcacccgcggcgcgctggcaccctgggcctcctggaagcgggcggggctgggcggggaagagtgggcgtcaggagtgcaagaggggctggtggagtgggtggacagcccctgcggggtccggcggtctgggcgcagtctgggcgaggtgaatcaccccgcatgcctgcgggggcgggggccaggcgcagcagcgcagccggcgggaggaggctggcgcccccaccccccggctccgcccggggccacttgttgctttctttgcagctctccccattcttcacacttggataaaaatgtagcttttggatcataacccccaataaacctgggagtctcgggtttctatgctgctcctctccacgccgcttccgcagtgccatcggggatgagattttgggctgggcggcaagtgttccagcctggctcctccccgcctcccaaaggcctgctgatgctcctaaccccagggaggcgggatcgtgtggggcaggggggttagtctatgctcccctctccccttcctctccctgctgaagggaatggaaagaaagggaaggctggatttcccacaccctccaagttagaagacccctttccgggagttgtggctctgctgactgctctggggcctggtcgagccgggttctgagtgaccatctggggtgaggcgagggggtccttggcttggtttccccaggaggagttaagatagatgcaaatcaggacaagtatctgggaagagtagagacagaaaggtgggtcagctggtacctatctgaggtggtgggacagaggcagaagtggcacttgtccccctccccacccttacccacggatgacagactcctcccaggaggcatatacgtggcttttaaaagctttacttcccctacttaagcactatttagatagaaaatgtttgcccagagctatttccacttagtctaactgcttggaggacgcaggatgagaggggggcttttgacgttttttaagagacctgcttagtactggggacattgagaggagcggaacaagacaggggtctgggacagcaagccagctctatatttcctccagagcctggtgtggccgagagccaccatgaagagctcgaggggtgacccttctcacgctaactatcccagaccatagaacctgggaaaagtcttggcctggaggtaaacttccctatgccaaagatggagattctgagagaagagggaaaggtatggagggagaaagacttatctgcagaggccactggcatccctctgttctgccctctccagcaatctgcagggatatgtctatattttagggggtgggagggaatgtgttctaatcacaggtggcttcaaatgaatctgcactaaaccaaggccagtgggtgacagagagttgaggtagtaagagtagctcaaatggagtcccaaacccacagagggaataactaagaactgaaatggtcccaacctggggaagacttcagacgtaaggaaaagattccagcaaatggggtgaggcttgggaaagcagaacttccctgagctgcagagcagatgttccaggtggggacccggctgctggaggaaagcagaggctgctcctgctcctcccagaggtctgcaggcctgagaagggaaggaggtaaaaatagctctgtgccttggcaggcctattagggaagattgggggcagcagcatttatggtaaagtccggctgaagggggaggatgttgggtggccaggcaaagagacagagatttggagaaagtttcctgggatggtgtgaattctctggaggggccataggggaagggatgctgtattccccactacaggggtgggaggtgatgatgtggcagtgggggcggggcagagaacaccaagggatgggaaggcccccgttgtgggatggagacatctggccttccataccctattcctggggagaaaaggagggaatcccttgtatggccccaccccaaattcagggaacttctagacttaatgatttcacagctttaagtttgcatttgaacacacacacacacacacacacacacacacacacacgaaattcagcacctcccaccccaaggtatcacagccctcatcttaaactcacttctgagtcattactgcccttctctggcatttccttccctgtctcccaaacaaaacctagcagtttgacattgcattctatcaggcgacacttggctagcaacagctagtaaatgagagaagtgaattctactagttataggagttaatggactgagggttgcaggacgatcaggccagattgtgaatatagaggcagttgctctaaaataccatgcagaggccgggctaggtggctcgtgcctgtaatcccagcactttaggaggctgaggcaggtggatcacttgaggtcagtagttcgagaccagcctggccaacatggtgaaacccctctctactaaaatacaaaaattagccgggcatggtggtgagcacctctaatcctggttactcgggaggctgaggcagaagaatggcttgaacctgggaggcggaggttgcagtgagcgagatcgtgttattgcactccagcctgggcgacagagtgagactccatctcaaaaataataataataataataataacaacaataaataaaataaaatgccatgcagatgagtggaactatgatcattaaagaaccaattcttccaggcaacaatttgttttttggggttttttggttttgtttttcagacaagttctcactctgttgctcaagctggagtgcagtgacacagtcatatcttactgcagtctcgaactcttgggctcaagtgatcctcctggttcagcctcccgagtagctaggactacaggtgcccaccaccgtgcccggcaaattgttttttttcatatttgtagagtccggggtctcacttagttgcccaggctgatctcaaactcctgggttcaaacagttctcctgtctgggcctcccaaagtgctgagactacaggcatgagctaccacgtgcatccagtttgtttatttttaaacttaaaaggctttatttttaattactatggatacataatagttgtacatatttttggagtacatgtgatatttcgagacaagtatgcaatgtataatgatcaaatcagggtaattagagtatccgtcatatcaagcatttatcatttccttgtgttaggaacatcccaattccactcctttaattattttgaaatacgcaataatttctgttaactctatcaccctattgtgctactgaacgttagatcttattccttctatctaactgtatttttgtacccattaaccatccctccaggcaacaatttggagagtagggctcttttagatccagaaagtggggataaaatggaaatacggggctgggcgcggtggctcacacctgtaatcccaacactttgggaggctgaggcgggcggatcacctgaggtggggagttcgagaccagcctgaccaacatggagaaaccccgtctctactaaaaatacaaaattagccaggcgtggttgcacatacctgtaatcccagctactcaggaggctgaggcaggagaatcacttgaacccaggaggcagaggttgcggtgagccgagatcgcaccattgcactccagcctgggcaacaagagcgaaacttggtctcaaaaaaaaaaaaaaaaaaaggaaatacagtcacgcattgcttaatgactgggatatgttcagagaaatgcagtgttaggccatttcctcactgtgtgaacatcatagagtaactttacataaacctaaacagtatagcctactgcacacctaggctatatgatacagcctattgctcctaggctacaaacctatacagcatgttaatgtactgaatactgtaggcaactataacacaatggtaagtatttgtgtatctaaatgtgtctaaacatagaaaaggtgcaatagccatggcacggtagctcacacctgtaatcccagcactttgggaggccgaggcaggtagatcacttgaggtcaggagttagagactagcctggccaacatggtgaaaccccatctctaaataaaaatacaaaaattaggtgggtgtggtggtgggtgcctgtaatcccagctacttgggaggctgaggcaggggaatcgtttgaacctgggagatggaggttgtgcctggacaagagagcaagactgtctcaaaaaaatagtatagtatagtaaatacataaccagtaacacagtcatgtcttatcaatatcaagtattatgtactgtatataattgtatgggctagacttttatacaactggtagtgcagcaggcttgtttacaccagcaatcaccataaacacttgagtaattcatttcactaacacattatgatggctacaatgttattaggtgataggaattttttatctccactacaatctttttttttttttttggagacaagttctcgctctgttgctcaggctagagtgcagtggcacaatcttggctcactgcaacccctctgcctcccaggttcaaacaattgttcttcttcagccttccgagtagctgggatttacaggtgtgagccaccatgcctggctaatatttttgtatttttaatagagacagggtttcaccatgttggccaggctggtctcgaactcctggcctcaagcaatccacctgccttggcctcccaaagtgctaagattacaggcataagccaccacaaccagcctccattacaatcttatgggaccacggttgtgtatgccgtctgttgactgaaacgttgctatgcggctcatgactaaaaatgtgttctggagcagttttgaggaggcaaagtcagtgacctacatatggaccagcagcaaaggcccatcagacctgctccaagtgcctggggataagggccaggaagcatttaagggattaggtgtctcatgggcattaaagggtagggcaccagggctggaacgagagcctgatggcttctcctccccaaatcgcaatccaacctgtacctctttcctggattcaacgcaaattagggctaccttgctctagaagaaccccaaacctttgtccaaaaatattctcaacccagggctttggtccctttcatccctaaaacccagcggccatggagagtatgcatagtacatcccttcctcccaaactgagtttgggttgtttttcctggtcactgggtccaaagcagggagggtatttttaggggtattcccaagacgaaaggaaatcatgctatccctgggttcctccctccctttttttttttttttttttttttttgagaaaggatcttagctctgcagcccaggctggagtggtggtatcatagctcactgcagcctcaaactcctaggctcaagcaatcctcccatctcaccatctcagcctcccaagtagctggtactacaggcacaagccaccatgcccagctaatttttaaattccttccggccttctttccttcttcttttcttcttttctctctctctctctctctcttctttctttgacagagtcttgctctgtcacccaggccggagtgcagtagcgtgatctcagctcactgtaacctccacctcctggattcaagcaattttcatgcctcaccgtcctaagtagctgggattacaggcatgtgccaccacacctggctaatttttgtatttttagcagagacggggtttcaccatgttggctaggctggtctcgaactcctgacctcaggtgatccacctgcctcagcctcccaaagtgctggaattacaggtgggagccactgtgctcagcctaaatgttttttctagagggtccccactgttgcttaggctggtctcgaattcctgggcataagtgatactcctgccttggccgcccaaagtgctggggttacaggcgtgagccacgcggcctttttatttttatttttcatattgtaaagatcaaagtcaaaagcatgaggagacagcaaagagtgggcaactgatagcaagaggggaggggatattattgctaagcaactaacctcagaagtaggagtggcttgggccatttttttttggaaatataacattgtgaatatttcatcattctgtcattagcattttttaaatttttcttttctttttttctttttttttgttttttgttttgttttgtttttctgagacagggtctcactctgttgcccaggctggaatgtagtggcagctgtcacggctcactgcagcccctgtcgtccgggctcaagcattcctcctgccttaggcccccaagtagctaggactacagacatgcaccaccacatccagctaatttttgtattttttggtggagatggggtttctccacattgcccagggtctccaattcctgagctcaagcaatccgtctgcctcagcctcccaaagtgctgggattacaggcgtgagccaccgcacccggcctcattatacacttcttgagctagaagacactttgcaaataatcaacttcaactccttcattttgtggtttaggaagctgaggcccagagaggggaagtcactagcctattgtcactcaagtgattgggagtcaaactggagccagaacccaggtgtacccttccgctacactcactgctccccaccccctccttccgttctgggctctgcagcagaaagctgagtgaagactagccctgacaaagctagggctagctgtggctccgacacttgctgagggagttagttgcacagtcctggccctggggctgctttgcgtgtgtatgggtgtttgtgtgtgtggcgttggctatgagtggccagcattggtggccattggctgcttagccttgtaagtgctgaagtagaggcaatgtgtggtcacctggcctggtgacagtgggaggggagaggtgtaggggaggggaggggtgtaggggagaaaagtgggggaaaggaggggtgttggggaggggaggggcgtaggggaggagtggagctcctggtcagccgtggtgtgccctggcagggactccacacatacctaggagagggacatgttgtttccctttctcttcagcctctctgccactcccacctcctccttgtaccctgcaggggaggttgggacctgctgctttgtttttttgagactacaggctttatcaaatactgctattgcctgagtccaatagtgccgccaagtgtccctctcgcctggcatctgattgctcaaagcaagaagcctatagtcttccacaactcagcccctcaggagagagagttgggggctgccgcagaggtccagaggtcccaggacataggctcacctgtcataaaaatagcttggttttgccaggcacagtgatgtgtgcctgtagtcccagctactcaataagttgaggcaggaagattgcttgagactaggagtttgaagccaggttggacagcatagagagactctatcttaaaaaaaaaaatagagcttggttttggatcctgatttctctgtgcattttagtgtatgatatcttaagtggtagcaagagggaggggtggcaagggagacagaaggtggggacgtggccaaagggaaattgccaggatgtccctcttccatgcctatccctctcctcatttggggtagcatcctgtgtccaccctaccccagggaagaatgaaaacagattaatctgggcacactggctcatgcctgtaatcccagcactttgggaggctgaggtgggtggaccacttgaggtcaggagttcaagaccagcctggccaacatggcgaaactccgtctctaccaaaaatacaaaaaaaattagccgggcatggtggcacacacctgtaatcccagctactagggaggctgaggcaggagaatcacttgaactcaggaggcagaggttgcagtgagccaagatcacgccactatactccacagcctgggtgacagagcaagactccgtctaaaaaaaaacaacaaccacaaaactgggattggcagagtctgactctgaagacagtgaagttgtgtgcctttgtatttactcatctgagcctccccagttataatccaacaactagccccttagaaaactccttatccacccctagtagcctccatagtcttcctatgattatggctggggaaggattggagatggaagcccaagaatgggactggggaatattgtagagggaggaagggaggggctcaattgaagctgtgtttattaattcttgggcttgagtttgccccaccccttttggccccagggacctctttttttttttttttttttttttttttttttttccctttttgagacagacttttgctctgtcgcccaggctaaagtgaagtggctggacctcagctcactgcaaacttcacctccctggttcaagtgattctcctgcctcagcctcccgagtagctgaaatttcaggcatgtgccaacaggccccactaacagtattttttgcagagacctgggcaatgttgctgaggctggtcttgaactcctgggctcaagggatccacccaccttggcctccaaagtgctgggattacagggattataggcgtgagccactgtgcccagctcccagggccctcttgatgaagcatttaaaatgagtttctaggccaggcatgatggtggctcatgcctgtaatcccagcactttgggagcccaaggagggcagatcacttgaggtcaggagttcaagaccagcctggccaacatggtgaaaccctatctctgctaaaatttcaaaatattagctgagcatggtggcacccacctgtaatcccagctacttgggaggctgaggcaggagaatcgcttgaacccaggaggcggaggttgcggtgaaccaagatcagagatcacgccactgcactacagtttagcagcctgggcgatagagagaggctccatctcaaaaaaataaataaaatagtccaggcgcagtggttcccgcctgtaatcccagcactttgggagaccgagacaagaggatcgcttgaggccaggagttcaagaccagcctggccaacacagtgaaacccggtctctactaaaagtataaaattagctgggcgtggtagcatgcacctgtaatcccagctattcgggaggctgaggcaggagaattacttgaacctgggaggtggaggttgcagtgagccaagatcgtgccactgcactccagcctgggcaacagagtgagactctgtctcaaaaaaataaaataaaatagtttctagcctgggcaacatagtgagaccttgtctctatcaaaaaaaaaaaaaaaattagccgggtttgatggtacacaactgtagtcctagatatttgggaggctgaggtaagaagattgcttgagcccaggagttggaggctgcagtgagctatgattgtgcactgcactacagcctgggcaacagagcaagacccccatttctaaaaaaaaaaaaaaaaaaaaagtggtttatttccatcctaatacattgtgctcccctccctactcaccagcccctactctgcatgccaccaaggcccttttttctcaactccttttgcacccaccccaagccccatttaaaccccttttcctcatcttagcccaagaagaagccgaatgcaccctctgacctggccacacccaagatcgtgccttttgacctgcctgagactgagccctttgacctgaagcctgagacagtgcctgagctcccaccttttgaccagacgcctagggcactgccatattacccagagcctgggccccggcccaccccagaggagctgacagccggtgggagtgtttagggtctcccggatcccgttctgtgggcgtggggtatctcttcagtccactgtcagcccacagcctagtggtgatcactgccaggagggccaccatccccagtcactgcccactgtggacgggtgccgggtactgtgagaacactggcgttatgcaaagttcaggagaatgggatgtatacagtggggatgggaggggaatggaaggggcctccccacttcttggtttctgtttttagtagtaaatgctcccccacacttaagctgcacccgaaggctgcctagcatgaaggcgcatggcttctggttctgccgttccccctgctgcctcctcctgagggacaacccagtttggctcaaagcctctttggagagggccatcatgaggctcaggcctggggtctgttctgtgccctctccacccactccctgcagctgaggaaaacatttacacgtattttctccagtttcttttagaaaatgctttgcaaagagatcgcttatgtttgccagatcctgccttgggtggggtgcccaaaagctgccaactcacagatgccaggagggggacattctagctggctctggctcaggacctctggccttcctatagcagagtgtttctcaacttaaaaaaaatgttaaaaaaattttttttagagatggggttggactgtgttgcccaggctggttctgaactcctggggctcaagtgatcctcccacctcagcttcccaaagtgctgggattacagatgtgagccacctcacccagccagtttttgttgttgatggttgttgttgttttcataatcactcccatatacagaccttttagtttttttttttttttttgagacatagtcctactctgtcacccaggttggagtgcagtggagtgatctcggctaactacaacctccacctcctcggttcaagtgattctcctgcctcagcctcccaagtagctgggattacaggcatgtgccaccacacccagctagtttttgtattttttggtagagacggggtttcgaactcctgacctcaggtgatctgccccgcctcccaaaattctgggattacaggcatgagccaccacccctggccctttcaattttttttttttttttttttttttttttttttttttttgagacagagtctcactccgtcgccaggctggattacagtggcacgatctcggctcactgcaatctccacctccctggttcagcctcccgagtagctgggattacaggctcgtgccaccacacccagctaatttttgtatttttagtagagacggagtttcaccatgttggccagaatggtctcgatctcctgacctcgtaatctgcccacctcggcctcccaaagtgctgggattacagccttgagccacagcacccggcccctttcagatatttttaaccaagctgttcatctccctcacgaaatgttaaaacaatagataaactgtatatctgtttatgtactgtggctcttgggagtggcacaaatcattgtgatatctaagtcccctcccaatctccaagaatcagttttcacccttttggatgcaatttcacccctgccaagaatgcacgctagagcagaagggagggacacttctgcccttggggtctctcatctccttgtcttagcaacctctagcagaggtcctgaattttaaagacgttctctccccttcacctctcccctcctctgcaccctcttctaacatacactctaagcagatcctgggtctctgaattacctctccagtctcctccagccattcccaggcagtggttggggacctagagctggtcagccttaagtcaagagagcctcctacccagacccatgtggcatctgtcccttctccctaacaaatgtgaagtgcctggccaagggccagatgtgtaataggtgctcaatgacattataatcttataaaaatcttcctaagccagatctcgagtttagacagcagggttggggggtggagtggaagaggctgggagcctccctgtggctcctctgcatccatcgaggattgaggagctatgtgtgcttggcaaagggcagggggaactgtaatgcttttgttcagagctggtcattaaaggtaactctggaaaccaagcctattgggagtggtggttttgtttaataaaaacgagaaacagaacaagcagagccgtccctccttgccatcccctgaggtccttcctttggcttaggagctctgccagagaagtaggggtgggacaagggtgcctggcctgtgtgcccagggtggagggagatgattttggattgtgtttgtggtggttgtaccagcaagcagatgggtgggaccaagacagcactccaaggctgtgagtcatgggggaaacctggcctggagtggagaggaaaagctaatggtgaaataccctctccagagccagcctattggacatcatcccaggattcagctcaagttgtttcgtctcctgtcccctgaccttccaccaagaaggcagctcctatggtgtaagccgtcactccaggggaagcctacgatgaatggggttagagcccccagatcccttactggtctggagagatttctaaatccaggaataaacctccccttggccaggcacagtggctcatgcgagaaatctcagcactttgggaggccgaggcaaggggatcacttgagcccaggagtttgagaccagcctgggcaacatagtgagactctgcctgtacaaaaactacaaaaattagctgggcatggtggcgtgcgcctgtagttccagctacttgggaggctgaggtgggaggatcactagagcccaggaggttgaggctgtagtgacctgtaatcatgccactgcacttcagcctggttgacagaacaagaccccatctcaaaacaaacaaacaaaaacacaaaaatggccagatgcggtggctcgtgcctgtaatcccagcactttgggaggccgaggtgggaggatcccttgaggtcaggagtttgagaacagcctggccaacatggtgaaaccctgtctctaccaaaaaatacaaaaactagccaggtgtggtggtgcatgcctgtaatcccagctacttgggaggctgaggcaggagaactgcttgaacccaggaggcagaggttgcagtgagccgagatcgcgccactgcactccaacctaggtgacagagtgagaccatgtctcaaaaaaaaaaaaaaaaaaggccgggcacggtggcttaggcttgtaatcccagcactttgggaggctgaggagggcgaatcacatgaggttgggagttcaagaccagcctgatcaacatggagaaaccccgtctctactaaaaatacaaaattagccaggtgtggtggcacatgcctgtaatctcagctatttgggaggcccaggcaggagaattgcttgaacctaggaggcggatgttgcggtgagccgagatcgtgtcattgcactccagcctggggagcaagagcaaaactccatctcaaaaaaaacaaaaaaactaaaaaacaaaaacctcctctcactaggattgcttccttatgttgtagtttgagacctttcatgaggcactaggaagatggcattggctataagaagtctgcagctctctccccagtcccattcacttccaagttcagctggcaaagacctttatctaggaagccacaggccaggaaaaccagccagctcagcctttaggggtggggtggagcaggcagcaggggtaggggagaagcgggggatgctgggggtagggcagagagacaaagtggatttgttttccagcagctggggctgtttcctgactattccctgcctgtcacccttaatccctccctagcctattcacattgtctgagtttagtgaaaggaggggctctctccaccctttggtggggcgtgggtgggtttttaagtctgggaggttatgaaggaaagatcagagctgaattttttttaatatatatatatactggggctgcaggtaaattctgggtggagatggatgaagagggtttagatcctacaatgatgtataagtcttaaatgatatgcactccagtagcaggcagggtaagggtgattgtaggagccccaaagtgaatgactggaaatcagagggaatgcaaagagaagttgagactctcctacactcagaacaaggaaaacacccttcaatgcctcagtgaatgataagaggcagagggataaacaaaatgccctaggattgcccatgatctgcactaagccgtctatggcaggtagagactacaagtcccagcatgccctgtgcccaggtcaccttgcctgctgggaggtgtagttgggtaacagagagctggaggtggcttggtgcccagcagagctgatgcccagatgagagaagaggtggagccagcattccctctttgtccctgctaatgctattgacaagaagggaaggaagttgggagagggtgttcctagttttcagtgtaaaccaggaaactctggggggatgttgatgggagggaagaggaaagaggttgggggctggggaaggaatttctgtagcaggtggtgcagagataccgagcagcctatgtataggggtgtgtgtgtgtggtgtcagtgagaggactcagtttatgttgccttaatttcttaggggacaggatttttcttataattctgggaaatggtcttcagaaaaccctttagaaaagcgactatctctcgttccttcatttgaagtcactaaagggagtctgggccaaagagatcctattgatgatcttggtctgccctttccctttctgtgctcagcctcccctgctctctgatgagggtggaggtgggggagggagtgatccagagattctgaaatgttggccagagtcaagatcttggaaaatcttcccggaatggaaagcagttctggtgctaagtcctccaaggagaagacagaaaagcaaagaactggttctgagctccagggtcatggggaatctgagaccacccatcctactcctagacccctgagctcaggctttgtgctgggggcagggggtagggaaagcaagaattgaaaagtaatctctcttctatcccaaagtagggaagtcacaaccagaagaaatgtccagactggggagaaaacatgtccgtggctcccagccagcttcttcctctttccaatatcaatttctaaatgtgggggagggggagaatgaccactggtggagccaaacagtatgaaggagtcaaagaaggtggaggtgggggagggtggaccacagttctccatctctaaggctggttctgaaatagcttgaggccaggagcagtggcttatgcctgtaatcccagcactttgggaggccaaggcgggtggatcatttgaggtcaggggttcgagaccaatctgaccaacatggtgaaaccccgagtctactaaaaatacaaaaaaattagccaggtgtggtggcgcatgcctgcagtcccagctactcaggaggctgaggcaggagaattgcttgaacctgggaggcagaggttgcagtcagcagagatcgtgtcactgcactgcagcctgggcgacaaagcgagactccatctcaaaaaaaaaaaaaaaaagaaatagcttgagtctaggaaatgcacttcctttactttacctgcttgggtgggtaggtgcagctgtgggctcaaacccctacccgctttcaacttagacactcccaccacttgcttttcggcctggctcgggcagtgtgcgatttgcggcaccagagggcgctccgcccatttccaaagtggagctgtgtctcccgagggccgtagtggtttaatatcatctacgggtggaaagggatcaggacagggttggacgaccacagagattttagcccaagtgcaattattacgcaaccccatctccgacccgaagtttggtcccctgctcccgcggtctgtttagtcaccattcgttcaacacacatgttttttagagaatggcggcgcgaggccgggcgcagtggctcacgcctgtaatcccagaactttgggaggccgaggcgggcggatcacctgaggtcgggagttcgagaccagcctgaccaatatggagaaacaccgtctctattaaagatacaaaatttagccggcgtggtggcgggcgcctgtaatcccagctattcgggaggctgaggcaggagaattgcttgaacccgggtggcggaggttgcggtgagccaagatcgcgcccactgcactccagcctcggcaacagatcgagactccgtttaaaaaaaaaaaaaaaaaaaaaaacaaggagagagagagagaaagaatggcgacgcggggttggggggccggagatgggtgatatgttgcccaggctggtctcgaactcctggactcaagccatcctcctgcctcggtctcccacagcgctaatattacaggcgtgagcctacacacatttattgagcgcccgccagtttcctggggaccacgagcgtcccatgctcccctctctccaggatcgtcaccaccctgactcaggctcgcccacatccgcctcctccgacgcctctcatgtcccttctcctcttcccttaggatgaagtgaagctgccggccaaactgagcatcagcaaatcgctgaaagagtcggaggcgctgccagagaaggagggcgaggagctgggcgagggcgagcggcccgaggaggacgcagcggcgctggagctttcgtcggacgaggcggtggaggttgaggaggttattgaggagtcccgcgcagagcgtatcaagcgcagcggcctgcggcgcgtggacgacttcaagaaggccttctccaaggagaagatggagaagaccaaggtgcgtacccgcgagaacctggagaagacgcgcctcaagaccaaggaaaacctggagaagacgcggcacaccctggagaagcgcatgaacaagctgggcacgcgcctggtgcccgccgagcggcgcgagaaactgaagacgtcgcgggacaagttgcgcaaatccttcacgcccgaccacgtggtgtacgcgcgctccaagaccgcggtctacaaggtgccacccttcaccttccacgtcaagaagatccgcgagggccaggtggaagtgctcaaggccaccgagatggtggaggtgggcgccgacgacgacgagggcggcgcggagcgcggggaggccggcgacctgcggcgcgggagcagccccgacgtgcacgcgctgctggagatcaccgaggagtcggacgccgtgctggtggacaagagcgacagcgactgagccgcccccgctgccacccaccccattcctcgctccttccgaacttcctctttcgcattctctctcggctcgagctggctgagatttttctaaattgaaaacacgcccccctccccacacctccaggaactccactcccagtcttagagctgttaggacccgatggggaggcagcccccgcagtggacaacccccgcttggacacagtccgagtggaatgggaagggaatggtcaatccctgtcctggttgtccaagtcgggatctcagaggaaattgcagtgattccacggttaggcccccctgggggggctgccttcccctcagcctctccccacaccacccacccagctgctgtcattccgctcactgagctcttcttcattctcaccctgatccctgggggactcaaagccaaaactgcccaaagaggaaagattgaatcctaaaggggatccctgcccccatgggaggccccctactagaaggacgtgaaagcagcttttgggggaaactgaggcagtggggaagacagagcagaatgagccctcaccctggctgggggtccagcacaggctgtatctgcagagggtcccagaggaacgctggagccaagagaagccctgggaaggaggggtggggaacgacatgcatgtgagggatggcacactgatgtgtttatgcacctgtacacaggagcgcatggccatggctttggaaaggagaatggaaaaatagaagaaggtcggccgggcttggtggcttatgcctgtaaccccagcactttgggaggccgaggtgggcggatcacctgaagtcaggagttcgggaccagcctggcaaacaccccatctctactaagcgaaaacccatctctactaaaattacaaaaattagctgggcatggttgcgcatgcctgtaatcccagctactttggaggctgaggtggggagaattgcttgaacctgggaggtggaggttgcagtgagccaaggtcgcgacactgcactccagcctgggtgacagagtgagactccatctcaacagaaggaaaaaaaaggaaaataggagaaggtggaaatgggtgaagagagaagtcccctcactagctgcatgagaaatctatcttactgtggttctccatgggcagcaggaccatttttcagaatcaagagggaggacagtgtgagaaggcgatgatccaaagaagacagagaggtcagccccacccgatccctcaaatgggctcttggaggcacccccaggggcagcccatttctcaaagtccagaaaattagggtcccagaagggggcagcagcaggctgggagttaggagggagagcagggtgccggccctgccaccaagttgagagctggaggggaggtggggagagaacatcacagagcagccagccctggttcactcctggcagtttcttctcaagctccttccctaggagcatggtggcacgtgcctgtggtctcagctacttgggaggctgaggcgggaggatcgccagagcccaggagtttgaggctgcagtgagctatgagggtgcctctgtgctccatcctaggcaacagagtgatacgctgtttaaaaaggaaaaaatccttccctagagctagtatcctaaagctgcagagctagcccagacctcattggtttccttgtccttggggtgcttttcctgaatctttgcgggtgaagggagtgttgctcccagtccagaggcctgattctgtttggactgggttctcaagacacgaccaggttctcaagacacgagtccccttgttcctccccattaaagggggtttgtcagaagcaagaacagcccctctccccagtcacagcctgaagggaggccccgagagcttcctccttccccccacctgctccttaccttctctgccctgctttttagaactgcagttcattgttttaagggattgggggagggagcctggggacacaaaccttttatacaatacaaagctttgctttttttttttttttcttccttttccctttctcggttctcttctctcctctgaatggctgaagacccctctgccgagggaggttggggattgtgggacaaggtcccttggtgctgatggcctgaaggggcctgagctgtgggcagatgcagttttctgtgggcttggggaacctctcacgttgctgtgtcctggtgagcagcccgaccaataaacctgcttttc

SEQ ID NO: 37063 - DNA, 20800 bp, Homo sapiens; identical to SEQ ID NO: 37062

SEQ ID NO: 37064 - DNA, 17877 bp, Homo sapiens
ctttccgcggcattctttgggcgtgagtcatgcaggtttgcagccagccccaaagggggtgtgtgcgcgagcagagcgctataaatacggcgcctcccagtgcccacaacgcggcgtcgccaggaggagcgcgcgggcacagggtgccgctgaccggtgagatgtccccgtcttccctacccttgagcagagccacaccaggacggatgggcgggcaggggatggcagccaggcagagagggatgacacagctcgcagtcacaacccctgcgctttcgacggagcccaggaagccagggaggggaggtggccggagccccatcaccaggcagctgagccaggggccccggcgcaaccgccgcctgagagcacgagctccaaccacaattctgtggtgggggggtaaatagaacagatataatgatcatcctttcgcaaagatggggaaactgagacctggagacctgccgcgttgcgggagacccaggctagcaggtgacagagctggcctgcaccgagctccttcctgcagcatatcctctgcgaagatgcggatctctcagttgtggctttcggcttgcatgcatgagtcatctagttttcttctaaattctctagctctctggacactgttgcctgtaagtatgaggctgcggatttcagtatatgctgcaaccaccgaaatccgactttttctgcctcctaatgcatctgaggtgcatcagagaaaagtcacacaagatccaccaggcctcagacctctgattccacagtctcattttacagatgataatctgaggcctggagaggtttaggactggtgccaacactaaacagcaaataagtatcagaattgggattcgagccaaagcctcttgaccttccagaatttctggacctagttaaaaaaaatatgatttttattattattttttaaacggagaggttaggaatttaaaggaaagtacagatactatataaaaaaagatgcccatgaaaatgttaagttataataatagtggagcattgggcacaactgaaatggccaatcttgtgagaatggtaaaataaacttaggtccgtgagtaagtggagtattacatagccataaaagtatgcccttaaagaatatttgaagatggtgaatgtgaagaatcttgtataaactgcatggaagacagaaggaaatataccacagtgctaacctttgcctctgggtgatatgaattaccggtgattatttttcttattttccttttggtttagttttctccatttgaagaagcagataggagccggggctttgggattgaaaccctcaccatctgtgtgccctcttcactgtcttcccatcctccccacggctccctgttcacagtcattgattttctttctttcttttctctctttttttttttttttcctgagaccaagtctcactctgttgcccaggctggagtagagtagcgccatctcggctcactgcaacctccgccatccgggttcaagcagttctcatgcctcagcctctgagtagctgggactacaggcgcatgctgctacatccggctaatttttgtatttttagtagagacatggtttcaccaccttggccaggctggtctcgaactcctgatctcaagtaatccgcctgtcttggcctcccaaagtgctggggtgacaggtgtgaatcaatgcgccctgccaggtcattgattttcttaagcctccagccctgccctgcttggaaacgttttgggaagctgctcagttcaaagttcccaggagggtgtgcctggaggggagttgctcccaaagtctgcctgctccccccgccccccctgccccccaccccccgccatcttctcctcctcctcttcccctgagcagcccctttgtccacagaaccggccttttctggtagaaggagcaaggccaagtggtttaagccttcttagggagaatgaggctgtgtggtagtgctggggactcgagggccttggccttggcatggctcttccacccagggcagctggcagccaggctcccaggaggcagaggagatgaggggggaggtgagtccgagcaaaggaaaggaggtcggctgtgcagtcacggttctagaacattccttggatcagcagcatccatatcacctgcagactggctggaaaagcagtctcagaaccaacattataaccagccctgcagtgattcataagtactttaaaaagtggtcaatcatttcagcaaagcagagccacacagtccgggggaccacaggtggcctctgtgtgcttgtctcggttttcctgcccctctccagacatgttgattagacactgccaatgcccagcctcagacctcagtctaatttggaagtagtcagaatttactatgattacataagaccctcgtgtttacagaacacattcccctctctgaggtctggattagatccattttacagatgaagaaactgaggctcagatatttaagtgacttggaatcaaggaaagaatactggactaggggtcgggagggctgggctctcatcccagggttaccatgagcatgctgtggactctagggagtcccatgccctctctgggcttcagcctcaccgctagggtagagaggttgggtgagagaacgacctccttcccaggtctgagctggatggttcaccagggaccccaggctccctggagcagactctgtgcccgctgctgagtctggaattcctttcctgtatcttgcctttggctgccccattcttcatggcccagcaccctgtcttctggtcagaacctagttctgaatgggtttttccagaagttgttgctttcaggggcccctggcagagaggtgtttctggctggctttgtctctctggcatgacaaaggctctgttcctgctggaggcatttcagggctcagtgggcagctggggcagagcccgtgagaccacagccttcctggtgagcccggtctccgccccctaccccatctctggggaaggcgctgaccccatctcttctcccacgctgctccctggctctttgcgcctgattacttctcatgagaggcactccttgttaatgtgctactgagtgtccagatgggcctgctgggctgagcgggctttggatgtgaaccatttcaggaaggggaaccccatcgtcctgttggttctgtgatggcaaatgggtgagctcagataagcagttcttgggaggggcatggtgggggtggagtgcagggggaggggtttctgttttatgcaacagcctcagcttctgggaaagggtccattgtgtaagaccggggctatggcctgtgccccgtggctcagggcagccagcccagtggtggcaggaacactggcagggcagcctgctgtcggcttagaggggatgggcagtgtggagggcctggcagagcaagaggactcatccttccaaagggactttctctgggaagcctgctcctcgggccactgcgaaccctctctactctccgaagggaattgtccttcctggcttccactacttccacccctgaatgcacaggcagcccggcccaagtctcccactagggatgcagatggattcggtgtgaagggctggctgctgttgcctccggctcttgaaagtcaagttcaggtggtgctgagactccctgggggctgcagcgctgtggtgaatggggagcgtctgctggggtgaaggtttaggtgcacattgcagaggacgtggctggtctctgggatgcagtccctctgtggaggtggcatggggagggacggatgcatgacctaaggggggtattttcagtgtctgacatgatcgataccactctggacaaggaggccaggatgcagaaagcctgtgtgcctcgctgattgtcggggaggatgtggcttggacaagagcctggttcctccgatgccagggttcttgtttcttccactcaacattgctgtcctgcagtccctccctccctgcacctcctgccttcgctttcattcgaggtgtccatggcaagtctggtcatttccccccatttcctcaggaataaaagtgcagcagtgcctgctgtggggacagctgagggcagtgaggccctggggagctgctgcaggcagcaggtgggcgggacgccagcaggctgtctagctgttcccatgatggtctcctgttctctgcagaggcgtgcaaagactccagaattggaggcatgatgaagactctgctgctgtttgtggggctgctgctgacctgggagagtgggcaggtcctgggggaccagacggtctcagacaatgagctccagggtgagtagaccaagcatgatgttcctctggccacagggtgatgaggtcagagggcagggtagctaattctgctcagtgcctctctatcaggccccagtgttacagaccgtttttatcttgtgcactgggtctgggtgcctgtgtctgggcccactctgagcctcagctccgaggcccctggttcaggctctgcgtgcatcagactgccggcatttgcaggcatttcccaagcactttcggctgttgcatttcattcagctcttcccctcccaggccccttagcccagctcccaggcctcctccacgaagctgtgtctggaccaccggagctcttatccctctcccctttggagtgcccagagcttatccctcctgtgagctgacggtttctgcaggatcattgttaaaaacccagatcagacatgggtgtgagtctgtttcacctcttctcagctgggtgactttgggccactatcttgatctcatgacactccccccaccccccattttattgagatataattaacaaataaaaattgtgtatatttaaggtatatgacgtgatgttttgaaatgcacatacattgaaatgatgaccactttttatggtgggacggtgggaagacttaaaatctactttcttagcaaatttccagttatgatatggtgttattaactataagcaccacctgtatgttagacctccagaacatactcctcctacctgatgaacactttgaccctttatcatatcacacttcccatgtctccctctgcgaagtgggcacggcggggggctggagcattatgtaaactgcacatgaagtgtttggcgcagtgcttggcatgggataaacaccagtgaagtagcacttaggtgacacagtgtttcgctgcatttgtcaccagtgctataccttactcatttactcatcttcttattcctgtcgcctggcactgcattggaacaaagaaatacacatatctgtttaaactgaactctagaaagatttgtgtccaaaataacaatattttatattttgatgctgcaaagctgacacttctgggtttttttttttccttgccaagtttcttctgcacccagctcattctccaggggcacatggcagtggctgggcataactctgggtgtgccggctcccatggtctgcatttctaagcagtagggtgcagtcagcaaggagcctgtgatgggagcctgtgccagggcaaggctggggccatgctgctgcctgctggcaggagtgggggtcccagccttgacagcccctgaactgaacgggcctttctggccatccagctcattccagggtcctgaggccacctcttcctctcgcctcattctgcctcttgcacttctcttgcagaaatgtccaatcagggaagtaagtacgtcaataaggaaattcaaaatgctgtcaacggggtgaaacagataaagactctcatagaaaaaacaaacgaagagcgcaagacactgctcagcaacctagaagaagccaagaagaagaaagaggtcaggaggagccgctaccgcctccctgccttgaccatcccactggaggggagggagggggtcactgcgcggtgccctgctgggttgccatggtgacccgcagtcctcccaggctgtgtcagctgatgctgaggctgcaattaagaagcagggaaggttcatttgcttctgaaagcatcagggagtgagatcttggatctggttttgttatgagcctggcccagggcctaatgcccagattcatttcaatagatgtttctaagccctgatcacatgctagttccaagcaggctctggatggggtggcggcaggggcccagacaggcgtggcgtccaaccttcaggaagcttatctaataggggtgatatggttagggttaaggcaggcacacagcaccccacgtcttgctagagttctggactacttcataaagaaacatcttaagcccagtagtggatatagcaggtctagcctgtgcttaatgattcaacaaaactaaaacactataattcaatgaacaacttatttaagaaatcaagtctccttaagagtatcctacaaacctcctctcacggtcgccctacttcagatgctaagatgtagctacctgcaagcttcatgatccatcgtgcatgttaaaagcatttcaaaggctctgagaagttctgccgtaaagaaacctgtgtaactccatgaaacccagagttttccaaactgaccagggaattcatttttgtttttgtttttttttcctggccgctttgagcacagctccataggagccacttcagggattgctggcctggatgtggctctacctttttttcaagtttcatgccctttcttggccttagtatcagttctcaccattctatgagaatcctcaaatagctcctggggaaggggcatgacttgttctcacatttttgtggttatcactggagtttgacattcaacaattctggttttataataaagcacatcacatacatttggagaaaagagcctgctacttcttagttgaggagtaggtgagccagaaggcaaggaagtaggtagcaggggtggcgcttgtgtcttggctcagtgggaggtgggttgtccttgcccagcaggggacaggggatgatggagcaggacaaagacctcacctaactctggggtgtggataggctatttttttttttttgaagactaacacactcattcatagagactttaatatagaaaagtagaaaaggaaaagtttttccataatccttttgcccaaggacaagtcactgttaacatttgatctatttttcctattattttcttctatgcttttttgacagtggctatatttaaaattatgaatttttaacatataatattcaaaatggactataaacatcctttgtaatgatgtaccatctaccctttatatgaaccatagtttgtttaatctgtctcttttaagcatctgggttggttctgatttttttttttttgccataagctaatactgtttcaaatatttttaagtatctttttctttgtcaggggattcctttgagatagagtctttgttttgttttgttttgttttgttttgtttttttgagacagagtcttgctctgtcacccaggctggagtgcagtggtttgatcttggttcactacaacctccgcctcccaggttcaagcgattctcctgcctcagcatcccaagtagctgggagtgcaggtgtgcaccaccacaccagctaatttttgtatttttagtagagatggagtttcaccatgttagccaggctggtctcaaactcctgaccccaagtaatatgcctgcctcggcctcccaaagtgctgggattacaggtgtcagctgccgcacctggcctgagacagattcttacagaattattgggtcaagtggcaagggcccgttagagaattttgatagctggtgtggctttggtgctgaatgcctgccattccctttgcacgccaggaggcatggttgcaatagaaaggtaagattcagggagtctgcagcctgctttggaagatgaaatttaaacaccagaagcagagaataggaaatgaggcttcagtgagagggtagtcattgagtaggtgatcagagagagaggtggtgtccacatgggttccaggagttgggaagcttctaggagttagggaacagttggatcttgaaggatgagtggattctttaagccaggtgggaaggggattccaggtgggcgaatgaggggaagcttgaactggagcaagggtaggcacttgcatgctgggtggccagcctatgggaaggcctgccctggggcagagggcctggcacccagcagctctttgagtgcatgagcctgtggtctctgtgtggctcagccagccttgtgtcttcctgtaggatgccctaaatgagaccagggaatcagagacaaagctgaaggagctcccaggagtgtgcaatgagaccatgatggccctctgggaagagtgtaagccctgcctgaaacagacctgcatgaagttctacgcacgcgtctgcagaagtggctcaggcctggttggccgccaggtgaaaaggggacacatgagtggccaaggctctgagtggggaaggaggggagcctagtgaaatatgcttcattccgcatgccagatgcaattgattagcattggctggcttgcccagagtgccatgctccattggtaatgtctggcatgagtagagagagtggagtcatcaaaaggatgtaggccaggtatctgccttctcttagaaaactcatgcagcagtgcttagctggatgacataataaactgcttcgtgggatggcagagccctgtgtccacttatgtggaaggatttaagaatttttttttttttttgagacagggtctcactctgtcacccaggctggagtacagtgatgtgatcatgtttcactgcagcttcgacctcctgggttcaggtgatcctcccacctcagcctcccaagtagctgggactacaggcacgtaccaccacacccagctaatttttgtattttttttttgtaaacatggggtttggccatgttgcccaggctggtctcaaactcctaagctcaagtaatcctcctaccttggcctcccaaattgttgggattatagatgtgtgccactatgcccagccaatgtaagattttgtagtatattagtgttgctcctgtcctctgctgcagggcttttttgattgggactcagtgaattgctccaatccctgaagtcacatcagttggcccttagccgagcgggggtggatatcattggtggccaaagatgacagtgaatgaacctgaaatgttgggccttgtgacttttggggcctcccaggtgtctcaaaactgtcccccatggagggagataaaaggaaagagcatggacctgacagatggggtgctgggggctggtcccagctgggctgttggtcacttgctgtgtgactgttacagccatgggcagggcctggcctggctcaccagggggtgggaggccaggaggccgtggccttggtgagcttctcctaactgtgcccatgctggctgtcccagcttgaggagttcctgaaccagagctcgcccttctacttctggatgaatggtgaccgcatcgactccctgctggagaacgaccggcagcagacgcacatgctggatgtcatgcaggaccacttcagccgcgcgtccagcatcatagacgagctcttccaggacaggttcttcacccgggagccccaggatacctaccactacctgcccttcagcctgccccaccggaggcctcacttcttctttcccaagtcccgcatcgtccgcagcttgatgcccttctctccgtacgagcccctgaacttccacgccatgttccagcccttccttgagatgatacacgaggctcagcaggccatggacatccacttccatagcccggccttccagcacccgccaacagaattcatacgaggtgagaaggggtggaagctcatggccttttgagcaactcgttagatgctgagaaccatgccgagggctcagcgggtgtcatctcgatttttctccagcaatatcacaagggtgatattatccttatttaaagaggaaaaaaactgagctgggcatggtggctcatgcctgtgatgccagcactttgagaggccaaggcgggaggatcatttgaggccaggagtttgagaccagcctggccaagatagtgagaccctgtctctacaaaaataaaaacttaaaaaattagccgggtgtggtggtgcacacctgtagtctcagctactcgggaggctgaggcaagagagtcacctgagcctggaagttggaggctgcagtgagctatgattgcaccattgcattccagcctgggcaacagagtgagaccctgtctgtaaattaaaaaataaataaaaataacaataggaatcagtggagtccatctctgcatggctggatgactgactcttcttccctcgtgtgtccccagaaggcgacgatgaccggactgtgtgccgggagatccgccacaactccacgggctgcctgcggatgaaggaccagtgtgacaagtgccgggagatcttgtctgtgggtgagtcggggtccagaccacaagccgtcccccctgatcccttgtgtcctggggtcactggggcctcactggtgctgcctttatggagtcagacagataagcgtttggattccagctctgcagcctttgagctgtgtcccggggcaggtcctgagcctcatgcagcttcggttcctcatcttagaatgagatgatgatgcgaggctgtccctgaagtcggtgagatgtcgttagagatgcaaaagtgccctccacctggtcggccccatgttgaaaaaagcttgttgaaaaaagtcatccccctgggactccccggtgattctgttcccaagcgccaagcgcagtaggcatcttcattttcctctgcagattatgacattgcagacagtatgtgttttgtttaacaaaactgaccagaggccaggcactgttctaaacactcgacatacatttcctcatttcctcagaatgaccctctgaggaaactgagccacagaaaggttaataacttatccaagattgaccccgacatgggcgagctgggcttcaatcctagggcgctgtgttctctcctggggcccctcgcagcctctggccacagaagtcacgggtctcagtacctgggcatccaagcaatagtccctttggtcggttggttggtcccctaggcaaagggaatatttccctttaactgtccccctccgtttcaccagctctggttatgggttaacttctttccacttagagataacagctgtgacagtatttggactagttcctggtacacagcagttcatactcacaaagagttaattgtttccccttgtcaacagcttatcgatctggtggctttgctcttacttaatgcttagtttgagtttgccatggcaggccgccagggtctagttaaacattcctagcctcactcctataattttagaagccactgcaaaataaacagttgtgctttaacaggctgaagtataagttgctgtagatgagtgcacaaccaggccttggggctttttctataaaaaatatcatagagtggcatcaattacatggtacctcaccacaagaaagtcatgttagggtctgagaaaagatgtccagatgcctgtgcccagattggacctcttatgctgatttttactctgttgcccaggctgggctcaggtctggcgccaatcttaacagtcattgattacagttgagagtgcagccagcgccagtcttatcagtcattgattatagctggcgtacagtggctctatctcggctcactgcgacctccgcctcctgggttcaagtgattctcctgcctcagcctcccaagtagctgggagtgcaggtgtgcaccaccacacccagctaatttttgtatttttagtagagacagcatttcactatgttggccaggctggtcttgaactcctgacctcaagtaatctgcccgcctcggcctcccaaagttctgggattacaggtgtgagccactgtgcctgacctgagatagattcttagagaattattggtaagaataattctctaagctgagctaaatagtctacactgaagaggactgcctactgttatttaaggtgcttgcaaccatataagcacgtactgcctgggaactctagatgaggatttctcaatttcagcgctgttgatttttttttttttttttgagacagggtctctctctatcacccagcctggagtgcagtggcaccattacagctcactgcagcctagacctcttgggctgaagtcatcctcctgcctcagcctcctgagtaacagactacaggtgtgctccaccatgcttggctaatttttttatttttagtagagatggggtcttgctacattgcccaagctggtctctaactcctgggctcaagtgatcctcctacctcagcctcccagagtgctgggattacaggtgtgagcagtgctgacattttggaccaggtcattctttgtcgttgggggctgtcctgagcagttcagggtgtttggcagcattcctggcctctgcccactagaggtcagcagctcccttccctttgttgtgacaaccagcttcagaacttgctaaatctccctgggtgacagcgtcaccccagtagagaacctctattctagactaagcctcagctctcaaggatttttcttattttattattatttttttaagacagggtctcgctctatcacccaggctggagcgtagtggcgcaatctttgctcactgcaacctctgcttcctgggttcaagcgattctcctgccccagcctcctgagtagctgggattacaggcgtgcaccgccacgcctggctaatttttatatttttagtagagacagggtttcaccatattggccaggctggtctcaaactcttgacctcaagtgatcagcctgcctcagcctcccaaagtgctgggattacaggtgtgagctagtttttcttatttttaaatttttttttggtaaaataatgaagtttatttattacatatttattttcaaactggcatcttgttagtaattctgtttctttccccacctaacattttgtttactataaatgattgcagtcatcatcctaaagcatatgcaaaatctcccttcccctgactcacgtttgatgtacctgcctctggatatttttgaaataccttagggggagaaaaacagtagttttaagagctagtggacagtttccaggtcttaatgaatctgacaacctgcagcccagggccaagaggaatgaattctcttttccctgctctcttgatgaactcactgaccagccatgggcgggcaggtgggcaggcaaggacccctggccaccaggtgccagtgcatcagctgcatgaactcctggcaccagaactgccacctctacagacatgctcaaaagacaagtttggaccgggtgcattggctcacacctgtaatcccagcaccttgagaggccgaggtgggtggacccctgaggtcaggagtttgagaccagcctagccaacatggtgaaaccctgtctctcctaaaaatacaaaaaaatcacccgggggtggtggcaggcacctgtaatcccaactactctggaggctgaggcaggagaattgcttgaacccgggaggtggaggttgcagtgagctgagctcgcgccattgcactccagcctgggaaacaagagcgaaattctgtctcaaaaaaaagacaagcttggaggattgtccagaaccacagatccagggtaggaaaagcccaagcttaggagctgaagaccctggttcaatcccgggcccagagatcatttattctatggctttaggtaagctatttattgatacttctgtgggcctcagtttcattattggtaaaaattatttcattattggtaaaattaggacttaagtcctaatccttaagtcagaacagatccaattcttagagaaaaaggatatccagagagaactttctgcggtgtctgggacgaaggcagtgccacacgaatggcagctgtgagtaatattcctcctctctggaaatgattcccgggagggactagggcaacgagagccactccaggtctgagaacatggagaacttgagatcagtgcttttggaagtgtggtcaacacagtttgtcaccaaagagataagggtctggcacccaaagataaatcaatgatgttacgaagcacactgtttaggtcagttggcgtatttttccagagcaaggcttctcaggctgggcgtggtggctcacaccagtaatcccagcactttttgggcagatgggttgagcccaggagttcgagaccagcctggacaacacagagaaaccccgtgtctacaaaaaatacaaaaattagctgggcatggtagcatgtgcctatagtcccagctactcaggaggctgaggttggaggacagcctgagcctgggaagtcaaggctgcagtgagccgagatctcaccactgtattccagcctaggcaacagagcaaaactctgtctcaaaaaaacaaaaacaaaaacaaaaaacccaaaagactttctggatgacggaagcagtgtctagattcacattctgaggcaaaacctttattttgtcgtggacaattccagtttgtggcccttcccttagggaagcactgcttttgttcccgctgcatgtgctaacttccattcattcatggttctatccctttgtagccttcccttcacacttctcacttgcgtttcttccatctctgggcagactgttccaccaacaacccctcccaggctaagctgcggcgggagctcgacgaatccctccaggtcgctgagaggttgaccaggaaatacaacgagctgctaaagtcctaccagtggaagatgctcaacacctcctccttgctggagcagctgaacgagcagtttaactgggtgtcccggctggcaaacctcacgcaaggcgaagaccagtactatctgcgggtcaccacggtgagctgtgtcccggccacatgctgtggctcgggagcccgagctgtgatcgggagcaggggcatgtgtgcttttgactgagcatttatcacacggcagaaaatagaaaactttaggcgcccctgttgccttgaagcctcatcacccactcagggaaaatataaccctgctttacaaaggagcaaagtaagagaggttccacagcttggccaaggtgtgatagctgacagatgacttggacgggtatttgaacctgactgcctggctgccaagcctgtattttgttgttgttgtttttgttttggtgcacaaatctgtgaataaaccagaagcctctgttcttttctcaaagctacaaggctgccctctggcatgtaaaatggcttatgaattagtacatcactctctgccagtgataaaaacttctctctaggccagacatggtggctcatgcctgtaatcccagcactttgggaggcagaggcaagaggattgcttgaggccaggaatttgagaccagcctgggcaacacagcaagattccctctctacaaaaaatacaaaaatcagtcaggtgtggtggcacacacttgtagtcccagctattcaggaggctgaggtgggaggattgcctgagccctgaagtggaggctgcagtgagctgtgatcacgccactgcactccagcctgggtgacagagtgagactctgtctcttaaaaaatatatatatataaaataataaaataaagttaaaaaatcaaataaaacttatttctagtactgggaactcttctttttcttttctttcttccctccaggccctctggattccttttctaccctactctgaccaagggctgcttctaaagcaaatgtttggaaaccacttttattctttggggtgctccctgggctggtcatttgcagatgacatttgccccaacacatgagtgtctgtgaaccaggtccgttctgtccactgagctgtacttacgtctagatgtataagaagcatggggtcagctctctaggtttccttggagaagcaggaggacttccttatcagaagcctgacttctgttgcagagcgcatgcattttgaccacagtgtttcagctcttcccttttctcttgttccatttaggtggcttcccacacttctgactcggacgttccttccggtgtcactgaggtggtcgtgaagctctttgactctgatcccatcactgtgacggtccctgtagaagtctccaggaagaaccctaaatttatggagaccgtggcggagaaagcgctgcaggaataccgcaaaaagcaccggtaagcaggcgggcctttcctgcgggcctgcagggcccagtgagtctctgggagccacaaaaaaacaaacaaagtgcagactctatagcctggtgggaacgactccgcccggagccagagcccaagaacaaagccaggaagttacgggggaattttatttttcctttggaggatgttttactttggaggataactgttttttatttcagggaggagtgagatgtggatgttgcttttgcacctacgggggcatctgagtccagctccccccaagatgagctgcagccccccagagagagctctgcacgtcaccaagtaaccaggccccagcctccaggcccccaactccgcccagcctctccccgctctggatcctgcactctaacactcgactctgctgctcatgggaagaacagaattgctcctgcatgcaactaattcaataaaactgtcttgtgagctgatcgcttggagggtcctctttttatgttgagttgctgcttcccggcatgccttcattttgctatggggggcaggcaggggggatggaaaataagtagaaacaaaaaagcagtggctaagatggtatagggactgtcataccagtgaagaataaaagggtgaagaataaaagggatatgatgacaaggttgatccacttcaagaattgcttgctttcaggaagagagatgtgtttcaacaagccaactaaaatatattgctgcaaatggaagcttttctgttctattataaaactgtcgatgtattctgaccaaggtgcgacaatctcctaaaggaatacactgaaagttaaggagaagaatcagtaagtgtaaggtgtacttggtattataatgcataattgatgttttcgttatgaaaacatttggtgcccagaagtccaaattatcagttttatttgtaagagctattgcttttgcagcggttttatttgtaaaagctgttgatttcgagttgtaagagctcagcatcccaggggcatcttcttgactgtggcatttcctgtccaccgccggtttatatgatcttcatacctttccctggaccacaggcgtttctcggcttttagtctgaaccatagctgggctgcagtaccctacgctgccagcaggtggccatgactacccgtggtaccaatctcagtcttaaagctcaggcttttcgttcattaacattctctgatagaattctggtcatcagatgtactgcaatggaacaaaactcatctggctgcatcccaggtgtgtagcaaagtccacatgtaaatttatagcttagaatattcttaagtcactgtcccttgtctctctttgaagttataaacaacaaacttaaagcttagcttatgtccaaggtaagtattttagcatggctgtcaaggaaattcagagtaaagtcagtgtgattcacttaatgatatacattaattagaattatggggtcagaggtatttgcttaagtgatcataattgtaaagtatatgtcacattgtcacattaatgtca

SEQ ID NO: 37065 - DNA, 17877 bp, Homo sapiens; identical to SEQ ID NO: 37064

SEQ ID NO: 37066 - DNA, 7444 bp, Homo sapiens
attcctcgttagggcaggcgcggccccttcggctccgagctgaccctgatcagggccgagttgtctcggcggcgctgccgaggcctccacccaggacagtccccctccccgggcctctctcctcttgcctacgagtcccctctcctcgtaggcctctcggatctgatatcgtggggtgaggtgagcaggcccggggagggtggttaccgctgaggagctgcagtctctgtcaaggtgagtgggactgcgcgggagttgaccgccaggtgcgggtggggagctgggttgggggcgcggggcgaggagtaggtctggcccgcgcccttttccacactaaactctaccgctgttgtgagcacaagcccaggctagtccgaggctggaggggcggagccggatccggcctcctgaggtgcctttcgtgtctgccgacccagtcccagggactagcctggggaggaagaatggaacccctgcagttagaggttcctcacatgactagctctgaagacctcctgccttcctgtctttagttggtgtgggagggaccttccatgtatccagggcttagcttgtgcccgggacatggttgtgttatgcacacttaaatcaatggaattcccaggttcatctttcagactaggttagcaacaacccaccgcacccccccgccccaatacgtgctcctaatgtcaccttttaagtttcctttcctaacaacaataaaagttaagtaatattgagtattgtgtgccaagcactgtgctatactctttaagtggtgaatcatcttgttcagtcttcacattcagcgacagatattgttaccctcattttataaatctagaaagaagctcaagctcattattattgttcagtgttttttaagcgtctactgtatgtgctaagctctttacgtgatttcattttaactcacaaatctgtgaggtaggtcataaaccttatccctactttatcaatgtggaactaagtacaattaagtaacttgaacagttcattttgttaatatgtggcagaatacttaactaccatctgcttttcactttcggtatcctgtcttacggtgtttattcgtggttatctattgacagtgaataacttgaacaagtatttcttgaagatttgcattttatttttctaaaaagcatggttccgaccgggcgcggtggctcacgcctgtaatcccggcactttggaaggccgaggcgggcagatcacaaggccaggagaccgagaccatcctggccaacatggtgaaaccccgtctctactaaaaatataaaaattagctgggcgcggtggcgcatgcctgtaatcccagctcctcgggaggctgaggcaggagaatcgcttgaaccagggagtcggaggttgcagtgagccaagatcgtgccactgtactccagcctggcaacagagcgagactccttctcaaaaaaaaaaaaaaaaagcatggttccttccctctaggaactcaatttaggatgtgaccaacttgtagaagggaaataaataacagatggcactttgcaatgacttagatgcactagccgcattgggggatgggaggcttataaatcatttcttggcccagtgcaaagatggccaaggaaagcaggaaggactactcttacactccttgctggtctttttttctatatatagatgatagaggtactgacaacaactgactctcagaaactgctacaccagctgaatgccctgttggaacaggagtctagatgtcagccaaaggtctgtggtttgagactaattgagtctgcacacgataatggcctcagaatgactgcaagactaagggactttgaagtaaaagatcttcttagtctaactcagttctttggctttgacacagagacattttctctagctgtgaatttactggacagattcctgtctaaaatgaaggtatgtttgaagctacatttttgtaattttgctcagtgtgttttggagatggaattgttaccttttggctggtattcataaacttgaccttttttttttcagcacgtagccaaaacattaattttgtctactacagcattaatatttcttatcataatcaagagtagtacatcaggtattagacttaaattctgaaatgaaaaatagtctaatatcaagtaacaaattgcagtttcctagtaagaaaattggctgtttttaaaaaacccttcttgataggttggatttgtccatttatttactatttttagatataaacaaatttattagtggcagaaatttattagaggctacattgtggctaagaattaagatatatttgttaatcactacccatatataaaattgtaaatgttttagccttagacctagtcaagacttgcttatgcttggcatttccagcttcagtgtacatgcagtagggaggagagtgtgtctgaaggaggagcaactattttcctatactagataaacaagactgtcactttcagagcttaactgttacaaatgcatctgcctttcctgtacacccatggtcactggaggaaaataagatgatgtgacaattggaaggaaactcatattttagtcctcggtatctaacacagtgcatcataaaaaaggacttcaatatttgttgaagattcaagaaatttgcttcaacagactaattaagctctttagacatttcacatgtagtcattacctttgaatctgtaaatgttgcacaaatgaataatatacagctattcctcaggtataattcagtcttatgtgagaataagatcgttgctcttatgtacaagtcataataagaaaaataactacattatgcctttaaagaggcataagtgtactgctgaagagtttacaagaagagagagagcacagagatattaatactggtaaaagcttagtttcatgtgagctggaagtaaactggataaagttttgactgtgtctcatacggcagacattcagaaaattaaatgataaagattagtagtggatagaactcttagaggcagagtaaacagtatatgccatagtattttaaaactgttttatatgtgttcccacaaagacaagagcctggaaaaaatacaacatcctgcaaagaaatggcttattttgtaaataagccataaagtatttcagtcctcatatatctttgactagttaacttatttgatcaaactagaacaatgtttacttatagttctacagtgattaataaaaacacactttttctatgctgagccaaacattatactgaaactcagtccagttactcaaaaattggttctaagtggggtccatagtgttgacaggctatagtttaggtatgagtggattgtgttaagtccatcacagctgagaaataaacctcaaatatacattttcaaaatgttgggtcggagttctagattatcctttatgttttaattgaaataaggtagagtcatgggcttactggttttgtttttgattttttaggtacagcccaagcaccttgggtgtgttggactgagctgcttttatttggctgtaaaatcaatagaagaggaaaggaatgtcccattggcaactgacttgatccgaataagtcaatataggtttacggtttcagacttgatgagaatggaaaagattgtattggagaaggtgtgttggaaagtcaaagctactactgcctttcaatttctgcaactgtattattcactccttcaagagaacttgccacttgaaaggtaagtgacctttgttttgaacaagagacatttggaaatcagaatggtattgtatggatattgcataaaatcagtatcctcatagaattctaataaaaataagtaaaatgacagctgtggctccttgaactttaatgtccatcataagtgagaaaatgttccattgtcaatagcttcgttaaagctaattcttgggattaaagtacattttgactttatagaacctagtaggaaagcatctaacacaaatttatggaaaaaaaggaccttcagtggatgttgaaatatttattaaaactaaaagaaaataaatcttgtatttgtggcatagtactattcattttaattttttggcccaaatcatctaaaactcccatatggtgcctttagaagttagtatctctgatggaaggggaattcctttcaatagttcatttgctatgttaagtgtgcataagctttactttaaaaattgacttcaatgtttttctaaaaacatcttttgactagatgtagtattacctaataaaagtaataccattttctttttaaaggagaaatagcattaattttgaaagactagaagctcaactgaaggcatgtcattgcaggatcatattttctaaagcaaaggtaaatattttataaagattatgcctattgatatgatctgtttttatatttggcatttactttaaatttatctcttttagccttctgtgttggcattgtctatcattgcattagagatccaagcacagaagtgtgtagagttaacagaaggaatagaatgtcttcagaaacattccaaggtatgtgaaggacatagcctaaatcctattaacagctgtaaaagaaactaaaccccttctatctcctgaagtaaaatgagatgtcatatgtttatttgaaacttaagtagctatcctcaaatgtttttaatgagcaaagacacatgttcataggattgcatttattaatgtagttaaataaggtgggacttacttggagtaataattttttaaaatttatgtatgtacagataaatggcagagatctgaccttctggcaagagcttgtatccaaatgtttaactgaatattcatcaaataagtgttccaaaccaaatgttcagaagttgaaatggattgtttctgggcgtactgcacggcaattgaagcatagctactacagaataactcaccttccaacaattcctgaaatggtcccttaactggtaaatttggtccgttattattctccagatagagaacattttccaatgccataattttcaactaaagaagagtaattatcttcaaaataaacaaaatggagttggaatagtaaagggggagatgacatcactgatctagtcagctaatatttgaaggcctttactatatacaaggtacaacatcttaggagtaaggaattatccaacctctgatacatacgttagccatttcattaaattttcagcttagagaacagcatcctccttgtagcactaaaatcatgcttttttttaattgcacatgatcttgctgtatgtatctgactgatttaaaattacataagctgagcaggacaacagcaccaaaagtctgaaccaagtatgaactaatttgagactgttagcttataagcaaaatcaatatgaacttggatattgtacttaaaagaaaaaaaagtaggccggatgcagtggctcacgcctgtaatcccagcactttgggaggccaaggcgggcggatcacgaggtcaggagatcgagaccatcctggccaacatggtgaaaccccgtctctgctaaaaaatacaaaaaaatttagccagtcgcggtggcgggcgcctgtagtcccagctactcgggaggctgaggcaggagaatggcgggaacccgggaggcggagtttgcagtgagctgagatcgcgccactacactccagcctgggcgacagagcaagactccgccacaaaaaaaaaaaaaaaaagaaaaaaagtaggatatgatagatggtctctacattgggtatctggaaactgccagagtgtgtcaacactatactaacctatcattgctatagcagctggactactgcaaagtagttatatgcataaaaaatgtaaacttgctttctgcatatgtgatatacattcttgccatataaatttcctaactcagtgatgatttattctactcaaaactaaatgttaacatttaatacatctacatgtgattatgaatattagatatgaacatttcaattttcttagtagtatttaggcagactggcttctgttaagttggattttgtttgttttctttatttaaataggattattacagcaccaaaaaacttctctgaagcctttctccacaaccttgttctatggattccataatgttacaatggatttaagctatgaagcctcaaaacatcacgagataagcatgatggtctcagacttgggaaaactgcctaatattatgctgtagtggaattatgtttagatttgaattcatctgtgaagcattcaaatcaaagctaaaagcctaaatgtgaaatgctaatgacaagcctgagaaggtaaactgtgaatcttcatttctatcattgatctaactttagatattggatcaatatatttaggtggtattgaaaatgctattggaggagtcacactaatactatcaactatcagtcttcccacagcttcaatcactgtcattattctaatcctactcctacttaaattttaagttatgaggtttatgtcaaaagcaacatttcacaaatgtacttttaaggcataataagggttaacattctaggcagtataaacacaccccataatgcaagtaataggtaatctagagatgtggactttattgctatatgggaattacatttaaatttgagggcattttatataaagaaaaatacagacctataaagtttggcatattcattaagttatcttttaatatttttttctagaaaacaggtgacatttgtatctacgataaaaatttttatacagaacctactgcctcaaactgaatcccatcaagaaaactagtttctattgtattagtaactcaaaataaattatcacttcgaaaacttgctttcccacactaaggtaagttcagactagattgaacactccagaattttttactacagactgtttttaagttagaagtgatggcaattttataaatagagaatatacttccactgatgcccttactgtgccaaaacaaaaatcttaagaaaagcaagtagacaccttcataactatgaatgaagctgctgaagtagtgtttaggatcctccatggcagttagtgaatgtaagaagtacagtgttaaagtgttgtaaacagttactcagtgcaatgtatagcctgagtctatccatgatggctatatccaatttgacatcacgttatggatcagtacacaatgaaaaaccaaagaaccacagtatatcttattcttaacttttgtaaaccatgttttatgggtaactttttagttttcccaaaaggctgataaatttcaatattttgaatacatcattgttaattttgagttggcagaggtaaactaaccaactaccattatgttttagtactaagggatatacctttcaataaagttaatgaaattc

SEQ ID NO: 37067 - DNA, 9050 bp, Homo sapiens
ctttctgcccacactagacatggcgcttgccagcgtgttggagagaccgctaccggtgaaccagcgcgggtttttcggacttgggggtcgtgcagatctgctggatctaggtccagggagtctcagtgatggtctgagcctggccgcgccaggctggggtgtcccagaagagccaggaatcgaaatgcttcatggaacaaccaccctggccttcaaggtgtggagccagcccccttgccaggctgagtactgaacgcccgcgacttgcctggcctcccagcctgaccggagtttgcggtggccttggccaccaacccaggcggaggctgggtcctctcgttcggaccgcagcagttttgctgtctcattggcccaggaggcccctgtctttgctctggttggaaagggtggcggtggggccgggggtaagtcgggggaggaaggtgaggcctcttgggttgattcctaggcgaccccaggttgctgctgttcaggatcttctagctgggaaaggccgcaacaacaatgaatcttggccgagggaaggctattgtaaacgtttaccaaagttttggaaactgggcggcccctcaaggcaggggtaactgaaactggcatgaaggggaagcgtggtgagggtaagcattgtactaagaatcagacatttggggttccttgcccagctctgcaataactagctctagattgagaaatcatttgatttcattgaacctgtttcctcatctataaaatgatttgttttttttttttttttgaaacagggcttttcgctgtcgctcaggctggagtgcagtggctccagcgcctcagcctccagagtagctgacactataggcacacaccaccacgacaggctaagtttttttactttttgtagagatggatctccctgtgttgcccaggctggtctccagcacctggcctcaagcggtcctcccgccttggtctcccaaaatgcctgggttacaggagtgagccaccacgcccatcctataaaatgaatttaatatgggttatatccatgtcaagggattgatgtgaagctcgggtgacattaatatatggtgaagtatagaagtatactgtgaagtataaaaggacggagaaagagatgtgctgggtttggattgatgcaaaaagaagtatgtaggagtgtttttgtggtcttatgtggcctgttttgtgttttcctctgatcttaacagttccgccatggagtcatagttgcagctgactccagggctacagcgggtgcttacattgcctcccagacggtgaagaaggtgatagagatcaacccatacctgctaggcaccatggctgggggcgcagcggattgcagcttctgggaacggctgttggctcggcaatgtcgaatctatgagcttcgaaataaggaacgcatctctgtagcagctgcctccaaactgcttgccaacatggtgtatcagtacaaaggcatggggctgtccatgggcaccatgatctgtggctgggataagagaggccctggtgagttaagctgcaaccacatgatccttgggctgacactacagtgaggaggggttggatggacagatgaattaaagggcttggtgtcaatgctgaagaagtgtaattaggtccttagcccttccttctctctttttttttttcctgtttttttagactgtgtctcattctgtcgctcaggctggagtgcagtggcatgatctcagctcactgcagcctccgcccccaggttcaggaattcaagaccagcctggccaacatggcgaaaccccatctctactaaaaatacaaaaattagcccggcgtggtggcgggcgcctgtaataccagctgctcaggaggctgaggcatgagaattgcttgaacccaggaggtggatgttgcagtgagcagagatcgcgccactgcactccagcctgggcgacagagtgagactctgtctcaaaaaaaagaatttaagaattcgttgaaggccgggcgtggtggctcactcctgtaatcccagcactttgggaggctgagacagtggatcacgaggtcaggagatcgagaccatcctggctaacaaggtgaaaccccgtctctaccaaaaatacaaaaaattagccaggcgtggtggcaggcgcctgtagtcccagctactcaggaggctgaggcaggagaatagtgtgaacccaggaggcggagcttgcagtgagtcgagatggtgccactgcactccagcctgggcaacagagcgagactctgtctcaaaaaaaaaaacaaaaaaaagaattcgttgaatcccacatgtggcagtagtgctatttcaagtgttcattgaccatgtgtggcttgtggctactgtattggactctaatatatggttgtccctcaaaagttagtcatttctcttctgtttttttctttttttctttttttgagatgcaaagtttcactccgatcgtccagtctggcgtgtaatggcattgtttcagctcactacaacctctgcctcctgggttcaagtgattctcctgccgcagtctcccaagtacctgggattacaagcgcccaccagcatgcccagctaattttatatttttagtagagatggggtttcaccatgttggccaggctggtctcgaaatcctgacctcaggtgattcacccgcctcagcctcccaaagtgccaggattaaaggcgtgagccgctgcacccggcctcttctctttttttctttagagagtctttggcctagaaggggccttttgggctcctctcttttttgagggggtggggatggagtctcgctctgtcgccccgactggagtgcagcggcgggatctcagctcactgcaatctctgcctcccaggttcaagtgattctcctgcctcaaccttccatgtagctgagactacaggcatatgccaccatgcgcgtctaatttttgtatttttagtagagacagggtttcaccatgttggccaggctggtcttgaactcctgacctcaggtgatctgcccacctcagcctgccaaagtgttgagattacaggagtgagccattgcgcctagtcctgggctcatttcttttatttctttgctggttataatcacccttacaatcatgctaggtccggttctatcatctctgaaaataagttccttagcctgtttttcctttccagcatttaagaaacttgccagacagttcaactttgtatttaatgtcatttcctcatcagccagttttgaattgcccgtttagtaaagttggagtatagctagtcaccttctaattttcccttccatatgcttaaaaataattattctttcctccttttgattttgcttcattcatttacctgcttactaaatacctagttatcttatagaacaattatagggtacctaccactttttcacttgctttcaaacgagaatagaaagggctgtagggagtatccacttactacccaatggaggatgaaaggaaattaaaaaccggatgtgagagaggagctcactttgttactttggaaattgagatgcttttctctgaaaggtgggaaaagacagttccatacattttacgtgatccagggaagcattttggaaatgttgctttgaacctttagctggcggatttgttctaggtgatggaaacagtgtaaaagagtacagggaccgggtaacaaggaaaatccagggagactgagcatcatttaaacagtgccttcttcaagaggccttcctgatgaccctgtcccattcattgtgagtcagccccttgcctcatattacagttggcccttgagcaacatgggtttgaatcactcaggtccacttatacgcaggtatttttcaacctaattctgattgaaaatacacattcccagaatttgaaacccaaatatacagaggaccaatttatttatttatttatttatttatttttgagatggagttttcctcttgtcacccatgctggagtgcaatggcgcgatctcagttcattgcaacctccacctcctgggttcaagtgatctcctgcctcagcctcccgagtagctgggattacagacacccgccaccctgccagctaacttttgtatttttagtagagacagggtttcaccatgttggccaggctggtcttaaactcctgacctcgggtgatccacctgcctcagcctcccaaagtgctgggtggcgtgagccaccatatctggccaacttttcatatatgcaggttctgcagggccaactttgggacttgagtgtgcatagattttggtatatgcaggggtcttgggacaaatccccttcatataccaaaggatgactagttaacccaaggctgaataagataaataacctttttttttttttattgagacggagtctcgctctgtcgcccaggctggagtgcagtggtgccatctctgctcactgcaagctccgcctcccggattcacgccattctcctgcctcagcctcccgagtagctgggactacaggtgcccgccaccacgcccggctaattttttgtatttttagtagagacggggtttcactgtgttagccaggatggtctcaatctcctgacctcatgatccacccgcctcggcctcccaaagtgctgggattgcaggcgtgagccacagctcctggcctgataaataccgtttttaaaagaaccagttggctgggcatggtggctcatgcctgtaatctcagcactttgggaggccgagatgggtggatcaccggagatcaggagttcgagaccagcctgaccaacatggtggaaccttgtctctactaaaaatacaaaattattgggaggccgaggcgggcggatcacgaggccaggagatcgagaccatcctggctaacacggtgaaaccccatctctactaaaaatacaaaaaattagctgggcgtggtggtggtcgcctgtagtcccagctacttgggaggctgaggcaggagaatggcgtgaacccaggaggtggagcttgcagtgagctgagatcgtgccactgcactccagactgggcaacagagcaagactccatctcaaaaaaaaaaaatacaaaattagccggctgtggtggcacatgcctgtaatcccagctactcagggagatgaggcaggagaatctcttgaaccctggaggtgcatgcctgtaatcccagctactcaggaggctgaggcaggagaatcaatcacttgaacctgggaggcagaggttgcagtaagctgagattgtgccattgcactccagcttgggaaacaagaaagaaactttgtctcaaaaatcagtcagtcaatcaataaataaaaagaaccagtcaaatgcggaaggagttttgaggaggaagagattacttatgatgggaggaattggggaagacttcatggattggtggtggttgtcctggatgtaaaaaagggaaagggaacataacaaagaaagggaggaaagaagcatgagcttttgaggagtaactgaaagtccagtttaattggaactaagtgggtgaaggggaatagtgagccataaagccagaagggtactttggaaccagatgatgacccccctctaggcaagagagcatggcactggggctgaggaggggccagagaaaggagtaaggtagacatcagaatcacctgaacctgaaaaccaataagggcagaggtgctcaagctggcttgcattaaaatcacctgggggacttaaaaaacaagttccatacctgtttcccaccccacaccagttataaaaaatacctagggtaagtcctgtgcatttttgaaaaaaatctttgttagatgactctagtgcacagtgagatgtgagaatcactgaaacaggaaaaagagtagtgatgctattggcagaatttcagaagacaggaggaagcgtgggtttgtggcgcacaagagagatgagtgtggtaggtaatggagaaccactggtatctaagtttaggaagtttgaatctgtacatgatgacaaagacatccagctggagggatccagtaggcagttgggattgaacactttgtctaaattttcatctgtaccaaaagtcagctagttttttcataaagggccaaatagtaaatattttaggtctgcaggcctaaatctttgtctcaaatacttaactctgccggtgttgcacaaaacaaccatagacagtatggaaacagtggctctgttccaataacattttaattacaaaaataaaggcagttggcctggccaaaccctggtctataccagcaatagaaatataatgtgagccatatatgtaattttacattttatactagctacgcttttaaaattaaaaaaaattaatttcaatatattttgtttaacctaataaatccaaaatattatgttagcaggtagtactagttcatttcaaatgctcaactagtcctgtgtggctagtggctaccatatggacagtgcaggtctttacaatgtgattacaaactctaggctttattatcctcctgtgtaaagtatgtcttgttctccagatagtctaaactctttgagttctggcattatggagtttgtttttctgtcacacaggctgcagtgcagtggcataatcacagctcactgtagcctcaacctcctgggctcaagtgactgggattatggggtcttttgatgggggagtggggattatgttttgtttgtttgttttttgagacagagtttcactcttgttgcccaggctggagtgcagtggtgcgatctcggctcactgcaaactccacctcccaggttcaagtgattctcctgcctccgcctcctgagtagctgggattacaggcatgcgccaccacgcctggctaattttgtatttttagtagagacagggtttctccatgttggtcaggcttgtcttgaactcctgacctcaggtgacccacctgcctcggcctcccaaagtgctgggattacgggtttgagccactgcgcctggccggggattatgttttaaatgttatctttcacagtgtctgaagttctgtgcttgaaacctaagtcatttggaatgtacttgttttgtgggtgtgctgagaggatcggcaacatggcaaggtagttattataatataaggtgagatggggtggtatgttgtagaatcctggagtcttaatattaaattttattccttcaggttttttttttttcctgaagacagcatctcagtctgttgcccaagctggagtgtggtggtgtgattatagcttactgcagcctgcaagtcctgagctcaaacaatcctcctgtttcaacctcccacagacatgcaccaccacactcagctagcttttaaaaaaataataataattttatagaagtcctatcttgtatttatgttggcttccctgggtttctcttttatatatatatatattattttatttatttattattattattattattttttttttttttgagacaaagtcttgctctgtctcccaggctggagtgcagtggcgcgatctcggctcaccgcaagctccgcctcccgggtttacgccattctcctgcctcagcctcctgagtagctgggactgcaggcgaccgcaaccacacctggctaattttttgttttttagtagagacggggtttcaccgtgttagccaggatgatctcgatctcctgacctcgtgatccacccgcctcggcctcccaaagtgctgggattacaggcgttagccaccgcgcctggcctatttattatattattttgagacagcgtttcactcttgttgcccaggctggagtgcaatggcgcgatcttggcttaccgcaacctttgcctcccaggttcaagtgattctcctgcatcagcctcctgagtagctgggattataggcatgtgccaccacgcctggcaaattttgtatttttagtagagatggggtttcttcatgttggtcaggctggtctcaaacgcctgacctcaggtgatctgcccacctcagcctcccaaagtgctgggattacaggcatgagccaccgcgcccggcctatttttttatttttttaaattttattctaggttttaagagaactactgctggccgggcgaggtggctcacgcctgtaatcccagcactttgggagtccgagaagggcagatccccagaggtcaggagttcaagaccagcctgaccaacatggtgaaaccccgtctctactaaaaatacaaaaattagctgggcgtggttacgagcgcttgtaatcctagctacctgggaaactgaggcaggagaatcactttaacccaggaggcggaggttgtggtgagccgagattgcgccattgcactctagcttgggcaacaagagcaaaactccatctcaaaaaaaaagaactactgccttggcatatgaattagatatcaaaaggggtgatctttttttttttcctgctaacctcatctccctttccaggcctctactacgtggacagtgaagggaaccggatttcaggggccaccttctctgtaggttctggctctgtgtatgcatatggggtcatggatcggggctattcctatgacctggaagtggagcaggcctatgatctggcccgtcgagccatctaccaagccacctacagagatgcctactcaggaggtgcagtcaacctctaccacgtgcgggaggatggctggatccgagtctccagtgacaatgtggctgatctacatgagaagtatagtggctctaccccctgaaagagggtggatgcagctgcttgtgtttcttggggtgactgtcattggtaatacggacacagtgacccatcctccatcctatttatagtggaagggccttcaattgtatcagtacttttttttaagctctggcacattgacctctatgtgttaccagtcattaatgagctgctgcagaggtgactatttgttttactttcttggatgttaacattacactactcactactcaatctca

SEQ ID NO: 37068 - DNA, 36065 bp, Homo sapiens
gcccctcgtctcctccaagatggcgagcggcggcagcgggggggtgtcagtacctgcgctgtggagtgaagtgaaccggtatggccagaacggcgacttcacgcgcgctctcaagaccgtcaataagagtaagtgtcggggtgggcactggggcgggcccaggccggctggaggatgcggcctgtttccggcgcgcgagaccacctcgcgcgggaggcacgggaaggggagacccccgaaacccccccgtctattgtccgcccggctcgggccctagcgcccggaagacgcaggtctcactcctcggcttcaccaggccagcctggggtccctggttgcttacagccacgtgtacttctctttttaccctccgcgggaagcgagggaaggttttaaagagaccgcagctcccggagtccatttcaaactgttttcttatttgactcctttgctgctttatttcacaaatattccaaagtgcctccttttcttcttcgtcttgagcgcagtgatcaggactctattgctgagggagcttgttctctttggccgctaaagggggaggaacctgcttgggacacgtagtttagaggctggtgctaaccaggtggaagctgtacgggttctacggggcgagaggaaagggctggatctggatgtcaggcctgtcattcccatagatgagatctcttcagtgttattaagttaggaaatatgtgtgtggaagcaccaacacttgaaataatgtcggaagaaaagtttggcctgtttttttgccctgtaagggatgatttcggtttttaccgcctttggtgtgaggtttaattcatcatattcttttgttccttactacatacctggaatatggccatgctgcttaatgttctcggtggtgcgcagttcttctctactgaagatacagcctgtgcatgttagatttggaaatgtaattaccaaggcagggcttagctgttcagagtagcagtaacctaaaaggtgtgtcagtaacatgcaaagctatctaagtaattttcaacactctagtactgggttaacgtgaaaagtagtgattgtgcccacagtgcacttttggtgatttcagacattgaggaaaatagctacgaattagaattatttgatccctaaatttgtttgaattaactctagccttccaaccagtactgtatacttagtatagtattttgcaggaattctttaatcagcaaagattgtcaacttgtttaccagtatgttttcttaattggtagaaattcttgtgattctttgagaattggacttctgtagttgcacaggagcaagagtaactatgatcctggtcattttaacaccgaacagttgttagcgttgaaacttgccacctgagttcttccttatactttggtcatcttagttgaaaaggggaaattttaatgatttttggaaacgttgccagcaagataaattgcctttgtattatactttataagatttttccaaaatattcatttcatattgtcagtaaccttattaaataggtaatgcttttctaatcattttgtagctaagaaaactgagatttggctgttaagtgatatgcccaatacctcaaagcatttagtggcaagcttgcaccaaacctaggtcatttgcttccaaattctacctgaactttttccctgtgaagtaatgaactatgtagaatgtagcatgcatttcaagatgaaatatctggagaaattgcttctttcttctttatttcactgcacttttttggtacatgtatattgggaatctttatctcattgaaaatttaatctataactctccttattgtcacttcttaagttaaaagcaaagattagttgttttctgggtttgttttgttttgttgctgtttcttccagttgttctgaccaattatttctgttgcaataaaagtagaaatttagctttcggagagacagggtgggaaaatttagtaaaaatgtgaaaaggaaatggatttaaaaatgacttttcctaaaattgttctctagtactacagatcaacaaagatgacgtaactgccctgcattgtaaagtggtatgccttatccagaatggaagtttcaaggaagctttgaatgtcatcaatactcacaccaaagtgttagccaagtaagtgattcagttagttgcttgtacagttattagaaacacttactatagctataatctcttccatgttttttcccaactatttgctgattttttttaacgtttttttccttcctttttttccccccttttgcttgtcaataatgtttctgaactggaaggaatactagtaacttctgtttttttcagccttagagagtttttttttttttttttaaccactgtgtttcctttgaaccgctaaggaggtgaaccatagagagttgtggggcataattatgagtcgttggaggatgtagcaagaataactcagtcgaagtttctttactgttatacctaggctccaaaaaaatatgtattgaaattaagtttgaagcatattaatgggatactggtttataaggtgcagaacaatatatattatacttccttttacaagaggaggaggatataaaaatttatatatgcatttgcctgtatttgcaaaacaaacagtataaagagaaacaatgaatagtcatttgtgggaggcctaagagggcggatcacgaggtcaggggtttgagaccagaccgagcaatatggtgaaaccccatgtctactgaagatacaaaaaattagctgggtatggtggtgtgcacctgtattcccagttacttgggaggctgaggcaggagaatcacttgaacccaggaggcagaggctgcagtgagctgagatcgtgccattgcactccagcctgggtgacggggagactccgtctcaaaaaaaaaaaaaagtcatttgtaggaggtaataggaacaggttagatttgggtagcagtgggaataaagcctcttagtgtatctctttttctttttatatttgaggcgtataaatgtgttagagattaaaaattaattgtaaactttattaaaaataaaagggaaatagaggcaatgctgcttttctcctattaaatatgtttgctaaaattcagtctcttgattttgggctattttgtgagaaaagagacattttcaaaaacattttgtcaatgagtcttggataaaagttttttttttttttttttgggaggagtcttgctctgtcgcccaggctggtggaacctccaccttccgggttcacgcgattctcctgcctcagcctcccaagtagctgtgattacagatgtgcaccaccacgcccagctaatttttgtaattttagtagagacagggttttgccgtgttggccaggctggtcttgaactcctcacctcaagtgatctgcccaccttggcttcccaaagtgctgggattacaggcatgagccaccacacctggctcaaaaataaattttttgttaggtaagtaaataaaggacattagcctttgctttgataaatatttttcctcatggattatggttgaaacatcaacaatgaggtatcacattaatgtagatgaatttttaagtgtgtgtatgttagtagtgtttaccagttgtttgattacaggtacttcttttaagatttctagttactgtttctttgctaatcatttgtttcttaaacaagtttaaagaaatatggcttattgttttgttaatgaatttaagaaacttctaaaacaacccatttaacatccttcagattatctttgtatctaagacaattacttatttagcagatgaatgatttccttcttaaatgtttatttcaaaaggccaataattttaataacaatatccatgaaagagaggctagggaagttgatatatgcttaattatatgtttgattgatatacatttacaagctatctgatatttagacaagtctctaacctttgtcagttttctcatctgttatcaggactaaatccagtgtttagagtggtgttgtatataatgggtgcattgcattgttagataataatcagatactgtttttttttccttcttcagtaactctctctcctttgaaaaggcatattgcgagtacaggctgaacagaattgagaatgccttgaagacaatagaaagtgccaaccagcagacagacaaactgaaggagctttatggacaagtggtaattactgcttttaaatacatgttgacagtgatactgagtgagcatgactacctctagcaaggagcagggttgaggaaacccagcccatcctgatgctccacaaaactgaccaccaaaccagtccttaaggtttgaacataattcctcttcttgatcttcatacaaacagttgcatatataatgtgctatgaacaaatgacttcctcaggtaatcagaaaatcaaagaaaatgaactaatctgtttaattttgacttttgagttagaaagatgaagcacattgagcttgtatattaaacagatttgaaatactatttcactaatattttactctaaggatgtcatgatagataagaatttagatgattctagcccatgaaattgtgaaaatattttaaagtattttgagacataaaattaaccctaatgtaaaatagggctgttaatgacaagaggacagaaatgtgtatcttacagctagcaaaaccctcttaaagtttttctttttttttttttttttttaatggagtctctctgtttcccaggctggagtgcagtggcactatctcggctcactgcagcctctgactcccaggttcaagcgattctcctgcctcagccttccaagtagctgtgattacaggcatgtgccaactcgtgcagctaatttttatattttttagtagagatggggttatgccatgttgcctaggctcgtctcaaactcccagcatcaagtgatttgcctgccttgacctcccaaagtactgggattacaggtgtaagccaccatgcctggcctcctcttaaagacttttaaatgtcaatttagggcaaataatgttgtattgaatgtattgtcctcaggaggtagtatggatttaataatacaaatgagttgaagatagatttggacaaattcatggattgtaggtctataaaaaacttttaaggtaaactggataactttagggtaaattctagcattttgaggttaaggacatcagcctgtgtcatacataatggactaattgacctagagtggcagttgttgttctttgagcacaacttgaatgaaatcagtaggaattctattgtgtctgcttgagactcacctgtgtgatagctggtttctgagaaagataaaatgaagattatagcgaactcctaggaaacattaagtctttttcttaacatttaattttgttcctattttagtaatcattttgtgttgtggaaaaatattttcattgtaattttagatctaggtaacagggttacctagacctatagaaaggtgttctttcacaacctatttaggcactttactaatttcaagaagaaaggtaaagaaaatcacttttcgcacttggggaggccaaggcgggcggatcatgaggtcaggagatcgagaccatcctggctaacatgatgaaaccccatctctactaaaaaatacaaaaaattagccaggtgtggtggcgggcgcctggtcccagctactcgggaggctgaggcgggagaatggcatgaacctgggaggcggagcttgcagtgagccgagatcgcgccactgcactccagcctgggtgacagagcgagactccatctcaaaaaaaaaaaaagaaaatcagttttctgggtcgggtgcggtggctcacgcctgtaatcccagcactttgggaggctgaggtgggcggatcacttgaggttgggagtttgagactagcctgaccatggagaaaccccatctctactaaaaatacaaaattagccaggcatggtggcgcacgtctgtaatctcagctactcgggaggctgaggcaggagaatctcttgaaccagggaggtggaggttgcagtgagccaagatcgcgccattgctctccagtctaggcaacaagagcgaaactccgtctcaaaaaaaaaagaaaaagaaaagaaagaaaatgacttttctcaactgaatcctgcctacagaaccacaatatagtgaaaattcattttaaaagtattttcaaaaagtaatttatttgaaagtatgactagtacatggaactatttaaaaattataaaacataaacagttgattgttcatgttatgctgaactaggattcctacttagtggttccaaaaaaggtttgcatgatattaaagacataacaccatatttgtctctgattttttacttgctatttattattcagttataccgtttggaacgctatgatgaatgcttagcagtgtatagagatctcgtccgaaactcccaagatgattatgatgaggagaggaaaacaaacctttcagcagttgttgcagctcaaagcaattgggaaaaagtggttccagtgagtatccttgtggtgtacccatacagtcatgaattattattcatatttagtatttaactggtattttgtcccctgacaggagaacctgggcctccaagaaggcacacatgagctgtgctacaacactgcatgtgcactgataggccaaggccagctgaaccaggccatgaaaatcctacaaaaagctgaaggttggaagtttgttaaacttatctgtaaatataacgtgcatataactttgtagagtatcttctaaaattgcatttgacttctgtgaaattattaaatggaagttattgatgcagtgacaatttctccaagttcctgtcgtctttctctctcttttttttttttatggagtgggacagaatcttaccctgttgcccaggctggagtacaatggcacgatctcggctcactgcaacctctgtctcccgagttcaagcaattctcctgcctcagcctcccgagtagctgggattataggtgcgcgtcaccacacccagctaatttttgtatgtttagtagaaatggggtttcaccatattggccaggctcatttcaccctccgcctcccaggttcaagcaattcttgtgcctcagcctcccaagtagctgggatcacaggcgcatgccagaaatgcccaactaatttttgtattttcagtagagatggttttcgccatgttggccaggctagtctcaaattcctgtcgtcaagtgatctgcctgccttggcctcctaaagtgctgggattacagccgtgagccactgtgcccagctgaagcttttaattaagaaaaaaattaatttattagagaactgtgtcaggtattaacgtgaacattttgactttgcttgtgcataaatttttccctggaagctataaaagtgatgtaggtactgcagtgatcactggggtggaaaaaaaggtgaaacaaagtctgttttactgttaaatattaggggttaaaatgagatcacagtttactgtcaaatgttgaaagttaaaataagaacaaaggttagagcctcatgagaagaaaaatctgtttaagaattataatttttttggctgagtgcagtggctcacgcctataatcccagcacttttgggaggccaaggcaggaggattgcttgagcctagcagttcaagaccagcctgggtaatatagtaagccttcgtttttacaaaaaaaaaatatatatgtggccgagtgtggtggtacacacctgtattcccagctactctggtggctgaggcagcagggcctaggagggcctaggaggttgaggctccagtgagctgaaatcataccactgtattccagcctgggtgacagagtgagacgctgtctcaaaaaaaaaaaaaaaaaagaattataatttcctgacctcaagtgacccacccaccttgaccacccgaagtgctgggattacaagtgtgagccactgcacctggcagaattataatttcttgatcatacccaatgaagaacattctcatacattgtgggtttgaatgtaagagtaatacagacttttcagtgagcagtttggtgatgtgtagcagattttaaatttacctaccctttgatccaataatttcacttctagaaacttgaggaaatgattagataaatttacgtatgtgtctgtgtgaatgttcattgaaggaatattcataagaacagaaatttagaaacagcataaagttctgtactattaaaggattggctaaattttaccataatcacaaagtaattacagtcactacaaccaataacattaaaaaagatacagtaatgtagatctatgtttattgtaacaaagatatccacaggatattgaatggggaagggaggtttcaaaatagtatgcaccgtgtctcactttcattttaaaatgcagctgtgcatttacataaaactaagccaggtatggtggctcacagctatagtcccagctacttgggaggcggaggtgggagggtcacttgagcccagaatttcaaggctgcagtgagctatgattaagccactgcactccagcctgggcaacagagtgagacctccaactttaaaaacaaacaaaaaaaatattaaaaaactaaataactgaaatgctagtagtgtttatctctgggtggtaggattgtttatttttatacttttctataattgatttttcgcaattaatatttactacatttgtattttttaatgcactttacaaatatttttagcacagacacaacaaatgaaagcaaagtgccaaagagctgggaaagtcaagagactgataatatatatgtagtatatttgatgctaatgtaaatttcacaactgcttgttactacgattatcttggaatcttctgcttaggaatttagatcttgctctttggaatagtgaaagaaatgggatttacccagcaatactacttttaaaacaatttttctcctgtagatctttgccgccgttcattatcagaagacactgtaagtattccatcattgttaaacctaaattttacacttctgactatgatagattactgaggcttcattgtactatttattgactttttttagaagatggcaattcattaagtaggaatcacactagaaaccaccctctagtatcagttatttgatgaagtctactagagtgagaaatcacaatacaaaaaattttgacataaccttaagcacttgattatacatttatataatgtaaatttattcccccattttaggatgtaggactaaggtctttgaggactggtctgctcctaggagttccatgtatatttcttatgtagtgacataattcaacattcccaatttacacttttggtttttctttttaagtgtaacaatatcttaaatacagttggtaagcacttccattatagagtccttatgttttttttttgttgtttgttttttaccaatctcttaccattttttggctcacaactaattagacaataattttctttaggaatttacgtttaccgtatctttctgagtattcaacatgatttacattgaaatatgtctcttttcacattcatagttctctctctctctctctctttttttttttttttttttttgagacaggatcttgctgtttcacccaggctggattgctgtgatatgatcataggtcactgtaacctcaaactcctgggctcaagcaatcctctcaccacagcctcctgagtagcaccaccatgcccagctaattattttcttctttgtagagatgggggtctcgctgtgttgacaagtttggcttatctcaaactccaggcctcaagcgaccctcccacctcagcctcctaaagcactgagattacaggcgtgaaccaccatgcccagcccatagttcttctctttaatatttttaagttttatcatttcctcatcaaacacaactgcataatgggtttggaaacaaacatatctgactcctggtcagcagatactcaccaggtgagagcaggagtgttgggtcattaaaggactgttgtctcctagtcttgagtattcattgtacagccttttcagaaggaaaggagaaatgtggattaatctggagcatcggttaagagagctactactttaattacagaatttgttcaattacaggattaaagtacagaattagttccagcttttgaagtttttttgtatggtgttaattggaattttctagtttttgaggtagagttatggtagaatagagagaaaagcatttttaaatgtgatttttatgagaaaattatgtttccagaatttagggatatcattataaaaagatatacttccatgcttgttttttacttacgttttttaattcttgggctttagaggatgataatgatcaataaatggtagtcctaaacttgttaccatgttcttctaggatctttttgccttttcttttttttttttttttctttagatacttcttagaagttgaagtctttttgctgttttcacttaaacttctctcttgctggctgtttctaaagaactgactctaagggaaaatttctgaaattatgtgtcttcaggattgtatctcttttgaatgtttgggtcatttggaaaatatgtagatcagtttggaaaatttatatgggaaaaacatttctttctcttaggatgggactgaggaagacccacaggcagaactggccatcattcatggtcagatggcttatattctgcagcttcagggtcgaacagaggaggctttgcaactttacaatcaaataataaaactaaagtgagttattaaaaggaagtgtcttttataggggatggggttctttttaaaggtttgtttggttttgactgttgcttgttgttcacagaccaacagatgtgggattactagctgtaattgcaaataacatcattaccattaacaaggtatggagtatttgtgctttccatagatatattttaccctgaaagctcatcaccctagttttagttttgttctaggatagcctaagtgttctttttaacatgatgaaaaaagtccagttgtagcaaaatcacaatggatagtattacttaactctcctaatgataatgatgctgcaaggtatactcaagtaataaaaccttttgtagtagaccctagactttaagatcctccccttttcccagcatctaatagtatagagactctctctttgtaagagatataaattattggggcttttaaacttttaagtatacgcatgttttatatgatttcttcgtctatggaatctgaatgtgaaagtgttctttatataattttctctcgggttttctttttttagggggtatggacaggtgctctttcttctcccccacaccccatcccatgtaaaatactataaatatatatataagcactcttaacttagagtactgtactaatgtcattagccaccattaggaacactcttttttgttttgttttttttgagaccgagtctcgctctgtcgcccggactggagtgcagtgacacgatctcggctcactgcaacctccgcctcccgcgttcacgccattctcctgcctcagcctcccaagtagctgggactacaggcacccgccaccatgcctgtctaatttttcgtatttttagtagagacggggtttcaccatgttagccaggatgttctcattctcccgacctcgtgatccgcccacctcagcctcccaaagtgctgggattacaggcgtgagccaccgtgcccggccaggaacactctaatggaaaaagctttatttttctttctttctttttttttttttttttgagactgtcacccaggctggagggcagtggtgcagacatgactcactatagccccagacagtcctcccaagtacctgggaccacaggtacacaccaccatgcccggctaatttaaaaaaaaatttgtagagacagagtcttgccatgttgcccaggctggtctttaaactcctgggctcaacaaatcctcctgcctcagcctcccaaattgctgggattccaggggtgagcgaccacacccagcctggaaaaacatttcaaggtcacaattgaaatccaagtcagtggaaagtaagaaaagtaacatttgaacatacaatttatcttgatataccatgtgatttttcaagtaccaccttatttcttcctctcaataatctttttaggtggtagtccttatctctgtaggagtataatctgagactaaaagtagttaagtaatttgtataaggtcatagcctacttcataagaggaaaaacttggattcagattctagtttctgacttcaaagctttccccttctactacttagtggttcttctctcctgtggcagaaatgtagtgtatctttggatgtagataatggcattaaaaggggtagtaatcatgggaggttgctgttggccattggtatggtatagatttccaaacattgatactagcctttgaatcttggcaaaaatatatacctgcctatgtttatgaattttgaaatgcttgtcaggacaaatttttttttcccccaagatggagtctctgttgcccaggctggagtgcagtggcacaatctcggcttactgcagcctccacctcccgggttcaagtgattctcatgcctcagccacccgagtagctgggactacagtcacgtgccaccacacccggctaatttttgtatttttagtagagatggggtttcaccatgttgggcaggctggtctcaaactcctgatctcaagtgatcctcctgcctcagcctcccaaagtgttgggattataggcatgagccaccacacccagccaggacaaattctttttatctgacatacataattgtaggggaagagagcatgtgagatactaaatatctcagtctgaacataacttatacactgaactttctttagtcagtgggtatttctgactttttcaaaatagtactggatgcaataggtaatgaaaaatacaaagcatcatcacatagtttaaaatctctttctggtgttgaaaaaaattgttcatgtttaaattttttgtccgtatactttataactatatatttaatactacatttggtgaacggaaggatctctggtttggcaagtttgagctgacccttgaaggaggactgtggtttgaaggttaagcaacagcacaaaaaaaagtacatatgaagaaatatttatgatttgtaggggaaaagtgagaacacagaagagggtatgtatttgctggatagtttaaaaagtagattagattgaactatatcagggccttggaaatcaagtttaagaaaagtctggcagtgacgtgcacaattaattgaagtattaaaattgcgacatgagagaaccagctagaaaatacggtttctttaggattgatttatatgaaaggcagtttcttgctgtacattaaagtagtttcaaattggtttggagctcgacagtaagaaaaagtagaatttattttagatttttttcgcttcctttttgtctttaaactggtagaagacctggtttaaaaaagcacagtggtatcatgtatttgcaagtaaatacattgttttacaaagctagagtattgtgcacaaagtagatactcacatgctcagtttgtgcttctcaggatgcaatcagtgtgacttagttttctccctttttttggagatgtatgtgactttcaataattcttaataggactttctttgggcagataacactgtgcccccacatgggaattttagaaattgagcttctttatgcttttgcttggctaagaagaaggggctttaggaaaggaaaaacagtagatatgttacatgagtattttctgctaaaaaaaaaatgggttcaaaagtggtacagatatgtttctgaggtttcatgattgccttacagagtcactacaggcatacctcattttattgtgctttactttattacactttgtaagtttttcacatattgaaggtttgtggcaactctgtgttgagcatatctgttggctcctttttttttttttttttttttaagatggagtctcgctctcttgcccaggctggagtgcagtggtgggatctcagctcactgcaacctcccaggttcaagcagtgctcctgcctcagccttctgagtagctgggactagcgtgtgccaccacacccagctaatttttgtatttttagtagagatgggggtttcaccatgttggccaggctggtcccgaactcctggcctcaggtgatccacccacctctgccttccaaagtgctgggattacaggcgtgagccactgtgcctggccatggtggtatcatttttttaacagcatgtgtccatttcatatctctgtatcagtattttttagcattgaagtatttttaaataaaggtatgtactgggccgggcacagtggctcacgcctgtaatcccaggactttgggaggcctaggtgggcgaatcacgaggtcagaagatcgagaccatcctggctaacacggtgaaaccccatctctactaaaaatacaaaaaaaaaaaaattagccaggcatggtggcgggcacctgtagtcccagctactcgggagactgaggcaggagaatggcgtgaacccgtgaggcggagctggtagtgagctgagactgtgccactgctctccagcctgggtgacagagcgagactccatctcaaaaaaaaaaaaggtatgtacttgttttcagacataatgctgttgcacacttaatagacaacaatatagtgtaaacatagcttttatatgcactgggaaaccaaaaaatctgtgactccttctattgtaatatttgctttattgcggtagtctggaaccaaacacgaaatatctccaagatatttctgtattttgaagaggagtgagttactttttatttatcatctaaattctagagggcatagcttgtagaaattgccaagttaggtatttttgtagtcctaatacacttcaatttgtgctgtccctttttttccttcaaaaagctcaaaacaagcaattaatagtggaaaaataaaacaaatcttgttctccatttctttaaagcagttcacttgttaagcctttttatacctaggaagcctcctttgagaaggctttaaaaggagtgggggtagattctgggataactatatgtacatgagtagatttgaattgcagagattcaaaaagagtagatttgaattacttctgtgaatcaggataaatttatatgcatcttattagcttaggcaccccaatcaggtagatagattcaagctctcctgctgtatctatataaagttaatagaaaaaggaataagttgaaatctgagattctgttaatgatagataaacttttctttgttaggaccaaaatgtctttgactccaagaagaaagtgaaattaaccaatgcggaaggagtagagtttaagctttccaagaaacaactacaagctatagaatttaacaaagctttacttgctatgtacacaaaccaggtgggtaattacctttggtgtcatggctaaaccttttgtaatatggtatatgaggagtaatagggatattagtctaatctttttatagtttttgtttgtattttgtcttcaactcataaatatatttttttgccttcctcaaaatattatatatattattggctgggcacaatggctcatgcctgtaatcctagcactttgggaggttgaagtgggcggaatgcctgagttcaagagttcgagaccagcctgagcaacatggtgaaaccctgtctctacatggtggtgtatgcctgtagtcccagctactctggagactgaggcacaagaattgtttgcagtgagctgagattgtgccacttcactccagcctgggcaacagagagagactgtctccaaaaagaaaaaaaaaaaagaaagaatattatgtgtcatagattttatttattaaacaagtaatttgcccaatttcttataagggtgtagggttgacaccttttaaggggaagaaaacagtattcacacctttaaatgagataactttctcattaccttatttctaatctgaattaagataaaatcatcaaagatgctagccatgattatagatttaagacccatctttcatttttgctgtgtataatcacatcaagttataaatgttaaggaagtcaattctaactccagtaagcattctaattctaattttatactgttttagagcagaagttttagtgggagacagagaagcagtaatttttttttttttttttttttttttgagatggagtctcgctctgtcgcccaggctggagtgcagtggtgccatctcggctcgctgcaacctctgcctcctgggttcacgctattctcctgcctcaccctcccgagtagctgggactacaggcgcccagcaccacgcctggctaatttacttgtatttttagtagagacggggtttcaccatgttagccaggatggtcttgatctcctgacctcgtgatctgcccacctcagcctctcaaagtcctgggattacaggcatgagccaccacgcccggccgagagacagtaatgtttttattatttagaactgagtcaagttattcttaataatgtagcaaaaaatacatatatgcattttgttgtttttgaagcaaatgcttatatttgatgtgtttgatttttttaaacagttctagaatttaggcatccaagtgaatgtttagaatttctcctttactaaagactcttagagctcatagattaaattcaataaatggaaaccattttcttacaagaaaaaattgagaatagatactgtaaactgattctcttaccctaggcagttctttggttaatatttgtttcaactgattttcccatgtttcttttctttctggtcatttagtgtttaatttcattaaccagtttatttttcttgtgggggttggatatcttctaggctgaacaatgccgcaaaatatctgccagtttacagtcccaaagtcccgagcatctcttacctgtgttaatccaagctgcccagctctgccgtgaaaagcagcacacaaaagcaatagagctgcttcaggtaaaataattacttgaatgaggtgtcagacatttgcagctttgtttcattttcattgtgttgtaataacctactagcatgtaaatttaatgggaaaactaatcagaaatgtaccactacacaaatttcattgtcattttagttaactcttgggttacagagctttatataaatttctttgtgttatataaatttctataatgtaaatatttgttataaatgctgaagaatgctgttttgtttggagatctgtttaacctgagttaggggatcatttaggcatgtataattccagaacatacttaacctcttttgcaataatctgatctccagtgagttctactccagaacctcaattatggagatactgactttgtttttatcaacccaaaccagctattatattgcatatttaaatttcttgaatataaactacattggaaagttggacaggtacaattaggatcatcctgacagacaaaattgcctaacagggacactcagtgaagagacaccgccccttctctccccacagcaaaaaaaaaaaaaaaaaaaaatctatttagtaatctttattatagttgaccctttgtattcttgagttttgcatccaagaattcaaccagccatggattaaaaacattttgtgggggtcgccaggcgtagtggctgacgtctgtaatcccagcactttgggaggcccaatcaggcagatcatctgaggtcaggagttcaagaccagcctggccaacatgttgaaaccccatctctactaaaaatacaaaaaattagcctggcatggtggcgcattcctgtaattccaactacgtgggaggctgaggcaggagaatcacttgaacctggcaggcggagttgcagtgagccgagatcacgccactgcactccagcctgggtgacagagcaagactccgcctcagaaaaaaaaagcacattttgaggttggaaatgtatgactgcctctgtactgaacatatacaaactttaaaaatcattactccctagataatataacaactatacacataggatttacattgtattaggtattataagtaacctagcaatgatttaaaatgtataggagcatgtatgtaggttatacgcaaatactatacttttatataagggacttgagcatccttgggttttggaatcgggggtggttctggaagtaataccctgtggctgagggatgatggatttctctgttagtgacttacagaaaacttgacttcattgcacttacttttagagcatacctttaagaaaaaaagtgagtgttgaataaaaatttccccaagttaagattttgacctgcagccagaagtttaatgttttaaaactggatttaaaatcttatgtagctaagtaattgtaatgtatacaattagttgtgtaaattaaatgtgatttttttcccccaaactaaaaaaatttaggaattttcagatcagcatccagaaaatgcagctgaaattaagctgaccatggcacagttgaaaatttctcaaggtattatggttttcatcatgattaaaatattttaatgaaaacatgtttggaatgattaagcagttgtgaactatgtgattttaagtttttttgtgtaatagtaaagcataataattactgtttcaaacatgcagctagattgtatgatctccaacagatttagtagtgaggtagttgccccttttcgtggattattcctaaattattagaatgattcttaatctatgccttgaaagttctgaagcaaaggattcctctcttccaaaagaccatacatactactcaaattgcctgagtatgtcacatgcagaaatgcttatgtccgtcacttggtaatatttgtacgactactttgcatcatagttttcagaatttcttagcttggcccttcatccttacttcattttacactttgccacctatgtctttgggcttggggaaaggtaatagaatttaacgagaactgatgtgtttgaatcttaaaactgccaatgtttttgtctgtggttttcatctaactttgaatatctagagccatgttgcccagtttggtagtcactagccacatacagctattttaagtttaaattagttaaatgaaattttaaattcagttctttgattatgctagccacatcttagaagcttagtagctatatgcagccattggctacaatattggacagcacagatataggacatttatatcatcacaaaaagttctgtcgaacagctctggtatagaatgtggattttcaatggtggtgacaattcttcacaaaaatcttaaatattacagtggctgaaatgaaaattttatgagttgaaggaggggagttggcagttagggaaaaaatgtttaaaatgtccttagtagggcaataatgaaaataaggttgagacacactgctgatctccctcttatccaattctcacatttctttgctttccttgtctctttttccttctcctcagccctgtcttctcttccttgccctttacttgatctttcctcctatgtttagtttattttttcaaggattatttattatcttgaaattactgacaatctgtcatggttttttgtttgtttttaaagactgggaattttgagttattgaggtttgcagtgaatacaaaatcagaatttaacaccataggaaattttccattgcactcatgtctacagtaacatatttcaaggcctttagggaaggacccccaccttcaagttacagcccaaaaaagaagaaatagaactcaacagactgggagctgggagacttcttttctggtagcagctctgccattaactttctttgtgagcttaagcaaggtatattatttctttagaactcaatttccttatctctaaatgaacagagttcaccatccccaagaccccaaagtttatatgtttagcgatgttacaaaacatgagttatggttgctttcctaaggaaaagtagtgggaggaagtaaaatttcttgtatttttttttcataatatgtgttcttctatgtaatgctgattttgtttattctcctaaggtaatatttctaaagcatgtctaatattgagaagcatagaggagttaaagcataaaccaggcatggtgagttttaaaaattacaaaattgaaaagtagttgaattgataatttgtatgtctaatgtgtattcactttatttatatgtcgaatgtgtattcactttaaggtaggagtagtaattataatagtaatagttgtctggtataaatttaatttcattctctgctctggtattggtttcttattcagtcaaatgtgccaggcactatttaggccttatagtatcactgaaaaccaacctcaaataatctcagatctgtataggaatttcttagcctatatcattttcgtcagtgtgatttctttaaattagaacaatttcataattgtggccaacaaatttagtttttagttttctgattattcaaatattgcaggtttcaatcattaatacagctgtgaaagcatcttttccatagtagaaactaattctgtagtggtagtatgtgcatcttttggacaggggctgttttattcatgtttgcattctcatggcctctgtgcagttggcactcagtaaatgtaatatggtagtgctttcccttaaagattcatattttaaggatcgtgctataattactttaccttagagtcaaatacagtatatgactgaaaataaaatgtttctaatatttaatatatgaccaccttttacctttcaaggaatgtatccatttcatttaggttgctgactttattggcataaaagttcttcattttatttctttattgtccttttaatatctatagaacctctctcattcctgatattggttattcatgtatttttttctttttccctctgattagcctgtccagaggtttatcagttttactgattgttcttaaagatccagctttttgtttgtttcctttctatcctcatctcctactgctcagcatccccctccccctccactccagctatgtaggcctccttcctgtccctcagccacaccaggcaccctttttactggcttcaaacagctcatgccacatgggattcatcatgagagttcagccgctctatgtatgcctcactgatcatacacttaaatgtccagcagtgtcttattgtagaaacatttctaagggcttattctcaacttctgtacttaccaaaccatttgtgaactggcactgctttaaaggaaagttttattttacagatatctaccttcatatttggaaaacacggttgttcatggtatttctagaagtaaagttaactatgttctctaaagggagtagcttttatgataaatcaggtattagcggagagcctttatttgctatttcttcagcgttttttattttcaaaagcggtattctgggagtgaagggggagttcactaatttatacctttggctgtgtaggtatctgcattagttaccatgtatagccatgaagaagatattgatagtgccattgaggtcttcacacaagctatccagtggtatcaaaaccatcaggtaaataaatggagtaaaatgttatgagagcatgtttttacataaaaataaagatggagtagtgaaaaaattcaggcaaacaagtattacacgtcactattttaaaagtggaatactatttagattatcaaatgcatttttttagtataccagatccaaattaagttattagaaataagcaatggctgcaaaatagaaaaatagcacatttatatttattgaagctccttgctgtatgtgtacatgcatttgtgtatgtaatctcaagaaataataatagtacatgattgcatatttaagagatcgtcttaaatggctagagagcccatgggtggtagtaattagtacaacagtaatacatggaatagttgtttatcatgtctctatctagtaggaatatcttaatttccagtatggatctctgcatgggcagtatccaacttaaaattatacatacgctgtgcaggtggcatttatactgttagtactgttagcagtggaggggtatcagtgctctgggaaagtattatattaaattaatgtttgagaactatggtggcatatctttaagatttgattattataggggaatgtttccagttgtagacactaaatagatataggttgttttccagattcatcaattggtgattacttgtacaattaataatttgtccacctgctttcctctacatgtgtggatgattttgttgtttcaggcattcagtgaaacttaagatgagggatctaatgcataggtgtatttcttaaaggtctaatgaatataactgcatgcacttgctagatatttaacttgaaactttttttttctttttattgaaactgtagccaaaatctcctgctcatttgtccttgataagagaagctgcaaacttcaaactcaaatatgggcggaagaaggaggcaattagtgacctacaacagctgtggaagtaagctctgaaacgtggagttgtagaaataacacatttattgttgctacttgatatgagggagttacttgtttatattactttctccagttttataaacagttcaataattttcttatttcttcttttagacaaaatccaaaagatattcacaccctggcacagcttatttctgcttactcacttgtagatccagagaaagccaaagcgtatccttttgattgttattccttacagctcctcagtagcacaatagatctcttctgatatctgtgttttgaccagagctttttcaattgtaaactgcaactaacaaatcctccttttaactagtaaaaccaaaaaatgagaatttattgatcagtgtgactgaaaaatgcggcgatagatccaacttagggttcagtttcatccagaagcaaaaatgaagtcaaaagggtatggcctcttttcctccaggttcaagatcagcagcaaggtaaagaaaaagcatattttatgtgggtacttttgcatgattctgaaatgttattttcagattcaactacttaggtcacttgcttatctcaaatagttacctgataagcgaatttggtgcccttattgagcttggatcatatgtgctactctaaatcagagtgtgttcccaaaactgaggtgggttggtggatgctaagcagtcacaagtcataaacttgatagttgttttggaatagagtttgtattaagccaccaccttgctccacatcactgtgttaaggaatagagaattagattatgactcctcatgttctcctttcagaatactgtatgtactatataattgatatgacttgttattgtatagaagatttaggaacattttttgcttttgttgaaggtcatcaagaaaagacagtcttccagtgtcaatagatacattggcaaacatatatatctatataaatgtgtgtgtttgtgtatattatgttcctgaactcctgttctatcacagtcttagtaaacacttgccatcgtcagatagtatgtctctaaaagtagatgttgaggctcttgaaaattctgctggtgctacatacattcggaagaagggtggaaaagttactggagatagtcaaccaaaggaacaagggtaatatttttcattgtaacgttctctaatgctgattttaaattagacaaggaataaaaaatacattctcatagaaatttcatgtgaataaagttctagttctctttgttccttttccatttctctcactgtgcccagctctttgtccttatttccttcccttttccctcagcccaaaattaacctctggtattaatttaatctattattccagaagtttttctttgtgtttacacacacagatggtttacaaatattttctttaaattggtttatttattactattttttttttatttgtttgtttgttgagacagagtcttgctctgtctcccaggctggagtacagtggcacagtcttggctcagtgcagcctccgcctcccgggttcaagcaattctgcctcagcctcccgagtagctgggactacaggctaatttttgtgcatttagtagagacagggtttcacccttttgaccaggttcgtcttgaactcctgacctcaagtgatctgcccacctcggcctcccaaagtgctgggcaccacgcccagttattttttacagaaggaggattgtattgtacttagtgtttcccaacttacttttatttaatgagttttagagatctttccacgtactaaaatgtggacctatttcatcctttttatgcataacactccataggctggatgtgccttcctttaccttttagttattgttgtacatttagtacatcatttagtatatgatttcttttgctgatttgaagaaaaggttagtcggcttcatctacttaaaagaagtcagattttgacttgtttcttccatcgtcatcttaaaaatatagttagcagagacctacagtaaaatgttttaagattttacttttgactcaggatgaatagagcatggaaaagataaaacatttccttagctttgtgacttttataagtttttgctacttcctccttttttgaatgccttttgaaatctaaatttttccctaacttaaaaaaaactcagcaacaatgactgatttctttctaacaaactctgcatttcataaaaagcattgttgttctcataataacttccaaaacttttaataaggaattggagtctcaaagaggttacattgttccgaattccatttcatcttacaattataaattcagtctgggttcttaaatggattttcaattaaagtatgtttactatttttttcttccccaaacagggttgagtaactactaaggacacgcagttccttctttagcctggcatagtggctctgtgttccagttactgggaggctgaggcgggatgattgcctgagcccaggagtttgaggctccagtgagcagtgattgcatcactgcaccccagcctgagtgacagagcaagacccccatctctaaaaataataagtttttaaaagtttttttaaataatctttgtttcttttgtttgtttgttttcttttttgagacggagtcttgctctgttgcccaggctggagtgcagtgactcaatctcagctcactgcaacctccgcctcctgggttcaagcaattctcctgcctcagcctcctgagtagctgggactacaggtgcctgccatcacgcctggctaatttttgtatttttagtagacagggtttcaccatgtcgatcaggctggtcttgaactcctgacctcaggtgatccacccgcctcagcctcccaaagtgctgggattacaggcatgagccaccaagcctggcttctttctcttttttcttagacaatcattaagatatacattgactttttaagcttttaagtttcagcacagtattttcattatgcattattaatgctctttattttatcttattagaagttagtattttgttatactaacttggatgcaaaggtttagtttcctttaacaatacactatgtgataggtttatgctaggtgttgaccagaaaataaatcatggtacttgctctcaaaagaacttgagccctgacatggtggtggctcatgcctgtaatcccagcactttgggaggccaaggcaggcggattacttgaggtcaggagttcgaaaccagcctggacaacatggtgaaacccccatctctactaaaaatacaaaaattagccgggcgtagtgacacatgtctataatcccagctatttgggaggctgaggcaggagaatcacttgaacccaggaggtggaggttgcagtgagccaagatctcaccactgcactccagcctgggtgaccgaatgagactctgtctaaaaaaaaggaacttgaatctagcagaaggaaatatatttaaacagtaattgcaataaagattgcacctgttgtgattgtacagggcatagaggagtacaccggagggaatagtcacttcttcctgaggacagtgggaagttaggaaaggcttcatggagaagatgattgtgttgactctgaggaagatgaggacgaggtaggcaaagggtgagctaaggcagagaaataagaaatagcagagaacccttgggaaattttagtatggctgtggagtataatttgtagggagacaatttagaatactattgcacactgggtaagagatgaaacactcaagtaagatacagtatgttgcatttcttatttggggtatcctgagagaacgttcacaattgaatgacttgtagaatgaatttttggtaggaattgttgtctcatctttttagttcactgtttcatatttctcgagttatatcacataagaatatatagagagatgtatttttatgtttttctcttttcactagagctttcagaatgctttttttttttttttgagacggagtcttgctccatcgctcaggctggagtgcagtggcgcaatctcgctcactgcagcctctgcctccctggttcaagtgattctcctgcctcagcctcccaagtagctgagattacaggcacgcactgccacacccaactaatttttgtatttttagtagagacggggttttactatgttgtccaggctggtctggaactcctgacctcaggtgatccacctgccttggcctcccatcgtgctgggattacagacgtgagccactgttcccagccactttcagaatgcttgacaattattttgaagtgttaatttttatgccctttttagtgccttttttggtcaatgtacttaatatagattttacttacataaaaaaattaataaactcacaggtttaaaatacaaaagataaaaaagtgtaagagtaagtaaaaagtcttccatccgtgtctacccacctccctcccagggccataaccaacgtaacttgttttgaatctccttccagagatattctttgcatgtatcttacctacacatgttcttctggcaaaaaatttattctctaaagtcttgccaaacatagagtaacttaccaagggattctaggtagtcatgcttgtgcaaattactttttacatagacttaatgtgtgccactgaaaaacttttttcagtgtaaacagaatctgttttcgaattgtcacctctgttttctaaactactttccaaaaattatagtatctgaagcttaattgactttaacctgaatcaaatcttaactaatttgttagctttggtaagctgataccaagtcttaaaccatgtttatgataagtgcccaactaactcttatagagcacttacttaatgctctataaatattttatcacaaagatggtaatgatttttttttctctttgtagacagggagatttgaaaaagaagaaaaagaaaaagaagggtaaggcattaaaaaagtctttataaattttctccaaaataaatgtttgattttagccctatatagaaatatttggacataaatatactgccctcccttgtatctttgaaaactttttatcttgactatagctaacatttaattttattctattactttaaagatcgcaattcactagtttgcctaaattcaaatcgttgctccctcttttactctgtgactgtggacaggctatttaatatacctgccagagtttttcatatgtaaaatggaatatgatagtatatatcttgtagtattagatactacatgtaaagttcttagagtggtgcctggcacaaaagtaagcacttacacattttgatgtttctgctacacataactacaaaattccatcaaactagcttaagaaaatttactgtttataaagttggcagtctagaggaatgttagcatcaaggttggttgactcagtatttttacctctttgttctgctctccacaaaacagaatcccattagagtcatatgatgtatattgtaaacagtcagggccacatacttgtcatttatatccatcacaacaaagaagccctctccagacttggcaagtatttctcattaatctgattgggccaagcaggtcagtgtccagccttgaattattaaccagggaaataatgtgcattgattggcttggagtgtggctttaatctctggaaaaattgggtggcattaccgtgcttgattttacctagtcagatgttatccttggagccacccaagttcctgaggttttgaggaatctatcatataaatcaggttatttcttgattttgctctctgccgtcttaggatacaggtttcccaaggcttagctcagtttattattactcctccatctgttttccagctaccaaaattttattgacaatatcttttcttctgtcttcctttaatgtgttttattaccattttagtggagtttgaggaaggtacacaagctaatgtttgtatccatttcactatctttaactggaagtcttattggttcttttgtcacagtacttgaaaattggcaaacatttaatatttgttttgtgcattagtaatactgcaaggaaacagctgatgactgtaggtggtaataacctaaaattttactttcttttctatttttatagtttccagatgaatatttttttaaatttacaagtgatatatgctcattctaaaaacaaaggtagttgttatctatcattatagagtggcctaaagagtgtaaaattccctgcccaaaattcatgctcccggctgggcatggtggctcacgcctgtaatcccagcactttgggaggccaaggtgggtggatcatttgaggtcaggagttcgagaccagcctggccaacctggtgaaaccccatctctagtacaaatataaaaattagccgagcagtactcatgcgtgcctgtaatcccagctacttgggaggctgaggcaggagaatcgcctgaacccgggaggccaaggttgcagtgagttgagattgcgtcacggcactccagcctggtgacagagtgagaccctctccctgcccccaaaaaaaagcatgctcccagagacaattacttaacttttttatgtgtgtttatatgtatatacagaatcaaacgtatcattaggtactcaaagtttttataaaattgttttgaacataatataatttgtttgttttaatcttctactttagactgaattgtgaagaacatttttccaaattaatagatgcacttcactttatttattttttattttattttatttatttatttttttttttttgagaccgcgtcttgctctgttgcccaggctggagtgcagtggcgctatctcggctcactgcaagctccacctcccaggttcatgccattctcctgcctcagcctcccaagtagctgggactgcaggcgtaccccaccacgcccagctaattttttgtatttttagtagagacggggtttcaccatgttagctaggatggtctcgatctcctcacctcgtgatctgcccacctcggcctcccaaagtgctgggattacaggcgtgagccactgcgcccggcctgcacttcagtttttaaccaattgaatagcttgctatagtttgggcatattataatgtaatcatcttcattgatagatatttaagttattttgccatcttaaagaatatcagcccacccataccttgccctatccatctttaaaaaaaaagaaaaggagtatcaccgagaatattctgttcttaactttgtatctcttgggtttctgcaggataaatttctagaagtctataaatttctaatggtactgccagattaaattgctttccacaaaggctataccagtatacacttcccctagtatagtgttggtgagtgcttctcaccatttcaccaacactgggtattactgcaagtctgatagagttttttacccttctcatttttaattagtgagggtgaacatctgttcagaagatgaatgactttcctttctcctagcctaccttaattataactgagtccatttttctttgagtggtttacatagtgatcagcaagaattctttctatattaaggatttttttccactcctctattatatagtttgtattttaaattttttcttagaaatatattttttactaaatgaagattttaacatttttttatagatgtatctgtgaagtttttttctttatggtctctgaatttttttgtcatgctgagaaatgaggccttttcccccttcaataaaattcaacaccccttcatgctaaaaactctcaataaactacgtattgatggaatgtatctcaaaataataataactatttatgacaagcccacagccaatatcatactgaatgagcaaaagctggaagcattccctttgaaaaccggcacaagacaaggatgccctctctcaccactcccattcaacataatgttggaagttctggccagggcaatcaggcaagagaaagaaataaaggatattcaaacaaaaaggaagtcaggttgtctctgtttgcagatgacatgattgtatatttagaaaaccccatcgtctcagcccaaaatctccttaagctgataagcaacttcagcaaagtctcaggacacaaaatcaatgtgcaaaaatcacaagctttcctgtacaccaatagtagacaagcagagagccaaatcatgagtgaactcccgttcacaattgctacaaaagaataaaatacctaggcatacaactaacaagggatgtgaaggacctcttcaaggagaactacaaaccactgctcaaggaaatgagagaggacacaaatggaagaacattccatgctcatggataggaagaatcaatatcgtgaaaatggccatactgcctaaagtaatttatagattcaatgctatctccatcaagctgccattgactttcttcacagaattagaaaaaaactactttaaatttcatatggaaccaaaaaagaacccatatagccaagacagtcctaagcagagaacaaagctggacgcatcatgctacctgacttcaaactattgttacaaggctacagtaaccaaaacagaatggtacgggtaccaaaacagatctgtagaccaatggaacagaatagaggcctcagaaataacaccacacatctacaaccatctgatctttgacaaacctgacaaaagcaatggggaaaggattctagccatatgcagaaaacaaactggaccccttccttacaccttatacaaaaattaactcaagatggattaaagacttaaacataagacctaaaaccataaaaaccctagaagaaaacctaggcaataccattcaggacataggcatgggcaagaacttcatgactaaaaccccaaaagcaatggcaacaaaagccaaaactgacaaatgggatctaattaaactaaagagcttctgcacagcaaaagaagctatcatcagagtaaacagccaacttacagaatgggagaaaatttttgcagtccatctgacaaagggctaatatccagaatcaacaaagaacttcaacaaatttacaagaaaaaaccccatcaaaaagtgggcaaaggatatgaacagacacttctcaaaactgccatttatgtggccaagaaacatgaaaaaaagctcatcatcactggtgattagagaaatgcaaatcaaaacaacaatgaaataccatctcataccagttagaatggcgatcattaaaaagtcaggaaacaacagatgctggagaggatgtggagaaataggaacactttaacattgttggtgggagtgtaaattagtttagccattgtggaagacagtgtggcaattcctcaaggacctagaaccagaaataccatttaacccagcagtcgcattactggatatatacccaaaggattataaatcattctgctataaagacacatgcacacttatgtttattgcagcagtattcacattagcaaagattggaaccaacccaaatgcccatcaatgatagagtggataaagaagatgtggcacatagacaccatcaatactatgcagccataaaaaacgatgagttcatatcctttgcagggacatggatgaagctttaaaaccatcagtctcagcaaactaacacaggaacagaaaaccaaacaccgcgtgttctcactcataagtgggagttgaacaatgagaacacatggacacagggaggggaatatcacacaccaggcctgtcggggggcggtgggaggctaggggagggatagcattgggagaaatacctaatgtagatgacgggttgatgggtgcagcaaaccaccatggcacatgtatacctatgtaacaaacctgcacgttctgcgcatgtatcccagaacttaaagtataataatttaaaaaaaaagaccatttcgcctgctagattatacaaactaaactttctcaaataaattcatttccattttaatgttatttattcccaggcttagagacatcgtttaaacaaactatcttgaaaatattatgacacatctctcatttctttataatcgttatgcaggaaaattgcctaagaattatgacccaaaagttaccccagatccagaaagatggctgccaatgcgagaacgttcttactaccggggaagaaagaagggtaaaaagaaggatcagattggaaaagggacccagggagcaactgcaggagcttcatctgaactgtaagttattgctccacaattgagggcacttagaacatacgttgtttctagattgactcaaggctattagtgagaatttgttaatataaagtatgagaaatgtgatgtatctttgataaatgtttatactacacttatgcaaatgaaagaaaatatattgcctttttagactagtttttcctttagtttttacaattcagtcaaatagttttaagtatttacaatataatcaaatatatattgtgaaatatatatagtaaaaactattataaaaactaaaagtctcaaggcaactaaatacactgagtcattcaactaaataaatatctagataaacagatgtaaataaataatatgactagaaagaagtgttagaagtattaatacgttttacatggtggatgacaggttattttaaaaaattttttctggccgggcgcagtggctcacgcctgtaatcccagcactttgggaggccaaagcaggcagatcatttgaggttgctagttcgagaatagcttggccaatatggtgaaaccctgtctctactaaaaatacaaaaattagccgggtgtggtagtgcgcacctgtaatcccagctactcgggtggttgaggcaggagaatcacgtgaacccagaaggatcacgtgaacccaggaggtggatggaggttgcagtgagctgagatggtgccactgcattccagcctgagggacagagcaagactctgtctcaaaaaaataaaattttttattttctacgctttctaaaacttggcatgtgtaccatgttttacttttcttcaataaaaacagtgaaaatgttattcaaaagaaaagtcgatagggagttggggagcttaccttaaaagaagtagaaaatgtgtgggagattgttaagtgtgataagtaaaacccatgtacatacatttttatactcttccttcgttgaatatatgagtgaccaaaaatgatctgatgatttcagggatgccagtaaaactgtgagcagcccacccacctccccaagacctggcagtgctgcaacagtatctgcctctacaagtaacatcatacccccaagacaccagaaacctgcaggggctccagcaacaaaaaagaaacagcaacagaaaaagaagaaaggtggaaaaggtggctggtgatgagaatattcttgttgcaggctgtttttaaactagtgtcagtgacactaggaatataataaaggtaacacagcaagaagcacagaactactccctcttcatctccatattttcataatttcttgtgtttcaaatagggaaacatcttcctcaaagtctgcctagtgagatatggcctactggttgcctcatagctttgtacagattatgaggactgaaaataattgggcatttacccatcttggtatctgttgtatcctttatctgtgtgtgctgatttgatcttttttcagtttcacataccttatctaaggtttcccaggatttaaacagaaactacttctatgatttcagctggagtctgaagatacttgtttctgttcaagtcccactttaaattatgtcttaggagactgaaagtggaatcttctgagcattcctaaatatctgcttagaaatatcatgtgataaagagggaccttcttaatacactgatgttcttcactaaatggatggccacaagaaaaataaagtaaatgtcttaaataatttaaccataaattttctgtcatgtgatactggaatatgggatacttttcatgtttatatatatatatatatgtatatatatatacatatatatatatatataaacatgaaatatatatatatggctcctttgtgccccatgtcattttcagattatggtagcatgctgatacagcaccatgaaagaactcaaggaaaatatatcaatgtaagaagttcactcttagacccagtgttctgaggtcacatgggtttggactgtctcaatcagaaagattaatgactgttatcaagaacatgaacattggcttcctccatagagaagaaatcagtatctgagttgcataccaggcagtattaaaatctaacaggtctgtttggcccattgatagatactcaaatggtgtctccttctggttatggattttgaccattgattacctttctcaatgtaatgaagtattttacagtcaatttgtggtgtaaatgttgctcttgtctttccttgcttacaaactactttcacattgaacagctgtgagacagacatattgagatgcctgcccttgttagtattcattttatgctgcccaagatatcatttaatttagacttaacaagtatttccttgtgattatattactctgtccttgttaataaagtgctgctgtgtttgactctgaacatactaccaaaacttcttcaaagagttttttatgaaagactttcctcctttacaagaaagaaatggggtgctgcctttctgtttagtaaaagcagaatttgcagtggcatctaaagagatcttttttaaataaaaattatgtattgtggcataatcctttttttgagctctacagagaacagtcttttggtaatagtggcaggtatttattccttctgaatatataccccattataggaataactgttacttatttaggattccatcattgaaaattttgacccaaggcacagcagtgaaatttatagttctcaatttagttgtcattattgacaggcattggtattattagtcattgctaagcaactaaaacttcatcagttcaaataagttttaattgtcaaatgaagtataaacacatgaactttctagaaatatttcctcttttggataggtctttaaccagttcatatatatactttgtcaaatatatggatgtgtatgtgtacatttataagaaccagtatggatacatccattcactgtggtacattttaaaataaaatattttagcagtgaatatgga

SEQ ID NO: 37069 - DNA, 36065 bp, Homo sapiens; identical to SEQ ID NO: 37068

SEQ ID NO: 37070 - DNA, 80423 bp, Homo sapiens
ggagaaaggagagaaaggaaagcgcgaggagccgccgccaccaccagcgcagcagtcctggagctgtgaggagattcgggccgtcaccctgcctcccctgcgtcccgccaccggccgcttctgtcctcggtgagggtctgttccgagggtcgggggaggtcgcctagggccccgcgcgcgcccggcagacggcggacctcacccggcgcctggcaacagcgcggggggtgaccggggtcgccggccggggaaaggactggacggggcgggggccgtggccggggttgcggggcgaagggtgggcggggtcctctgggtcaggtctggggccggggccggggctggggtctggggccgcccggccgcgtcctccccgcccggcgtccttgccggaacgcggcccagcctccgcggcggcggttgggggtggggcccggcctgggagcggccggctggggctcggctggggctcggcggggccggcagcgtgggaggcgtggagcgccttctttttctaaggctcccgcactcgcgtctgaaaccagaaacgggagtggcttgcggagcaggaatgccgcagccgtgccgccaagttcggagggagaagaagcaggtgggggaccgcaaagccctgtttctagaactccggacggattgttcagaagtttgtggaagagcaggctgcctttctcactcagaatgtttgtctgctttgctttgcgttaaagaatctgcaccgtagttgatgcaactgaagtttatataagaagtttacattaactcttacctaaggaaggtcagtgacacacgcagtgtaaactgcaaatcatatattggctcgagaaaggttttggcactagcgaattttttaaaggatgggtttgctagtcagacgtaaacttctgtgctaacttctcacgtaaacggggcaggaaacagcgcaagtagaacgatcgtgccaccaccgaaggggtgccgcctgcgagctcggaggcttcagcctgtttgggaagagtaggctgagcggcgctctttgtagttttcaacgtttttattgagttgcgaattttagtaaggatttgtcgctacaatttaagccaaattattgatttagtagaaaagttagagtgaagaccgaagaaaggaaacagacgttaaccattaaagcttgattgctgctgcttcgtgtttaaccgcacttttccaaatagtgttgcgtatcagaacgattcatgatttctgaaaggaattatatgcagccgccttactcctccgccagtccacccgtcccgcgttctctctgggtttactccagacttcctttttttttttttcctgagacggagtctgttctgttgcccaggccagagtgcagtggcgcgatctccactcactgcaacttccagctcccaggttcaagcgagtctcctgcctcagcctcctgagtagctggggttacgggtgctcgccaccatgtccgactaatttttgtatttttagtagagacgggggtttcaccgtgttggtcaggctggtctcgaacttatgacctaaagtgatcgcctgcctcggcctcccaaagtgttgggattagaggcgcgagccaccgcgcctcgccgactccagacttgtttccactcctgagggccttaagctcccttggagtttgtgctttcacatttctttctgccttccgtgataaagggatgaatagtttttatgcacgcttcagcgagctgcgggtttttgtggattacgcaggctgtgaaatttgggaagtaagttgccttaagttggtagatgtggagatttgacaggaagtgggagaacaaaggggttgggaagcttttggaaagtgtccaggcttcatctgtgctgtggaaggtgagaaagttgggaattccagagggcagagctcttaaagaatttgagatgagttcagcactctcttcaaaacagtgttttaaaatttattttcttctggatatgaaagtgttaggtttgggaagtaattctggctgtaggacagtttttccggaacactaggtggggagtgttgaatgttgtgaagactaaaatatgcatatggtattacagtgtgatacctgttactgagtggcgtacattagctttcatttttaagcaagcccgtaattcccttctattaactctgttttggacagtggtacccgtcaccctcatcagtcttcaacctagataacctaaatccaggtctgaggtgggggtggaatggtctgtttgcaccttttttttttttttttttttttttttttttgagacggagtcttgctctgtcgcccaggccgtaattaatgcggtggcgcgatctcggctcactgcaagctccacctcccggggtcacaccattctcctgcctcagcctcccgagtagctgggacttcaagcttccgccaccacagccggctaatttttttgtatttttttagtagagacggggtttcaccgtgttagccaggatggtcttgatctcctgacctcgtgatccgcctcctcggcctcccaaagtgctgggattacaggcatgagccaccgcgcccggccttttgtgtgtgtgtgtgtgtgtgtgtgtgtgtgtgtgtgtgtgtgtgtgagatggagtttagctcttgcccctgctggagtataatggcaccatcttggctcactgcaacttcgcctcccaggttcaagcgattctcctgcctcagcctcccgagtagctgggattacaggcatgcgccaccacgcccagctaattttttctatttttattagagacgaggtttcactatgttgttcaggctggtctcgaactcctgacctcaggtgatccacccgcctcggcttcgcaaagtgctggattacaggtgtgagcccgcgcgtccggctgtcactttaaagagtattataagagggcacttcataacttgggcaggtatttttagtcatcctgaacgtgtcgctgtggactgggtgtcaccgcgggaccgcacagacaccttactgtcgtctgctgtaaaggtcagcttctatattggttaatgcttacagatatctgttgaggaataagagaatgtaattagcctttgtatttgtgagttgacgttttgacgggatttttacttcttagtatttatttgcatcgaggttacacactggattaacagcgttttttggaaacctttttaaaactttttcatttcctcagaaatgattctgttcaaaatgtggtttggttaaatttgtgcaggaccccacctggtggtgagaggcgggtaactgcaggctcattagcgagtaagagtaggatcagtggcaggatttagcaaatggtgtagttcaaggatgaatagaatttgagaatatcaaactcaaaaaaatgaggttaatgagaagaagagcaaagttggtgaaaacaagaatatgttagaaacgatgatgtaggaatggaaaaacgacaacgcctacctgcagaaaagtcaactagtaaaaatgtgatttttttttttgtattgatattaatgaggtgttttgtcaaacaaaaccctttatgtttttgtatggacataaatcactgttgacctgtttcatgttcctggagatatcctacttgagaaggaatattgattgatgattagttgactgactgatttacttgagatggagtccttgctctgtgtcccaggctggagtgcagtggcgcggtcttggctcactgcactcctgggttcaagccattctcctgcttcagcctgccaggtagctgggatgacaggcgcgtgtcaccacgcctggctaatttttgtatttttagtagagacggtttcaccatgttggtcaggctggtctcgaacacctgacctcaggtgatcccctgcctccgcctcccaaagtgctgggattacaggcgtgacccaccgcacctggctgtgtgtgtgtgtgtgtgtgtgtgtgtgtgtgtgcgcgcgcgcaggtggaatcaccctgtgtgcccaggctggtctcgaactcctggcctcaagtgagtctttcatcccggcctgtcaaagtgctagaattacaagtgtgagccaggtgcctggccagattttagatttttttgttgttgttgagatggaatctcatattgcccaggctggatgcagtggcgccatctcggctcactgcaacctctgccgcacgggttcaagcgattctcctgcctcagcctcccgagtagctgtgattacaggcacctgccactgctcccgactgatttttgtatttttagtagagacgggggtttcaccatcttggccaggctggtcttgaactcttgacctcgtgatccacccgcctcggcctcccaaagtggtgggatcacaggtgtgagccactgcgccaggccatattttagaattcttaagctgtgttgcaaaattacgtgtctttggaagggtgatttagtttacactacatatgatttttccccctttgatatttttctacttaccttttgccaccaaaggcttaaattaaaagtgtgttttatatttgtgttgtgcatatatacgtgtgtgctctagttggtatgcttatgaactgtgtactaatacttattcctctctgccaccttgagatggcatgtaccacttgggtgggctttgaatctgaagttatttgtgtttataggaatgtccaggacacagagtgcttagaaagtattgattgaattagattctttctagtttgtgtatgtcctgatgaccttcctgtgattaataatggaatccagaattcaagaaagttggaaaaaataagtttcagcagcactggagactgagtacttaaccgagtgttgctttgtttattttagagtctcacactgtcacccaggctggagtgcagtgtcgcgatcttggctcaccgcaacctccacctctggggttcaagcgattctcctgcctcagcctccctggtagctgagattacaggcgttcgccactacacctggctaattgttgtatatttagtagagagtgggttttgccatgttggccagactggtttggaagcaggtgatccacctgctttggcctcccaaagtgctgggattacaggtgtgaagcaccgagcctggccctattttattataataataattttttttgagacagggtctcactctgtcacccagactggagtgcagtggcgtgatctcagctcaccccagcctccgcctcctagtgtcaagtgattctcctacctcaggctccggagtagctgggattacaggcacgtgccactatcctggctaatttttttttttttttttttttttttttgagtttcactcttgttgcccaggctggagtgcagtggtgcaatctcagctcactgcaacctctgcctcccaggttcaagcgattctcctgcctcagcctcccgagtacatgggattacaggcatgcaccacgacacccagctaattttgtatttttagtagagacagggttttgccctgtccaactcctgacctcaggtcatccgcctgccttggcctcccaaagtgttgggattacaggcgtgagccagcgtgctggcctaacttctatatttttagtagagatagggtttcaccatgttggccaggctggtcttgaacttgtgacctcaatccaccttcctcgaccttccaaagtgctgggattacaggtgtgagccaccaagcctggcctattatgattttttaatgaaagggagttaagcttggaagtatctaataggtgatgagtgctagttgaagaaatggtctctgatcttgagtaatggggaaataacttctgtgtttgtttcagaaatattttaggacatactggataatgaaataagtaggtgatgtgtgtgataaggaatgaaaattcactgctgtgggtttttttttttcctacctgtctgtactttttttgtttttgctttttttttttgttgtttgagaccaagtctcactctgtcacttaggctggagtgcagcggcgtgatcttggctcactgcaacctttgcctcccaggctcaagcaattcttgtgcttcagccttctttctgagtagctgggattacagatgtgcaccaccacacccaggtaattttttttttttttttaagacagagtcttgctctgttgctcaggcaggagtgcagtggcactatcttggctcactgcgcctgcacctcccaggttcaagcaattctcctgcctcaggctgccgagtagctgggactacaggcgctcaccaccatgcctggctaatttttgtatttttagtagagaaaggggtttgccatgttggccgggctggtcttgaacacctcaggtgatctgcgtgcctcggccctccaaagtgctgggattacaggcgtgagccacctcacctggcctcagatgaatttagaaaccactatttttttttgagatggagtcttgctctgttgccccggctggagtgctgtggtgtgatctcagctcactgcaaactctcccgggttcaagcagttctcctgcctcacctggaactacaggcgccaccacgtctgactgggttttgtatttttagtagagacggggtttcaccacgttggccatgctgttctcaaactcctgaccccaggtgatccacctgccatggcctcccaaagtgctgggattatacgcatgagctacccacgcctaatctttatgtgacgtgtttttttaaaagtcctaaacttagaggtcattgaatttattggagaaggttatttttgattaatggcgattaggctaatttttttcatggttttaatagagatttttcgtttttttaaacttgatttagatgtattgcttttggaaattgcagaaattaacaaaccgagttttcctaagaaatattttttcttaatttcttaattgaaaagttttctatggcttccttaatagacagtaggacctagttaatagtttaaagaagtttcataattgttattagaaatgttaattatgggccgggtgtggtggctcacacctgtaatcccagtactttgggaggccaaggtggtcagatcacaaggtcaggagtttgagaccatcctggctagcatggtgaaaccccatctctactaaaacaatacaaaaatcagctgggcgtggtgacaggtgcctgtagtctcagctacttagcaggctgaggcaggagaatggcgtgaacgcgggaggcggagcttgcagtgagccgagatccctctactgcactctactgcactctgcctgggtgacagagtgagactccgtctcaaaaaaaaaaaaaaatagccaggcattgtgggacacacctgtagtcccaggtactcgggaggctgatgcaggagaatcgctggaaccagggaggtggaggttgcagtgagctgagattgtgctgctgcactccagcctgggcaacagagtgagactcaaactcaaaaaaaaaaaaaagttaattttgtagttagagaatatcttcctgctctacgcaaattcccttccagcctgaaattatttgtttttttattttttatttaaaaaaaaatttattatttttgtgacagggtcttgctccgttacgtaggctggagggcattggtgcgttcacgtctcactagcatcgactgcctgggctcaagtgattttcctgcctcagccacttccagtagctgggactacaggtgcacactgccacaccctactgagtttttatatttcgtagagacaagattttgctgtgttactcagcgtggtcttgaactcctgagctgaagtgatccccctgcctcagcctgccaaagtgttaggattacaggcatgagctactgtacccagctgtgatttcttttaaagtgctactttacagcactgtcacttttattttatcatttttaactttaaagttttttgtttatttttatttattttattttttgagatgaagtttcgcccttgttgcccaggctagagtgcaatggagtggtctcggctcactgcaacctctgccttccaggttcaagtgattctcctgcctcagcctcccaagtaactgggattacaggcgcccgccaccacacctggctagtttttgtattttttgtagagacaggatttcaccatgttgtccagactggtcttgaattcctgacctcaggtgatccacccgcctcagcctcccaaagtgctgggattacaggcgtgagccactgcgcctggcttaaaatttttattttttatatattttgtttttttctgagacagggccttgccctgtctcttgtccaagttggagtgcagtgacatgacatggctcacagcatccttgatctcttgcgctcaagtgatcctgccatttcagcctcctgcatagctgggagtacaggcatgtgccaccccactcagctaattttttttatctttttgtagagatggtgtcttactgtgttgcccaggctggtctcaagctcttgggctcaagtgatccttctgcacatttccaaggttgtttcactcctgtgtctttgctgtctagaagcttttcagtgtgatgtaatcccacttgtctgtttcggcttttgttccttgtgcttttgggggtcatatccaaacaaagattgctgaggggccaaattttaaattgtgtataattttaatgacttcagatttaaatagctgcatttggcttatggagtcttttgagcagcatggttttaaaaaggtttttgccaagtggggttctaatggacacctatgcttgtagagctctgatgtgagtgatctgctgtagaaattacttcttttgatttagtatattattttaaaatgcaggtgatgcactggtttcttggtgagggaagctggtttttcctggctgagcttctgtagggtggagggctggagtccaggctctcgctgggcagggaaggcagcttgagtgtgccttccagtcctcctgagggcccacatttttctgggatcacctgttttctgtaatgtgcattgaacacacgggccaggagaagagggaagtagaggagctttgtcctctgtgctcatcctcacagtgctgggcgggccagaaggattcagggccaaccttagggagatgaaggccagttaaaatgttttattgccacaaatggtgtcttttaagaaatgaatccatgtattttacacttaaatgatattaggctactccgggcacactgcctatggggtagccctgctctgcaaggagtagtaaaaaaaaaaaaaaaaaaaaagttaaagatacaacttagtttctctgtgactagggaaatcgtccaagtatgtatcaaataatgctaattggtacctagttttatatcttgattaggcaactttttgcttaaaattgttttggaatgcattagtatttctacagcttcaggctgctttatcatctaatacacagttggatatttaatatatagttttatcagttttttttaaacactgtttttgagaggtctgaggaaaaaaaagatagtgttaccaaaaatacttctatagggaaatactgatagaaatgtataggtagccttgaaattctgaggttaataaaaaaatttgaatgcaggtaacctttcatggagtttgtcaaattttaaattgtgtcttacatcagtgatgactgaagcagtaaggagtgagcttgcagcaaacagtggggattgttgcagcatcagcacttcagccagctctgcaggtttccttggagacacgtggatttctctttctagaccttcagctattttcttttttttcttgttttcttgagatggagtcttgctctgtcgcccaggctgcagtgcagtggtgcgatctcggcgcactgcaagctccacctctcgggttcacaccgttctcctgcctcagcctgccaagtagctgagactacaggcgcccgccaccacgcccggctaattttttctatttttagtagagacggggtttcaccgtgttagctaggatggtcttgatctcctgacctcgtgattcgcctgcctcggcctcccaaagtgctgggattacaggcatgagccaccgcgcccggccagctattttcattttgttgtttctgtaatgcgtatttgtatttaatttatattctaaatttgttagtcttactggcatttgatgaaaactaaaaaggtaattttgagatttcaagtactggtgagagaatgtcccatagccttgagggttggaattgtgtacattgacagcatagtgccacgatacaggctagcatgagttctggaggcaaacttggattcttactatttttaaagatgcagtgtctttggtatgttgcccaggttgaactcagactcctgggctgaagccatcctcctgcctcagccttctgagtcactgggactttaggtgcacgtgactgtgctcggctcagacttgggttttgaacttgctggaacattgacatttacttaattcctttgagcccccgtttcctcacctacaaacagtaactcacagaatgactgtgatggaatacgtacctgtaagaatgtgtgacacgtgagtcagtaacacattgttgccccagctcctttcccccttaatcggctaataattaagcctcaattattagtaaactaattaagcatcatatgacttgatgattagcatgtcacgtttaaaattacctgttgtcattcaggttataagaagtttgtttatttatttgtttttttgagttggagtctcgctctgtcaccctggctggagtgcagtggtgtgatcttggtttactccaacctctgcctcccgggctcaagcgattcttctgcctcagcctcccgagtagctgggattacaggtgcacaccaccatgcctagctaatttttgtatttttagtagagatggtgttacgtcatgttggtcaggctggtcttgaactcttgacctcaggtgatccacctacctcagcctcccaaagtgctgggattacaggcgtgagccaccatgcctggccttattttatttttttgagatggagtcttgctctgtggctcaggctggagtgcagtagcgtgatcttggctcactgtgacctctgcctcccgggttcaagcgattctcctgcctcagcctcctgagtagctgggattacaggcgcccaccaccttgcccagctaattttttgtatttttagtagagatggggtttcgccatgttggccaggctggtcttgaactcctgacctcaagtgatccacccgtcttggcctcccaaagtgctggaattacaggcatgagccactgcgcccagtcttattttttaatattgccatattttaaataggaatggaagatttctgcaccagtcctagcgtttgtggatgtgcatggaaccctgttggtgaagttttcttgccttggagaaggaccctaaacagtttcctaaatagctctcctgtctgcgcttggttgcattcctgtcgtttttgattcccgcacatatcgtttggagcatcttcgtaaccctgccgtccagtcatcactctcttaagtccatctcccttgtagttagaagttatctttccacatactcctgttgagttcacaccaccgcttaactcttctacttacagtggaagagtcctaattccttagttgtaaaattcttcagttgcgccctgttctttcttgtcctgactccctcccctccctcttactcccagcaccctcacactgacgttccaccctactaacttgctgcgtcccacatgggctgtgtgctgtcgttattttgcctgagcatacgctgttacttgtgtgtggaatacttttgcctctgttctctgcctggggagcttactcttgtttttcatttcgtcagtaaaatgtcagtgttaatttttcctttcctcatggtctctataccatctccccagcactctgtgcatatttgtctttttaaatttttttttattttttgtgtagatgagggcttgctgtgttgttgctcacgcttatctggaattcctgggctgaagcagtcttccagcctcggcctcccagtagtgctgggattacaggtgtgagaccctgcaacggccatgtgcatatttgtctacatgcctgtcttccactaaacttgatgacttttattatttccaaagctagcatagtgtgtgttataaatagtaagtttgtatgattaaattcaatcagaatgacaatattcttttaacattaggaaggctttgattggttgactaatggggccagtctcactaaaatgaaacagttgggcaaggtgtgaccctcccttcccttgagagtctcacctgcccaaaggtaatgggaaggcaggaccgtgaccccaggttagaaaagaccaggggacttagcagagttttattactttttttttttgagtcagagtcttgctcggtcacccaggttggcgtgcagtggtaaaatcacggctcactgcagcctagacctcctgggctcaagccatcctcccacctcagcctcccgagtagctgggaccatgcgctgtgccatcatgcctggctaattattttattttttgagacggagtctcactctgtcatccaggctggagtgcagtggcatgatctcagctcactgcaacctccgcctcccgggttcaagcaattctcatgcctcagtctcctgagtaactgggattacaggttcatgccaccacacccagctgatttttgtatttttagtagagacggtttcgtcatgtcagccaggctggtctcgaactcctggcctcaggtgatctgtccgcctcagcctcccagagtggtgggatttcagacatgagccaccgcgcctggccaacgcccggctaattattttatttttagtagattcagagtctccctttgttgtccaggctggtcttgagctccttagctcaagcgttccctcattctctgtccccagaacactgggattacaggcatgaaccattgcatcctgcccgaattttattgttaattgtagcatcctggtccattttcccgtcctgatcagaaagagagctgtgggtcttgttatcttttgttggtggcaattggactgtccctggagtatctgtgttggactgggggcactaagacattacgacattggagcttgctcagaggggagggaccaggtaggtcagggtttctcaggaggaactgtgaagaattgtaagggtatatttgcctagagacagaaaaacttgccaagataaagcccccaaatatccaaaggtaactatgcggaagagaaattgaacctgtatcgcataatttgaataaggaccaaagggtgaaaattccttggagacccccgctccccagcataaggaagaattcctgtagttaactaaaattcagggcttgactttggagataatgagttccggtcactggcgtttgttcaggcagagaaaggttgcactaattagtggttattgaagtgtggatgccttatgagtcagagcttgaacttggtgatataaaggtcctttaataagaatttgaggaagacgcccaatatggcacttttctcgaagtacttggagacaacaacctttttttttttatttttttttgagatggagtcttactctgtctcccaggctggagtgcagtggtgcgatcttggctcactgcaaccaccacctcccaggttcaagtgagtctcctgcctcagcctcccgagtcttagctggcgttacaggtgttagccaccagacctggccagagacaacaactttttaattctgagattctgtggtagcatatgccagacattagccagctgcttaacttttgtccagtcttttttttttttttgagacagagtttcgctcttgttggccaggctggagtgcgatggtgcaatcgcggctcactgcagcctccgtctcccaggttcaagcaattctcctgcctcagcctcctgagtagctgggattacaggaatgtgccaccatgcctagttaattttgtatttttagtagagacagagtttctccatgttggtcaggctggtctcgaactctctacctcaggtgatccgcccccctcagcctgagccaccatacctgtcctgtctttgaatactgtctcactgtttttgttctgagtctttgaaaagaatgttaaaggtcaatagtagttggaagaactaagcctgactgtctcccaactcatggttttaccaaaaactctattaaaaaactgttgtgggccgggcacggtggctcatgtctgtaatcccagcactttgggaggccgaggagggcggatctacaaggtcaggagatcgagaccatcctggctggcatggtgaaaccctgtctctactaaaaatacaaaaaaaaaattggccaggtgtggtggtggatgcctgtagtcccagctcctcaggaggctgaggcaggagaatggtgtgaaccctagaggtggagtttgcagtgagctgagattgtgccactgcactccagcctgggtgacatagtgagactctgtctcaaaacaacaacaacaacaacaacaacaacaaaaaaaaccacaaaacttgtttggctggatatggtgtatgcccataatcccagcactttggtaggccaaggtggacagatcacctgaggtcaggagtttgaaaccagcctggccaacatggtgaaaccctgtgtctactttaaaaaaaacccaaaaaacaaaacaaaaaaaaccacaaaaaattagtcggtgtggtggcacatgcctgtagtcccagctagctgggaggctgaggcaggagaattgcttgaacccgggaggtggggaggtttcagtgagtcgagattgtgctgctgcattccagcctgggcgtcagagagcgagacactatctcaaaaacaaacaaacaaacaaacaaaaaaacaaaacttctcaatttaaaatatttactccaatttgtggctcacgcctgtattcccagcactttaggaggctgaggtgagcggataacgaggtcaggagatcgagaccatcctggccaacatggtgaaacccgtccctactaaaaatagaaaaattagctaggcgtggtggtgggcacctgtaatcccagctactccagaggctgagacaggaaagtcgcttgaaccagggagttggaggttgcagtgagccaaaattgtgctactctactctggcgacagagcaagactctgtctcaaaatatatacatatatatgtatatatatataattttcttttttactccaagtaagctaggagtatcttcagtattgctgaaggctttatttaatcatgcagtgtgtatttgatggtggattactctctgaatatttattcagttgaatgtggaatgaggtggtatgaagatgggggtgggggtgatttggaggtcctttgactattcctgctggctccctggtgagggtgtggcatctctgcagatgagttctcctgactgtgctcaggcggctgtctgtgtgcccatcgctcctgcctgcttttctctttccttcccacttcctcattgtgtgagaccatccactccgtgtattactggttcctttctacttcatcacaagcaggtagcacttaggatattctagatggagctcagggctttcttcccttggagagcatcatctgtaaacaaccatggaagtggatgtcacccacttcacagggtggggaagcaaccacagtgagtaggtagttttccaaggaaccacggcttgtttacgataaacacccagttccacttccaagttcctacgctgtgaacattactgcttccctgtacagggaaggcagggtggtaaatccttgattcttagtgcttgctggctttttagagtgacatgaactcaagaattttaaatgtaggttttaaattcaattcagtcaattcactttgaagcccacattctcgttaaggtcaggaattgccctatcaaatttttttttttttaatttttaaaatttttcgtagagacagggtttcgccgtgttgccaaggctggtcttgaactgctgggctcatgcagtttgtccgcctcgggctcctaaagtgttgagattacaggtgtgagctgccgcacccggtccagtttggtttctgtgtccttttgatgtacacttcgtctttttgaagtttttaaactttattttgaggtagttttagatttacagaaaagttgtaaagatagtacagggattttcctgtataccattcacccaacttcccttaatctttctgtaactgtggtaactgtggtgaatttctcaaaagtaagcagttgacaccgctacagtattgttaaatgtggactttattcatattccacctgtttttctgctaatgtccttttcctgttctagaaaccatccgaggaacccagattgtatttagttgtcatttactcttagttacaggttgtctgtcccgttgtttttcttgaccggggtgtgtgtgtgtgtgtgtgtgtgtgtgtgtgtgtgtatgtatttttttttgtttgtttgtgataagttgggcctggttagtgcttggatgggagatagggtctcgttctgttgcctgtgctggaatgccgcggtgcagtcctgactcactgtagccttgacaaccttcctggctcaagtgatcctcccacctcagcctcctgagtagctgggatgacagacacatgccaccatgcacagctacttaaattttttttttgttgcacagagttctcactgtgtttcccaggctgatcttgaactcctgggctcaagcagtcctcctgccttggcctcccaaagtgctggaattataggagtgagccactgcgcctggcctgagtctgtgattttggatagctttttaaattttcttgcttgatctagcattagccagtatagtaaatttttatttcaatttaattctgaattgacctgtactttatagctggttttgtccagggcaggaccacagattgtatctgttgtgataataatctacacatttattcatttttgtttgtttttttcgacttttttgagatggagttttgttcttgttgcccaggctggagtgcaatggtgcgatctcggctcaccgcagcctccgcttcctgggttcaagcgattctcctgcctcagcctcttgagtagctgggattacaggcatgcgctaccacgcccggctaattttgtatttttagtagagacaaggttgctccatgttgatcaggctggtctcgaactcccgacctcaggtgatccacccaccttggcctcccaaagtgctgggattacaggtgtgagccgctgtgcccagctattcatttttagttttaattttttttttaaaaaaattattttcatttttttggagacaggtctcgctctcaccccaagctggagtgctgtggcacgctttcgaactggtctccaactcctgggctcaaggagtcctcccactttggtctcacaaagtgccaggattacaggtgtgtgccaccgtgcccagccaatatctgcacatttataagctgacatctctgagagcacagggcaggatgaaattagaggctgctgtaggtcagggtaagggataatgatgctggtgaagataaagaacagtgaatgaatttcatttatttcagaggtagactcggcagaactttgtgatttatttgtgtctgtgtgctgagtgtagtgacgttggcgaaggtgaacatttcacaggcacctcggagctcaaggtagaatttactagaaaatgaccaggtatgtaggaggtggggaggattaagagttaaattttggtcgtgttctatttaggatgtctgctggacatccaagtggctgtgtcaagtagtcatctgtctatttgtgtctgaagtgcccaggagaggcctgagcttggagcttacatctgggactcattgctaagtaaattatatttatgtaatgggaaaggatgaaaacccacatgtaggatgagagttggccttgagcctttagcgttcccgtagtttcttttatttatttatttatttattttgagatggagtctcactgtcgtccaggttggagtgcagtggcgcgggcgcgatctcggctcactgcaggctccgcctcccggggttcacgccgttctcctgcctcaccatcccgagtagctgggactacaggcacccgccacctctcttggctaattttttgtatttttagtagagatggagtttcaccgtgttagccaggatggtcttgatctcctgacctcgtgatctgcccgcctcggcctcccaaagtggtgggattacaggcgtgagccaccgcacccggccagcattcccgtggtttcttcagcgggccagtggaggggtgaaagctggtggtggaaggcagatggagagagaagttggacaaggagagctgggaaacgtctgtgggtggtgctgtgggttttttactgaccttaaataagagcctccagtggcaggcagtggggagctgcagcaggactgggggatgagtccaggcaaggaagtggagcggctaagggtaagcagtgcaggaggagcgcagaggtgagggcatccactccagggggtggctctcatactgcctttatgctttccttgtagggtagccttcatttggtaaggaaactagccatttgatggagtgctgcatgaataccgagtgctgttagtggatgctgcacgtacatgacagagcaggctttcagtgagagtgtttttggtggtgaagtaaatcacagcattccccagctggccacgcggccctcacccacacccacgttctcacctctgtgctcactgcctcgggaggtgtcttcctcccattcccaccaccatatgcacaaacacaggcacacaagtgcagatagaagatgagctgtttggacttgcgagggcatgtgtgcttggtgtgtggcacattgaatggcctcttgctatatatagtgctcagaggggatgatccagatgtctggcatggggagactggtactgagatttctgctcttgttctgttagtgagagtggattagcagcttccctctgtttctgctaggtactgccactggcatcactgccaaaatgccacctcagatcgttggcagcaaactggagctggagtgaaaataacctcacgtagtcactcagccaagggaatgagggagacgtgaagaaacgctggctttcctgctgcttgttgcctgctctgtcttgtgtgctgtgactgatgggcaggtttttagttactgaaagaagattgcggtgttcctacttacgggagtcgactcctgtcttttctctagagactggtcggacctgtgtggcttgaatcctgtatgttgccatgtcattctaactaccagggaggaaatctttcataactaggggttccttaccttgtaacttattacatgaagtccctaatattttatattgattatttccaaatggagtggaaagaactgtgcagtggtatacccttaggcacattctccaattaatattttatctttgttttattatgtatccagcaaagctgataacgttaaattggaataattacaagaaaataggaacaagtttttttctaagttgtaattttaaaaatactgggaacaaatctacttaagaaaaagaacattttgatactctaaattccgtatcttgtagttggcatattaaacttaacacctagaatctttgctgtcatgtatttgaagatgtacatttcttttctaagtttgatgttagtcattctgtcgaattgataatgtagtttatatacatctaaatagatcctgatttccattatagttttttgtttttttgatgaaaggacttccataaaaacaagagttttaggtccaggtttggtggctcatgcctgcagtcccagcactttgggaggctgaggtgggaagaatccttgagcccaggagtttgagaccaagatcagcaacaaagtgagaccctgtctcaattaaaaaaaaaaacaaaaaacaaaaaccaagagttgaagtttccacagatgtgtctttgtggctttgtgatactgttgtccttccttccttccttccttccttccttccttccttccttccttccttccgtccttccttccgtccttccttccgtccttccttccttccttccttccttccttccttcctcgttccgtcgcccgggctggagtccggtggcatgggctggagtctggtggcacgatgtcagctcactgcagtctctgcctcctgggttcaagcaattctgcttcagcctcccgagtagctgggactacaggtgtgcaccacgatgccggctaatttttgtatttttagtagagacaggatttcaccatgttggccaggctgatctcgaactcctgacctcaagtgatccacctccctcggcctcctaaagcgctgggattacaggtgtgagccacgcgcccggctgtgcagattcttgattgttgttttaaaagagtaggttagccagtcaaattgaaagaagtaaattggttaggaaacgtcacatcttaaagcagcagtgtgcgtagttcctccttgtgggaccagaggctacatcctccattagagctggcagaagcagaatgggtttcattgtacattttactgcccggggaagtaacaaggttgaaccacgtaatccataggggaacttagagaatgaatctctgctgctggttttccaccttccattcggtagtgatactatctaattagtgtggtcaacagggcaatattgtatttctttggtagaggaatggatgggagcttggaaccagagggtaaagttaacgctaactgctgtgtagtcaaaggtctttctctcttgggagatgtgtgggagggcttttgctgttccctcgtgtgggtgacagaatggtggaaggatggctttctattgttcccatgtgaagttagttcagggcagggacaacgtgtttgtccttggagccccgtggtcttgcccgatgcctggcacaggaatgcattgaatgaaagaggtaactgacgttccctgagcacagaccgtgtctaggaacacatgacagactttgtcagctagtggtcaagtggcacggagtctctgcctagagtcacctgttgtttagtttaggctattattaggctatttcagagcttttttccccgtctctagaagggtcttagggcatgaatctgggaaccagttcccagacaaggtcttggcccagcaggctagtggttagctctagtggaagttccctctgtaggccagtaggtgctaaggtgacaccaccccttcctccctctccagacccatcccaccaccgtgatttgcccatccccagcagcctcatcactgaccacctgtttttacttgcaggacccattccaacaatctcgtaaaacatggtggattactatgaagttctaggcgtgcagagacatgcctcacccgaggatattaaaaaggcgtaagtagttttatttctgtggtaatgcattttcacagtggtacattggtaattgagtagtataacttcttctattgcctatgaaaatggcttttaatgtagtataccagtctttgaatgccacatagtttaatttgacagagcagttaacgagcatttgcagtctaggcctgggctttgctcttcattagtcagtcacttggtttatatctgaagttgatgattgtttcactgaggatgtgagataatcccaaacatcttttacattggactttgaaaatggagctgacttggcattcttgagtgcccctttggaaggcaggggcccagagtacatagcactcaaattttcttgttgtgattgttgggctccggcctatgccactggagtcccttctgattcatatgaaagttcgagaactgcagcgctgcctgtggtacctgcatctgtgtgaccagggcctggccattgtgaggagggcagttcagccacagaaggctctcacggtaaccttagtctgtttaattaatgaggtgttaactgtgaatgtagagtatacagcaaagacgtcatgaaacagattgttagattttaacatagctagagagcagttagcctggaatagttggaaccaacttaaaaaaattgttaataaataatggagtgtctatactgctagacttagtgggtctgaagatagaattaacttttttgggggccaaatagttcattttgcttaatttttaaattttaataaaaatacagagtctcaatatgttgctcaggctggtctcaaactcctgggctcaagcgattctcttgccttggcctcccagattgctgcggttatatttgtgagccactgtgtgtagctgagatagttcattttaaaatgctaaattacggccaggcaagtggctcacacctctaatcctagcacttcgagaggcctaggtgggagggtcactggagcccaggggtttgagaccagcctgggcaacaaaatgagatactgtcttgaccaaaaaaaaatagttgggtgtggtggcacatgcctgtagtcccaactgctccagaggctgaggcaggagaattgcttgagcccaggaggttgaggctgcagtgagctatgttcgtgccactgtgttccagcttgggcaaccaagccgagaccctgtctcaaaaaagccaagtcaggatggctgacgttgcctgaaggttatttgaaacctctgccgaggaacctagtagaagcagtctactgaggagaggtcaggcaggccctgatgctgtcactagtagagtgaggtttcccacactgtgaggaagcctgtgctgcacacttgaggctcacactattcttatcagtaatgttaacagccaggcatacttgacagattataagacgaagacagttgggaataccttactcctctcgaataagttaatggatgtattagtctgtttttacgctgctgataaagacgtacctgagactgggaagaaaaggaggtttaatttgacttacagttccacatggctggggaggtcttacaatcatggaggagggcgaaagacacttcttacatggcgacagcaagagaatgaggaagaagcaaaagcggaaaccccttataaacccatcaggtcttgtgaggcttattatcaggagaatagcacgggaaagactagtccccatgattcagttacctccccctgggtccctcgcataacacctgggagttctgggagttacaactcaagttgagatttgggtggggacatagccagcccttatcaatggataagcataatatgtgtacagtgctttcagtaatgatggaaattacatacctttatgatagaggtcattagagagtagattggttttagttgtttctgagaacatacaggttgctgagtgtctctagcatgacgttgaagtaggaatttagaaaaggctgttacctttaaaagcagtgagatttcctgcactcctgagtgtacagttgtataaatgctgacttttaaaaatgagcagaatgatagctatgggggcgtgctgttagtctatcttgtgtacccttggctttgtgtgttgacagtttttgattgaagacttaaaggtctgtggctgccacctgttctgcatctctcctgagataccagactcttcctgggtttgagtcacacaccatgggccttccttccttggtgctgaagtactggtgtgcaggtccaacagatctgaaggtcaacattcaaagtcatttggcactgtttacacttgcatatcgtgttgtattacaccttgatttttaaatattttagtagtgtatgactggggcatacacagttgaatcttgtcctgcattctcatccattgccaagttttcatatgaacactagatgataggtagtactgcacactaatcattttttctcttttgtcttttgtatggtctgttatttttgactgaggatttctggcacatttagggttatttgatccactgctacacgtttttttttttttttgagacggtgtctcgctatgtcacccaggctggagttcaatggcgtgatctcggctcactgcaacctctgcctcccaggttcaggcgattctcctgccttagcctcccgagtaggtggaactgcaggcgcctgccatgatgcccagctaatttttatatttttaatagagacggggtttcaccatgttggccaggatggtctcgatctcttgacctcgtgatctgcctgcctcagcctcccaaagtgctgagattacaggcatgagccactgcgcccggctgctacatgtttgtttaggtccacagtgacataaattactgttaagtattctggactccagctttaatcagattttagtatggttaagccaaggttttgttgaacatgttgtaagttaaattgagccacaacagctttacagtaataacttgcctagtgttaaaagcactgtcagattagtatactagtctgaaattttgaggggtatgctgcttctcttttttaacgttaccctccttttgaatatatgctgcttaggttttgctaattagactagaggatttttttgtattcattcattcattcattcattcattcatgcattcatgttgagccggaggctcgctctgtcacctagcctggagttcagtggcacgatgttggctcactgcaacctctttctcctgggttcaagcaattcttctgtctcagcctcctgagtagctgggattacaggtgcgtgccttcatgtccggctttttgtatttttagtagagatggggttttgccatgttggccaggttggtctcgaactcctgacctcaggtgatccacccacctcggcctgccagagtgctgggattacaggtgtgagccgctgcacccggcctttttttttgtatttaaatagcgtgcaattatttggtcagttggaactctgcaacagaatatgaccttggtcatagaatctttgtagaagtcagtgttttaactctgtttagatcttgaatctggcacagagggtgtttgaaagattctgagatcctggcctgttgggtggcaggtgattcacctttggcacacagatgagctaggtagtggggctggctgaggaagtagggtcctgggaatcagaacatggaaggatatgaatggtgatgttggatcttgctgctcagtgacccaggcctttttttccctttttaaaaattttttgagacggagtttcgctcttgttgcccaggctggagtgcaatggtgcgatctcggctcaccacaacctctgcctcccaggttccagtgattctcctgccgcagcctcctgagtagctgggattacagtcaagtaccacaatgcccggctaattttgtatttttagtagcgttggggtttctccatgttggccaggctggtctcgaacttctgacctcaggtgatctgcccacctcccaaagtgctgggattacaggcatgagccaccacgcctggcctttctcctttacttcacatacttgctcagtcttgtcactgtcagtccacgttgtggacactgtgatctttatttttctatctctagaggttcgtttgtattatgctatcaggatttttattctaaaacttactttaatgagtatttttacaattttaattttgagacagtcttgttctgtcgcccaggctggactgcagtggtgtgatcatagctcactgtagccttgaactcctggcctcaagcagttgtcacgcctcagcctctggagtagctgggtctatctgtggctgcacgccactacgcctggctatctggattttagaactttgtgtatttcattgtagaggaaagggaggttttacagttaaaaccagtattcatctcaccagttggcagctctgaagccattctcgtggttaatgatgttagtttcaaaagcatagttgatttctggatttagaatgtgatctatatcctttattctttccaagatatcggaaactggcactgaagtggcatccagataaaaatcctgagaataaagaagaagcagagagaaaattcaagcaagtagcggaggcatatgaagtgctgtcggatggtgagtgacagcgagctgctgaaggaccctgagcgggcatgccggaatgcggagtgggtgttgggatcctcctcagggtagcacagtatggactcaagtgacttgtttttgatgcctactggattttgggcccttctaagagatttttacttttctcgtgaagatttgaattgatttaggtaaccacgagtgctggggagctccagggcttctagtagtttctcctaggatggctgttttaaaagcgggactagacatcctgggtttgaggaacctgggagagaggaggttgcgggactcaggtcactgtgcatgtggcgtgcttgcccccgttgtgtgtgatcattctgaccttgctcacccccactggcttaaacaataccattccagtggagtcagctttactgcttgagaggatgtcattagttcccaaaaagaggggatggaacatacagctaaaatttagatttccagtttcaggcctgttttcccctcctaggtctggagcagaggtgttctatgttactggaagtcagatccattggcctagttcacaaatgggtgaggggtcagaggtcagctgtcgcctagatgcagtcagggttccatgggggaagtaaaggctgtgcatggggcctggggtgggggaacagtgacagaactggaaagccacacagtgcccctgtctgctgcagtgctgggtggcctgttgtgagcaaaggccgaggcttttccaaggttagggatggactaactgaaccctggaagtgggcacttggttaagtgtatctgcatgtggtcaggtaattggcccttatttacaacaaaaaaaattttttttttttttaaagaacccaatttgaggcagaggttgcagtgagccgagattgcgccactgcactccagcctgggcgacagtgcgagactgtctccaaaaaacaaaacaaaaccaaaccaatcagaaggaacccagtgtaagcttgccaccttcaacagctaccagcacaccaccagccttgctttctctggtgacactgtggcccaccccctttgttttagaggaaattccaaacattttacttcaaaaaatatgaaaagacataaaaacaccgatatttgaagtcttcttgaaatgtggcatttaaggtcttgaactgttgagcttattcattggaaagtttattttttttaaagagagaggatcttgctatgtttcctagggaggccttgaactcctgggttgaggtgatcgtcctctctcctcaagttccaagcaccattgcgccaggcttgttcccttagatttgtgcgctgggagtgacagaggagggcacaggcctcagtgttaccatcttggtcttcggtccttgttgtttgtgtgctaattcagtattgccagattcaggattttagggactagtaacattaggaaaagtgagggccaaaatgaagcttcatatttgatagagcagctttaaactaccacactgaaaagtcgcttggttcttttgggaggtgtatgaggtgtgtttttcatgtccttttaggcagccttcagtgccagctggagttgtcttcaaaacatggtcattgttcttgccatggcactggctacctgaaactgcttgcaagtggtttgtttctaagctcgttttcccattttgtggaatgtgagattttcttctactttttaaaaattgagaaggggtctcactctgttgcccaggctggaatgtagtggcatgatcacagttcgctgcagtcttgacctcccaggctcaagcgattctcccatctcggcttcctgagtaactgggaccacgggtgggtgccactgtgcccagctaacttttttgtattgtgtttaaaggtgggattttgccgtgttgcccaggctggtcttgaactcctgggcttaagtgatccaccttccttgcccacgcaaagtgttgggattataggcgttagccactgcatccagcctatgagattttttgaggaacgcagatggtgtcatgtcagaagtaccagtgcttctaatgtcattgtttttgttctgggatataagtagcatttggaatgtaagtgtgaagactgtcagtggagaggggcacactagccccaggccttgcatccgggtggtccacttcgagggtgaatgagcctgtagggtgttaggttggcgcctttctggcacatctgctttctcccacttgcctaggccctggcatgtttgttttcgtgctgcagatatggtcctctaattgggtttttgtagtaagatggtgcacttctgtggttgcaataatcttgtacttggtcgtgtgattttaatgtagcatgtctgggctctgtgcagtagagtgaaagaaacgatctaatggaataaagaaaaaaatttttttttgcttttgagatggagttttgctcgttgcccaggcttgagtgcaatggtgcaatctgggctcactgcaacttctgcctcctgggttcaagcgattctcctgcttcagtcccctgagtagctgggatcacaggcatgcgccaccatgcctggctaattttgtatttttagtagagactgggtttctccgtgttggccaggctgctctcgaactcctgacctcaggtgatcggcccttctcggcctctgaaagtgctgggattacaggtatgagctacctcgcgtggctaagtcccccccgcgcctactcttgttgcccaggctggagtgcaatggcacgatcttggctcaccacaaactccgcctcccgggttccagctattctcttgcctcagcctcctgagtagctgggattacaagtgcctgccaccacgcctggctaattattgtatttttacaagagatgaggtttcaccatattggccaggctggtctcaaactcctgacctcaggtgatctgcccaccttggcctcccaaagtggtgggattacaggtgtgagccaccatgcctggccgtaaatacttaaatatttctaataacttgtaaaaattcaacatactgaattttttttgaattgtttttcaggagagaggtacagaaagttttccctgttgctttgttttgttttaaagaaaaggtggccatactccttgaaattcagttgtaaaacatcgaaaactgatttacaactggggaaataccttatctattgaattaagggtttaaaaggaacttggccttaccgacttttctttcaatttttagctaagaaacgggacatctatgacaaatatggcaaagaaggattaaatggtggaggaggaggtaagtacgtgagttttttctttgaagacaaaaggtcttggcaagtaagttgagtttgtaaatcacgagtctcttggtcagagtcgattttgtatcagtaaatagagatgcaacgtagaaagcgaactaaattggggagaggacagagaaattgatggcatttaaaagtcttttacgagactagaagtatatgttgatgtattttttatagatagaaacaatttgtaaccatactgcaatatattgtgaacatatacccttagatcagcacttgacgttatgtcaaaatatcctaagggtttaaagagcagattttcctgaaaagctaaaataatgactttgaagggcgtggactttgtccccaaaagttcccacggtcactgggctgtgaccagcctccccaggggtgttgggaaattattgctccaaacccactggggccacgcggcagcttctgtggctccaggaggccagtcgtcgaagtggatgcagatactcttggtcttcataaaccttcataacaaatcataaaaatggtgtgtaatgttacatgttatatgccgatcacggatttagagatggtgaaaagtagtgtcgaaggggccactgctgcactcatatgccatcagcgctgggcacactcactctctgtcagtacagggctcatgttttgaattatagagaacttcaggtttatgaaatatttttgtttttattagttcatgatttgtataatgttttgtcaacaaagaattctttgcctacaaagcaccaaaattcataaactaaaagctgtgttgtatttgtgcaggtggaagtcattttgacagtccatttgaatttggcttcacattccgtaacccagatgatgtcttcagggaattttttggtggaagggacccattttcatttgacttctttggtaagttaatcacgtgggttgacttggtgtgtgtccatgacccaaatgagggcttacttagtatggcctttctgttgaattaacattgtattttaggctgggcgcggtggctcatgcctgtaatcccagcactttgggagcctgaggcgggcagatcacctgaggttgggagttcaagaccagcctgaccaacatggagaagccacgtctctattaaaatacaaaattagccgggcatggtggcgcatgcctgtaatcccagctacttgggaggctgaggcaggagaatcacttgaacccgggaggcagaggttgcggtgaactgagatcatgccattgcattgttgtctgggcaacaagagtgaaactcctgtctcaaaaaaaaaaaagttaacattgtattttgtcacgaaactttgtgtttaaagcagcattggactagcctgaacaacatggtgaaaccctgtctcaacaacaacaaaaaaaatactaaaaattagctgagtgtggtggcgtgtgcctgtggtcccagctacttgggaggctgaggtgggaggatttccttgagcctgggaggttgagattgggccactgcactccagcttgggtgacagagcaaggccctgtctcaaaaaaataaaacagcacagtagctgtaaaatcttttctcttcttcctctttgaaaatttaagttacagcttgaaaaattaaaataataaagggtttaatgtatttttttctttgttatgtatggccttaattaacttgcttttgccctcagaagagacagtggtaagggcatgggtgcgagtgtcttggaaacgttgtttcccattgaacaaccaattggtgtgtgaatttgccacatcatattcctggtaaaatcattaagcaccatagtactgttggcaagacctttcatccgtaaacattgtgtgtgaggactgttgttgagagtttgcggaaaggcacctctagagcaagactgcggaggcctttgctgaggagagaatggttttgttaagggagacagtgctgttatagctgctgtttgattgtaggaaaatggatttctcatcagtggcatctcagtcctgatgcctggtcctaggcgttggtgtatgtcttgggcacagtttgggtcaggcacttttgttagctgtctcctgttagagtcttctcaaccactgggacttcctgagtggtgcactgggtgacctgagaggtcaggattaaacatgtactcctgtagttgtttttgtcttttgacttattgaaagggaaacacattgtatgtttacctccttcattgcctggagcttgggtgaagaaactgaacaccacctgcaactcgaggagggaaagagaagagtagttgtgtctacagataatacaggggagaaacgtggagctcctgcctgccgcaggcacgaagaagcataatcactctcatatctggtaggtcttgggccttttgcatggtgcagttcttcagtgtgtctcaaatggggattcaaagaggttgttcttacaccttattatgggctggctggcttgaagagagcccctttctgagggaggaaggacagtcagtggcctcaagcattttcagggaaactgaagctgagcaggcgatttccgattaggggaccgggagactggcgtgctcatcgtttaagtgcatttgctgtaatcactgctgccatcagcagaaacagagctcaagaaagaaccatgtttacatccgtccttcatcaaccctcacaggcaagaaatatttctctaagaaaaataatttacggattgatctctgtcttaaaaatgacctttgcatcttgctgtagccttcagcaaactgcatttgttgctttgcaggacagggcagtgtttgggttgaagtcctgtgttctgatcggtgattctcatggtgaccaagcgaggaagaaggcccgctcttccaacaccatggcttctcttctggggcacacgaggtgaaacgggctgtcctcgtgatgtctgagaccgggcgtcttcaacaggccctgcttaacattatgattaaacagggctttcttaccattattattaaacaggccgtttctcaacattattattaaataggccccttcttaacattgttattaaagaggccctttcttcacattattattaaacaggccccttcttaacattattattaaacaggcctttcataacgttattattaaacgggccccttcttcacattattattaaacaggccccttcttaacattattattaaacaggcctttcataacattattattaaacgagccccttcttaacatcattattaaacaggcctttcataacgttattattaaacgggccccttcttcacattattattaaacaggccccttctcaacattattattaaacaggccccttcttaacattattattaaacgggacccttcttaagattattaaacgggccctttcttaacattattattaaacaggccccttcttaacattattattaaagaggccctttcttaacattattattaaacaggtctttcataacgttattattaaacgggccccttcttaacattattattaaacaggccccttcttaacattattattaaatgggacccttcttaagattattaaacgggccccttcttaacattattattaaacaggccccttcttaacattattattaaagaggccctttcttcacattattattaaacaggccctttcttaacattattattaaaccggcctttcattaacgttattattaaatgggccccttcttaacattattattaaacgggccccttcttaacattattattaaacaggccgtttctcaacatgattattaaacaggaccttcttaacattattattaaatgggccctttcttaacattatgattaaacaggtcctttcttaacattatgattattattttaattcaaaggggaagggtcccttagtgactgaattgtagctaatttttgttttccttggggaaaataatctgatacaccaagccatagagcaattacttgtaaagaaggtatagagatctaattagatgtgagtgaataagtgagtttttacccctagtccaaggagagaggtgctagtcttactgaagcgctttactgttaaatgctccattttacatgcagacctattttaagaccaggtaccctgtgtttcccatgattagtgtggcagtgatacttgttcattccgttcttataggtgttctagatgacttccattttcaggctctcaggatttacacactggggaagctgctgctccatggctgctatatgtatgtagtcactgagcagcctgctgacggtatgtttaatgtagatgggtgtggatgcagagccagagggatttccgcttattcatgatgtagttcaggggtcaacaccctggtctgtggcctgttacgaactggcctgttgggaacaggaggtgagcggcgcgcaggcaggcaagcattactgcctgagccccacctcctatcagctcagtggcagcattggagtctcataagggcacaaaccctattgtgaactgcacacgcgagggacctaggttgcgcattcctcatcagaatccagtatctgaaaccatccccctaccccaacccatcacccactgtgtggaagaattgtcttccatgaaaccagtccctggtggcaaaaaggttggggaccgctgttgacaaatcatatttactagacctggtgtactttccacgtgacgaaaaagtagtttaaaatgtgctgtaagatatttccgagctgcactttacatttatcagaatgcagaacccctgctgtacttcagacctccctcatgataggtggggaagggtgaaggggtgccggatgttggacacatggtatgcaggtctgtgcctgagcaccaggcagtgctcactgtcacactgtggccaaggagacttgggcctggggcctgcggtgtggaacccgtcctttacagaagaagccctcccaggagaggtcgcggaggcggattctaacaccagcctggaaggaatgctgcctctgaattggaggggtacaatcaaaactgctgaggctaggtgactgtcgaaatttccagaatgtggagcacatgcaaatgagctcttgtcgaaatgttaattggaaaatattaataggcagtggacttatttgaattaggatgctctctttattttattattagaggaccctattgctcagtgaaatgatgttctgagataggaaagaaagggtacctgataatagtgccttttgatcccattagtcacagcaggcattacatctgggaaaagcctgtgggtttaacttcacattttatttatattcttggaaaaccaaagcgaacctttaaggtttccagagaggccttttattttagcagtgcagcaagtttttcctttgtaaagcatcactgtggtacgaatgatgctctgtagcaatagaggaggagtcctgtggtatgtagaaccaaggaaagcagacttcttgcaggaaaaatgagtgcattgaggatagtaacctgactttctgacctgtgattaaattatgatagtagtcagtcattttactctcccagggtttgaggaagtggccggtgaggacttggagcctagtgaggagttagtagagctgcccagggtggaggaggccacagaggacagccctggtgaagagaacagtgaggccttggatgtgttgatatccagcaaggacctggcactgtctagtgaggacgaggcctgcacaggatgtaactggggcctgggcgagcccttcagcgaggagctggggctcatatccagcgaggacggggccagccctggggacgtagaggagctcggcgaggagtgcgaggagccgctgagtgaggaggagcacagcgggccagagctggggcgctgccggcaccaccataaagtgtcaaggagctgcccgagtgggactgacttaaaacagtgtatctagaataaaatggtttcctctagtgccttgatactgtccttggtcagacgacctcagctgccttggagatagaactgaagaagcaagagagggaggtggcagccctgaagcacaggccgggcgtctcgtaggctctttccctagaagccagagcacagaccctgaagacagccttgagtttgatccgtaccacaaaccgggggcttaaactaccaaaatgtaccatctcccagtcctggaggctggccatgtgagacccaggtattgcagggctggttgcttctgaggctgagatgtgtcccgtcttgctccaggcccttccccagctgttcttctccctacatttgcagacggatggcccatccgatgttgacatcatctcctttgtgtctgtctctgtgtccattggatttaatgttttagagacagatttcactgtgttgcttaggctggcctccaaccgctaggctcaagcagtcttccttcctcagcctcccaagtaactgatcacaggcatgagccactgtgcccagccacaagttccccctttttataaggacatcatttatattggcttagtgcccactgtaatgatttcatcttaacttgataatctataaagagcctgttcccagtaaggtcacattcacaggtactggggattaggactctaatttaatcttttttggggaccatgattcaaccactttaacatcatatttctaacgggtagatttttgtgctagtctttgaaattcacagccaagcagcaaattttgaaaggtgaaaggaggaggaacctttaaagttagacatgtgccctcacccctcgctctgagacagagttttgctctgtcacccaggctggagtgcagtggcacagtctcagcttactgcaacttccgcctcccaggttcaagtgattctcttgcctcagcctcccaagtagctgggatttcaggtacccaccaccacacctggctaatgtttgtgtttttagtagagacggagtttcaccatgttggccaggctagtctcgaacttctgacctcaggtcatctgcctgccttggcctcccgaagtgctgggattacatgcgtgagccaccatgcctggccaaagttagatgtgttaatgagagctagaagttaggggtcaagtacaggcatgggagtggcacagcagattggatcggtgtgtgctggtgacctggacccactatcattacacggcgctacagcagtttgtttgtaatgagtgttctttgattactttggacagagttcatacacaggcacacctacacacaggtcacttagaagaagttaaggagtctttttaaatacacataaaaacatcacatactaagccaggcatggtggtgtacccctgtaatgccagctactggggaggctgaggtaggagattccttgagcccaggagttcgagtccagcttgggaaaaataatgagatgccatctctaaaaatttaagaaaaaaaggttaaaaaatgaaaccgtgatgtacgagactggtttccagctaaagttgttggaaccatccttgtgtgtaatttcacatggtcgtgaagcagtgggcagtcccgcccggcatccccacgcgctcttcctctcatctggtgagagtttcttggagaacatgccaaactcatgtatggttgtgtgcgtatttgagaactcctcgtgttgagatggagctgttttttggaagtatctcattttttttgagatggagtctcactctgtcgcccagctggagtgcagtggcgtgatctcggctcactgcaacctgtacctcccgggttcaagtgattctcctgccttagcctcccaagtagcggggattacagacatgtgccaccgcgcccggctaattttgtatttttatgagagacagggtttcttcatgttggtcaggttggtctcgaactcctgagctcaggcgatccacccacctcggccacccagagtgctgggattacaggcatgagccaccgtgccaggccgttcatttctactgaaaattatcctggctagtgaggatgggtgccatgttagtgatctgcgattcttttgtgctgtttttcagtacatacttggtcgtttcaggacctttgtttcctctgacgtcctcccttaaatagggagaggaaatggttcctggaaacggtcattttgagaattttctgtgctgtgagaactgaggctctggctacccctctaaaaggcttgagccatgctgtaagagtttgtgggcagtgtttctgtggtgtttcctcccttgtattttgtggtgttggtccccctaacaggtctttgtatagtgtttggttcacattgttggcatgacagtcacctgagcaagacgttgcctgagtcctttgtcagtttgggttttcgcatcatctgtttccagtgggattttggtccctggtcaacttgtggacaactccagagattgagatagttgccgtatccttagtgctcccagggggagatgttctgggactgtaggtgcaagatgtaggaagagtgatttaaacttgaggctgcaggcagacctgatactgtgttgggctttgacaggtttagggaataccagtatttataggcagtatgatagtgtagggggacagtgaggtggaaggtgtgatggtggaggaaagatgaatcggccatctgcgagtagggctcagaaaagagcctggagcctgctgctgttctggtggtttcttccctgagcaatgaggactgtggttgggaagaggcccattcctcctgacgccagagttcctcatctcatgttggctcttttgtatttgaaatagaataatttgattgcagtgtattgtggattctttgacttcgatagatttttgtaacttttgggaaacagattactctaaccagacctgggaagtagctagaaattatacttgtaataaaaaacaattatatgggaagctgaaaatggtggtgttcatttaacaaatatggcgtgcctgctgtttagtgccaggcactattctaggtgctggtttggcagtggagagaaacactgaagccctgttctcagggcgtgcacttcagggcggagctccggccgtgttcttcattggctcccattgcgtgttgtattccagattcctaacagttaggttatttgctacttctgaaaatgtgagttgtaataaatgagtgcctggttttgagaggagttgggagagcagaggaagtctgtctttcatgcttgccttttgaatctcaagcgtttctcccttttgagggcggctgtctaggttttagctttggaacttgaggagagagtgacatattttcctttgtttgaaatagccatggtgctttttcagttttgttttgctgtcatttttttgttccagcttttctgtgcacttggggaattgacagtgggtcctgaaatcatgacagcaggcctctcctgggccgcggctgggagtgtgctgaggaagggcgagcttagtgctgccctgagatgaacgtggttggtgggaatcccttcgcttcgttgtgaagctgttcctgttccatcaggttctcatgcttggtaaagctcagagaaaatgtgtgggtttaaaacatgttctccacttcctcagtgttcttcaagtttgtatgtgggtaaatgtttgttacatgtgttttgtggtcagttttctcacactgttcattgtatatatatattttttggtcataaatttgtgactgttctttagatagtcagtttagtatcttgttaatgttatgggccccttaatgcattggtcttagtattcctcagggaatagcatgatattgcaaaattttaaagaagctcttgctatacgatgcccagaatgttgaaatggaagaagtgtcactgaaaagagtcaaactgtaaaatatttgaagagatgtattctgagccaaatataagtgaccatgctggtgacacagcctcaggagtcccaagaacatgtgtccaagtggtcagggtgcagcttggtttatacattatagggaggcatgagacatcaatcagatcataacctgtaatccctgcactttgggaggctgaggcggatggatcgcttgaggtcaggagttccagaccagcctggccaacatggtgaaacactacctctactaaaaataaaaaaattagccaggcggggtggcaggcacctgtaatcccagctacttgggaggctgaggcaggagaactgcttgacctgggaggcagaggttgcagtgagccaagatcgcgccactacactccagcctgggcgacagagcaagactccgtcttgggaaaacaaacaaacaaaaagaaatacattgttttggcccagaaaggcaggacagctcaaagcaggggggcttccagactgttggtgaatgaaaacattttctggttgacaattggttgagtttgtctaaagacctgggatcatagaaaaaaaatgttcaggttaagataaaagatcgtggagatgaaggttcctttgaagtctcatagtggctgcccttagagacaatagatgacaaatgtttccttttcagacctttaacatgtgctagactttcagttaatctcttcaggattgggagggtctggaagaaaaagatctagccatgttaataagactgttcacagatgcacatttcccccacaaaggatggctttgcaggacaatttcaaatggtttgtagggcatgactccccagaccccttaggtaggaatttgggcaagataaaaaatcagaactcagtcctcaagagttaaatcctaatgctgtttcaagtaatgtttgtacctcaggatacaaagttaaggtttgaagacccatttaaagatgcttctgaagagatgagcatacatgttttgctttgcagaatctgcatgagtctagagaaactgccactgggggagaaacgtgtattacaaggaaggtgctcacgactctaaccctcaccactgtggaagctagccagtaaaatctgtcaggactggagcagtctcctcccccggggtgggatggtgtggggtggggatcacaggcccccaggtgattggtcgaggcccatccacattagggaggcaagctgctttaccagtctcctgatccaaatgctaatctcatccagaatcacccagaaggatgttcggctcaatatttgggaactctgtgcatggcccagttaacctgaacatgaaatcaaccacatgtccatctgttgtcaacttggcacccatatgcatttccttaacccagggcttaatcgtcaagtgagggcaagaacaaggtcatagccacctaacacgatccactatcccacagacaaccaacagtgcactagccccttgcccagcgcaggtcacgttctcctgtgatgtttacggttctccttgatacggggtaacttaataggcaatatgtgtgtattacataagaggataagagagggaagaaaactgctatgtgcctaaatataacatgcatagattatatatgacaagtattggtcacaaaataaggaggaaatactccaggcattgatggtcctcgttcctgtaactggtcctgtggacacagccactttcttccactgcccattctgtggtcttgtggccttcagcaggcacctcactggttgtggttctttctggtgaggtaaagtaaaaaagaagttggtagcacatttgattaacacgtgtcttaagatttatttctaaggtataaaagtatgatcagttgtttataaatccaaaagtaataatacatgctgggtttaagatttgaaaatgggaatgaggtgagaggaggaggaggtcttgcccctccaccccagttggagccccacaggaacgttgtagcacgtgctgtatagttgtgatgcccgcggtcggagccccacgggagcattgtagcacgcgctgtatggttgtgcgttgtagcgtgcgctgtatagttgtgatgcccacaggcttccttgcatttctctccagctctgctagccacgaacacttcaagtctgcacttcacatgcttgcttgcctgtgcatggttacgcacgctcagcaacttagttccacgttttgggatgagttgagttccctgacgtagaattgctgggttgagggttttttataataaaaatattggttttattttgggggctgaaggttttaaaagcttaatacatacttctagattgcttttcaaaacgacagaaaccagcacatgataagtagctcttacttgaaataaggacttgtctgatctcaagtggcaacttttaactggtctttaaatattataaattttgaaattattttaatgtttcttagcactgtttctgttacaaatgagacttcatttttagggtaatttgtgattttaatatttgaaattatacgagttaaaattcagtgaatacctgaattgtgaaaaattatatttaagctacaaaatgtcagtagagaaataaacaagataaagatttttttcatacaagaaaatggaacggaaaagcattggccttctcataacatagtactcagccagcttttgaggtagcttctgtagatgatgatataattatgaatgtcattgtcttaatttagcttagaatgcaaaccagttaaaatcacttggttagtactgttaccactgagacacgggttcaagatgcatgtaaaagctcagtgccttgtggacaacttctaagggtttagttgccatggatttaaagaaattgtgactaaaccaatgttttagcattgataaatgggaaattgcggaaggatgtaaacgtagagtttaactctacaacttggcttagggactcaggtatggacagtgagaataacttggtttagggactcagatatggacagtgagactggccacatgagtgcctttctcactgtcacactcttacccaggttggagtgcagtggctgtcgacaggtgtgatcatagctccctgcagccttgaattcctgggctcaagcagtcctgcctcagcctcccaaggaggtgggactaaagatggtgtgccaccacacctggctaatttttaaatttattgtagagaaggggtcttgctatgttgcccaggttggtcttgaacccctgacctccagggatctctcctgccttggcctcctcaggagctggaactacagatatatgctaatgtcttcaatttatggaaatgcagaaatgccttttttttttttttttttttttttgagatggactcatgttctgctgcccaggctggagtgctgtggtgtgatcttagctcactgtatcctccacctccggggttcaagcaattttcgtgcctcagcctcctgggtggctgagactacagatgcccaccaccactcctggctaacttttttgtatttttagtagagacagggttttaccatgttggccaggctggtctcaaactcctgacctcaagtgatctgcccgcctcggcctcccaaagtactgggattatagctgtgagccactgcaccctcccggaaatgctttttaacggtcacctcctaggggagatgaagagagttaccgcataatcagttttaactgtatttgtaatgtttgtttctttacctgggaggatatgttgtagatacgtgagatagaatacctaagtgacacaatggtgtgcaggctatggctgcaaagtagaaagtttctaaatagcatgcttggatttttatttgaattggatgaagtttttgtgtcctagagaaattcacaaaatgttcctagtttcagataaaaggttatgatttaacatctttgcttttgttctttcttgtctttgaatagaacagtgggggacggtaaggtctgtttgcaaagtacctatgaccatcttacattatttttatgggtggggggcattgactgtggaatgtgggcagtaacttgcacagtcagtaaccgtttgagtaacttcttgttggcatccccattctggcactcctcctctaggtctccacctcacacgctggtttgtgggcggaggggcaggttggtgcgtggggtgtccgggcactggctgtgcatgccttcttcctcttctgtctcttggccaccttttccaaaaagtcaccagtgaccaattctcccagtgtttctttgggactcaatgccttgggcttggcattgggtaaagccaactggccagtttcattctgacgagctctatagtagtccggtgtggacctctgccctccctgctctgcggaagcttcctcagcctttgcttctcactatttactatttgcgggtcctgggggtacccagcgtctcagggttttggctgcccacctgtacgtcggtcctttcaaactgtggtcagagtcaacctcaggtgctgcttttctctagtcactgcattttttttttttagtagagacaaagtcttgctgtgttgtccagcctggattcaaactcctgagctcaaggaatcctcccactcagcctccagagtagctggatcaagtcactcttgttcataacctcagttgcttcatgaatctcgatttctgcttgatttcagtgcttgctgttgtatccttgtgtgctgcagtatttattgttaacatttgtgactcaaatgtatccactccctgctttggttgctctggcctgcaagtaggccgtactaattctgtagttggtcctagcttgcctttgtctttaccttgcatgcgtttatgtcttaatgcacctattaggattccttgcttttatcacaggtttcccatttttctgaaaaaattacagtaattattaacgcagaacccaggtaaattaaaaaggtttgtatgctttatgaatttttagtaagtactcattgattgataacagcaacagaggaaaacaaaacggtcagttccgatcttgatttccaggagcactttgtgtttccacttggcagcgtgatgcttcctcatgtcggtgattttctgttgagacatcttcaagcatcatcttacgtctgcttgttaacatttgttcagatttgatttcagctaatccttaaaagttttttgagacatcaaacttagaataaaaggaatttcctttgccgagattcatcaggtatttacacttagcttacatggccacaccattcctcgtgtgtgtgtgtgtgtgtgtgtgtgtgtgtgggcgcgcgcatgttagggtaatccatttttctgtttgtttctgaattgctttggagaaggcaactcagactccaaggaatacaacagctgccgtgtgaagcttttctcacttttccagtggtcgtagcaggaacagcgtcttgacctcacatcagtgacgtgaaaagagctgagtttgaagtgcatattggtcctccataaagaatgtgtgtatgtgctgtttttttaattaagtctggtaatttatttgatacaatgtattgtagttttagttgaattaaactagttagtaaaactgttggtgaggtagtgtttcagttactctgtagataagctcttttgttaaaacctcttaagttttttgttcctgaatatgttacaaacatctattttctcttactgtagctatcacatgaggaaaaaaacttgaaaaaaagacttcatagtgtgtgtttatgtttgattttagaagacccttttgaggacttctttgggaatcgaaggggtccccgaggaagcagaagccgagggacggggtcgtttttctctgcgttcagtggatttccgtcttttggaagtggattttcttcttttgatacaggtattaaatccctaggtttaatctctgttatcttaacagcagttagtacttataaaatcataatactcttttagttagagtgctttaaaatatgtgtatacctttcgtagaatagcattgtggatttgccagctttttttggtatacaggtctgcgcttaacctacattttctcctaatcttcctaagaatgtcgtgcttggaaatcttctcctcttaatataataatcaaggccagaatgtaatgaaattcttagttaaaaaggggcaacatatgttctgcatcagtaggtggaaagtaacgcagttggaaaatctcactaaccttcatgctgtctaacctcctttgtagttaaaacaaaagtgcacaaatagcatcctaggagcatcccactggatggaatcgaaggctgggccttaccactagcccaggccaggctcactcactagtgaagtgtcagcctcacgcacgtagctcttcatagttcaccgatggaaacaagcttgtagactggagtaacatgaatatgcatatatcatgatatgcctgtgtgtttagcctgaagaatcccacttttctctgaagctcatccagtttctcttcacaaaggagcttttttttttgttgtgttttgtttttaaatttaaaaagagtctcactttagtgagtgccactcttagtgtagtggcacggtctcagctcactgcagcctcccgcctcctgggttgaagtgattcttgtgcctcagcctcctgagtagctgggatcacaggtgtgcaccagcaggcccagctaatttttgtatttttaatggagacagggtttttgtcgtgttggccaggctggtgttgaactgacctcgggtggatccacccgtcttggcctcccaaagtgctaggattacaggcatgagccaccactcctggcctggagctgctgttttgattctctcatttttatttttaagcctccacgataagaattgggagagcttgttatatagggttccttcttcatcatggtcagaattttattttctttgaacattgcgctcatgccatctaggtaagtagtgaattctgctcgattggacctcagttttgatgtgctttccctcaacagatcctctcatttgataccatggaatatgctgaccacaggttaagaaagctagttaaaaataccacgtaaattgtcctttttaaaagtaatcagtggctcctgtatgtgtgtttgtgtgtgtgtgtgtgtgtgtgtgtgtgtgtggtgggggtgtaagccttctccacttctgaggtgccttacaaagtatcacaagaataaatacttagcgaggcttaattgagaccagtgcagtagccaccagccacgtgtagctcctgagccctggaggcctggctactcctaacggagatcagcaggagtgtgaaatagtcattgggtttcaaagatggaacatgggaagcagtgtaaaataccgcaaatgattttgattttttgtatttccaattgaaatattttggatatactgtattaaataaaatactaaaattaatgtcactagtttctgctttttagtgaaatcattagaaaaggtaaacttaacatacctggttcacatatttcttcaggacaccaccagccctagacagtatctgcgcttagatgattgaatcatgttcagaggtatgcgtcatttgtgttaatgggagcattttggaaacaggacaaaagctctaaccagtagaccagctttaatatcgaaaaataggtttgctttagtgtgacttgtgaaagtttttagtgtccacactgcgataatatccataatgtataattgagaatggtgttcatgaactgtagaaccatagttttttgagacgaatacttgtattctttctgcaattattttagttttttaataatttagattcttatcccctgtggtcctgtggcaaagaggagggaagccgattaggtttgctgttctgtggtggtgaggtcactctgttcctgtggggtaagagtgtccatcacagtctgtggagtttacaagccacgccaaagcaaacagagcttgataccgaggctgctctgctggttggagcttaatactggtctcggttccagaatgttcacattaacacaacacgtgcttcatggtgccaagcagaccacccacaagcaggggctgtctttggcatgtcagaaaagctgcttgggtcccgcgaagctctgcatgaggagagggggaggggagaggctgcactctcgcgttgccctagagtccccactcagggatctgagagacagtctttccccctgggcaccccagcacttcagctgaggccttgatagttgcgtcgtttattactcctcggttctatgccttaacattaaatattctgctactgaactttcaaactcttgtctttgcattactagttgacatatttctttaagcatttttcttttctgttttcctgtaggatttacttcatttgggtcactaggtcacgggggcctcacttcattctcttccacgtcatttggtggtagtggcatgggcaacttcaaatcgatatcaacttcaactaaaatggttaatggcagaaaaatcactacaaagaggtactgtggtattctgcattttatatttttagtaagcaggcgtaacgtttcactggtgccatgttgcacgtctcccagagtgtgaagtagaggttgttgtatgctaaatctggcgccatgaaaatcttttgctctccaaattcattaattaaagccttttctcttaaattttacttaactgttgaattattagagggaatctttaatgtaatacagtgtaataagtttctgcagcattgttaaaatggtaaaatggaaaatcattaatagtaaagcctttactgttttatagcctctgcatgtatttagcatccgcctgtacggtatttgagacacaatttattttgtcaggttaattctattttaggaaaggaagatgtgttgttgacaggttggcttcagccatgtttttacagcctgaaaattacttatattcatggtgtatttcagtaatgtccttaaacaacttagttaccctcacacatgcattttctttaccagaaaggtttttaaatgaatttttttcctacagaattgtcgagaacggtcaagaaagagtagaagttgaagaagatggccagttaaagtccttaacaataaatggtaaggagcagctgctgcgcttggataacaagtaattcaacgcacgcacttaacagaaatgttaaactataacaagcaccatttgaggattaacaggaacatttttttgaagatttcaaacgaactcgactttcagtataattgtacctaaagtatttataaacagctcatcggagcctctatttgtcatagacttttgagttgattgttgggaccacataataggaccattttttttttgtctttaaaattgttgtaaatctctgtatgcactttgcttttttattaaacgtactccaaggtgagtcttgactctttagtgtaggacaagattgtacactaacaccagcatggacctgcttttcattgtgtctgaaatgtgagccacgtagtgtcggcctgctgtgaagttaacattgccaggacgattcttctacagaaataatttcaatttttttcagtatttagtagtgaaagatattaatacattaatggtaatacatttctggtttaatataaattaaggatgttttctagttgtgcatgaatgctggcaacttagtaagttttgacaattgtttaaatatgtaatgttaagcttaggtttaaaaaagtaaagctggtaaactgggtctttgtcatttgctttaaaaaaaaaaaaaaagaaaataaatgcgaatgtgttggtgcattcttcctgagtgggatctggagcttttttgtgtctgtgtatgatttgtgcctgggcttctagtgtcactttaatagcgtttcgtgctgttcattcaggtggatgccgcacctcagttacatgtagacattttcttcagtatatttgaagtatatgaagattttcatattgtaagttgtgatttagcaattgatcaaacatttaattatggtaacatttctacaggagagggaagaaaccattgtataatttttcactcttaaagtatgttctagtttgatgtaagatcacttacggatccgggcgcggtagctcaacgcctgtaatcccagcactttgggaggctgaggcgggtggatcacctgaggtcaggagtttgagaccagcctgaccaagatggtgaaacccctgtctctactaaaaatagaaaaattagctgggtgtggtggcaggcgcctgtaatcccagctactctggaggctgaggcagaagaattgcttgaacccgggaggtggacgttgcagtgagctgagatcgtgccattgcactccagcctgggagacagagcaagccttcatctcaaaaaaaaaaaaaaatcactttgggacagtcaaggtcttttgtttctcagtttgtaatatctttcatgattaccattggtaactagaatcctagctgtagtgaatattgaactagactttgactgaatttgaaactgttttggaactaaacagcgtgaaaaccgctagaaggacaggcggttccctgacaaacagcgtagcgtgttccatccgtgctggctttgcaggagggcatagagattgctcgggatacgccagagcccttaagcaacctcacgtgctgttactgaaaataagtaaaaaatattttaaggaatttcataggagctcaaaaaagcatagcaacagttaagtaattggggacagttgaagtacaagaagaacaacgagtgatgtgcttgtctgttgtgtcggaaataacccagcacgcggcacttcctgtctctggataaggtaggtatgcagccatggcacgtgcgggaaagcgggacagcgccctctagtgttggaaatcccactcacaactagcattgtgcgatcatagagcgcgcttttgtttatgccatcaggacgggtggttttttgttactaaataaattcaagtagatacttggactaaggcgttttatatttttcattagtgggtgggatgagtcagtgcagcagccttgagacatccagggatgtccagaaataccaggaaaatgaaaagtctttacctgtaattcttaaactaggaagcattttgctatagcgttggtactacacaattttagaacacatttggttgttctagactttgtggagtgtttcatgcaactctagctgtgaacagtttactcaacatggtgttacaggtaaaatatgtttgactcctaaggaatctttcttgtgaaaatttttttttgaggaggagggagcattcatttgtacttgggaaaactactgttttgtttgtttgtttgtttgtttgtttttttgagacggagtcttgctctgtcatccaggctggagtgcagtggtgtgatcttggctcattgtaacctctgcctcccgggttcaagcagttctcctgcctcagcctcctgagtagctgggattacaggcacccaccaccacactcagctaatttttgtatttttagtagagatgggatttcaccatgttgtcagggctggtctggaactcttgacttcaagtgatccatccaccttggcctcccaaagtgctgggattacaggcgtgagccactgcgcctggctgagaaaattacttttattctgttcttccattgatagaagtgtaattttattaagttactaatagaatagaaagcctatttgttgctgtcaaatcttacacctttcatttttaaaccccgttaagtttattcctagagaattcagtctaagggtgcatgagagtacctttgaaaagttaggaaatggctgtgagcattgataccatcactcaagtaagtgatggcttggaagaataatagcatttgatttaaattacagtttttggtaaattcaacagtctctttacttgctgtagtgttgagcgcctctgaaaataggaagctgaacgctccttaacggcacgtatctggttgtgcacagccccatgtggtcccatccattctggggtgtgctgtctgctgtgtttggtttgtgctcaacttccctgtttgagattcttttttaagttttatttttaaagtctttaatttttaaaaatacttcaatagcttttggggggggggtaagtggtttttggtgacgtagatgcattatatagtgaattctgagatgttagtgctgctgtcacccaagcagtgtatgttgtacccaaagtgtagttttttaatccctgtttggcatccttttgtctggagggctcaataatctgtatttttgtcatctcctgttttcctattccttgtagctccccaccccgttggtttgatttgagtgatggattattccttatatttctatcctttataaaatttaagctttttagattccaaagattccaggcttgattttggaaactcggggttttaaataatctgaaagatgtcaatcaatagtggcatcatgggcgacttgtcattcttcctcttggaagtccttcaatgagtagattttagaagtgggtagagttagtgtcaccatttgctaaacttacctgtgcacctagtgtgctgaagtaaatgttccttacaatgtggaaacgcttgaggaacactgtggggtgattgtctttccaatcaattttaatttctgtttattaattagagcttgaaaaatgcctgcttatcctgtcttgattaccttctagatatcatttctttccgggaatactgatcttgttttaagcactatagaatgaattagaaacatttttatttgcagaggattcaacggtaataaataattggcatattatctctgttattgattggcagcagtgttgaaatttagccattagcatgttcagtgacagaatggaggcagatgttgttatttcggaggttttcaagcacaaaattatgtttagttgatttgaatacttggtttcgtggggtctggaggggactgaattacataacccactgctgtttgtatttttaaaaacgaaggcatgagatcttaccctttggggtcttgatttcaaagcctttggatatggtattcctagctgttctagggacgtggggggagctagatgtaggccttggtactaaagtgtgaccaatggttgaaatggggtagaccgaagtctgtcatttggctacgttatttcgtcttcctgtttaaaaaggtgaaaagagggaatgtcacagcagctattcctgtgttagaaatctagacgtcactgatttccagagacagcagagtttatgattgggcgttagaaggcctgtcctggcttctgtgctttggtcagtatttgctgccttttgtgcagggtatcagtcggtcttacctaactgttcactaaggactcgactctgagctttgtggcctgggcaagttgcacactcagggcagacccctgactgcgctttgcccttttccctgtaccctgattgggagaagattcctgcctcggagtgcaaccccaacaggaatgcaggtcctgtgaaggcagtaattctcgtctgtctggctgctgctgtgtcctggcaggtgtgccctggaagcatcccgtgagtgctggctgcggaaacccagatggtggttgctgtcccacagcccttgattcagagatgccctggaccacagctgcctggagtgtagagcagaggcttactccccacacccctcctgctgtgcgacctgcggcccagcctgctgttggaggcttgccatgtggatccgaaggacctgcgtcttggctttacaaagattctccactcctgggagccctgactagcaaacgtctgtgtagtgttgatgccacactgcagttgttaacatcgcgtccttttctgccctgttaggttggtttctctcttaaacagggcagcgctgtcatcccattcccccgcctggtccttcctcttccccctagctggttactgaactgactgccattcaggcactgatgggaaatcacttccagaacttgcaaaaccatagagaccggaggttttctgaaggaggctttggtgctgaaacattgctgctgaaacattgttgcagaaatgtggggtggagcctccttcctgcccgtctcacccaggggatgtggtttgcttcccgtgtggtcagcgctgtgctgcgagctctgagaggtgaccttttcctctgccttcccacagctgccctgagttggcaaaaagtgctttgcccaaggacagggtctaattgataatggcgtgtgggggagatgtggctcctgaggcctggagcatgcattcattcattcctttatattattttatattttacttaacttttggaccagttctctctctctaacccaggctggagtacagtggtgcagtcacagctctctgtagccttcaactcctgggctcaagcattcctcccacctcagcccctaagcagttgggactacaggtgtgcgacacaacgcctggctaactttttgtatttttagtggagacagggttttgccgtgttgcccaggctggtcttgaactcttgggctcgagcgcatcactcactttggcctcccagagtgctgggatcacagacatgagcccccactcccagcccagagcattttacaccagatgtcaggacattgctggtaggaacagcagttggagcagaagctcggggtgtggtcatcagggaactgtggagtttgcagcctgcgtgagacacgtttcgtacacacatttctgccaaattgagaactttgctgctcgtcagctctaagccaagtaacctcttacccaaaacttccagggatgctttacataatgccaggcctctgagaaagtcagctgcagaacttgaacgagaaagtgctgttttccacgagtcttttcagccgtatctttccgtgtccatgggtcagtggtccctgcacagatgaattggcactggacacggcctcctgcggtggctgctgggggctgagccttccctgccagtccctgccaagcaggaaagacaagtttccctcagttggggtctgtgcccagcatgagtggtctatctagtgagtggctgggcacagttgtccccatccatggcggatgcctggtggcagcacccactgggtctcagcccaagtcttccgtggatcctggcaaaatattgatgtccttttccacataatatttaaggtatttgtgtagagtcttatgtacttgcaggagcagttggttaaattaggtacctagaagttgagtaattggcttgagaaacgtgtgcattgaaaatcggtaagttaccaggcgcagtggctcatgcctgtaatcccagtgctctgggaggctgaggtgggttgattgctttgagcccaggagttcaagaccagcctgggcaacatggtcaaaccacgtctctacaaaaaatatgaaaattagctgggcttggtggcgtgcgcttgtagtcccagatactcaggaggctgaggtggaaggatcacttgagtcagggatatgaggctgcagtgagccgtgatcgagccactgcactccaacctgggcaacaaggagaccctgtctcaaaaaaaaaaaaaaaaaaggatagtcataaatgatttcttagaaggagtcttctcctatcaacaacggattggggtctgtgtcctcacgcttgctagtactgtctgtcaacagtttctaaaatttgcgtcttggctatccagggcaagcatcttgtgtcacctgcgtgtgcctctttttctgtggacttactctcttgattttataggagccctttacatgctagttgattagtctttagcctgctgtgttgaaagtgggttttttttttttttttggtttttcttttgttcacgtgacttactgtgtggtagtcttaattatttacacagatgtgtgtgtgcgtgcgtgtgcctgttacagagctgccccatatttttattttgtaatcctgtgtgtgtttacttttatttatttggaaaggttgttgtgtgggaaacagccagctttgtcccagatttcttgcccgcgtttctgccggactctcgtcctgtctggtttcttgcaccctgtatggatggcagtgtgtgcatccggaagcgcagctcctttccagctcgtttctaggccagtcttcgtcgtgctttcaaatgaaaggtgcagtcagtgcgaggaacaccccatgtagatttgggagagcctttgacacccgagagccatgtggcagactaatttttttaacatcctgttttacggacagctgtaaagtgctgtcttaatatgtaggtgtgcacatttcctcattgtatcactacatgaagctgggaatgccgtctgtgtgtgttttctgttctaacttatggaaaaccaggaagtcggtacgccttacattgctttttatctcatcactttagtcttggtattctgattttattatatttatttttttgaggcagtgtcttgctgtgtcgcccaggctggatggagtgcagtggtgtgatcacggctgactgcaacccctgcctcctgggttcaagcgattctcctgcctcagcctcccgagtagctggaattacaggcgcctgccaccacccctggctaatttttttgtatttttagtagagacggagtttcactattttggtcaggctgatcccaaactcctgacctcgagttatcccgccctccttggcctcccaaagtgctgggattacaggtgtgagccactgcgcctcgcctattctgattttaaaaaagaattggaatatcatattttttacaattggaaaactctataaattttctaatttttacccttatttttcttattgatataagtatttttgtcttgttttccagcaggctgattttagtattttactgtgtgattatgtttctgagaaagattagttactgtgtttatgtcccaaaattcctctacatggcactgttgggttctcttgtaccttgattttactttgggttttagattctgtagagagggtgaagctcccggccctgtgatcttgaggagggtgagttgggagccgtccatgccctgcctaccccaacaccaggttcagctgcctgtgaagtcatttgtttcgtgcacatttcctagttactggtattttttaatcattaaaaatgtttttaaattattgatagtaattgtacgtatttgtagggtgcatgtgtgcagtgggtgatgatcagatcggggtgcatgtgtgcagtgggtgatgatcagattggggttaatggcagagccacctcacagttactgttttgtgttgggaacattcagagcctctcagaaaactttatttcctaagctggtttgttgaggggttttctttcatatcagtttgctaatttatgtgttcactggaagcatccacggtgttctgaggcctgtgatcatgcgcctttctcattctttacatttgtccgtgtctgaaggtttccaagtgttttcctgttggtttagtttctctcaaaagaatacctttctcatatcttattattatcctgagtttttcttcctattttggttagttgtgcttctgcagaatatttatttgcagtacttttgttcataaataggaatgttaagaattgtttttaagttcgacttgtaaaacatttttgttgacttctaagtcgttcttttaaatttctattttcattcaaaaataacccatatgacatctattttttggaaggaagggttaagaaacagcagatgttgccttgtcaattctgtgagcttgtattctactggatttttttctatcttgcttaagaaatgctgcccctgtgtatctaccttaaaaaatgtttaagtccaggcgtggtggctcacgcctgtattccagcactttgagtggctaagtgggtggatcgcttgagccctggaggtcgaggctacagtgagtcgtgatgacaccactgcactccagtctggtgatggagtgagaccctgtctcagaaaaaaaaaagttgaaaatatgaatccatctagaacatttgtgtgaagtggcctcactttttcctcctctatggacaatttgtccttcctccatgatgaattgtgatttaatttttaatgatttgcttgtctgcagcttttttgggaggaactttattgggatttgcccatcatgagtacatttgttaaggatgggtgcgatttccctcttgtgaagaagcaacacatcacaagagcagattttgtccccgcctctcagcggagcttagaaccatacagaaagtgggccagacgtggtggcttacgcctgtaattccagcactttgggaggctgagctgcgtggcgggtggattgcttgagcccagcctgggcaacgtggtgagactctgtctccacaaagaatagaaaatattagcctggcttgggggtgcacgcctctagtcccagctactcaggaggctaaggtgcgaggattgcttgagctggtggaggtcaaggctgcagtgagccaggattgcaccactcggcactccagcctgggcaacagagcaagaccctgtgcccgccgcgcccccccacctcccaaaaaaccccagaaagcagagagttagctgtttgtcttccccatccggtattaccagggctggaagcatacttgagagcactacgtttaatgggcagcattttgggagggggctgggggggggttggtgctgggcacatctggccacttaatgtagttaaagcaatagcaactgaatgaaaagctctaacatgaattcatcgtttcatctgttatctgacttttaacattaacatatctagttctgcttttgtctgtcttttaaagagaattgcatgggcagcttctctgtttttcctgcgtatgcaggagcttagctttgggctcctgagctcaggccttctcagctctgatgagcttcaggagaggcagttggaggttgaatctgggtggtgtatgccttcttatggaagtccctgatgggaagacagaggagctctgagaagaaactagaatgacttgtcattacatttttatgtggaataagattcagatgtctttagaaaaataaaattttgtgaatatgcgagtctgcaaaagttacaacattcattctacgttttttcttttcttttttttttttttttttgagacggagtcatgctctgtcgcccaggctggagtacagtggggcgatctcggctcactgcaacctctgcctccctagtagctgggattacaggcctgtgccaccacacccggctaattctttttatattttcagtagagacagagtttcactctgttggccaggctggtcttgaactcctgacctcaagtgatccacctgccttggcctcccaaagtgctgggattacaggcttgagcctgtaatttttttttttttttttggagacgtagtcttactctgtcacccaggctggagtgcagtgaagtgaactcggctcactgcaacctccgtctcctgggttcaagcgattctcatgcctcagcctcctgaatagctaggactactggtgtgtgccaccacgcccagctaatattttgcatttttaggagagacagagtttcactatgttgcccaggctggtctcaaaaccctgacctcaggcaatctgcccgcttcagcctcccaaagtgctgggattacatgcgtgagccactgtgcctggccccatgttccttttcaagatttaatgattaagtgggcaacagttaaatccctccagcgcctcagcctaaccagggagcggggcagtctcagggcgacgtgtttcttgaggacgcttagatgcctagggttccgtttataaagagttccttcaataaaaatcacacttagactttatgtagtgggcagttagaaacagggaactaaagacttttcctttctctgcctccagcaaagcccaggcaccccacccagcaccatgctgtcagccgtggggacaggcagcccaaggctgcagggagagggccccaggaggcctggccctgtgggttgaggctgcagtgcgccctgggccccctcctctgctctcagtgtgagagtccactctctctgctgccctctggggtactctgtggaccgcagctgtgtccatactaaaacatgaccaaaggctgtaatttccggctttcatagccctttgtcagggtatcgtatattgtgagttcctgggaaatgggcacaaatcaaagggacccagttcggggcagggaggccacagcgtatcccccgagactgaggaacttcagacagttcaagtctaaggggtttttcaggcataaacatccaccgcccgcctccttttctacatgggaaggccgacgccacagtgtgctttagttggtttccatctgaaaggggtcctgaacctgccacgggacgtgatgccagtggtagctgaatgtgcctcactccaggtcctcctggaattatcctcaccactcggctgagggatgctgtccacacccctctcaccgatgtggacgtgtgcacgcggtgtgtgtgcagaatccaggctatcaggatgctgtgccgtggctgcccctgcgaggcccgtgtgaagccagccccgtgcgtctgtagctaccccttgaggagtaacccgagcggcgtgcttcctgggaagttgctaagctgcgctgaggtggtaacaacagcatgtggcctccacctcacgtaagcatttggtgtctccttgaacctctgttgtgcaccagcacctaggagacactgaagagccagacccagtcacggccgcccagccagggagagggggtgcgggtgaatggtgtcctgcaggtgctgggccggaacctctgtgtcgctgcggtggtgtgttcagctctgacatgagtggggatgccaaccccagcagggcttctgggaatcttttggccttttgttggcggggtttcgtgagcctcttatgctgggaggaatccaacaggagactttcctcctcattgtcctcagccttcgcccgtgctccgatttcctcctgtgtccccatgtgtgctccagtgccaccatccctctcccagctgggccctgggcacgtccccgtgccgtcagccagtgcgctcttggagcagttatttccaaaccgaccttcacgtcttcattccctggagccacctcttcataagtagccatgaagagttaattgtggcacctgttctccctctcgacctctgcccttcatccttctcaattcagcttctatgtcacgagcccatcacgtggctggcaaaagcaagtcactgtcctgtttaaaactgttcaggagtctgggcgtggtggcccacgcctgtaatcccagctactcggaaggctgaggcagaattacttgaaccgggaggcagagtttgcagtgagctgagatggcgccactgcactccagtctgggcagcagagcgagactcttgtctcaaaacaaacaaaaacttgttcagccttcgtacctgctctgccctgtgtttgaagccgggttcctagcgtttccccagcagatggcgtctgccattccagggctgttcgatgtgcctttgtatctgcagagtgcagacagacagcactgccttgccacattgtttggagtctgtccacccttgagctccctaggagtgagggcagggtcttgctgggtgtccccagtgcctggcacacattaaatgtttgaatgagcccatcttctgatgggccaggcatgcatttttggttgtttgaataatctgcagtgtgtgagtggtattcctaatttgtgtaagtagcgactaacccccctctctccccaaaaaaagtcaaagaaaggagcagtctccccaggggcctcgtggattgtgtgtatttgggaaaagcgtgtttttatctgcaggagtttgttttcatctgcgtgttatcagccaggctcctgcactccattcagactccatttggggaagaaactggagcctctgataagatggccatgcccgcgcggcagctgcggaacattcctctaatagcttctcgatgatttcagtgtgtttttggcttgaggggggggatgctggcagatcttgtttctgtttttaaattttatttaactgtggttacaaaacaggatgttttctggtatatttagttcccccaataaaaagaaacttgatctgttgtaaccagcctacattttagtaatttataaggtttaatatttaattcacacacaggaagaagcagaaattatacccaaacagtaaattatctatgggctgtagaattagaagtgacttgttttttctacaactaatgtgtattgccttttccgtacaaattgctaaactaaaattgtttaaacaattagtggtaaatttccaaagaagagtaattaatggtattacatggaaagttttaaaaggctatatagaaagattttagaaaatggttggctttcagaaagtggtgttggctctcagagggtgaggctgaacggcagtgaatgcccttttttggttttaatttggggaattttaggttaatttgtgagaagttgagttgttttcttaaggatgtttgtagaagttccgctgacaagtttgttgggggctcttcgtgtgagatcttgcacgagtcaggctgcttgactggaaggttctcagcagcttttgcaggtcgggtccctgtggccccccgccatcccctgccttgtctggtgatgctcatgcctagaagggaggtctttcgcctcctgatgagtaggtgccaggaaagtggccctgcccctgcttggtgctaaagaacagccctgaccgcatcaggacattttggccagtggtggtccacgtagaccgcaggggttgcgtaaggttaggacggcattttcactgcatgtgatccaggtttgtatccttgccgttgacctacagctgcttgcagcgctcagtgctgggatggcggcacaggtttgcggcctagcagcagtcggccgggccctgcagcctgggtgtggagtgggccgtgccctctaggcctgagtgcggtgacatcacctaacatacccctgttgctaagctgcatgtgactatatatctatatatctctctctctatctgtattttttttttggagatggagtctcgccctgtcgcccaagctggagagcaatggcacagttgtggctcactgcaacgtccgcctcctgggttcaagcaattctcctgccttagcctctggagtagctgggattacaggtgcgcgccaccacccctggctaacttttgtatttttagtagagacggggtttcaccacgttggccaggctgatctcaaaatcctgacctcaggtgatctgcctgcctcagcctcccaaagtgcttggatgacagacgtgagccgccgcacccggcctgtattttgtcaggagaatatcagcatgagttaagtttatgatgcaggtgttcaaagtttttgtttagttggggaaagtgcagtattttgtaccacccagtaaagcctttgtaaagccaaaacatgaagtagatattgatcactaataaggtttaatacagttggttttgccttttttcggtttctttgtgagctgcagtaacgggaaagcaagttctagggaagtgtgagcatgaggtgctgggatgcctgggtccccgcgcctttgtgtatgtgctcgcgtctagggagttctgaacatgggggatgcccgggtccccgcgccttcgtgtacgcacttgtacgtagggaggtctgagcatgggggatgcctgggtccccgcgccttcatggacacgctcgtgtgtggtgtgccgtgatgcttgctgtgcagcaggccggctggtggagagctttcgctggcaccgagctcttctccttggtgtggccgtcggctccatcctggtcatccttccctggtaggtgttactctaaagctgggtcctaaacctggcaggagcttctaatgagaaggggcacttgatcctcgggtgggctgtgtttacgttcttggctctggaattacctttgtcttgcggtctccgccgctggtggtctatgtctcatcaccaggctcaccgccggggctcttgcgtccgcctggcacgtgtcagctgtgggtccgggatgaagcccgggtggaagtcgagggtgttgatgaggcacacaggtcatgaggcggggcaggaactgtgggtgggcgagacgtgagtgggtcatggaaggatctttctggaagtgagttggtcgctgaatcctgcagaggggcctggcacaaaggtgtggaaggcaggtgtgctggagtccccaccctggccagcccttggcttgtttctgtgtgtggctgtgaccccggactctggatttctaggaagctgaaaaggtttgatgacctctttctgtcttaaaaggggaggtgaggtaaaaccactcctgagagggacttacccgctgtggtccctgctttgccgaagccccgggttttgatggtgccggcagctgtcggcctcctcgcctctgatttctctggcccaccacgagcccctcacctcctgcagggcttactgtgacctgggctcctcctcctgtatcaaaggattgctggcagtcagagctcttcagtcgtgtacatgatttatataatttatatttcttttttctttttttttgagaaggagtctcactctgttgcctagcctggagtgcgatggcgccatcttggttcaccgctacctccacctcctgggttcaagcaactctgcctcagcctcccgagtagctgggattacaggcacgcgccaccacaccccgctaattttgtatttttagtagagacggggtttctccatgttaggctggtcttgaactcctgacctcaggtgatctgcctgcctcggcctcccaaagtgctggcattacaggcatgagccaccgtgcttgaccaacctaatttatacttcttaaggaatggaaagagcacagagacctgttcatatggtggatgtagcagtttttaaaagcgaatgtagatttgaagtcatgacatctgtgtgtgagtttttggggacatggttcagcttgtaacaggggaagtaaatcaggtgtaaaaatgtgtcaaggtgggtggaactaaggggagagagctgtgacgtgaagcattacgcaataaagaggttcccgcctattagatagaaacagaggtgggaacaggaccgaggcggtgtgagtgtgccctgacctctgcagcagcggccctcctgccgccgtctccacgcgcccttcccagacctgttcagtttcccagcagcgggctggcgcctgccttctctctgttgcagaggccggctcttcctggatgtgggccctctcaggatggttgcaagcctggagcccacaggctgcttatcttagcagaaggccttgagggctccttcccctgcggtcgctgtgacggagggagcgtgtctgctctctgtggcttcggttcttcaggctgctgttgtgttgagagtggcttctgccgcactccgcattgataactgggtttcatcctcgttgtattttcttattttttatagagatggggtctccctatgttgcccaggctggtctcgaactcctgggcccacgtgatcctccctgcttggcctcccagagtgtggggatcccaggcggggtccaccctggccttgtcctcattttaaagacgaggggactgtggaagcacagggaaggcgcctcttcttccctgagctgcaccccttccacaggcacccatgctgcccgtgcagtggcgggtgcagcacagtcccactgctgagcggcttggcctgcagcgaggccccctcccacctgccatgctctcttgctggccgtggggcgggcgtggggtgacagggttgcctgtggtggccacagggccatgtgtgctttgagtctggcgccgtcatgctatgcatggtgtccatctccattcagagacaaacacctcccaggctggccagaccactcacaccacttccacctccgtaggcctgagggagccgggtcccaggggagggctgtgggagtggcaggagaagtagcgatgtgtcttggggacgtaggccccagtcatcccaggggcctacggtgcatgggtggtcccaatttaaaacaaataaggaatatggggcctgtggtttcttatttaaagtaagccactctttggcccctgcacttttccagggcagggtaaaccggaacgttgttagaattgggaacagtcatcaccgtgggccacggagaaagtccacggaaccccactttctccatcagccttctggtctgccttcgtactgtgaaccaggagtatctgagaccgtctcagtcagtgtagaaagtttattttgccgaggttgaggacacgcccgtgacacagcctcaggaggccctgacgacaggtgcccgaggtggtcggggcgcggcttggttttatgcatctcagggagacatgaggcgtccctacacgcaagatgtacgttccggaaaggtgggacagctggacgtggggtcgggggcttccgggtcataggtggataagacgaatcattgcattctatgagtctctgatcagcctttcactgaatacacaatccacatatgagagggggtaggggaagggccacgtgtgccttagtctggctcagtgagacaacagggcagaggaagcagtcagatatgcgtttgtttcgggggagcagagggatgactttgagttctgtcctttgtctgcacctgtgaagataagctgtccactgacattgccagggtgaaaacccaacaactgctctagggtaaagatcttgagccccacggggaatttccttgtgcacaaattgtgagggaggtgtgtggcttttttgtttgttttttttgagacattgtctcattcctgctgcccaagctggagtccagtggtgcagtctcagctcgcagcaacctttgcctcctgagctcacgtaaagcgatcctcccagctcagcctcctgagtagctgggaccacaggtgtgcacccctgtgccctgctgtagccaccttctttaggaataaaatgggaggcaggtgtgcccgatgcagttcccagcttgctctctccctttagctgagtgattttggggtcctgagattcattgtcgtttcacaataccttgtttcccaaattagcaaccaaagagagcggttatacttgccctggggctttagggggaagcgcagcccaccctgtgtggactcgcagcggaagcagaggctgctccagagactgcggtgccttcctgtccaccctgacccaggagcctcagtgttgagtgaggggcactggctgtttcttgagggtgggaaggaacaccttttcagcctactgtgcagggtttttttttaaggcaggatttctgttacccaggcaggagtgcagtggtgcgatcacagctcactgcagcctcgaactcctaggctcaagccgtcctcccagctcagccccctgagtagcttagactacaggcatgcaccactaggcctggctaattttttctttttttttgtagagatggggtctcactatgttgcccaggctggtctcaaactcttgggcccaagtgatctttagcctccactttagcctcccaaagtgctgggatgacaggtgtgagctgccactttcagccctactgtgcagttttttttttctttttctttttttgagacaaagtcttaatctgtcagttaggctggagtgcagtggtgcgatcacagctcactgcagccttgaaccccctcggctcaagtaattctcccacctcagcctccagagcggctgggactgtaggcgtgcaacagcgcactgggctaatttttgtctttttttttttttttttttgatagagatggggtctgtcttttttcttttcttttttttttttggtaaggagtctcgctctgttgcccagcctggagtgcagtggtgcaatcttggctcactgcaacctctgcctcccaggctcaagcgattcttatgcttgagcctcccgagtaactgggactacaggcacacgccaccacacccgactaatttttgtatttttagtagagacggggtcatgttgcccaggctggtctcaaactcctgacctcaagtgatccgcctgcctcagcctctcaaagtgctgggattataggcgtgagccaccgtgcctggcccagatggggtctttctgtgttacccaagctgatctcaaagctaagctggtctcaaactcctgggcttaagtgatcctcctgcctcagcctcccaaagtgctgggatgacaggtgtgagccactgtgccagcctgtgcagtgtttttaaaaggattggtgtaacagtaacttgtgtgaacacattgatgtggtctgggcccttccccgcatgaaaggactgatggaatcctcagaactgcaggcatgttgagcgccagaagcagggtccttgggtcactgacaggccggccttggtgaacacgtgctgcagaacactacctccaggtcctcccacatgtgggacgcggcgatggcagagataagaaggtgatgtggcaggaaaattctgaatcatacaaggacgtgttgtgcaatagctgcgtgagctctagcaggatgttcgagagaatgtcctgggggctctttgccatgggagagggtgttgctgtgggaagtgtgctgagttgtgtgttcctcggccctctgtgtggcgcctgcttccaggctgtgcgtgaggctggcttgttccgtcctgggatgctggcaggagtgtgggtctgtgcattcccatatcttgtgaggcatgttctcagcatcagcagccccagctccttcctcctcgtggtgactgggaggcgaatgggccagggtgctgggtttccaagaacacctgccttgctctctgtggggatccacagagagttcacgcagtggccctgtcagccctgaacatggagagccactgcatgtgaggccttgggggcatgtctggagagcctgtcatggcgtggagctcaccgtacagtctcctgggaccttgacagaccgcaccaggccacatcctgcgccaattaaacccgaacctcagggctgatcccgttgtggccaggaggaagaatggataatgctgggcctgggagggaccgggaggccgagtccgaggcgagagccatggggtggtgcttgttccggttctcctgcagccggtctgtccatcctgcctgctgtgactgttctccagccactttctctttttcatttttcttgctggaaagctgtagaaggcagtggggtgggaacgctccatccacagtgcaggttagaaccttggaggtgatggcttcgcctggcagtgaggtgaacagagcctccagcagtgccgggcgtgtagccagggcagctgcagcaggaggacgcccagagccttggctctgaacagatagaaccatcgaggccgaatcgggcagtcctcctgttcagaccaactgtgtgtcccttttgtgagacagctggtgacccctgctggcacatctgtgtcccagccgtgaggcggccgctccctgtccatgccggcagtgcaccgtgcccacgggaagctcggtgtgggggtttggagcagcagcacgctgcgtgactccccaggtgatgccagggagatctggataaggaggtccacatctccaccttcatcttctttcctcaagtcacttttcctggcacctcactaaccatgaggtttcacaggaaccttggggagtcccttgtgtgcttggcctggggacacaggactgtgtcggactgctggggccagaagggtttttctagagaccagacccaagcagctgctgtccacctgccacgtgtgccagccccagccttcctcccaagtgagtgggggagggaggcttctgggtgttgccgggacctggccgggggcggagtggctgagctgtgcaggagaggatggggcgcaggcatccacaggagccaggctgccctgtggatgtggccgtggagcctgcacctttctcccccagtcactccagggcttctctgagcccgcagccggccagctcagcggcccggggttggaaggaacgcaacatccatgcctgcctggcggtctcagcctctgaggagacgacacagggagctttggacgctgcaggtgtcttcaatattcattttcaaaatatcagtcttaagtctcagcggggcctttttctaaacagacggtaaatgcaaaacctcccccagagcagctctgaaggcagcgcgtttctcttcctccgtggtgggaggaggctgggctttgagggcgggaagccctggtcgaggctggacccgcagcctggccctccccaggcgatggcagccccggctgacccacagcgctctgaagacaggtcctcggacacccgcccaggggcgcgttttcacctgcggagcaggggtgcggggaacagctgggaggtggggggggtcccaaccgcagctgagctggaagtgcagaatttcaactggcagcgagactgggcttcccagagccaggatgagccaggatgtgtggggttaccctgcccccattttccctccgcgtggagtggggcgagtgagcggctcacgcttggctctgaagctccctgggcacggggggctgtgactgggccaggcaggggcggctcttctggcggcagtgacagagctcacgctgcatcgctgtgccccggggaagacttcacagctatggatatttagggtccagttcagtgtgtcacacaccagaaactttaaatttttttctcaaatgttctactttagttggcaaagtataattcttaaaagtcatggcggagtattgggtgcaatcctcctggaggcaggaacgggcttagcaccggcaggttctggttggccctttgctgctgtgtgcgtgggtcccttcgtctctcctctctccctccaaggtgggatgtggtaccctgggagcacctgtgctgagtctctccttggtgtccaaggggctgggatggcccagggtgcacaggtgtccccgggcagcctgcagatgcttctcgacgacacggcccctttgagttcgaaggtcagatctggaagccacgttgccacacaacagcgacttcgcagcactgtcgccatgtgtcccgctctcttgccagggtccaggcagctgggaaacagcttggtttgctgagaagccacgtcctgggtgtccctgtcccagagccctcctcgctcccagcctgcaactggggcctggtcgggcgccctggcatgtttcctcctgctgcaggcgtgctcaggaagtgctgtgtgtgcatggcgcccgcgggcatggcctgtgtgctgggtgctgttttacttcactcacgtcatagaatcgcagacagcagccctgccacctgtttgttctgcaggtgagcacgtggagttcccaaggggagaactggccccgggctaggtgacccctctcagctcaacagttccatgtgatgctgagagatgtgcgtgcattctcctggtgcagccatctcagcaggggtcctggggtcccctggcaggacgcgcgggccgggtgttgacaatggggtgtcataggtcaagcctcacagcctgcgtttacggtgcttggttaaatggtccccaaaatcacgtttctgtgttcaaagtgtggggaaataggattggggtagaaggtgacatctgaggcctgcgcctcctcttgggtttgctgaattccagaaacgatggagccctgtgggcgccgtgctgtggctttaggattttgtgaggcttgccctcccctctggggacacacaggctccaggctgcgagttgcccaggtcttggtgttcattggagatgaatttctgcacttgtgtgggggtcttccttaggccagcatcaccatcgtggtctccaaagaccagagcctggcctgaggggacagcctgagagcaggttccttcctgacctcggagcccgttctctctgttgtggttgagccacatttgagctcctgggggcaggccctgggcctggcactcagcactggaagtggtgtataggccagtttaattggagaagctcctgaatgtctgtcggtctgtcagtccgttgggtttcagatgcatttcaatggctgagtgctcctcagtgcttgcggggaagcgaggaggatggggccgcccctggcgtaaactctctgctgtgccacgggaggggtctgccttgctttacatctgcgcagggctcggggcccgaagtgctgggtgcgacagtcgttttaggcacattttagagtttgcggagggacgaggaatcccaccacctgcggcctcgcacacttgctcctggagctctgacgcagctgcctccctcacatccacgcagtgattgccactcaaactttgagaatcacagtggagaacattctgtgaatattgttttcttgtttttattcctcagcgttcaaaacattttttccatatttcttttttttaatgcatggccttccaatgactttttctgtatttcaaagattaataaaagcacaacttttcagagcgttgagaagccggcccgtcttgggtgtgtgtgttgtgcggggccagagctggagctgcactggagtggccgggatggccctgccttgggcggggctgtggctcccgtgggcgccgccgctgctgccacagatttattccagcacgaggcggagaggggatgtcttccgtgtatggactcaggaggaaatcgccaactggacccagaacctttcttccccagggtggctcagctggctggttttgacagcgaacttgtcagccctgaccgtgatttcagtggggcacactcactctcggaagaggcgtgttgactgtgccaaagctggtggggcggggagccgcttcttccaggagagagagaggggtgattttctgatgactcacttttttcccactcttggaggattaagttctggccccagtggcgccactgaagaaaggagataacctctttctcctgcccggagatggcgcgtctggattcagggagatcgtgcggccagcttccctccctctgctctggatgggggccggccgccgccgctcactcacggctctctctctcccgctgtgcctgcaggtgtggccgacgacgatgccctcgctgaggagcgcatgcggagaggccagaacgccctgccagcccagcctgccggcctccgcccgccgaagccgccccggcctgcctcgctgctgagacacgcgcctcactgtctctctgaggaggagggcgagcaggaccgacctcgggcacccgggccctgggaccccctcgcgtccgcagcaggtgtgcaaagggaggcagccgtggagcaggcgcagagtgagacttctctgggtgccagaggacagcgaggacacaaaccgcgcctgggctgctgtgttctgacctgagcgggcgtgggcggtcgggcggggcgggaggaggtagcctcgctctgctcctctcccgctcgcggcgccccacgccacggtggctccgggccccccaccgttaaaacggggtccgcgtgtcctgtacgcagcgtgttgctccgcaaaggatgacagagctgccacggcagtgcgaggtgctgcttttaccgtagacgtgccttttcgtagctttcagcgtagagcttgaggcctgtggcttaggccgggtggtctcgtgctggtggggtctgcgtttgcccctgcccctccgtcagcttcaccttctcgtgccttcttctgcgctgggtgcagaacaaaagaccccctcaagtcaagcctccttgtgaagcgtagtctgcccgcccaccccccgtggggttcttggccgccctgccctcctcccacctgttagggagccggatagtctctgaagtgagtgccccggagaagttctgggtcaccctgaggacgtgctgtgcatgtaggcttggccctgactgcgtcctaaagcccagggtccatgtagtgtgaatcgtgcgtcagttggaagtatttgtgcctcttctggttcttatcaccgcacgcggtgaggtgaccccagccgctcatgtcgtgcaggaagacatggatggttgatccctgggtttgggggaccgaagcggatgtcgtgaggttacttctgtggacttgggccgaacagcactgtctaagcaggacatgaaaagaagggggaagcgtctctccttttcccttcatggaactttccattgaaaaattagccccttccagtccttctcggatgaagcacagttgccggttacgcttccgaggaggacggaaggtgcacccccagccgtgagagcctcaggatgtgccgcctgtgggtgggcacggcagcccctccagccggccgcccacctgccgtgctgcgctcacctttgctgtgtgagtctgtgctgtgtcactgagtgacagacagaggcagttgcaggctgcatgcacccagaaagaactccccctgcactaagcgggcatgggggaggctccccagggtccctgcactgagcggggtgggggaggctccccacggttccctgcactgagcggggtgggggagactccccacggttccctgcactgagcgggcgtggggaaggttcccaggatccctgcactgagcggggtgggggagactccccacggttccctgcactgagcgggcgtggggaaggttcccaggatccctgcactgagcgggcgtggggaaggttcccaggatccctgcactgagcgggcgtaggggaggctccccaggatccctgcactgagcgggcgttggggaggctccccagggtctgttgtgcgctcctggtactggagggtctgatggccgtagggagggtgcactgtttgtcgatgggtctttgcaaggtgcaggatagagcagggttgtagctgtagtgtccctgaaccactggggttaggaggccaccggaagcctggcctgctaggggccttgtgatttcgcaggccccgagaacgtggtgtgcaggtgcgggccgcctgggggagccatgtttaaagtgcggtgaggctcctggaacggcacccaccgcaggcccgaggccacacctgtatgtcagaactgggcgggtcttctcctcccaggccttcagcgcctgtggctatggctgtgggcgggactgatacgggcaggcaggcgctgttctccccacgtattctcggcttccccgccatacaccgtttctgagtggggagaactggttgactgctgaatcccaacacaaatccttagagcaaagaggccagtgatggcttttgtttctgcccggatcctctttgtggatcttccgttttgcggcttttcctctcatttgtttcctttttttaatcgcttcatgagatcttgaagataccaaagtaaccatcaaagatttaaagacgtgatttttatacaaatatataacgaacacgtcagagacttttacttaagttcttactgagagatgacaaagctgactcaaaggatgagtcaagaaaccgctgcagagttggagacagaactggagtgaaattgcaaagcagggtggttttggtctctgcagaggccatttgcgactcactcaccaactccggtgtcagggtgctggtgggtgacagggaagaggttgagcaagcctccgcccctgcaggctcgctcattatacaatgagcacctgcaccaccaaatccgaacaactgtacatgcttacagagaagggcacgtgctagtgtgggagtgacaaagtcacacgggtgcagaccccttagctccagcctgctgggtgttctgacgaatggactttgtagcgataacacaggctcctgagtcaggatactggtttgctgcatttctgcgtcactgaaggtctcgctttccccgaagccccttgtcacagaaaacccatgactcttggccaggcctctgggtgcctggaagatcccactatcatctttttgtgggatttgcatgtcctggtcaaggttcctgtaaaaggaatacagtgaggagaccggccacccgacagtattgatggcccccactttggcctccagccgtctgacccgtccctgaatcgagcaggtcctgtcggagctcccaggagtgagcgagcttccactcacagggtcacagccaggtgtgcagcccccaggcctgggcggttctagggcatgattttttttaggctggaaatgagctctcacttgagatgcacccctcaaaatactgaacgtactgcttctgtgagaatttcccctccttgtgtctggtgtgattgacaacgggtgcagccagtggaagcaggaatgtcggggagcgcggggtgcagggggtgccctgtcacagtcagcggggagcgcctgtccctgctgcgtggtgtggggttcccgtggctggcatttgctgctgtgtggagtcctcaaacccagcgctcgccctgcctgcgttcagaggacagaggcaccaccgggaacccaccggatcctcactcaggctttggaaaggccgagtgatgttttgtgtttgtgaattccacacatactgtaggagtatcaagaacacgtaactgttaaaaaaggaaaagtaaaattactgaacaggaaagaaagaataaagcaggtcctttgtttttttggctgaggaaagcagcctgccctggaacgctgtagaatgtctccctttttgtgaagcacagcatggagctctcggaactgaagatgggaatctaaccctgccctcagctttcaacagctcgaagtttgtctttttaatgaaactaatttgtgtatttatacttaagggttttcaagtccttaaacttgataagaaaacttaagtcgttttctatcaggacaagtttttaagtagtcactggtgggagagcgtgcctctgtggactgtgcccaaggctggcggtcccacgaagtcccagagcccgcgagccggtgcccaaggccatgtctgtgatttgcaggaggttcaggtgacaggaaggcctgctctgtttttctcacttcaattttggacttttttttttttttttttttttttgagacagtctcgctctgtcgcccaggctggagtgcagtggcgtgatctcggctcactgcaacctctgcctcaagggttccagcgattttcctgcctcacctccccagtggccggaactacaggtgcttgccaccacttctggctcatttttgtatttttagtagagatgtggtttctccatgttggactggctgctctcgaactcctgacctcaggtgatccccccgcttcagcctcccaaagtgctgggattacaggcgggagccaccgcgcccggcaatagtggaggcttgaagaacaccggaaagtggtttccttgtaccggacccgcccctcccccaccatcccggcagccccagggcgggtgagggcgactgcagtgtggtcacctcaggctttccgtccctagctcataaaggcccagtggcagcagttgctttaaaggagctccgttactccctttgttctggggtcttggtaaagtttgctttgctgaagcggaggaaccgcaggcggtgctgacccccccaccccgcccccatcccacggggtcccttgggtcccggggcacgaggctcctctgagggacacggcctccaagagctggctctgccctggccgccctccacagtcacggcggctccccgcatgctcctcgggacggagatctcctggcttcctcccgcttcctttcctctgcgttttccgcagagccgcctccctgctttggaagcaggtactcagcggcctctgcagccgccaacggcacacaggcctctctctgttcgttctttctttccgtaaccgtagcttgaggcacatttcctaaatatgcagcatggaacgcttggcggttctgaacgcgcatctcgtgctgctcctgtagggcggttaggacgcgctcctctggcgaggaaggtggcagcctccactgtgcacgggtcacaggcgagtgtggtgtggtgtggttgtgggtggggtgtggactggatctgcaggcttgtccctctctcgtggagagctgtcggggtccaggcagtgctcagtggtgagagccacagcacatttgaaagtccacatgtgtttgccccactgtggtccaggacatgtgtgagccacactcagtggacttgcacctgtgacatgttggtcagcgtggcggccgtcagctgggtgtggaatgcatctgattggagcctggcacccggcctaccatgattgtgattctctggggcgagtcctgagtgtgggcagggcctcaggcccccaagagggctgtgagcaggcaccttcctgtgaggcacgatgccaccatgtgaagttgtgtgggtctttggagagttctggcaggttgagggcctgtgcgtgtgggacccaggcctgccctgcctgctgccggccatgttccctctgcccagtcatgttgacaattgtggccaaattcaacatcgggcctgtttcctgcacccacgttggcacacactgagttcaagacagtttctgcagaaatgaatccagaggtgtttatttctggcacgttggatcagacgttcagagggtgggcgtctttctccatgcacttcagctggatcagtcagtgtcagccattgactttagcaacagggaaatgaaagactttcctcaataagaaatgggactttctcacgctggatggcacagagctggcaaacatgaggccagtccacaccaaggctttgcctgcagaaaggctgcactgtggccagcgggggaagcggaggagacacctgtggacaccctccccacaggtgggcacacctttgcgcaggcccagtgtgcgttctgaaggagagcccagggtggggttccgggactgaggtgcagccgtgtccagggtgggcttctagctctgccgctgggcggaactggggtaggtcccagggtggggttccaggactgaggtgcagccgtgcccagggtgggcttctagctctgccgctgggcagaactggggtagtcccagggtgggcttttagctctgccgctgggcggaactcgggtaggtgggagtcctcacttctctgcagggtggtgaagctctctgggtagtgtgagcagttctcaacgtgcaccttggaaagcgcccgttttgaggtttagctgtggccaagatagatgacttcattttgttgctttttgttcttaacatggggagatatttagaaaacatgtttggctcttgctggggaagcagtgctgttccgtacagtgttttacaagccgtgtttccttaggattgaaagaaggtggcaagaggaagaagcagaagcagagagaggagtcgaagaagaagaagtcgaccaaaggcaatcactagaccggacttgaggcacgcggtgcacccccagacgctggcgctccaccgtgctcggcatgcggtcgtgcacacgcgctaggtagcagcgtcggtcaggactgtctcgaggccacactcgctcggcaggattatgcgatcacggatcagtcagagcagggtcaggagacggggctgacggcacgggtggcggggacagacgtttgggacttggccgcgactctctgcttctctccagctctcaatctgctgcattttcctctagtgcttccggatcctcttcattcttttcggctactcaaccactccgcatgctgctggaatatttctggctttagaagtacaggagggcgcagatggctaactgagtaacattcatgaaatgaggctttctgtggcggcgtagtgtttggaattagaaggtaattcagtagagtgtaacttagagaatattgcaagtgacacattgaatcctgcccgtcagggcaccttttcctcagagcaatccggccacacgaatagaaggctgtcgtgaatcacatcagatgtaaaatcattccttctgtttactcttttaattttcatcctttgcaggtagtgcaaattcaacttcaaatatggtgtaggttttgctagattccatatttttttcttggatttttgctaattatttttagcaaaaaatttttgctcagtggcactctccctagtgtccatgggttagggccatgctggggaaaacgggccggtatttacacacgcgcaaaacacccagagacggcacaaggaggttgaactcatgtttcagttcgcgaacattgactccttacgaaagtcacttcattctaactagatgcgcccacttccggtcattatttcgtttgcatgatgtattgcttcttcacgttttgtttttattgagcacggagtagaattccagggctgccttgacttcttccctgcatgctccctcccagtgactttccttccctttcacatgaggatctgccgttcatgttgctttctcctttgtcctcttggacttgagggcattgtgaaaagctttgctgtgatttaaaaatgccagcaattttaatctagcagtgttgaagctgggaattttttggcgcaatccatgtagcagtgacccaggcttgggagccagaaacaagtgtgacctgggattttatttaacacaactgttgccaaagagttggctttgtttatttggttttggcggggagaggagtggtatttgatgctttctgtggacaatgtaaccctaaacacatcatgtattttaaatgccacctacataaataaaacataagcatattgaatac

SEQ ID NO: 37071 - DNA, 33719 bp, Homo sapiens
tctcttgattcctagtctctcgatatggcacctccgtcagtctttgccgaggttccgcaggcccagcctgtcctggtcttcaagctcactgccgacttcagggaggatccggacccccgcaaggtcaacctgggagtgggaggtaaggatgtagtgctctggagtgtgagcagctcggggagtggagcggacccaacccaggtcgtggagactgtgggagaagccgaggcccagtgtggcgctgcctgaagagggcggcgccggagaggaggctggatccacgaaggcttcctaaaacctgcccattttacagatgcaggtgtggagtccctggaaaggggcgatgtgtccgaggccgcacaaaccaggtgtagcagccaagacacaaactcagtctttccgattccccattctgccttctttatactgcatcctcctaagaaatgaggctgccggagcttgtagagagaggtagaaaaataggaagcctgataggcttagggttctggttgctaggaaatgggtaaaggagaacttttaacgctagaaagctctgttctgagtcggtaaatatttgagtgaccaccgagtatcaatcagccaccttattaagctttgtagggggagactgaggcttgattttgcccttaaggatttaaaaatctgctggtgttacacaatgctttgagacaggttaatgctgcccccggggggtctggggagatggttctggccgtcacagatgtggtaggaatgggtagagatggtggaaaggagtggagagaagtatggatggtagaagcttactttccacacatcctatcttcatttcttgattcaagtgattctcttctgtaccttggacagctcagagcatgggcctcagtttccccatctgccaagaagatttatattggagtgcctctcaaattttttacccctaaccctctctgatgaatttgttattcttctcactatcatttggatgtttgaagccccacagacacttattttctccatttggattttgccacgtgcaaagaccagccagagagatgaaaatgggtaggataaagtcttatgctaggtaatagacttagaataaaaggactagaaattgtggaaagagaaggtggaatcattttgtagcagagtgtgacatgaaggacgctcagaatcaggtttctcatagataacgttttgtctgtgcatagcatttgttaaaaaaaaaaaaaaaaagtcggccgggcgcggtggctcaggcctgtaatcccagcactttgggaggctgagacgggcggatcacgaggtcaggagatgagaccatcgtggctaacacggtgaaaccccatctctactaaaaatacaaaaaagtatccgggcgtggtgttggccgcctatagtcccaggtactcgggaggctgaggcagaagaattgcttaaacccgggagacggaggttgcagtgagccgagatcgtgccattgcactccaggctgggcgacagagcgagactctttctcaaaaaaaaaaaaaagtcttcactaaggagtatggggaggggtaaggaaaaatccattgaaaagtgatggtttgttgaagcgggtaatttgttgaagctggatgatgggtacatgggcatacgttatattattctctcagcttttgtataggtttgaaatttttcatcataaagcttttaagataagtcagtactacatagtttggcccattgagggaaaatgatgtttttagcaggcaactgagtgggagaaatgttgaaagattgcctcaaattgaatttgaatggacaccatttggtctcttaatttaaaaccagtccaaaacctccaagcgtttctttgcagcgggatgtatacaaagaactagtattactgtcaatctaaatacatctttttaaaacgtcagattttgcctgccacggtggctcacgcctgtaatcccagcactttgggaggccaaggcaggtggatcacctgaggtcaggagttcgagaccagcctggctaacatggtgaaaccccatctttactaaaaatacaaaaattagccagacgtggtggtgcacactggtagtcacagctacttgggaggctgaagcaggagaatcgcttgaacctgggaggtggcggttgcagtgagccaagatcacgccattgtactccagcctgggtaacagagtgagactccgtctcaagaaagaaagaaaaaaaaaaacaaaaaaccacgtcagatttattttattaattcaatttacctttgaactatcttacagggtttctgtgaggattaagtacatttaaagtgtttatagctgtatttggcacataagtaggatttatataagtgttaggtattactgttattgttgttttggcatttctttgagtgattctcataaaagatattgaataaaaattttcagttcaagaactgcaaaatgaactaatttatgaccttggttcagaaataaactgctcctgcagagaaaaagcaccccgacagcacaggccagaagcaatggactcagaattggagtcattgactcagacggccacctcagctgtgaaggtgcctttgtcatgttttccaggaactccaactccttaccatgagcaaattatttatgcatgtaatctcactgaatgctcacaactctggagggtggtttattactattactgtttagaggcaaggaagccgaagactggagaggtgaagcaatttgccccaggtcatttgaccactgggtggtagagctgggaatccaggccaggtctctcaggcctcagagtctctgcccacacctgtatttcaggtacctccaggtggtagccagtacactgtagtgggaagagccaggagacctaggtacaggcccagcaccgtggtccagccatgtgacttggaagggttgtttaacatccctggggctcatctgttaaatgaggagccaagattgaatgacctctctcccaaattctactcttaagattctactgggccaggcatggtggctcacgcctgtaatcccaacgctttgggaggccgaggcgggcggatcacgaggtcaggagattgagaccatcctggctaacacggtgaaaccccgtctctactaaaaatacaaaaaaattagcagggcgtggtggcgggcgcctgcagtcccagctacacgggaggctgaggcaggagaatggcgtgaacccaggaggcggagcttgcagtgagctgagatcgcgccactgcactccagcctgggcaacagagtgagactccgtctcaaaaataaataaataaataaataaataaaaaagattctactgtactaaaagtcaactccacaattcactagcacattctatgactgtagcgtaggataataattttactggcctcatcagttgtctgaggattaaatgaataattatatgtgaaatgtgatatataaatgaaaagtgtcatatataagtgttatttttgatcatcactgtgacccgtctttttgtggatagcaggtgtttggataaggatctaattagagtagaataaaaggtctccttccagccgttatatgtcctagtcttatttatacacatccccaagtataccccttgtgaagaaaatgtaattaatcattgaccttagggaagatactttttttcccccaagttaatataaaacctaatggaggttatctagttaatgttccagtgattttggacacgtttagaataaactgcacctgtaatctcagacagttcctacttgcagctagtttcctcagtttttcttcttgctgtgatgatttaaataatttccttataggtaaacagaggagagtatcacattttccactgctaagcacaatgctttctaagttgatcattttagtgcttctcaaagcttcagactgaagtggttttaaggacatgggaaatggatccaacctggtgcaacctgtagcaagaagtttcttcaaagactccagtccattttttcatgtgagcctagctttcttttggcccagataaactctgctagctttaatatttcttattttcaacatggtttcctagcatcttcaaataaaatagttgggaaaatatgctttatcagatgtttctgagtacccctagccttctccccagtatcctaataggctcttgagtggggataggtgagggaagtggcgatcttaggaggaagatgagggtgatggtttgaccatttaaatctgtgttctttcttcctttccttctgcaaagcaagactgctgggcccacctgtagactgtgtgactcccctaaaagggtttatgtccaggaagaagagcagtggggcatggagctggggagcatgctgataaaaaggcccctgacatggtcccaggggcctgcttgcttcaggctttctctagacatctcttgcttttaaaaaagcacatggatccatgaacttaatagtatgacagcctagctcttgttatctctgtgatcctgggcaaatggtttgacttttctggctgcagcagccagatccttaaaatagacatcacaatatctattttgtgggttgctatccaaattaaatgagagtaaagaaatgtatttagtgcagtaccttgtatgtacaaagtatttagtaaatccgtgttgttatttctctgccctcaggttccgtcaatgtctttctccatgccccagacctcatctctgaatgtcaggcctacagtggacacatcctacaactccctcaaattcagcatgttcaaagcacagctcatcatttccaccttccccttgatcttttcttctatcttccccttgtgttctaggtcttggtcgaccccactaccaccatccactcattatccagacttgagggagaccttggagtcaacagcagccctttccccaatcccctgtctttttatttggtcaataggttctgtcttttctacctcgaatctatttccaatggcaccccttttcttcatccctgctgccattgtgtgaattcaaggcctcattatttcgcttctggaatattgcagtagctttctactccttctacttctagtaactcacccttcttaactactgtctctgtccttctctctggtttattttctgtggtgtcactcaaatgatcccattaaaatgtgcagctgctcatgttactctcttgcttaaatgctttcagtggttacccattgaaactgaagttccctaaaagagactccaggattcttttagccactcccagctaatccttagtggattccacatcagagtcatgaaaatgcagatcctcaaagacctcatgctccccaggcctctggggccttgcacaggtgtgccctctcgcatgcccttcttcccttgtttaccttttaaactcttattcatctttcattcttcattctctgtaaaatcttctctgattcctcaaattagaattaaaggctctatctatgctctgtgtttcttggagggcagatgggatcttattttatcaatctctatagcttctactagccagtgcctggctcatggtgagacttagtaagtacttgttatgtgagcgagtgaatgaaagagtgaatgagaaactcaagggtccaacaaataggaataaaaattcttggggacagcaggaatagtggttgttgttaatgcctgaccccactgctccagtcacccaagaggaatctggttctgcttcactagggcagttaggagaggcatcaggaacaaatctagaactcaacctgggaaaaactgggcaatggagaaggaaggggagttgtaaattggccagtttttttttagtcacagtatagacacaatgcctctccaaccatccccaacccaagtagtagtattggaattttagagtttcacagagtattcagtagtggtaagaacagcagtattccagtcttttctttctctttcatattttatttattcatagcacattatttgtgaatgacatattatcataaatataaacacatagcctaataatgttatagaatagatataacacccagacacagaactgaaacataacagaactggtttttctataaacatcccaaatttttttgcatctacctagtatcctttgtaggtagttcaaatatgcttttcttgttccaagatttctagaaaccccttttagactagctatcaaggcatgtaggacccacacaagggatcattttttaaaataattgttctccgtaagttttacccagcttattcactcactcttttcaatggagatgatgcaaatgctattcccgaaaaataattgactttcaaaggacaaagatttggcactattgaggctattcaaaataatgagatgttgcctctagaaacaattccaaaagaagtttcaagaatattttgaacaatggtaacgttgtgatcatagatatgttgatgtgctttagggacaactcttacttggaagtagctattttggtacatctttagagaagccagaccaaatcccagctggcgaaggaggctttttgaacttgttgagaagtttggtggactaaggggtatatcatgaatggtatgagagtattgtgagttgggccaggcatggtggctcactcctgtaatcccagcactttggaagtccgaggcgggaggtttgcttgagcccaggagtttgagaccagcctgggcaacaaagtgaggccctgtttctatgaaaaatttaaaaaaaaaaaattagctggtcctggtggtgaatgactttggtctcagctacatgggaagctgaggcaagagaattgcttgagcccagggggttgaagctgcagtgagctgtgttcgtgccactgcactctcacctgggcaacagagtgagaccctgtctcaaaaaaagaaaaaaatattgtgagttagattcaccagagccggagggtagactatgagtggtatgagagtattgtttgattcacctacccagaggcatttggtcagtggctctgtcagtctgtagccctgtccacatttctattactaacttgaaatgtttctcagatttgcagatgacatattcctggagggtagagttagctgatcattcaaaatgatcttataaagtctttttactgtatatcctgtgacctaataaattaacatttagatatttttcctaagaaaacactcatgaatatgtgtaaatatatgaacatttatcacaatgtttataatagcaaataatttaaagcaacacagttaataaattatatataaaacaaatattatttatccactaaactgatgttgtaaatggctcatatttatgaaaaatacccaattgcattcataataagataaatgcaaattaaaactacttgacatattatattggcaaaaatacactcagtgcgtaaggctgtgtggaagcaaacgctcttaaacagtgctggtgggaatgtaaattgatataattcctgtatcaattgggacaatttggaaatatttgtcaaaattacaaaaacacatacttcttagcccactcttttgttttccacccagcatcttacagatatatttgcatacatgtgagatgacgtatgtacagggtcgttcactgaagtattgttttaatagccaaagattgtaaacaactcaaatgtccaacaagagactggcaaagtaaaatatggtacattcatcagctaagcagctgtaaaaaagaacaaggacgctctctatgcgcaaatgtaaaatgattttcaagtggaaaaagcaaggaacacaaaacagtgtatagtatgccgtatgctaccttttgtttaaaagggcatatgtaagaagctgtgtttgcttgtgtaggcatagggaaatgcaggaaggatatgtaagaaactaacagttgttatttatggagggagggatttgagaactaggtagatagaggataagaatgggatggagacatgcaaacatgtcacctattagaagaatagttaatgaggaggaaaaatgcatagtatatatttaaatggaaaaaagcatgttgaaattctatgtacagtttgatccatattttataaaagaatatgcccatcaaaaataaagcttagaaggttgtacaccaaaattttcatactccttgtctctgagtactgggattatatgttatgttagttctcacactgctataaagaactacctgagactgggtaatttataaagaaaagaggtttaatggactcatagttccaccggccatataagaaacatggttgggaggcctcaggaaacttacaatcatggaggaagagtgaagcgcaagcaagcaccttcacatggcccagcaggagagagagcaaagcgggaggtgctatacacttttaaaaaaccagatgtagtgagaactcactcactgtcacaagaacagcaaggcagaaatctgcccccatggtccatcaacactggagattacaattcaacatgagatttgggtggggacacacagccaaactatatcagtctactcctgacccctatcaaatctcatcgccttctcacatttcaaaacacaatcacatgttaattataatgtttattttttaccttctgggcttttcccaattttctacaatcaacacgtgttgttcagtaaatggtaacaacaaccctaaaatgtaattttttttttaagtcagggattaattttgggcagaaatcaagaaaataaaaatcagtatcactctaaaattttgtttccatttcaaaatcacttgcgtaagtgtaggattattgaggacctaaacattcaaacagagaggcaaatgacccctgccaggaatcctacttggacagattattggcgtgggtgcaaagctaaggtaactgccctgtaaagctctaatcctaacataatcatagaatagtgtagggaaaaaaattggtgctggataactcagagtgacttaaaaatactttcagaggaagaggaaatgcttagaggtttactgtagagcaggatcaaatattgtgaaatagatcaatttagatcaatgaaagggtgaggcagatgaagtgggatgaagtcagaagggtaaacactggctgaggtcaaaatacagagagaggatagagatgtgtttaagtgggtccttgggtgattgtgtcacctgtcattgaaatcgtcagggcatttgcttatcattcgtcttatttctgttcctctgggacaagaggagtggtgggccttcttccactccttctccatgtttgtgttaaaggtgccaggttcatgtggaagtagcacctaggctttttctggaagtctcttggggagatgcagaaggaagaagactgctgggccaatggcctagagacctcagtgcactagtgatattgacatgacatttgcaagatgctttttactttgcagagtgcttttctatgtactttctcatgtgaccaggctctgtgatgtcccagttttatttcagcattctactttttggaggtcacatagttaagagctgtaagttccacaaggatggggaccacatctgcccttatgtttgcccagcacctagcccaatgcttggctcaaattaggtactcagtaagtgaacaaacttttctccaatttccttcactgttctgttttgaccggaaggtggtgggattctcctggttcacagttacaaactcttaacttggacacagcatgagcctccactatgtataactcttttccattctccagcatatcgcacggatgactgccatccctgggttttgccagtagtgaagaaagtggagcagaagattgctaatgacaatagcctaaatcacgagtatctgccaatcctgggcctggctgagttccggagctgtgcttctcgtcttgcccttggggatgacagcccagcactcaaggagaagcgggtaagttttgggtaaggatgtattttctctttagaaactgaaagtaaaaagatgttgagaatacagtttgtttaaaatattaggcgttatgtctattgaactgccaatgaataagtgtttctgtagcgcgagttcaggaacctgatagcgcaaataatgtggccatgtacaaagcacggctttttcacttgttcagttttgcccagtagatcatcagattttagctactgcatttgaagcagtcagtggagatgccaagtagaaagaatttaatggagtgataaagacaccagggttctagatccaactctgccactacttttgatcataggcaagtcatttagccctctgggctcacatacacatgttagaaaaagaccacatagtgcgagtctgtgatcccatgaggagcacttgcgtagggaattgtttaaggggcctctgagtcccctgaaattatatgcagaattttgtgtgtacttatttcttgggagaaggtgcatagcttttagcagattttcaaaaggtgtctgtggcccttcaagggttcaggagctactagtagatgctgtctaaagtccctgccagttctaatattctttaatacttctactgttgatctcagcacctatcatttaagtgcttcctggtatatagtctgtgtgtaactggagatacatggaggaagaacacatttggaagtagacacagtgagataggctgtgtgttccaggaagtggaacagattctcagtgttgtaggaattcagaggggagggagacctatgagtgctggagatggcacttgagctgaatcttagagaatgtgtgagcgaggccgggacactggttctcagctccagctggatgttagtattacctggggagtttttaaaaacatactgtggctgggccctgtggaccccatgccaggccaggtaaatcagaatcttggaggcaccacccttctcccctctctttcactcccttttcttctcccccatgggcatattttttaaatactccccaggtgttttcaaagtatagccagttttgagaaccataaaatatggaagaggggcaagaggaaggatattcatcttgcatggtaggagtccagggacagaggcaagagctaagcaggtctagcttgtaaagagacctacctgatgagagctgggaacatgttggataggttaggcaggctgattctggcagccagggcaggagaagccaactgaaggttggagcagaggagttacccaataaaagtgttgtttgaagaagataagtctgattgggtgggtgggaaaaagaagagctcagatttttgcactagtccagttgggaattgcacagtttaaaccagtggccattatcattcccctgggtcagtgttgtgatgtagcctgtaattcatgcattgaggaaaccacatcttggagtcatctgatttattccccacatgctgtgtacagtaggttttccttttatatatcatgttacccagatgccctgataagcagaatggcagaggacaataaaggttgcacacccatacatttgtacatgtaccaggaagcagggaaggccctggtgaaggtcttgggactcaggtccatgattaggcaagtaatgaacttcattaaggttttgtatggattggaatgagagactatgatttgcctcaatgaactgaagtcatatggttagaatagttaagagtatagagattattaatcatattgggaagtttttctgaaaatccagtgtttctgcagaggtagaggagaatcctaatgaagtttgaaagtggggaactggccaggcgtggtgatgcacgcctgtaatcccagcacttcgggaggccaaggtgggcagattacttgagctcaggagttcaagaccagcctgggtaacatggcaaaaacccgtttctacaaggaaatacaaaaattagccgggcatggtggcatgcatctgtagtcccaggtacttgggagactgaggtgggaggattgcttgaccccaagaagtggaggctgcagtgagccatgattgcaccactgcattccagcctgggcaacagaatgggaccctgtctcaaaagaaaagaaaaaaaaaaaaaaagaaagtggggaacataggccactggggcctctcttctgaaactaaataaattagttggaattctgttgctgacaaatgaaaacagagattccatgttggggagtttcttcctctaatactgcatttcttatatagttgttaactatgttgggcagatgctgttcctctgcccattgatctccatttgatgacttacactgtaagacttaaggctattttttgtagccttgaccctgggaacatagccctccctcttaatctagtttctcctgttttatatttttgaccataaaacaattttaaaaggccatcttcatggcagcaaatatttgaagatatactttttggatactctcttggcatctattaatacatcactgtgggtaccagtggttattgagctctgagcccttctttttatatatatatatatttttttttttaattatactttaagttctagggtacgtgtgcataacatgcaggtttgttacatatgtatacatgtgccatgttggtgtgctgcacccattaactcatcatttacattaggtatatctcctaatgctatccttcccccctctccgcaccccacaacaggacccgtgtgtgatgttctccttcctgtgtccaagtgttctcattgttcaattcccacctatgagtgagaacatgcagcatttggttttttgtccttgcgatagtttgctgagaatgatggtttccagcttcatccatgtccctacaaaggacatgaactcatccttttatatgtgccacattttcttaatccagtctatcattgatggacatttgggttggttccaagtctttgctattgtgaatagtgctgcaataaacatatgtatgcatgtgtctttatagcagcatgatttataatcctttgggtatatacccagtaatgggatggctgggaaaatggtatttctagttctagatccctgaggaatcaccacactatcttccacaacggttgaactagtttacagtcccaccaacagtgtaaaagtgttcctatttctccacatcctctccagcacctgttgtttcctgactttttaatgatcaccattctaactggtgtgagatggtatctcattgtggttttgatttgcatttctctgatggccagtgatgatgagcattttttcatgtgtctgttggctgcataaatgtcttcttttgagaagtgtctgttcatatccttcgcccacttgttgatggggttgtttgtttttttcttgtaaatttgtttgagttctttgtagattctggatattagtcctttgtcagatgagtagattgcaaaaatgttctcccattctgtaggttgcctgttcactctgatggtagtttcttttgctgtgcagaagctcttgagtttaattagatcccatttgtcaattttggcttttgttgacattgcttttggtgtttaagacatgaagtccttgcccatgcctatgtcctgaatagtattgcctaggttttcttctagggtttttatggttttaggtctaacatttaagtctttaatccatcttgaattaatttttgtataaggtgtaaggaagggatccagtttcagctttctacatatgtctagccagttttcccagcaccatttgttaaatagggaatcctttccccatttcttgtttttgtcaggtttgtcaaagatcagataattgtagatgtgtggtattatttctgagggctctgttctgttccattggtctatatctctgttttggtaccagtaccatgctgttttggttactgtagccttgtagtgtagtttgaagtcaagtagcatgatgcctccagcttaggattgacttggcaatgggggctgttttttggttccatatgaactttaaagtagtttttcccaattccgtgaagaaagtcattggtaggttgatggggatggcattgaatctataaattaccttgtacagtatggccattttcatgatattgattcttcctatccgtgagcatggaatgttcttccatttgtttgtatcctcttttatttcgttgagcagtggtttgtagttctccttgaagaggtccttcacatcccttgtaagttggattcctaggtattctattctctttgaagcaattgtgaatggtagttcattcatgatttggctctctatttgtctgttattggtgtataagaatgcttgtgatttttgcacattgattttgtatcctgagactttgctgaagtggctcatcagcttaaggagattttgtggtgagacgatggggttttctagatacacaatcatgtcatctgcaaacagggacaatttgacttcctcttttcctagttgaataccttgtatttctttctcctgcctgattgccctggccagaactttcaacactatgttgaataggagtggtgagagaggacatccctgtcttgtgcccgttttcaaagggaatgcttccagtttttgcccattcagtatgatattggctgtgggtttgtcatagatagctcttattattttgagatacgtcccatcaatacctaatttattgagagtttttagcatgaacggctgttgaattttgtcaaaggccttttctgcatctattgagataatcatgtggtttttggctttggttctgtttatatgctggattacgtttattgatttgtgtatgttgaaatagccttgcatcccagggatgaagcccattgatcatggtggataagctttttgatgtgctgctggatttggtttgccagcattttattgaggatttttgcgtcgatgttcatcagggatattggtctaaaattctcttttttggttgtgtctctgccaggctttggtatcaggatgatgctggcctcataaaatgagttagggaggatttcctctttttctattgattggaatagtttcagaaggaatggtaccagctcctccttgtatctctggtagaattcggctgtgaatccgtctggtcctggactttttttggttggtaagctattaattactgcctcaatttcagctcctgttattggtctattcagagattcaacttctttctggtttagtcttgggagggtgtatgtgtcgaggaatttatccatttcttctagattttctagtttatttccatagaggtgtttatagtattctctgatggtagtttgtatttctgtgggatcggtggtgatatcccctttatcattttttattgcgtctatttggttcttctcttttttcttctttattagtcttgctagcggtctatcaattttgttgatcttttcaaaaaaccagctcctggattcattgattttttgaagggttttttgtgtctctgtctccttcagttctgctctgatcttagttatttcttgccttctgctagcttttgaatgtgtttgctcttgcttctctagttcttttaattgtgatgttagggtgtgaattttagatctttcctgctttctcttgtgggcatttagtgctataaatttccctctacacactgttttaaatgtgtcccagagattctggtatgttgtgtctttgttctcggtggtttcaaagaacacctttatgtctgccttcatttcgttatgtacccagtagtcattcaggagcaggttgttcagttttcatgtagttgagcggttttgagtgagtttcttaatcctgagttctagtttgattgcactgtggtctgagagacagtttgttataatttctgttcttttacatttgctgaggagtgctttacttccaactatgtggtcaattttgaaataagtgtggtgtggtgctgagaagaatgtatattctgttgatttggggtggagagttctgtagatgtctattaggtcctcttgatgcagagctgagttcaattcctggatatccttgttaactttctgtcttcattgatctgtctaatgttgacagtggggtgttaaagtctcctattattattgtatgggagtctcagtccctttgtaggtccctaaggacttgctttatgaatctgggtgctcctgtattgggtgcatatatatttaggataggtagctcttcttgttgaattgatccctttacaattatgtaatggccttctttatctcttttgatctttgttggtttaaagtctgttttatgagagactaggattgcaacccctgccttttttgttttccatttgcttggtagatcttcctccatccctttattttgagcccatgtatgtctctgcacgtgagatgggtttcctgaatacagcacactgatgggtcttgactctttatccaatttgccagtctgtgtcttttaattggagcatttagcccatttacatttaaggttaatattgttatgtgtgaatttgatcctgttattatgatgttagctgcttattttgcttgttagttgatgcagtttcttcctagcctcgatggtctttacaatttggcatgtttttgcagtggctggtaccggttgttcctttccatatttagtgcttccttcaggagctcttgtagggcaggcctcgtggtgacaaaatctctcagcatttgcttgtctgtaaaggattttatttctccttcacttatgaagcttagtttggctggatatgaaattctgggttgaaaattcttttctttaagaatgttgaatattggcccccactctcttctggcttgtagagtttctgctgagagatcagctgttagtgtgacgggcttccctttgtgggtaacccgacctttctttctggctgcctttaacattttttccttcatttcaactttggtgaatctgacaattatgtgtcttggagttgctgtttttgaggagtatcttcatggcattctctgtatttcctgaatttgaatgttggcctgccttgctaggttggggaacttctcctggataatatcctgcagagtgttttccaacttggttccattctccccgtcactttcaggtacaccaatcagatgtagatttggtcttttcacatagtcgcatatttcttggaggctttgttcgtttctttttattcttttttctctaaacttctcttctcacttcatttcattcatttgatcttccatcactgataccctttcttccagttgatcgaatcggctactgaagcttgtgcattcgtcatgtagttctcgtgccatggttttcagctccatcaggtcctttaagtacttctctgcattggttattctagttagccattcgtctaatcttttttcaaggtttttaacttctttgcgatgggttcgaacttcctcctttagctcagagaagtttgatcttctgaagccttcttctctcaactcgtcaaagtcattctccatccagctttgttccgttgctggtgaggagctgcattcctttgtaggaggagaggcactctgatttttagaattttcagtttttctgctctgttttttccccatctttgtggttttatctacctttggtctctgatgatgtacagatgggtttttggtgtggatgtcctttctgtttgttagttatccttttaacagtcaggaccctcagctgcagatctgttggagtttgctggcggtccactccagaccttgtttgcctgggtatcagcagcggaggctgcagaacggggaatattggtgaacagcaaatgttgctgcctgatcgttcctctggaagtttcgtctcagaggggtacccggccatgtgaggtatcagtctgcccctactggggggtgcctcccagttaggctactcaggggtcagggacccacttgaggaggcaggctgtccgttcttagatctgaaactccgtgctgagagaaccactactctcttcaaagctgtcagacagggacatttaagtctgcagaggtttctgctgccttttgttcgagctctgagcctttcttctgcttggaaggcctcaccattcccaggctgctgtcttagttcactaatagcctcttaatttaccttcctgcctctagtctcttccctgttttagtacattctgcatgctgcagctaggatgaccttccttggcaaaacaagctactcatgtcacctgttcccactccccacccccaccgcccatagctcccccattgcctgtagggtaaaatccagactttgagcttggcatgcagtgaaagtaggtgacaggtgacagtcttcatcctgttcttacagttgctgatttcccctcactccactagaggtcctgacattctaagagtcttgctgttctctagacctactgggccctgtcaagactaagaacctttgcctggcccttctctccatttggaatgccctcccttattgctctagctgtccagtccccacctctaagtccttcaagagctgatcaagggtcacttccacactgaatccttaggtattttaggcagagcttgttgtttaagctctctgagttatcacaggactttgttcacagcttgggaataacagtacttaactgttcttactataatggataattttataagtcttcatctcccacaaggccctaactttccccaggagagtgatcattgcttatttaccttgcagattttcagcatttggctcctatccgggtacctcaggttccaaaggtttggattcattcattcctttagtcatcagatgcccactactagagccaggcactgttctagatgctggagcacagcagtgactcaaacacacagaatcccctgcccttgcattcagtttcggggagaggaacagactctaaatgtaatctttttgactatatcagtaagaaaatgatgtagtatactaaagatgataaatgctataaaaatggagcaggaggtggcatgttaggaattctaggagtggatacagttttaactagggtggttatgatagaaatagaaatgacatttgagccaaaacttaaagacgagacataaatgaaagaatgagtgaacaagtaaaccaacagtaattgtttcttcccttagatttttcttctccagattcaacatttccagatcctttacccattttgaggagacctattttctagactcctcactgccttgtattacttttccactttcagatcttaggatccagacagaaatgtcgatttttcatctctggcatagtgctgtttcagctttgagattactgagcattgtaggaaggagggctcatgggtcataactcattgtcacatcatgacatcccactctcgctttgattgcctctaggcgacttggggcttctgctgtggctcagatcttttcaccactgtcttctttcttcatctagttcagcacatgcttatgtagtaccatgtgccagatgccgtgagagatgctgggggcacccagatgaatgcagcatggctctggccacaggcagctcctggttgctctcctattcctcatggtgaagtcatagtatcggcaaattgttatctcagacaagggttctagaatccagcaatcttatgctgacatgtccaacagaggcctgctctatctagcttcataccaagtcttcctggatttcccttgttctggatactcttgtttacccaggtccagttgcctggctccttgagaagtctgtacttacttcctttgatgttatgattttcctttataacaagtacaggacattcttaggctgtaggacaatttgccaaaaatcagttcacagaatgaccacattgctatattattgattcaccaaaaacttgtttctgttagttgctgatgtttagagcaacttgtgtttcactgaagccatccagtatttaatagatttttagggagtgataacttcttgagaatttgatatttcaagtgtcatatatgtcatgaatgtcaaggattagttaatgtggagtgggtttatctcttctaagcacatttttaatgtattctactgatttttaaaaaaatgaatttgctttctgtagtgggagagaaagggtggagtgaaaagttgagaacaggaaatgaaaaattatgcctgggaatgtttccactggtatctatgcatctatcgtgtttccagaagttaaaaccatgttcaagggaggtcttgctcatttgcttaggaagtattagcactctagagtggcttaggtatctgcaatgtgaagtcatgtatgaaactgacattcaacttagctggatgacaaatccataaaaaataaatgcacatttgtgttatatcatcttggtagcaatttgcataaagaattcaggtaaaccacaatgtgggggcaaaacttttaaagtaatagcaagggatgagtgctcagtaaggatcactgtaaataacagagtagttagcacaccaaatctgacacacactgagcattttcaccccagtgcactgcctttgcccctctctgtaatgtacagctatgtttagttctgcatccccttgaatgtcaactttgcttatgtttcacatttcagatagtattctttcacagatgctcacacctataaatacaaacagaacattggtgcataatagtgccgataattggtaacattaccttgttgttggcttaaatgggatttctactaaacgattcactgtttttaagctgacttatgggttaaatgaatttttttcagtcattttcaggaagtatccactgtttcctgttttactaagcatttatctcaggaatagccaagcttttcttacctgttgtgatgatcatttgggttttctctatctagcagcatgattggttttatatctcttataatccattcatgggatgactctcaatcaagggggtaattttaatgtactgctggattaatattgttcattaatgtttacttgggaagttagtatcaaggtacgatctaggtctctcattctacttttttcccttttgttgtcttttagcagcaatgttatgttaggttcttgaaaagatttaggaagcttttcttctctaagaagagttttaaaacttttttattggccaggcgtggtggctcatgcctgtaatcccagtactttgggaagccgaggcaggcggatcacgaggtcaggagttggagagcagcctgaccaacatggtgaaaccccatctgtactaaaaacacaaaaattagctgggtgtggtggtacgtgcctgtagtcccagctcctcaggagtctgaggcaggagaatcacttgaacccaggaggcggaggttgcagtaagccaagatcgtgccactgcactccagcctgggcaacagagcgagactctgtctcaaaaaacaaacaaaaaaaaaacacaaaaaaaacctttttattatggaacatttcaaatctatatgaaagtagagaaaacagtataaagaatgaatccctgtgtatccatcacctagcttcaacaattatctgtatagggtcaatcctgtgtatttccatctacccactccctgcctccctgcctccctgccctccacgaaagctggattattatttaatagtaaatcccagacatctaaataggtgtttgaaattgtaaaattttatgactaatacatgaatacattcatcttatttttaaaaaaacgacttatagattaggccaaagtccctttcaaccactattcctacatccttggacccctccccagaggttgccactgttagaagattggcgtgtgtccctccttgtatttacttatttatttatttgagacagagtctcactgtgttgcccaggctggagggcagtggtgcgatcttggctcactgcaacctctgcctcccaggttcaaatgattctcacgtctcagcctcccgagtagctgagattacaggtgtgtgccaccatgcccagctaattttcttgtatttttaggagagacagggtttcaccatgttggccaggctggtctcaaactcctgggctcaagtgatccacccaccttggcctcccaaagtgctgggattacaggcgtgagccactgcgcccggctagatagactttttcatgtgatctttttcttcctttctcttcaatcctttagacaaattgggcaacatggggtttatgacatttttctgctgagagacttatgctgaaacctaattagaattttgaagaggcaaaatcaaagatctataggcagagaactacatcattagaatgtagtgactccatctagaatggaaaacctggatttgtgctgagctgtgccactcacaactgtgtatcctttgggaaaaacatgtctctgaatcagttcctcatgtttcaggggatatagacttgactttagagggcatgtgggcattgagtatacatgaaagcattttgtaaatgataaaatataggaatagaaaaccaaacacctcatgttctcacttaaaagtgggagctgaacaatgagaacacgtggacacagggaggggaacatcacacacgggggcctatcggtgggtgggaggcaaggggagggagagcattaggacaaatacctaatgcatgcggggcttaaaacctagatgacgggttgatgggtgccacaaaccaccatggcacatgtatagctatgtaacaaacctgcacattctgcacacatatcccagaacttaaagtaaaataaataaataaataaataaataaaatatggcttttattattgcctatgttaggtcactttaggatgagaggaagccagccaggcgcagtggctcacacctgtaatcccagcagtttgagaggccaaggcaggcagatcacaaggtcaggagttcgagaccaacctggccaaaatggtgaaaccccgtctctactaaatatacaaaaaattagccgggcatggtggcaggcgcctgtagtcccagctactcgggaggctgaggcaggagaatcacttgaacctgggaggcggaagttgcagttagctgagaccatgccactgcactccaacctaggtgacagaatgagactgtctcaaaaagaaaaaaaaaaaaaatgagaggaagccaaggagaagaaagtagtactcatgcatcacctctgttttgttagaacatacttctaaggattaataagcctgaattctagagatgaggagtagcacagattgatgtcaatgacaagttaggaacactgttttagaggcttatgctagagggtaagtttgatcttaggatgggtgctgaagagatgggtttgccttccaaggcatgtgcgtgcatgcacacacacacacacacacacactaatgtggcctcggtgtgtcctctacctctgtgttcagaagggaagcttcttctagtgtcagacctcctgggttgaagactggcactcctgctcagtagctggtaactttgagcaaggttcttcacctctctcagcctcagtttcctcagttgtaaacatgggcaaatcatagtacctttttcatgtagtagttgtaaggttttgatgagataatacaattaaaagccttagcacagagcaggcatagagtaagtgctcattattaccttatttttgtaaatattatctgacctcaccattatcagcctgtgaccctgtttcttctctttcaggtaggaggtgtgcaatctttggggggaacaggtgcacttcgaattggagctgatttcttagcgcgttggtacaatggaacaaacaacaagaacacacctgtctatgtgtcctcaccaacctggggtgagtctttcagctgaagtgagaggaaaaacagaaaccagagagaattatcctcatgactctccctggttacacagaaaatgtaatccagccctagaacaactgactgttgggaatggcttgaacagtgggttatggcagtgcatgagaaacctgctgctcaaaatcaagttaagaatactctttctcaagactcttagtagacttgtatctaccaaggctatgttgaaactccccagaggaggcatagaatgtagatgcaggaagtatcattgtagtagaatataagtctggcattaatgtgactggttgaacttgttcttggttacaatcattcctctacatcttaacccccagcctggatgatgcccagtggacattgagcctgggagggccctggaagctgacttgcatcctttccactcatgcctcctagtgtttgtaaagtgcttaactttttacttctttgcatgcagagaatcacaatgctgtgttttccgctgctggttttaaagacattcggtcctatcgctactgggatgcagagaagagaggattggacctccagggcttcctgaatgatctggaggtgggtgatttagaggaaaaagtagagaattgcatggtgtcaggaatctcaggcaaagtctttggaccagttgctaagtgaaggagtctgagacaccttccccatacctgatggtggtttctgacatagcatgtaagagagagggcacaaaagagacatgaaagagtgacaagaatatggttgccctttgccctccatcactgaccaatctgctgctgactctgtctcccaatattcccatcagtgtcagagctgacatagcttccttctcctcagaatgctcctgagttctccattgttgtcctccacgcctgtgcacacaacccaactgggattgacccaactccggagcagtggaagcagattgcttctgtcatgaaggtaactgccccttcagagcatctcttaaaaaatagtatatattcttatttaatgtatgtagaagcaatacctgtttgctgtttgctgaggaattaggaaaatggagaaaagtccaaagaagaaaataagtattaactgtaaattttattacctaaagaaagatactgttaatgttttggtagatagaatgtcagactgtgtgtgtgtgtgtgtgtgtgtgtgtgtgtgtgtgtgtctagttttatgtatatgttttacaaagatgagatcattttgtctgtactgttttgtgcaacacaatttgtttttcattttcacttctttatatacatgtcattgaatattttgcagcatcatttttcatagctatattatatttctttcatggatatgtcatattagggatggggtaaatcatctgatgaatatttaggtttacttcagattgcttgatctgatgaaaaattatgtaacaaaatttccttttattatttctttggcgtaactttctaggtgggaattcctagctgaaagtgtgtatattcttccttaacgagtttgtagaatacttattaaggaactgctgtgtattggacactgtgggaatacactattgaatggagcagatgcagtccctaccctcaaagacagacagcctgtttggggagatggacgagtactaaggcagctgtgatgctgtgagatagctgtgttgacagtgttataggggggtacatagcccagactttgggcagtgtatatgtgggagttggcgggttggtggcaggaaccttcctggaagcagtggtttctatgttgagtcctgtaggatggggaggagctaagaaggcatcagcagacaggggttgacagggaagggatgtgctctgcagaggacggagcatggtcagaagccccaggcagacatcatggggagtgtgagtgatgaggctagagtgaataggggcagggtctgtgctgaggcttggactttattctcagggcagtgcggagccactgaaatcttggatgtcggggagtgacatgattggatgtgcatggtcttaaggccaccctgatgtcatagcagggaatgggtcagagagaggcaagactagacaggccgtgggagcagttaggagaccattgccatagcccaggtaggagttgatggtgacctggatgaagtaggtagcagtggggacagtgagatgcaaaaggatttgggagctctgaagagacaggactgatgagacttggggagtgccaggatgtgggggatgagctgcagagttaggagtccagattccccccagtcccacctagtcaagataaacctaagagatgggaatcaaagtacaaccaaagatttggacagttccggggagggaagtggtgtccactcagagagcacagctgtagaagcaggttccctgtggagagctctttgaggagatgagtgacaggaatggaggctactctgttcccttcctcttgagtacctagcagaatagcccatgaggagccctggggataccaagcctacacttgactaaggctctcacgccagaaattcacagaggaaaatccacaatgtaggacattgtctccttgcatcaaaagtaagccctgtttctctaagctgaattgggacactctaggacaatttacttttaaaaagtaaagtttacggaaaaggttacacttgttggttgtagagagaaatggatgtaaagtggagcttgggtgcatatagtcaagaaataggagaaatggacagcatttgaaattccctccaggcatcagctggggaaggaaggccggtgtctgaggttggtgccagaaggatttcctgccctgactcactttgcttccccgcagcaccggtttctgttccccttctttgactcagcctatcagggcttcgcatctggaaacctggagagagatgcctgggccattcgctattttgtgtctgaaggcttcgagttcttctgtgcccagtccttctccaagaacttcgggctctacagtgagtgctctcctgaggagttacagccccacctcctcgcatcactccctgcttcagcagccacagctgattctggtccctctctttagatgagagagtcgggaatctgactgtggttggaaaagaacctgagagcatcctgcaagtcctttcccagatggagaagatcgtgcggattacttggtccaatccccccgcccagggagcacgaattgtggccagcaccctctctaaccctgagctctttgaggaatggtaaggggctcccagtctggtgggccggggggtggggagtgcagaacagtaattgtcccagtacatttaactgggtctcttcctttcattttggcagaagcaggataaaattactttaacttctttgactctcagatatttgtaaaacaggggctgatatctacctcacacgtgcataacacaacacctggaagacaggagggggcactcgatgaatggtagttttccccaatttccccccccacccagtcttcctctccatgaagttggaaaacccaagaaggtattcccagcaaaatagaatatcgaacgtctaggcagtttaacagtttgggagctcttggtttttatctgtaatttacatacactttatcttattttagaacagtaatttttatatagtagctaaatctgcaatctttatttagtaagtcctgatgaaacatattgccctattaatatctatagcagcacctcggtgaagcctgagttgaaatgtgagtgtattctagccagtatacccaagactagcactagactcactagtaaatgcagtcctttccttctgccccctaagtctctctctctggtatgttaatccacccatccagacatccacatgccataataggcaggttatgatcccattgtcagctgtcgtttaaattagagtttttaaacctgtgtgttttcgggtaccatctttcctgtctggattggtatttacgtcactgtccatgcttcaggacaggtaatgtgaagacaatggctgaccggattctgaccatgagatctgaactcagggcacgactagaagccctcaaaacccctgggacctggaaccacatcactgatcaaattggcatgttcagcttcactgggttgaaccgtaagtggcccccaccacctccagcccatgcgtgcatgtagacacacaacattcctttcagtcgctcgccttgagctgagctcactttcacagcctttgcctaattgggcagccattgctttggaccaggacaagttaggttttcttagggtgtcccaccatctcataaactctctgggtctcagaagagtattgtggtctgccctgctgacccacagccaagatatttccgtgtttgtgggctgggaagtggctcagagccagctgggaggtaacaggattggtagctgggagccttaatttatgaaaggttcttataaatgctcaggtacattttgggtttgccttaatcctgaatataatgattattcagggaactgatttcttgacaggtctttcttatttctaggtattatcctcaaaaagagattacaaagttatctctgcatttcataaacaagaacctagattgggctgggcacagtggctcacacctgtaatcccaacactttgggaggctgaggtgggcagatcacgagatcaggagatcaagaccatcctggctaacatggtgaaaccccgtgtctattaaaaatacaaaaaaattagccgggcgtggtggcaggcgcctgtagtcccagctactagggagactgaggcaggagaatcacttgaatccaggaggcagagcttgcagtgagtcgagaccgcaccactgcactccagcctgggcgacagagcgagactccgtctcaaaaaaaaaagaaaagaacctagattggtggttggaattaaaagctgattgaaaatctagtaggtggtcatgcatggtcttggtcaattgtcagtagggcacatctgccatctgcagtcccatctgatgacagaagagtcatttcttctttttttttttgagatggagtcttgctctgttgcccaggctggagtgcagtggtgtgatctcgactcactgcaacctccgcctcccggcttcaggttattctcctgcctcagcctcccgagtagctgagattacaggcgtcatttctttagtaattcccacagtgcagatgtggcgactcacctgtgtgtcccagtgactctagggagggatgtgtggctggcttggtttgtaggcagaacggcagaggccgtggggaggtatttaactggggccatcacagtgccagtgtgaagtgggctcagaaaaatccaaaggaaataaatataaatggcagttaatagagcttgtattgtggacccctcaaaatactttggggtaaaatgaagctacctaagaaagtaaagaaatagctcagttagctgtagatgtcctcttgactgaggaacagagaattagttcactcacaattataaaaatattacatgtaacagaaatattaatagtctttagtagtaatagtctaaaagctcacaatatgggaatgtctccctgtaaaatatccatatcttcccattatccacaggaggaaattagttttattaatatcacgaattggaaaaatgatgagaatagaactgtgcttataacacaaaagttatatttttagcgcttggcatcatttgcccttattaaaaacaggggttttgttttcctcccaactttttttttctttttgagacagagtcttgctctgttgctcaggctggagtgcagtggcacaatcttggctcactgcaacctccacctcctggattcaagcgattctcctgcctcagcctctcaagtagctgggactacaggcatgagccaccacacccagctaatttttgtatttttagtagagacagggtttcaccatgttgaccaggctggtctcaaactcctgaccttaagtgatctacctgccttggcctcccacagtgctgggattacaggcgtgagccactgtgcctggccttttttgtttgtttgtttgtttcagacacggtctcgctctgtcacccagggtggagtacagcggtgcaatctcgggccactgcaacttctgccccctgggctcaggtgatcattccacctcagtgtccaagtggctgggaccacaggcgtgaaccaccatgcccggctaattttttgtagaaacggggtctcaccatattgctcaggctggtctcaaactcctgagctcaagtgatctgcccgcctcggtctcccaaggtgctgggattacaggcatgagccactgcacctggccagaaaagttttaaacatacagaaaagttggaggaattgtacagtgaacccctatatatccgccacctagtttctacaattctcacattacaatacttcctttgttatcttttttctgtcagaatggggcttttaacctggaatccctggatgtacgtttaggagaactgtgaagcccctgaaatgatgtttaaaaaattgtatatgtgtattttggccctgctctagggaaagagtccataacttttactagcttttcaaactgtgacacttcccttctctgaaaaagtagaaaggcctcatttttactaaaacaaaaccaaaagccagggtaggagtcatttaatcactgcctcagggcacaggcttttagaaagagtggcacacccagggctgtgttggcttgaggctctatccccttgggtgaccaattcacacaggtaaacctcttcttaagcttgctttctttgttcactggtttggaggggtcaagggaaaacttaccctttgccctctgaaagtttgctggaaatcagctgacaagaggcagattaataggagaaaaggcatacaaatttatttatttatttttgagtcagagtctcactctgttgcccaggctggagtgcggcgtcacaatcatggcttactgtagcctcaacctcccaggcccaagcaatccacccacctcagccttcgtagtacctgggaccacaggtgtgtgccaccatgcccggctaatttttaagatttttttgtagagacagggtctccttatgatgcccaggctggtcgtcaactcctgggctcaagcaatcctccctcctcagcctcccaaagtacttggattacaggcatgagccactgtgcctggccagcatgcaaatttattaacttgcacaggtgtcttacaaaatagaactcaaataaatggccagatgattgatgcttttataccatcttggggttatagaaagaatgggagcttggagcttgccagaacagattatggcaggcagagaagagaaggcctggttagcaaaggtggtcttgttatattatgtagataagacaggtagcagccctcggagaaaatagcggtaaaggtctatttcttttagacctttaaaggcatcacactctcagttaatctcccctagatctggacaagggagggcctcagagaaagcctagctgcagccatgcagattttctctacagatacagatctctcccacaaaagacagctttgcagggctacttctgtatgtaggccctctcaacagccatctcaaaatatgtcaaagtatattttggggtgaactattttggtttccttcaaggagcactgagtccagggtccagatttttcacttccttagagaggcactgtagcatcacgggggcagtgtacagcccagacttgaaatcctgcctgaaaatcccacatccaccattgaccagctgtgcaatctcggaaggccatttaatgtctttatggcctatctgtaaaatgggcatgataaagttattatcaggatgaactaagatgcagtgcttagaacactgcctggcacatagtgtttactcctctgattatgatgattctattattattccatttcctcaggttggtggtatcttaaaggtactaattacttaagcaataattcactaaaattctttttttttttgagacagagtctcactctgtcacccaggctggagtgcagtggtgtgatctcggctcactgcaacttcctcctcttgggtttcaagcaattctcctgcctcagcctcctgagtagctgggaccataggcacatgccaccacgcctggctaatttttgtatttttagtagagactgggtctcagcatgttggccaggctggtctcaaacttctgacctcaggtaatccaccagcctcagcctcctgaagtgctgggatcacaggcgtgaaccactgtgcccagccaaattcactaaaattctatcaatggatttgccaaatagcaaaactgctttagagactgctgtataaaggaagtacaggtagtctcttcttacccacatgtgatgcatttctgaaaacatggaaaaactactgcatctgagagaaagctgagaaatgaacagaagtctgatggtgccaggtcagagaggtctgtgtcatttctcagctcattggttaattcacacaggattgatcaggtacctcatgcatggggccttacccaatgtattgtaaaaatgaaatgtcaaagggaggctgccgcgggtactcaatgcaagtccaggttagggaagaactaaaggaagcacttcatagccagcatttcatatcgctgtccgtctgatggttgtttttaggtgataggggtgtcctggtggatataatgtataaggcttggttggaaggcaatctcagattaaaattcccatcagtagtagccatattgaattttctggggattcaaaggtgaactagtaagagtactttccagaatctagtgagcatatttttctgtttgtcagttggacaaaatagcgccttttgttttgcttctctctgttaaggggaaagaagtaaagctgtaattgtcatataattgctgagcctccactgctttaaggatcccctctgctctgattatgtcttcttttggttttcaacagccaagcaggttgagtatctggtcaatgaaaagcacatctacctgctgccaagtggtcgaatcaacgtgagtggcttaaccaccaaaaatctagattacgtggccacctccatccatgaagcagtcaccaaaatccagtgaagaaacaccacccgtccagtaccaccaaagtagttctctgtcatgtgtgttccctgcctgcacaaacctacatgtacataccatggattagagacacttgcaggactgaaaggctgctctggtgaggcagcctctgtttaaaccggccccacatgaagagaacatcccttgagacgaatttggagactgggattagagcctttggaggtcaaagcaaattaagatttttatttaagaataaaagagtactttgatcatgagacataggtatcttgtccctctcactaaaaaggagtgttgtgtgtggcggccacgtgcttctatgtggtgtttgactctgtacaaattctagtcccaaagatcaagttgtctgaaggagccaaagtgtgaatgtgggtgtcggctgcggcattaaattcatcatctcaacccagagtgtctggtctccctgctctttctgcatggttgtgtccctagtcctaagctttggttctttagggtgactgtggtaagaaggatatttaatcatgacatgcacggacacgtacatatttaactgaaacaagttttaccaaacagtatttactcgtgatgtgcgtagtgcattctgatatttttgagccattctattgtgttctacttcacctaaaaaaataaaataaaaatgttgatcaag

SEQ ID NO: 37072 - DNA, 53048 bp, Homo sapiens
gctctggtgctgcggctccgctctcgtcgcaacgagatctttcgagatcttctccgcccccgctaccggcgcctcctctgcggccactgagccggagccggcctgagcagcgctctcggttgcagtacccactggaaggacttaggcgctcgcgtggacaccgcaagcccctcagtagcctcggcccaagaggcctgctttccactcgctagccccgccgggggtccgtgtcctgtctcggtggccggacccgggcccgagcccgagcagtagccggcgccatgtcggtggtgggcatagacctgggcttccagagctgctacgtcgctgtggcccgcgccggcggcatcgagactatcgctaatgagtatagcgaccgctgcacgccgtaagtgtgggccgggcctgccgcgtgcactggggttaggagataatgcttgttccagtctgggaccctcgctgcttggggaacgcgggccgaggagtcgcctccgttccgagccgaggtcccggtaggtcagggacccccagtaggtattaggacactaggggccgcggcccactatgagcgtgggtgtgtgctaagcgcgagggccttttccccggtggcccgtcggccgaagaaaggcttctggccggtactcggaccagcggagggcacgggtaggaactggaaggactgcaggcctaggatgtaaacggatcgcggtccttttcttgagggcagagaccaggcccaggtcgtactgagtcttttgagtccaacagaaagctcagaactttgcacacagcaggcgcttaataatagttgaatcgaacgggttctggggcttgccagccgcgagaccgtggagcggtcagcgtcccacgtgagtgggggcggggcagcgcccggaagagagcgagctggagcagcctcaggcacgggttccggatggactcggggtcttgagattgggttggcacggataggaatttaataaaatcggtgctcttatgataactttgcaatcgcttttgttttccacattatttcgggatattgtgctatattgggtcactctctgttttgtgcgcgttaacccctcaatagggttgcactttaacgataatgcattctaaccagtgtgttggccacaattgttagtggctcaagggcccgccttgacttctagaacccatagtaagttttgggaccagcatagacacagttctaaaaaatggtgggtcactcaggtctttcactggttacagtgtctgccttttgaatacttgtagatacattttaatccgttgtcgtgttcttagacaaaatcttgtaagaagttctgtattatttgccattcagggtctctcttctttttttttttttttttttcttttttgagacagacagggtctcactctggctgcccaggctggagtgcagtggtgcgatcttggttcactgcagcctcgacctccctggctcctggctcaggtgattctcccacctcagcctcctgagtagctggcgttgcaggcgtgcgccaccatgcttggctaattttatttatttttagtagaaatcgggtttcactatgtcactcaggatggtctcgaacttctggactcaagcagtcctccagcctcggccttctggagtactgggcttacaggcatgaaccaccgtgccctgcccaggggctcacttgttattgattgattgagatggagtctcgctctgtcgccccaggctggagtgcagtggcatgctctcggctcattgcaacctcggcctctggggttcatgcgattctcctgcctcagtctcctgaggagctgggattacaggcgcgtgctaccatgcccggctaaattttgtatttttagtagagacggggtgttgtcgagttgcccaggctggtctcgaactcctgacctcaagtgatcctcccgcctcggcctcccaaagtgctaggattacaggcgtgagtcacggtgcccggccccaggggctcaattctaaggtccattattttcaccctcaatttttgtcacatttcttcagcaggtttcagcgaaactagattgttcagaagtctcacatttcctttccacttgtcaaatttccgcaccccccacctcctaacccaggtgcttcccctgaaaactcatcccagaagccaaaacggtagtttgctgtccctttgctgagtttagtcttgttaacagccctattaaggtttatttatttatttatttattttgagaaaaggagtcttactctgttccctacgctggagtgcagtggcgtaatctcggctcactgcagcctccgcctcctgggttcaagcgattctcctgcgtcagcctcccgagtagctgggattacaggtgtgcgccaccacgcctggctaatttttgtcttttttagtagagacagggtttcaccatgttggccagggtgggctcgaactcttgacctcaagtgatctgcctgcctcggctttccaaagtgctgggtttacaggagtgagccaccgcacctggcacagctttattaaggtttaattcatatactatacaatttaaccagatgaagtgatcgtttttagtgtagtcacaaaacagtgcaaccattactgtaatcaattttagaacatttttatcactcccccaaagccctgtgccctttagcagtttattttccctatttgtactttttaacaatgggtagtctaacttggcatctccagggaagtgtattgtgccctgaagtttttttttaagcattaaagtttgtttttaagcattttagtatttgagaatatctttgtatccgtgttttcttggtctataaaatgtctcccctaaggaactgaaaaggctaaagcgctgagttaatgtatttagtgttttggtcctttcctgccctgtgattgaacacgctttagttccaaagggcgcacaggaagagaatcccaagtatggggaagaacagtgttcctatcctttcttttagattattatcacatgctcctgtttttcttttagaaagacaatagctacaacaattataccatgaattctatttgaaactgagttgttgcagataaaaaatttgcctcaaagacattgtgatatatatgaccccatacaccacggaattgtgataagaaaattccatttaaataattttccttacatgttttctttatattttccttcatagttttcattaacttacaggcatgccatacatttcaagtgatttctgaactgtatgattttgattcactttgattactctgttttggagtcttgggctaaatagaaaatggtagcaggaaggttgatttttttttttttttttttttttttttttttggtagcggttatggaggaatggatttggagctcatatgtaaaaaagactgcatgttgtgggtttgttttaacatgagagtggaaatgagatgcaagtcttagagggtttatgatggtggaagtacctcgtttcagatatgggtgtaacaatctggattaggtttttgaggagccagtggagtctcatccagaagagacccttgattttccacccaatttaggcttccttcattttatcagatgttgagtgcctctgatgtggtagccatttttctaagcactggaggtactgtggtgaacaaataaggtcatgccattatggacatggctggtggattaaaccaaatactaaacaaaaatatgtagtaattactaactgtggtaaagggcaaggtggaaaagtacagaatacagtgagagtatagaataagcgggtctaatttaaattggatggaaggacctggcacgatagctcatgcctgtaatcccagcactctgggaggctgaggtaggaggatcgcttgaggtcaggagttcgcaaccagcctggccaacatgctggaaccctgtctctactaaaaatacaaaaattagctgggtgtggtggcgggcgcctgtggtcccagctactctggaggctgaggcagaagaatcgcttgaacctggtaggtggaggttgcagtgaaccgagatcatgcactgcactccaacctaggtgacagagcgagactctgtctcaaaaataagttgggtagaaggtgctttgaaagaagtaccatctgagacctgaggatgagtaggattttaccttggaggtcacagtaggtttgaggaagagttgttccaggcagaaggaacagcaagtgggaaagacctgagcaagaagagctgcatccttgatacattgaagagcagccacgactctttcagctgcttgagagaatgctgtgagatgaatctgaggaattaggcagagccttgtaaataataataatgatttttacctaggtgcagtgggaagattattttttgacacggagtctggctctgtcacccaggctggagtgcattgttgcggtcatgtgcatacatgcggctaatttttgtatttttaggtagacgtggtttcgccatgttggccaggatggtctcaaactcctggtctcaagtgatccgcccgccttgacctcccaaagtgctgggaatacaggcgtgagccaccgcgcccggcctgtaaaattctttattatggctctaacacgttttcttcaaacaggttatttctaactttttgctgttacaaatagttcttcaataagtagccttacatatttatgttgtaatgttaatgcttttatttttattgtatagatttccagaggtgaatttgctagggtaagggatatactgtatatacttaaagtttcagtaatattgccagaattctttacacaaatataacagattaatttgcagtaggaacagatgtgatttctctacttcattggagattatgagaattataatgagttaaaactataacttatacctttttttttgccatagtgctcagaataatgcctgggattcagtaaatactgccaaagtatttgctaataatactattactttttgtattttttattaattttttatgagattaggacagtaagatgaaatctatggaagtttaccttttgggttctacaactgtgtacttttaaagtgcaaaggttaattactgaggaatttgctgtgtttttaggaacagcaaatctcaaaagtatgagttgtttggtctgttgggtatcagctctttttggtactttctagtccatggctaatgcagtaaccagagagtactctgattaatgtctctatttccattctagttttgcctatcagttgtatgtgatagtctaattattgcggtttctctgaaaagctcattttctcctattgttgaagaaagtgaattagagcaatggctgttgtaatatcctgagagtagttctgcgtaccttttttttttttttttgagacaatgtcccactctgttgctcaggctggagtgcaatggtgcaatcttggctcactgcaacctccgcctttcaggctcaagcagttctggtgcctcagcctcccgaatagctgggactacaggtgcatgccaccgcgcctagctatgcatacacttataaaaatgaaactataccttttaaaggacctatgccaattgcagctgttcataatatcctctcagaatgtgcataaatattcggtcagtagtttcttttaagaaaaggaaaacagtgatattgtctggctgaaaaaagaagtaatttctaggacttaaagattagaacagagggatcttaaacttgatttgaattaactccgtgcaatttggaatggaggaaaagcaatgtcagtcaagcagcaaatgtgtgagtacttcttatggattaagcagcattgacttggcattgtgtgtagtatagaagaagtgtaagatagagattcctgctgtctagttgtaatcaatgtggttaaaatatgaataacataagcagcagtaaatagaatgagtccaattatggacaaggctgtgtgatacagacctaaaataccatgttcaaaggagatgtaagcagtggaggctaaactgatgaggaaaggctggagtgagacttgaacaaataggattagataatacatggaataaaggattcagatagtttgagtgaaggatggaagtaggaatgaattaaggctggctgtggtggctcatgcctgttatcccagcactttgggaggccgaggcaggaggattgcttgaagttaggagtgtgagaccagtctgggcaatatagcgagactctgtctctataaaaaatttaaaacattagcaggctgtggtggcatgccagctacttgggaaactgaggtgggaggatcacttgaggttagtgatcaaggctgcagtgagccgtgattgagtactacactccaagcctgggcaacagagtgagaaccatctcttaaaaaacataacggggctgggcacagtggctcacgcctgtaatctcagcacttgaagaggctgaggtgggcgggtcgcctgaagtcaggagtttgagaccagcctggccaacccggtgaaaccttgtctctactaaaaaatacaaaattagctgggtgtggtggtgcatgcctgtaatcccagctgaggatgaggctgaggcatgagaattgcttgaattcgggaggtggaggttgcagtgagctgaggtcatgccattgcactccagcctggccatcaggagtgaaactccatctcaaaaccccaaaaacaaaaccaaaacaaaatagggccgggtgtggtggtttacatctgtaatcccagcactttgggaggccgaggtggggggatcacttgagctccggagtttgggaccagcctggacaacatggcgaaaccccatctctacaaaaagtacaaaaattggccgggtgtggtggctcacacctgtaatcccagcactttcgaaggccgaggtgggcaaatcccctgaggccaggagtttgagaccagcctggccagtatgctgaaaccctgcctctactaaagatacaaaaattagctgggtgtggtggcacgcgcctgtaatcccagctcctcaggaggctgaggcaggagaattgcttgaatccaggaggcagaggttgcagtgagccgagatggtgccactgcactccagcctgggtgacagagtgagactccgtctcaaaaatagtaataataataataatagaataataaaagaggctgggtgtggtggctcgtgcctgtaatcccagcacttcgggaggccaaggcgggcggttcgcctgaggtcaggagtttgagaccagcctggccaagatggggaaaccctgtctctactaaaaataaaaaaattagctgggtgtggtggcaggttcctgtaatcccagctacttgggaggctgaggcaggagaatcacttgaacccgggaggcagaggttgcagtgagccgagattatgccattgcatccagcctgggtgacaagagtgagactttgtctcaaaaaaaaaaaaaaaattagctaggcatggtggtacacacctatagtcccagcttcttgggaggctgaggtaggaggattgcttgagcctgggaggcggaggttgcagtgagcagatatcgagccactgcattccagcctgggtgatagagtgagagaccctgtctcaaaaccagaaaaaaaatccaaaatgtgtgtatacgtggggtttggagtctgatggtcctaattttgaatcatagactctaatacgtttctgggcacactgacttgacttgaatcagctcttcctgtatactaatcccatttctcagagaatataggattatcaagtgtaggatgcttagcacaccacctggcaccagaaggctctgtaatgagaactatgaaacaagggatcttgacctgcttggatgagagaggattcctgccatggatagggatcagggatgtagactgcaagatttgaaagttcttgttgactggaaagtagtaggtatatttcctttaaatattcttgtcttgcttattccgtgtcaaaatcctcaataattcagccattgaagacttttcagagcatttgttgaggagaagcaaactgattgtggtatatcagttttactttttttttttaggacttactagatttattaggattacataggagtatttacctaaatgttaatagtggccctctgtggtggggggagggttgtggaagtatatataatttttatttttttcttcatacttgtctgttttctaattttctacagtaaacttgtaccaagaagcattgacctatgttctagtgctagcgctaatattcaagttaatctttttgagtattcatatcatttaaatattaggtttctttatgtaagcctttagttttcaaaatccttcaatttgtgctgttatacttttttttttttgcgacggagttcgctctgtcgcccaggccggaatgcagtggtgcaatctcggctcactacaatctctgcctccccggttcaagtgattcttctgcctcagccccctgagtagctgggattacaggcgcgtgccaccatgcctggctaatttttgtatttttagtagagacgggtttcaccgtgttgtccaggctggtctcaaactcctgacctcagatgatctgcccacctcggcctctcaaagtgttgggattacaggcctgagccagcgcgcctggtgctgttttacatactgacccaattcagcaaattgatcatattctgttttcagttgtcgttttttaatggaagtaggacttttttttaaaatcccacatcaatagataattttaaaggtagctgactagatttcagttccagtaggtgaaacaggactttttttttttttttttttttgagacaaggtctcgctctgtcactcagggtggagtgtagtggcatgattttagctcactgcaaccttgactgcaagaactgagttttaaattttatttaattttaaataatttaaatttaaatagccacatgtggctagtggctacttcattagacagcatgtatctgtaactgaagacctcagattttacatttttcattaagacttggtacgtgcacacacacaactgaaaagcttcattaaacaacagtactttcacatgcagtgcatacatgtgttttcttttctttttttttttttttgagacggagtcttgccctgtcacccaggctggagtgcagtgacgtgatctctcctcactgcaagctccacctgctgggttcacgccattctcctgcctcagcctcccaagtagctgggactacaggcgcccgccaccatgcctggctaattttttgtatttttagtagagatggggtttcactgtgttagccaggatggtctcgatttcttgatctcgtgatccacccgccttggcctcccaaagtgctgggattacaggtgtgagccaccgcgcccggccgtgttttctaagttgctgttcatgacttcttccaacccctgattgattttagacccacacatgggttgtgacttacggcttataaaacattgttttagcaagggaaataaatgtgttagtattgataatgtaattcggtttgtggttggtgttaagtagaaattaaaccaagtccagttttaagaggtaaaaaggattaccacccctccccaccacccgactgagtcttgctctcttgcccaggctggagtgcagtggcgtgatcttggctcactacaacctccacatcctgggttcaagcgattctggtgcctcagcctcccgagtagctgggactacaggcgtgtgccaccacgcctggctaatttttttgttttttgttttgtatttttagtagagacagagtttcgccatgttggccaggctgatcttgaactcctgacctcaggtgatctgcctgccttggcctccctaagtgctgggattacagacgtgagccaccgtgcccggtaaacgattactttttatttgggggctggggtgggttgagaaggctttacagacaaaataggtggaatttctagagaatacgtgaaggtactaagcatttcagacgtcaaaagtgacataagcaaagcaggaagattgggatactttattcaacttgtgttgattgtgtggatgaaatacagctggaaaatgggattgggttgggagaggccttaggttccatattaaggaatataggttttatttgttggtagttggttttgtttggaaggtaattagaagcaagacagtttcagagttactgacatagaataggaaattaacccttcagcaggatttgcaggaaagttggggattgtaattattttgaggagataaaggtttgaaaaagggctgcaggaaacaatggaagatgagtaacattgccttttagttatgttgtgattggggtcatggtgggatataccttagaaatttagatctggtggtatttagaaagatggaggtgtgccaattattaggcttatgctaggcagcctttttgaggtggaggaagtgggtaagattgccttgggcaatttcctaaagggtaatatgggctttgagaggagagacatttacgtggtagtgaggatttttttttatttatttgcatctagtgtctaaaacagagattttatttgttttagtgattggtggcatagttgcagaaaggctgagcttgacacctttgcttttgaggggctactcccagcactttctaggcccaaaagcttaggatttggaggaattctgatgaggtcctagggtgtaccatgtttgttcttcctgtcatttaatagaagtcatggcttcctgtggctgccctgggagattggcttacaggggttcttagccattggttgtgaaggaccactgaagcccagggaggcccagcattctgccagtttccacagggctcttaagtttatgtttctaccaaatcagtagttcatctaatttagtcagatttggaccaaggcagtatggttccagagctcttatttactctgttgacttggaagaattaggagttcagggaggatgagagtcaaagcttcagacatcacctagagtcctgacttcattgctttcaggttgcatgaccctggataaatttatttactatcttttttttttaaggcagggtcttgcttgctctcttccccaggctggagtgcaatagcatgatcacagcttactgcagcctcaggctcctgggttcaggtgatcctcctgcctcagccacccccaccccgtgactgccccatagctgggattacaggtgctcaccaccatgcccagctaatttttttgtattttttttttatagagacagggtttcgccatgctgcccaggctggtcttgaattcctgtactcaaatgatccacttgctttggcctcccaaaacgttgggattacaggcttgagccactgcgcccagccaaatttactcttttttttgttttgtttttgagacggagtctcgctgttgttgcccaggctggagtgcagtggtgcgatcttggctcactgcaacctccgtctcccaggttcaagtgattctcctgcctcagcctcctgagtagctgggattataggcgcccgccaccatgcccagctaatttttttgtatttttagtagagacggggtttgatcatgtgggcgtggctggtctcgaactccagacctcaggtgatctgcccgcctcggccccccaaagtgctggaattacaggcatgagccaccacgctcggccaaaatttacttatacttattaatgcccttttttgtttgttttgtttttgagatagggtcttgctctgttgccaggctggagtgcagtggcacaatctcggctcactgcaacctccgactccttggttcaagcaattctcctgcctcagcctcttgagtaggtgggattacaggcacatgccaccacgcccagctactttttgtatttttagtagggacagggtttcaccatgttggcctggctagtctcgaactcctgacctcaggtgatccgcctgcctcagcccgccaaagtgctgggattacaggcgtgagccactgcactttttaagcgtaagcacagagtttttatttaaccttcaagcaggtttcagtttcgcctttctaaaagaagcagtaaatggattaaatcaggagattgtgtatgaattggtgatttagaagaatgttcagaagtggggttaaagttccttgtcagaaattctgagtcctggccaggtgcggtggctcacgcctataacgtcagcattttgggagtccaaggtgggtgaatcatctgaggtcaggagttcgataccagcctgaccaacatggtgaaactccatctctactaaaaatacaaaaattagctgggcgtgatggtgcatgcctgtaatcccagctacttgggaggctgaggcatgaaaatcacttgaacctgggaggcggaggttgcagtgagctgagatagggccactgcagtcctgcctaggcaacagagtgagactcttggaaaaaaaaaaaaattgagtgcctggaaactagttgtagaaaaattacttttttacttatttaatagggcgagagttgttttcagggtttgtagactatattcttggtgaagttgtgagctgtcttaaaaatgttaattgatacattgatgtgagggtacattattttatactgggattttgaacaggagacttgaaaagtaattagaggatggtagagactgtctagcccacctctctagtattctagacaggtagttatcacatcagatctgtgctccagcatgtaaatgacaggactcagttgtaagaggcaacctgttccatggacagatttactcaatagaaaggtcaaaatcatagatttgtaccattaaaatatatggcattttagctgatactcagatcttgcctgctatgcttttggatttattattgtagtaagatttaattcttaagtgctttttttgtcttctagggcttgcatttcttttggtcctaagaatcgttcaattggagcagcagctaaaagccaggtaaagtttcatttttttcctaaaatgacttatttctcctcttcatccatgtgttcagcaagtagttgaatgcccattatgtgcctaacactggtaggccttgggaatacaactggcagatacagacctcttctctgttcccatgtacagtcagccctcagaattccatgggttctgcatctgtagattcaaacaactgtggatcaaaaatatttttgggaaaaaatacaacactggaacaataaaaaatacaaatgaaaacaatccagtgtaacaactacttacatagcatttacattgtattaggtgttataagtaatctagagacaacttcaggtatacaggaggatgtgcataggttataggccaatactatgtcattttgtctaagggacttgagcatctgtggattttggtctaattcaaggagtgccctggaatcagtcccctgcagatacccaggaaccactgcttcagtgagaagcacctggccttaaaatagcattagcagtataatctgtttaatgcaaactgccagggtgtattttgtccagatcttgttaagcaaggcttgcttgttccttgatattttacatgctccttaagtctgtcttgttgggcctttcatcttactcatatataaggtaagtgttgatcttgttaaacaagtttctcaaggaaggaaagcatacctctagaaatacattaaaggacttgcttttagtttactctgtaaaccaggaacctgacgtagttgctggtttctgaataaccagagcagcagaaccccaagagttctgttattctaagtgtctgagatatctgtaaaattaaggagttgcatgtttgaccttcttatggttcagcctggagcaaccctatagggtgaatctgtttttgaatggggcagggcctaaaatttattagcctaaaaaagtggtgcttggccaattggtttttaattaagttggatgttttatagttcattttcacagtgttcgagatcttttaggagacagcaggtagaaaatattgggccattttgaaatctcttccttctaaaatttgagcaaatcgctcctgttttttaaacctgcttttcatgattgagagacagttactatactaaactggctgcccagttctaggttgatacagttattgtgttacagagtttctgtttggcagcttgctcgaggaaggcatgatttgggtggcctcatctgtttcataaaaggacttctgtgtgttccctttcatctagttgatacaggagcttactacatctcctgcattgggaggagcagcctgtaaatcttaagcagaaggtcattctggaattttttgaatatttttgtcagcattttcccctcataaattgtgatagtttattctagaagaattagaaaacatagataaaaaagtgtaagtcacctgttcaaccattatccaaaaatcatatagacatttgtcttaccaccttctgaaaactttacctgttgatatttcattgtatgaatagcccataatttaagcatttccctgttattaaccatttaggctgtttctaggcgtctgctactacaaataatactctcccaatatccttttgtgttcatttttgtgtacttagtatgattttttttttcccctttatgagaaatttgtttcactggaattttttttcttttcttttttctttttttttttttttttgagagtgcagtttttgagagtgcagtggccctgtcagcgcaacctccacctcccaggttcaaatgattctcatgcctcagcctcctgagtagctggggttacaggtgcgcaccaccatgcctggctaattttttgtatttttagtagagacagcgtttcaccatgttggtcaggctggtctcgagctcctgacctcaaatgaggccctggcttctttcaaagtgctgggattacaggcgtgagccatgacacccggccttaactagaatttctaaatcaatttatgtattgctgagttggttcctggaaactttcaaccataaactatgggcaatttttaaaggctaaaagttattttatgtaaatgtttattagaagtttaagaacagaaaatacttatgcaagtataatgacctgacttcatgggatataggaagagcagggctctatttttagccctgccactctgagacccatgcaaatccctcctccctcacttcgcatgctagtgggcaccatttagaaaagtttagggtctgaagaaaccaaaaccaagaaggagactctatataaagttaaaatgttgctaatttaatctgaggctgttgaaataaaaaaaaaattagtagtagtctttccactctttgatattctttctcttaggtaatttctaatgcaaagaacacagtccaaggatttaaaagattccatggccgagcattctctgatccatttgtggaggcagaaaaatctaaccttgcatatgatattgtgcagttgcctacaggattaacaggtataaaggtaaggttgtcaggttaatgccttttaattaaaatgcattattatattttatcagttcaatatctatctgtacttttctgatgtcagattgcaatgaaaatgcttacagttgcttagggaaagcttttttctagtaaagactatttgacaatttttgaatgatctggatgttggttgggagccatgagtggtgctcttaatatgggttggagacctgggtagtgatggtttgaagttaatactgccattgctgcttgttttgctcactgatgcagtgggctttttagcatgattttagggaatgacttctggaagagcaggcaaagcaatcacagttttttttttttttttttgagatggactctcgccttgtcacccaggctggtgggcaatggtgtgatcttggctcactgccacctctgcctcctgggttccagcgattctcctgcctcagcctaccaagtagctgggattacaggcacgtgccaccatgcctgggtagttttttgcatctttagtagagacggggtttcactgtgttggccaggttggtctcgaactcctgaccttgtgattcccctgcctcagcctcccaaagtgctgggattacaggcgtgagccaccgcacctggtaggaatcacagttttaagtcactagcagatagatggacatactcttggagataggatttaatttagaaagagatgttcttttggggaaaagtgagtttggtctttatctctggtacatctagtggagtctctgtgaagtatgcagtgaactgatcacagaaaaagggtaagaggctgggagatggatagggtggacacatttgcctttcttgcactcagaggtagtaagaggaatccatgagggggggtgggggcgtgattggctttccaggcaggtgagattacggagagatttggttttggaggccaagaatcaggagaacaggctggaaagccaagagatgttgagaaccatgagaaaaaggtagtctgctgttgcagtgtagctgataatttagttgtatttagaagtgaaaaattctgaaaattaaagaatgatgactgggttttcttaaaatatctgtggtaattaaggacagtttgaatgggatagtaaaagatgaagctgaagcacaggagagagaaaggggttaaaaagggaggtgaagaaatgtgcaatacttattagaaataagaaataaagaaataggataggtattggcagatttattcataagcattgcaagaagcaaaggagaaaaagactaggaagaagatttgggaaacaagtagatgcaagtctaaaagtggtggaattgacctcagaattaggcaaatagcagggaagaaagagataatttagaaagggcaccaggagggatatttccccatctttatcatgcaataaagtaagaactgttcaattctaaaccataataaattgtggttgggctggggagtcagaaggtggcacgcaagcttgagttagggcagcagctaaaagaagagagcaacatgttctattctggattgtaatttgggaatatgggcatgtaggatgggttgggattgttttaggcagtccttcaatatttaaaattcgtaactgttatcacatttgcagacttttatctggaatagggctttatcttgaagctttgttcattattgttacttatttaaaatttttttttttttttgagacaatatcactgtgtcacctaggctggagtgcagtggcacgatgtaggtttactgcaacctctgcctcctgggttcaagcaattctcatgcttcagtctccctagtagctgggattacaggcatggaccatcatgcccagctaattttttgtgtttttagtagagatggggtttcaccattttggtcacgctggtcttgaactcctaacctcaagtgatttgcccgcctcagcctcccaaaatgctgggactacaggtgtgagccactgcacctagcccatcttttattatttaattcaaccagtatatattgtgccaggtcctgttctaggtgctggagctatggcagtgaacaatcagacaaatgcatgtcctcatattagattgaatcctaattgtggagatggataataaacagtaaacacattaaaatacacatagtatgtcagatagtaaaatagtttctaccagcagcctctttatggagggacagtgtgggtcatggtgagctacactgatttgtctttgcaaaggaagttgtcttaagatttgttgttttacactgtggtccttcatctccaagtatcgtgtttggttgaaagctaaaataggctatgcgtggtggctcatgcctgtaatcccagcactttgggaggccgaggcaggaggattccttgaagccaggagttttgagaccagcatcggcaacaaagcaagaaccctgtctctgcaagaaaaaaataaattagctaggtatggtgacatgtgcttttgctccccgctacttgggaggctgaggcaggaggattgcttaaacccaggaggttaagtctccagtgagctgtgatcatgccacggcgctccagagagagagaatgacagagagagagaccctgcctccaaaataataataataataaaaaaagaagctaaaagtgaccttcaaggtattacttcgaaaactagctttttttttttttcaatcccctcttgagataatgttgcattgataatgggaagcattgttcattttagcttttaggactaggacatgaagaaagaaatataataagtctaggcccctttgttgttttcttgcaggtgacatatatggaggaagagcgaaattttaccactgagcaagtgactgccatgcttttgtccaaactgaaggagacagccgaaagtgttcttaagaagcctgtagttgactgtgttgtttcggtgagtttgatccctatacattattgggaatttgcatgaagaagcagagagaagaaagctgctaatttcaagtaaacttgtttttttgtctcaggttgtaatggttatttaaaatgtttgtcaggccgggtgcagtggctcacgcctgtaatcccagcactttgggaggccaaggtgggtggatcacctgaggtcaggagttcgagaccagcctggccaacatggtaaaaccccgtctctactaaaaatacaaaaattagttgggcgtggtgatgggcacctgtaatcccagctattcgggaggctgaggcaggagaatcacttcaacccgggaggctgaggttgcggtgagccgagatcatgccattgcacttcggcctgggtgacaagagcaaaactctgtttcaaagaaaaaaaaaatttatgaaactagtcttcattttcttactctcttctgctgcttagcttttgctcaggcctcctttgttattctgcctatttaaatctcttctgtttttcaaggtgcattcatctcagcctgcccacttcttcctgtatttttttcatcgcctagcatagcacagggtagccactcatttgttgaattagttggatacccctaattgtaaatggcacttgttctgtatttgtatttgctgttggtatctagcgttaaagacaaaggcaaggactgggcatggtggtttaatcccagcactgtgggaggccagggcaggaagattgtttgagaccagcctgggcaacacaatgagatccctgtctttaccaaaaaaaaaaaaaaaaaaaaaaaaaaattagctgggcatggtggcacacacctgtagtcccagctacttgggaggctcattcgagcccaggagtttgaggctgcagtgagctgtgatcacaccactgcattctagcctggacaacagactgagaccctgtctcaaaaaacttatccaaaaaacaaagacatggcagcagttgactttatcttttgcatatccctgttaagatggaagcctggctactgtagttttgtgctttagtttggtggaatccttagggactgttgaaatatgtgtggttacattggctttgccaccgaatctcctcattctgtaattgttacctgatactttagtttcatggcctcttttgtcttaatgttggtgcattgattggcaaagcaaggactgttaggtggctttttcaccccagagtctgttgcctggcggatttcttggtccttggttattgtaaagtagaattgacatttgtcagaaagaattggattatagttgtgtacaccattctgggggtgggctttattctttatagaagaatgaaaattctgtgttcctttaaaaagctcagattcagtgaccttgattccccagtggctgatacaccagatcctgtatttcttagatgtttcctacctttcctcagctcttccattggtctcccagatttgtttccattcctccatctagtgcccctagctttgatcctgcataacactctgtgtgggagtaaaatttatgtaaaatattggaatgcgtaagtgtcttccagttttgggtatcaagttaaaaggtgatagtgttgagtcatgtttgggtggggcctcaagatcacactggagttttggtaatttgcttaggagggttcacgggccctagcgtatagctattctcatgctaagatttattgtagtgaagggatacaaagcaaaatcaacaaagggaaaaggcacatgaggcagagtctggaggaaaccaggcacaagcttcccagagtcagcctgtgcttaactccagcaacaggttgtaacaatacgggtgaaatgtcctctaccacaggagttctgcctagcctggtccagggttgtttttttttttttttttttttttggagactgagtttcgctcttgtttcccagctgggagtgcagtggcatgatcttggctcactgcagcttccacctcccaggttcaagcctcaacctttggagtagctgggattacaggcatgtgccaccacacccagctagtggtttattttttttttttttttgtattttttgtagagatggggtttcaccatgttggccaggctggtctcaaactcgtgacatcaggtgatccacccaccacggccccccaaagtgctgggattacaggcgtgagccaccacgcctggctagtccatggttttcatcaggggtctgtcacattggtaccctatacctagcatgaaccaaaattccaactcccagaaggaaagccggtagtcagcacaagctgcatgtttatataaacagtttaggtacagtgaaccactcttaatcatttagggaaattttttctattgatttagtgaactgtttgcaaatcaaggtcctagatgccaggcaaggaccaacatgcaagcaggtgttttctaaggatagcagtttctggcctttatattaactcttctctgcagtcactacttcagctgttggtattttggtctgccatgtaatgagtatatgtaaggtaatggtacggctatttgtttatcctaacactgcttactaaatattctaacttttccctactagtttgaaatattttcttgatcatatacagaataaattgctgtaggtatttgatggtgttcctggattttactaactaaaattagaatctataatacagtaagcattcttttttttttttgtaggttccttgtttctatactgatgcagaaagacgatcagtgatggatgcaacacagattgctggtcttaattgcttgcgattaatgaatgaaaccactgcaggtaaggaggaccgttgattatttttttgacttggttaatcttgaagattgtgaaattttaaaaccctggggtttcttgctctttattttgctttcagcactgctgctcttgcttaccactgtggtcatggtgtttttggatactgtgtcacttgtgaagaattaatctgaccagtgctttttgtgtacctttatagcatgcattttggtatttaaacacatgcttgttggggaaggagaacacttagcgtgtggagcagtgctttgggttaaagactggtcttctcttagacttgtggactggtagagtcagaggaatgggacattaagcagcatctcatggacagaacatgcggggatgttaacatagcataggggtagaaaagatccaggaaaatatatttggaaaatgggggaaatggcttggagaaaattatgccaaagtccattggcaactgtaaggaagtctaagtgaatatcagtatttaactcttggaagataatctttttcttgaataaattatacagtgcttataaagaatttgatttctaaaacataacacatgtagttgcattcgttatatataaaacctcttttttcctgcttaaatgaattttatttacttagacgttatttttaatttttgtgttttttcttctgtagttgctcttgcatatggaatctataagcaggatcttcctgccttagaagagaaaccaagaaatgtagtttttgtagacatgggccactctgcttatcaagtttctgtatgtgcatttaatagaggaaaactgaaagtaagtatatattttttttccagaagactgttagtagtatggtaattatgaaattttgagagacaatgattttttctcatctacaatatgggagaaacaatgcataccttacagggttattcagaggattttttttcttttctttcttttttttctcttttttttttttgagatagagtttcgctcttgttgcccaggctggagtgcaatggcgcgatcttggctcaccgcaacctccacctcccaggttcaagcgattctcctgcctcagcctccctagtagctgggattacgggcatgtgccaccacgcccggctaattttgtatttttagtagagacggggtttatccatgttggtcaggctggtctcgaactcccgacctgaggtgatccacctgcctcggcctcccaaagtgctggcattacaggcgtgagccacggcgcccagcaggaggattttttaacatgtagttccttggtgaattttacactggggattgagagggtggtacaggtgctctgtactcttgctcatgaggttttgagtgttctggaaaaggggtttcttttggatgccaaaacaaactggactaggaattatagatttctagaaagcctaaagtttaagcagttttgtacacacagaagtatagaaggcaaggaggggccagagggtgattgatctctgtcatagttgagtttgctggtttatgctagttccacagtagggtataaaattctctgtctagatgattttatctagaatttggtgaagaaccaaggatttctcaagtgtttgctttaattatttgaattgtatattaaaattgttggtgccaaggtctgaattgactgccttgtacccattggagattggtggagagggattaccccaaactaaatatttggtaattttggaggcattttgagacttcatttgttatggtcttgtttctttgaaaaatagacgtttccactttattttctggttttatattgtttctaggtggttttgtttttaaataaaaagaaagcgagtcttttagataattgggaaatgagagatttgtgattttgctttttgacagctataaatggtggaccaaatgtaattctcagtgtttaaactttaatcactaatagaatttctaagatctatgctatgctttcatctttttaaacggaagactctggttataatttagcctggctttggatcagaacgatgtgtattagtagccatctgcttctgtttttctaaattgtccttctgtgttacctgtcacctgtcagttttgcaatccttttgattacttttaaattataaaaatattcattacaaaaatctccccaaattggaaaacatttatgtgtaaagacaagtctgggcaacatggtaaaaccctgtctctacaaaagttagctgggtgtggcggtgtgcttgtagtcctagctactctggaggctgaggtggggggattgcttgagcccggagtttgagaacagcctgggcaacatggcaaaaccccgtctctacaaagaaaatacaaaaattagctggatgtggtgatgtgtgcctgtagtcctagctacttgggatgctggggtggcgggattgcttgagcctggatggtcgaggctacagtgagctgagattgtgccactgcactccagcctgggcaacagagtgagaccctgtctcaaaaaaaagaaaaaaaaataaagaaaagttacttacaatcttaccattcttaacagcttgatgtatttcattctaattttctaagaaaacagaattggagtcactatatttagctctgtgtcctgtctttttttaagttaacatactaagaaaatttcccccatgacgtgtagcattctttgaagagattgtttttactggttttattccttcataaggatgtcatcacttatttagcctaacttctattactgaatctaattagatctagtttgcttctaatctgttagagatttgaaaacgggtaacccaggctaattagacttccaggttaaatagaaacacattgcggtgagctaaggctttaaggaatcctttggtagtaaactgcagagagttgagcctttggtattactcagttttgtgatactgagtagactagaagtatgtacatgacatgttagtatattttaccttggacatgtaactgctattggttgtcagactggtgtagtggggagggcatggactttggaattaaggagatttggctttgaattccacttctaccacttagtagctttgtgaactgcagtttatctcatctgtctaggtctgtagcattatctgtaaattggggattatagtgcctatttttacagtgtggggtaataaggattaaatgatgtatacattgctttgttttaaccttaatgtaaccctccctctttttttttagataaacaacttaccaggtaaatatatatcatctgtttcaaaatcgattggttaattgttagattaattctcattttttccttaaggttctggccactgcatttgacacgacattgggaggtagaaaatttgatgaagtgttagtaaatcacttctgtgaagaatttgggaagaaatacaagctagacattaagtccaaaatccgtgcattattacgactctctcaggagtgtgagaaactcaagaaattgatgagtgcaaatgcttcagatctccctttgagcattgaatgttttatgaatgatgttgatgtatctggaactatgaataggtaagtatattactatttcgatgttaaagtgaagagtgagttttctccacatatattaacctttaattggctaattgttaaaataatcacggaggttatatgataattttggttctattttaaaaattagaagccattcaggaccctgctttttatgtaaagttgggtctggttaataatgtagactaatgtttttgttctgataaattgaatattccaacatgttgatagttctttacatatgcatttgttatacacgagatttcagtttccaaaaaatcagggcaaagggctgtaatgcagaattaaattgaatttaatttacccagtgactaagaaattgtaattttttttttgagatggaggtttttgctgttttgcccaggctggagtaaagtggcacaatctcaactcactgcaacctccacccccaggttcaagcgattctcctgcctcagcctcctgagtagctggggttataggtgcctgccaccacgcccagctaatttttgtatttttagtagggacggtgtttcgccatgttggccaggctggtctcaaactcctgacctcaggtgatccacccacctcagcctcccaaagtatgaggattacaggtgtgagccaccgtgcctagcccgaaatttttctttttgaaatattcgggttcacttgagggtgacagctctttttgtatagtgctgcaagaattctgggtaattgacatttcggggttatcctcagaaactacccagagtgttattgttgcctggttcagttgcttggatgatgggagtaagatgttcttttggctgtgaactctactggtagaattcaggcaagactgatggtgtatttggagacatgggcctgagctatccgtaaaaaaattgaaatggtgtttattgttgctttgtatccaaatttttagtcacctctccccctacttggaagagatggctttcgtttttgttaagcagcagtcttgtgtgtgtgtatgtgtgttccatgaagtctggaggtaagccagtatgtttaagaaattgttagtgaaatgttacgtgtttgtaagagctaagtagatacttattaagtagtttaaattttttaaaaactgaatttgcctgtgtgctgttgtttgaaaatagttgtggcctggtacggtggctcacgcctgtaatcccagcagtttgggaggcagaggcaggcggatcacgaggtcaggagattgagaccatcctggctaacatggtgaaaccccgtctctactaaaaatacaagaaattagccgggtatggtggcgggtgcctgtagtcccagctgctggggaggctgaggcaggggaatggtgtgaacctgggaggtgtagcttgcagtgagctgagatcgcaccactgcactccagcctgggcgacagtgagactccgtctcaaaagaaaaaaaaaaaatagttgtactgtgatggggcatggtggctcactcctgtaatcccagcactttgggaggcaggtgcatcacttgaggttaggagttagagaccagcctagccaacgaggtgaaactctttctctactaaaaatacaaaaactagctgggtgtggtggcaggcgcctgtaatcccagctacttgggaggctgaggcaggagaatcgcttgaacttgggagatgaaggttgcagtgagctgagatcgtgccactgtactctagcttgggcaacaaagtgagacactgtctccaaaaaaaaaaaaaaaaaaaaaagttgtactgtatttacatcatcagaatacgtagctcttatatgttctatattatagccttcatttagtgtgattattgttgttgttatttttttgagacaggatcttactctgtcacctaggctggagtgtagtggtgtgatcttggctcactgcaccctctgtttcctgggctcaagtgatcctcctgcctcagtctcctgagtagctgggactacaggcacgtgccaccacgcctggctaatttttgtattttttgtagagactgggtgtcaccatgttgcccaggctggtcttgaacttctggactcaagtgatctgcctgccttagcctcccaaagtactggggttacaggcacgagatactgtgcctggcccccttcatttagtcttttaacattcacctttgtttaaatcgatgaaaccagattatttgacattatatttcttttaattaatggtttcttcacttaaaaacttgaggtgaaattcaagtatcataaaattaagcattttaaagtaaacaattcactggaatttagtaaattcacagggttgtgcaatggccacctctatgtaatggaaaaacattttcatcaccccagaataaaacttcatacccagtaggtgattatttcctgtttccccttacctctggtccctggtgatcaacagcctgttttctgtttctgtggatttatctattctggatatttcatataagtgtaatcatgtaatatgcgtctggcttctttcgttctgacttctcagtgtaatgtttttgaggttcatccacattctgtatcagtacttaatttgtttttttgggcagatattattttcttgtatggatataccatattttattcatccattcgtttgctgatggacatttgggtttctactttttagctattgtgaatagtgctatggacatttgtgaacaagtacttgttttcaggtcttttgcttatatacctaggagtggaattgctggcttatacagcaattctatgtttaactttttgaggaatctccaaactatatttctcagtgattatccccaccagcgccctactgggtttcagtttctccacgtctttgtcaacacttattttcaattatttggattattttggtagattactagtagctttgtgttaattcatcgttttgatggttggaagtgcattctcctgcagattcctaagggatagcacatgtgaatagtgttccttaagttcctgcatgttgatgacagtttgccatgtttatacttaaaagtcactttagctggatagaacattcttagcttttctttccttgttgaggatcttaaatgcagtaacaatctattttcttttggtgtataatattgctgtcaaagtgtgacagcatagtttttagatatttgtcacttgttctttttgcttagatgcccaaatgtttttgatttttttttttcttgaaagtccatttgggtgtggtggctcacacctgtaatcctagcactttgggacgtcgaggtgggcggatggcttgagctcaggagttcgagaccagcctgggcaacatggcaaaacctcgtctctactaaaaatacaaaaaagtagcttgatgtggtggtgttcgcttgtagtaccggctactcgggaggcggaggtgggaggatcacctgagcttagtaagtcgaggctgcagcgaaccatgatcacaccacattgcactccagccagggtgatgagagtgagaccctgtctcaaaaaaaaaaaaaaaaaaaaaaaacccaataattttactacactatattttgatgttggttattttgcatcagtttttttccaggtacgcagtgtgccttttcattatatagtttgacattacaaatttaagtttaattaaaatttcttaagttttcttgaattatgttttctagtattctgttgtagtgctgtggttttctcttttgggaattcctacataattatgttggatcttccttgcctatcttacatatatatatatttttttttagtttgccttttttttgtatttgccatttttggtccagtccttcatggcatttctcttgtgtactgtttagttttcatttctgacatttattcttatacttctaattctgttctaggtctttctaattctgatttgttctttcatttcctgtatcacttttattgagatataattcacataccataaaaccttactattttaaagtgtacaattccagggttgtgcaactgtgaccactatttaattctagaatgtttttatcaccccaaaaagaaaacttgtacccattagcatttactctccatttccctccataccctaggcaattaccaatatgttttctgtctctatagatttgcctgttcttttttttttgagacagagtctcagtaggtcacccaggctggagtgcagtggtatgatcttggcttgcttcaacctccacctcccgggtttaaatgattctcatgcctcagcctcctcagtagctggaattacaggtgggggccaccacgcccagctaattttcgtatttttagtagagatggggtttcgccatgttggccatgctggtcttgaactgctgacctcgagtcatccacccgcctctgcctctcaaagtgcggggattataagtgtgagtccctcttttgtttttgtgaaatattttaaaaatgtggcttaactttctgagatgttttccctccctcttttgtgtttactgtgttgttctgcttagtttggattttttaatcagtagtttttcttcagtgagttcttttttctttgaagataactttaggtagggcccagtttgctgtggttcctgaataccttatttgaggaccttttatacttgttttggaggatgccaaacccctgctgatttcagctgctgttttcaatttggctctctgagttaggttattctggagttttcaggtcaattatatacccttttgtttccttctgtttattttgtacagagctgatactaagcaggaattgtagttgtgggtggtttgtctctgcctatatgtattttgaggtttgtgggcatatttcattacctagttttgttgcaggattgtttaagcccaggagatggaggcttctgtgaaccatgattgtgccactgcgctccagcctgggtgacagagggaaagcctctcaaaaacaaaaccaaaaaaatctgcatcaaattatcacatcattcagcagttgtatttctagatacatattcaagagaaatggaaacacatgtccacagaaaaactcatatgtgaatgttcattgcactactcataatagacaaaaagtggaaacaacccaaatgttcatcaactgatgaagtgggtaaataaaacatgctatgttcatacaatgggatatttttggtacttgaaaaaaatgtaatacagatacatactaaaacatgggtgaaccttcaaaagttcacgctgctgaaagaagtcacaaaaggccacattttgtatgattctatttatatgaaatgccccgaattggcaaatctatagagacagaaagtagatttagtgattgcctagggctgtgggagttgaggaaagtaacagttaagggtgatgaaaatattcttttttagactgaaaatgttttaaaattgattgtggcgatgcttgcacaactctgtatatatgaagtcactgaattgtatactttaaaaatatttttgtaccaaaacctcatgcccaaaagtcaataattacatactttatttttatctttttaatttttaaaatttatttctttttgaaacaagttctcacgttgtcatgcagtctggagtgcagtggtactatctccgctcactgcagcctcactctctcgggttctagagatcctcccacctcagacccccaagtagatgggagtataggtgttcaccgacatatctggccaatttttgtattttttgtagagacaggattttgccatattgctcaggctggtctcagattcctgagctcggccaccctcctcagactcccaaagtcctaggattacaggtgtgagccacctcacccggacgggaattatatactttaaatgggtgaattctatagcatgtaaattatattgcaataaaactttttaaaaagaaactatcaaaaaacctctactgtccaggcatggtggctcacgcctgtaatcccagcattttgggaggctgaggtgggtggatcacctgagttcaggagtttgagaccagctggccaatatggtgaaaccccatctctactaaaaatacaaaaattagccgggtgtagtggtgggtgcctgtaatcccaactactcgggaggctgaggcaggagaattgcttggacccgggaggtggaggctgcagtgagccgagatactgccactgcactccagcctggatgacagagcgagactccatctcaaaaaaatacaaaaaaaaaaaaaaaaaattacccgggcttggtggcgtgcacctgcagtcccagctactccggaggctgaggtgggagaattgcttgaacctgggaggcggaggtagcagtgagctgagatcgtgccactgcactccagcctgggtgacagaatgagactccatctcaaaaaaacaaacaaacccctaccgctgttgccatcttcttaacaatcttttcctttgcttttcacaattttgatttcagatagtttcagacatgcaacaaagttggaagaattttacagtaaatgtcctcatcccaccacttagagtctactgataacatttactgtacttgttttattatatatttgttcatatatcctataaagccatcaatttttaatttttttattattattattttttgagatggagttttgctcttgttgcccaggctggagtgcaatggcatgatttcagctcaccttaacctccgcctcccgggttcaagtgattctcctgcctcagcttcccaagtagctggggttacaggcatgcaccaccacacccagctaattttgtattttttgtagagatgttgtttctccgtgttggtcaggctggtcttgaactcccagcctcaggtgatccgcccgcctcagtctcccaaagtgctgggattacaggtgtgagctactgcgtggcctggcctcaattttgtttttagcatatctcaaagtaaattgcatctgtatacttcttgcagaaacttaaattgcggacatctataaatgtagacttctccccaaatactaaggtttgcatattaaccagaattcattgttttttggatatatttttatatgacatactcaggttttaagtgctcatttgctgagtttcaacatacacatatatctttgtaactaatgccattattatgaaatagaccattatgttggaatgtttcctcaggcttccataaccactgatgtgctttttgtatttttcagtccctagattaagtttgccaattctgtaacttcttgtaagtggaatcatgtattatgtagttttttgtgtaaggcattttttagtcagcataaaattgagattcatttgtttgtttcacatgccatttgttgttcttctgtattgctaactactgtgccattgtaggtttgttgttattgatggacagtgactctttagcttttttttctattagaagtaaaacattttaaacttgaacatgtaagatctctggttgctacacatctcaccagtattgaggttagcaatccttaagttttgcatgctctggtgggtgcattctatactttactattctttttttttgagatggagtttcactcttttcgtccaggttggagtgcagtgtcctgatctcggctcactgcaacctctgccttccaggttcaagcgattctcctgcctcagcctcccaaatagctgggattacaggcatgcaccaccacgcctggctaattttgtatttttggtagagacgggctttctccatgttggtcaggctggtctcaaactcccgacttgaggtgatccacccgcctcagcctcccgaagtgctgagtttacaggcatgagccaccgcacccagcctactattcttttttattgagatgtaatttaataaagttacccacttttcccttttttttggagaaaggatacctattgcccaggctggagtgcaatgggttgatcatggctcactgtagcttcgacctcccaggcccaggtgatcctcctgcctcagcttcctgggtagctgagactacaggtgtgcgccaccatgcctggctaatttcttgtatgttttgtagagatggggttttgctgtgttgtccaggctggtcttgaactcctgggctcaagccttagcttcatgatgtgttgggactacaggcgtgagccactgcacccaactagaagtcacccttttaacgtgtataattcagcgatttaaaaaaaaatttttttttttttagtatgttcgtagagctcagcagccatcatcacaactaaattttagaacgttttcattacttcttaaaccctaaatgagtgagtaatcaggctgtgaaaagacattgaggaaccttaaatgcatattgccaagtgaaagaagccaatttgaaaaatctgcatactgtaggattccaactatatgacattttggaaaaggcaaaactatgcagacgaccgggtgcgatggctcatgcctgtaatctcagcactttggaaggtgaggcaggtgaatcacttgaggtcaggagttcaagaccagcctgaccaacatggtgaaatcccatctctactaaaaaaaaaaaaatacaaaattagccgggcgtaggtggtgcatgcctgtaatcccagcttctcaggaggctgaggcaggagaattgcttgaacccggaaggtggaggttgcagtgagctgggattgcgccactgcactctagcctgggcaacaagattgaaactccgtctgaaaaaaagccctgccgcccccgccccccaaaaaaaactatgcagacaataaaacagtcagttacctggagtttggagcagggagggatgaatagttggagcacagggagggatgaatagttggagcacagggaaggatgaatagttggagcacagtgaaattattctgtatgttactgaagtggtgaatacttacacattgttaaaactcataaaacactaataggaactatcatttatcagcattgactcattaattgtaacaaatgtaccatactaatgcaagatgttaatagaggaactgggctgggagtgaggaggggatgtatggggattcttgttatgttcatttctctgtagacctaaaacatctaaaaatgtgtattaatataaaagaaagagacatggttgtgcatgcctgtagacccagctacttgggaggctaaggtgggaaaatcacctgagcctgggaactcactgctgaggttgcagtgagagtgagccaagatcgtgccactgcactccagtctgggcaatagagttagaccctgtctcaaaaacaaacaaacaaaaaacaaactctgtactcattaggtgtccttcccatctcttcttcttcccttttgtcattggtagccgctcgtctcctttctctggatatacctattctgaatatttcacataaatttttgttcttgtttgactttaacccagcataatgttttcatgtgttgtgatatgtattagttcctcttattgtattcattcatttgtatcgctttatacagttgataggcatctgggttgtttcagctgcttgtgaacgttgatataccagttttgtgtgtgaacatgtgttttctgttcttttggctatatacctagaatggaattgctgaatcatatgctaactctctaacgtcttgaggaactgccaaacacttttcccaagtggctgcaccattttcattttctattacctgggaatgtatgaaggatccactgtctccacattttgccagcacttgttgttacctgttttttattatagccatccattccacataaaagtggcatgtgatttaatgtactgtgttttttgttttgttttgttttttatagaggcaaatttctggagatgtgcaatgatctcttagctagagtggagccaccacttcgtagtgttttggaacaaaccagtaagtatttttgtgattgaatttgtttgcgtatctcagactgtttggaaattgttatttattatcttacttttgcaagcagtgatagaaatttttattgtatgaactaattcagtggtatatattaaactttttttcaacctgtatcttccccctgcccaaagtaatcttttgaaatgtctagggaaatctaataaaagtttctccaagaaactgaattcagactgaaagttggatataagcctcacaattatttaatggtggtaaaaattgtcttttgcgatgctgatatggtagtcttataagcttttctgtcagtgaattcttccctagctggatgagagctacagcaaagtgggaaggtaggataaccacatacttatttaacaagatgctttaattttgtctcaggctaaaaggtgactgtttgatttaggaatatatactaattttcctaaaatctttctttgacaaaccatttacctggacttcactgttgtgttgattgctatttcagagtgttgggatatactgtcagcttggcacaggctttcctctttagtgatgatggcaaatgggcttatttccacactgggaaagcccatttctttaaatagcccttctcaagaagttatcaatggttgttagataaaatgtgaccaggaaatcaggtgatattaagaagtattttatgagcaatagcagatcctttgatacacaccttctttctgatacgaagaaactgtacctgtagtttattttttattttatttttattttttgagatgggagtcttgctctgtcacccaggctggagtgcagtggttcaatctcagctcactgcaacctccacctcctgggttaaagcaattctcctgcctcagcctcctgagtagctgggattacaggcatgcgccactacttctggctaatttttgtatttttagtggagacggggttttaccatgttggtcaggctggttttgaactcctgacctcaggtgatccgcccacttcggcctcctaaagtactgggattacaagcatgagccaccatgcctggcctctacctgtgttttaacgtggactatgtttatgccttggattagaacactggagtagctggatgtgattcttcttttttttcctttaatgtcaggtcagaataactcagtggtttgaggccctcttattttcctgatggctagcgtgtttgaatgtttggtctgttgatgttttaacacttgtttgtgtgagattgtgtgagaaattcaggacctgtacactgcagtacatttgaggattcctggccctcacctcctaaatcccactagctacccttcccccattattttgagaattaaaacacctacttgtttccagatgccacctgcctctgtgagtgtgggcatgagtatgtgtgtgttgcggaggtgggtgagggagttggaggagttttgttacacatctgagttatttcatcatggtaagatgttattgttctttcatttcattaaaaaaatctgtctaattctttaaaaatagagttaaagaaagaagatatttatgcagtggagatagttggtggtgctacacgaatccctgcggtaaaagagaagatcagcaaatttttcggtaaagaacttagtacaacattaaatgctgatgaagctgtcactcgaggctgtgcattgcaggtgaatattctttcttttataggtaaccatttataaatcattgtaacaagatggcagtggtttatgtatctaataacctgggattagctcagggtgacttcagggtgttgagattccaaaacctttgttttaaaatagaggtgatgttcctaaaaataattgtactctatagcacataagatgaattaattgactagaaacataggtaactctgagcctgaagtatgactggaagtttggcctgttatgtatgtctgtatgaaatagtgtacattaattaaataagggttggggttaatagaaaaataaggaatagctagattatataggtaattgacatgatagaagtttgtaaaactgttcagacaccattaaattactaatataaatattttaaaaagaccattgattttctgaagtaatttgtatgtttaagtgatattatcagtttatattgtctatacttgttaaacggaatttttgaaaattattattctagtgtgccatcttatcgcctgctttcaaagtcagagaattttctatcactgatgtagtaccatatccaatatctctgagatggaattctccagctgaagaagggtcaaggtatcatgtttattaatcatttacatatctaaagttaattgactattaggtctgagtaatatgttgcttttcatttcagtttacataaatctgtaacattttatcatagtgcatgaaggaagtggtcatttattttagtcagaataaatttgtgtccttaattagtttctcacacttgattctgctgaaatcatcagtgccttttatgtgcagattgacgtatattccttttttactgactttatatataaagattcttgggaactcttataatctggaaataataccaattgaaaagagagagaaactaacactgtacaataattacaaacctagaacacatgggtaaaagtgttaggaatatcctgaatttgtgtttttgtctttttcctccattcagtgactgtgaagtcttttccaaaaatcatgctgctcctttctctaaagttcttacattttatagaaaggaacctttcactcttgaggcctactacagctctcctcaggatttgccctatccagatcctgctataggtaagtaaagagttggaaattaaaaaagaaaaaaaaaaaaaagcacagtggctcacaactgtaatcccaacactttgaaaggctaaggtgggaggatcacttgagctgaggagttcgagatcagcctgggcaacatagtgggaccctgtctccatttaaacaacaacaaaaaaaagcttatctacttggagagttcgcatagtagaaagaacaagtatggtattctgaaatttaggggctttagattgcaaaagaaaacctcttccagtctcgttagcaggtttagaaccagccaaatggctgttatttaattggatctcccattgtatcggcagtttttcttggttagcgcacattgtaattataacttatgtataaggtggtgctatatactataaggagttaacgaaattcagtttggaccctaacatacagttataagatgtatatagaaaatagccaggtgcggtggctcacgcctgtaatcccagcactttgggaggccaaggcgggcaggtcaggagatcgagaccatcctggctaacatggtgaaaccccgtctctactaaaaaaatacaaaaaaaaattagccaggtgtggtggcgggcgcctgtaatcccagctacttgggaggctgaggcaggagactggcgtgaactcggtaggcagagcttgcagtgagctgagatcacgccactgcactccagcctaggcgacagagcgagactctgtctcaaaaaaaaaaaaaaaaaaaaaaaaaggatgtatatagaaaatcattaggagatggtgatacaatatcaaaacatactaggtttcagaaccgtgttatctagagtagttatagactctgggaaactcttatctggaaataatactagttgagaagagatagaaactagttatagtataaagacctagaatatatgggtaaagaaattaggagtatcctgaatggcatttagaagctgtggaaagttaacctattcttttttccccatctgtaaatctgtaaaaccaggaataacaatgataattcatactttgcagagttctgggaatgaagaaaatgtaaataaaaaccttgtacagtcactggacctagaaatggcaatttactgataaacgacaagcagagtggaatcattttttttttctgttttgttttttgagtagagaatgtgacaaatctgttttaggaattaatctgaaagtagcatataaagataaatggaaataagaaattggaagaaaggaaagaatcgggagatatttgagttcttaattggggcaggataagataataagagactgtgaaagaagaaagagaaatctgatgatttaataagattctaaaaggaccgattttgcttattttaagcatcatgttactgagctatcattgaaagtagacataatctagcaatgtaggcatatattcatgcttgaattcatcctcttaggttatgtgttcttttgtctctcgtatgtccctagctcagttttcagttcagaaagtcactcctcagtctgatggctccagttcaaaagtgaaagtcaaagttcgagtaaatgtccatggcattttcagtgtgtccagtgcatctttagtggaggttcacaagtctgaggaaaatgaggagccaatggaaacagatcagaatgcaaaggaggaagaggtaatctagacattgtataccacttgtgatggcccagaggtgacttgtctagaaattgtagcaagcagacttggtggcaaggccggagcattgtgacagagctgctgagtgagagtgggtttgtatgtttgcccttcccccaatataagtgaaccagcagtagatttttatgcagaatttgtatagaagtggaacacaagttgatttcttctttcagatcatacacttctcaacttgagttattcctgattctggttgttgaagagtgctctgagtctcagttaattattttcaaaagtagaattgattgtacactcatttgttggaattatgcactgggtcttgtcttcattgtgcatcagaatcaaagctttacaaaactacaaattacctatgattccagcactttgggaggctgaggcaggaagattgcttgagcccagaagtttgaggccagcctgggcaacaaagtgagaccctcatctctacaaaaagttaaaaacaacaacaacaacaacaaaaaaactagccaggtgtggtggcacacacctgtggtcccacctgcatgggaggctgaggcaggaggattgcgtgagcctaggaggtcaaggctgcagtgagtcctgtttgcgccactgcactctagcctatgtgtcagagtgtgaccctgcctcaaggaaaacaaaactacaaatgcttgggtttcatccccacagattttactgaagttggtctgagctgaggtagcagtagttttaaaagcctctcaggtcattctaatatgttgcaggcattgagaagccactggttcaggctctccacaaaccttctttcattgttatttttaggctttgtaattttaacgtgttcgcctccccgagcacatgcagtggtcatacttttgaggatgaagagaggctgacttaggaactatttgaaaaagttggaacttttgagagaaaatacctttgaggaagcctggagaagcttatgctctcttcaggttgtattttgtagattgtattaaatgatgccacattgtgaactgtgagtacttaatggtgtacaaagcagttccacagttattcttgtgtatgtaagggtagggcagggcgagtgttatcctcattgtacagatgtattaactaagatccagagcggaaaacttctgtgtcctaggtaatgtggcctacctggaattttagcataggccttctgattgctggtaattcagcaggaattacataactatgtgactttgtcaatgtgtaatgaaggttgtttagtcttcctaattgcaggatttaatttgacctgtttttcagaagatgcaagtggaccaggaggaaccacatgttgaagagcaacagcagcagacaccagcagaaaataaggcagagtctgaagaaatggaggtatgcattgggtggtgttttttttttttttttttttttttttttttttgagacagagtttcagtctgttgcccaggctggagtgcagtgacatgatctcggctcgctgcatcctccacctcctgggttcaagtgattctcctacctcagcctgctgagtagctgggattacagacgcccaccaccacggcagctattttttttttttttttgtattttttagtagagttagggtttcactgtgttggctaggcaggtctcgaacttctgacctcaggtgatccacctgtcttgtcctcccaaagtgctagtattacaggcgtgagccaccacacccggctgagttgtgttttagagtatgcactgcagtctttttaaagtacatggttttggctgaggggcagtgtcttgaaagatagttatactagaaactcttaatttatttgaacaatttttttaggaagattttgtagtgatttgtaatgtgctatttgcaagatggcctttaaactctctcctggttgatacatgggaagaaagcactcaggaatcctagttttactaggctagtgatttatttatgctagtttctgaatggcttatactaagtctttctacccataatttaattcattactgataaacaataatgaaactgaaaaaattttcaaaatcatcaatgatccatgccttttactttttaatctttttatttttttgagatggactctagctctgtcgcccaggctggagtacagtggcatgatctcggctcactgcagcccccgccttccaggttcaagcgattcttatgcctcagcctcctgggtagctgggactacaggcgtgcaccatcacgcccggataatttctgtatttttagtagagacagggtttctccatgttggccaggctggtgttgaactcctgacctcaagtgatcctcccacttcagcaccctgggattacaggcatgagccactgcgcccagccaaaataacaacttttaataaaaaggcatggggcctggttcagtggttcatgcttgtaatcccagcactttgagaggccgaggtgggtggatcacttggggtcaggagtgagaccagcctggccaacatggtgaaaccccgtctctactaaaaatacaaaatttatcccagtggggtggtacacgctggtagctccagccacccaggaggctgaggcatgagaattgtttgaacctgggagatggaggttatgtgagctgagattgtgccactgcactccaatttgggcgacagagcaagactccatcttaaaaagttattttaaataatggaataatggatttaaatatattttgtgattaatgtaaataatgtatttatttcaaaaagagtagtaacatttttgaatcctttacaacctattctttaattttgagttgtcatgtttaaatttttttatcattgaaaatatcttttatttataaaattacaatgtataatctcaccatcttaggagtttctaattttaaaaagtttctaatttttacaaatttctaatttaaaagtgacatttaaaaaagttggacagaaccttaaagtggcttaagtccgttgtatattttcatgtcaattaacaaaatttaattgcttttctttagctgtgcaagtaatattaaaaaggaaaatggacaggaaatggtgcttacagattctttagttgggtcaggcctttttcaagatggaagaccctttatgttgttgggtgggatgggggcagcagtggcagagacaaggacttgttctcctatatgtttgtggaaggtgggtgaagagaagggagaagtgacggctgcttccccaatgcctttgagctgtgggagggggttttagaggtattagttatctaggcttccttgggatggctcagaaactaaagtgccttttgcatagcattgcttctaaaggcaaatgaaatagaaatgatagataaatttcagcagccgacttaagttagttataggaggtgggaaatgacattaaggttttgctttatcatagaacaaattgaattccagatgaattctaaagttgaaagttgaaaaagcttgaagtgaatatttttctaatctgtggatgaggaagggctttcagagtatgaaagcaacataagtaatctcaaaggaaaagatggatagatttgacagtcaaaacttatatgtagacaaataatacagttagaaaaaactagaagagtcgctgtggctcacacctgtaatccagcactttgggaggctgaggcagcggatcacctaaggtcaggagttcgagaccagcctagccaacatggtgaaaccccatctctactaaaaatacaaaaattagctgggcaggagcctgtaatcccagctactcaggaggctgaggcaggagaatctcttgaacctgagaggcagaggttgcagtgagctcagattgtgccattgcactccagcctgggctacagagcgagactccatctcaaaaaaacaaacaaaaaaaactagaagagtcagttgtttgtgggggaaagaaacactgcaatcctaagagaagagtggataaaatattactaggcagtttgaggaaatagttacatatggcttgtaagtgtctgaaaaaggttaaaagaaactcatactgaataacagtgagatgatgttaaatgaattctcatttgtggacagggtgcagtggaatgagttttttccttgtgagaatataaatagttacagacattatagaaatcaaattaccaatatgttactactgatccatagatatttcataccctcctcctcactaacttcatttgaatgtctatatgtttaaataaaggtagaaaaatttttaatagtaattatatattgatacgggattgtaggagatatgtattttataaaatttaccatcttaactgcttttaagtgtaccattcagtagtgttaagtagatagacattgtggtgtaaccaatcttcagaacttcatcttgaaaaactgaaactctatacccattaaataactttccattattcccctcccccatcccctgacagccactattctgcttccatttttatgaatttgactgctctagatacctcattgtatttacttattttttattttctagatgttatggtagtcctaagttacttagatcatcatcaaaagagaacgaagtaaaaaaagcaaaaacagttttccaacatgactcattttgaagtttaaggtagtctgtatatgtgtttgttcttaatgatttctattgttttagacctctcaagctggatccaaggataaaaagatggaccaaccaccccaagccaagaaggcaaaagtgaagaccagtactgtggacctgccaatcgagaatcagctattatggcagatagacagagagatgctcaacttgtacattgaaaatgaggttgttatttaaagtctattggaacaatgagctaacaaattaatgttaccatagtattcagactctgtgtctagtgactttttgcatttttgattgtttggacttagagaaaataaattagacttttgtgtggtattgtaagggcaagttgaagcaatagatcccatgttatgtcaattcttttatggtggtactaagatgtctgtattgctagaagctctgttatgaaaattttgacatataatgtctttggtgtaggggaggtattgttcatttttgaatacgtgggtatatttgttcactagagattgggatatttgaggttggtggtcatggaagttattcagtaggagaaatcgtatggcattaatggtggcagtattttgcttattcctttccgttgccagtcagtatgtaaatatagtaactcttactgagtgatgcaaggtttgggatttgtgagcacatttattgaattaatttttgtctatgaggtttcttaccaggtttccactggatcttagaatagttttgtcttatggaaacttcagcatttatactgcgtgaatgaatttgatttttcttatctcatattaatacagcagaggatatcacttagtgacattgaaccaatagttttttaaatttctcttgtcttaaattctttaattttgcttttgagtgtctacaccttgatatttctattgttcttttttttaatcccacctacaaaactctttttgatattcaaagtctgtcaaggattagtcttcccacttacctttgttatgtgacttgcagaactaaaaggatttggggaagaaagagtctctacttttataattatattggtatttaagaggaaattagttgtcctaatgtctgatttatacataatatttattctcagggtaagatgatcatgcaggataaactggagaaggagcggaatgatgctaagaacgcagtggaggaatatgtgtatgaaatgagagacaagcttagtggtgaatatgagaagtttgtgagtgaagatgtaagtctgccacaatatgcctaactactgtgtgtcttctgtgaacatctttaagtgggttagaagggaagtgtgcagctatatgtgtatagtagaattattaaaaatggagtttttctggggggggcaaaattttatatttttttatatatttctctattagtacagtgtttagtaaggtttggtctttgtgcatcacgttcacaaatcacttttgacacattcgaatattgttatttatcttgtatctttcttttcttttcttttttttttttttttgagacagagttttgctcttgttgctcaggctggagtgcagtggcgtgatctcggctcactgcagcctccgcctcccaggttcaagcagttctcctcccccagcctcccgaatagctgggattacaggcatgtgccaccaagcctggctaatttttgtatttttagtagagatgggatttctccatgttgatcaggctggtctctaactcctgacctcaggtgatccgcccgccttggcctcccgaagtgctgggattacaggtgtgagccactgcgcccagcctgtatttttctttaaattgttaaagctcactttttcctgtttattgtaactcagaatttttagtttttttttttttttaatttgaatagctcttgggtacaggtggtttttggttacatggatgaattatatagtggtgaattctgagattttggtgcacctgtcatccacgtcctgtacatcatacctaagatggtagtttttttatcccacaccccacttctgtcctcccgcttttgagtctccaaagtccattatatttctgcatatgctccatagcttagctcctacttataagggaaaacatagcagtatttggttttccattcccaagttacttcacttagaataatggcctccagctccatccagttgctgcaaaagacattattttgctactttttatgactcagtagtattccatggtgtgtatataccacgttttctttattttatttttattttttatttatttatttttgagacggagtctcgctctgtcgcccaggctggagtgcggtgacgcgatcttggctcactgcaggctctgcctctcaggttcacgccattctcctgcctcagcctccggagtagccgggagtacaggtgcctgctaccacgcctggctaattttttttttttttgtatttttttttagtagagatggggtttcaccgtgttagccaggatggtctcgatctcctgacttcgtgatccacctgcctcggcctcccagagtgctgggattacaggcgtgagtcaccgtgcccggtctaccatgttttctttatttactcattggttgatgggtacttagttgtttttatttttttatttttttgagatggagtttcggtcttattgcccaggctggagtacagtggtacgatcttggctcactgcaacctccacctccctggttcaagtgattcttctgcctcagcctccctagtagctgggactacaggcatgctccaccatgcctggctaatttttgtatttttagtagagacggggtttcaccatgttggccaggctagtctgtccttacctcaggtgatccacccgcctcagcctcccaaagtgctgggattacaggcgtgagccagtgttcccagatgcacttgcttttacatgcagtttttattctgaaattttttaacttaccgaaagccctccacggcagggagaataatataataaaactccccatacctatcaagtagaccaacatttgccatccttgttttctgtatctcccatctccttactccccctgtatcttatcttattttttttgaaatggagccttgctctgttgcccaggctggagtgcagtggccccatcttgggtcactgcaacctccgcctcctgagttcaggcagttcccctgcttcagcctttgtagtagctgggattacaggtgtctaccatcacgcccgggtaattttttttgtatttttagtggagacggggtttcaccatgttggccaggctgttcttgaactcctgacctcaggtgatccacctgcctcagcctcccaaagtgctgggattacaagtgtgagccactgcacctggctgccctctgtattttaaagcaaatctcagatacatcattatattctatgcctctgactgtattggggatgtaatttttgattgacctaattataatattttctttatcattaggatcgtaacagttttactttgaaactggaagatactgaaaattggttgtatgaggatggagaagaccagccaaagcaagtttatgttgataagttggctgaattaaaagtaagtgactcttgagagcagaggtatccagaacccttgttgaagcttcctctgaggagctcaaatttgggaggaattctcaagtaaagacagactgaaaatgatgtttgatgaactaaaataaaccctttatgacttaggctcattatcattctcacttttagaaccttgtaataacaaaatgatttttctgaaaattgactttaggtttgtaatgtttcactgaactggatgtttagtgcattcttggtgtcaagagataaaatgactgcaagacttagtacctgccctaaaggcacagggaatgcagctggagcagggctgtttctgtttatgtagtttggattcttgataaaagcaaagcatctggtggtttattttttattattttatttatttattatttatttattcatttatttatttttaaatacacagtcttgctctgttgcccaggctggagtgcagtggcgcagtctcggctcactgcaacctctgcctcctgggttcaggggattctcatgcttcagcctccagagtagctgggattacaggcgcgtgccaccatgcctagctaatttttgtatttttagtagagacagggtttcttttcaccatgttggccaggctggtcttgaactcctgacttcaagtgatctgcatgccttggcctcccgaagtgctggaattataggtgtgagccaccatgcctagccaaagcatctggttttgtatttaaagcatctgatcttttttttttttgagacggagccttgctctgttgccgaggctggagtgcagtggcgtgaccttggctcactgcaagctccgcctcccgggttcacgccattctcctgcctcagcctcccaagcgcggtggctcatgcctgtaatcccagcactttgggaggcctaggcgggcggatcacgaggtcggagatcgagaccaaggtgaaaccctgtctctactaaaaatacaaaaattagccgagcgtggtggcgggtgcctgtagtcccagcatctgatcttttaacattaggattaaacatgaaagaattacataaaattgaggccttttgttcagaaaaggttgcagatgcacaagaatgaactttttacatttctctttaaatttagctctggattacttggtttcttgtggaactgggccattttgaatctcactctgtcagtcgggctggagttcagtggtgttatcacggcttactgcagcctcgacctcccatgctcaagtggtccttctgccttagtctcccaagtagctaggactacagctgtgcgccatcacgcctggctgttttaattttttttgtagggaaagggtctccctgtgttgcccagactggtatgggtactcctggactcaagcaattctcctgccttggtctcccaaagtgctgggattacaggcatgagccaccgaacctgaccaagcacatcttaatatcactgttgtattaagttttcaagttccagttatttcataaatgatttttttgtttgaatcagtatccgtatagggctcatagattttattgatgtcgcttataactgtgtctatagttcttcttccgttatttccccatgtcgccccaccctttccttatttagtttatgaggaaattggatcattggtcctgtaggattttcctctagttggattttgctgattttcacctccctggtggtatttaacattatttgttaaattgatggttacatttagaggctccatcagattcagatgtttaagattttaaattaaaacattttttatttttggcaagtatactttatatttagtactgtgtatctccattaggaggcacctaatttttggtggtctccctgctgtgttttgagggctcaggtgacaaattgaagcgattccagatggatcagtgttgaggtatagtttcattcccctcctgaagtagcttcatatttccaaaggcctggagaaatatatttaacttcttatatatagcacacggagattaaatgtactttatcactagttttagtggaatcagtactctggatcgttgaactgccgtatgaagactgtgtattcttctgttaagaatctaggtcaacctattaagatacgtttccaggaatctgaagaacgaccaaaattatttgaagaactagggaaacagatccaacagtatatgaaaataatcagctctttcaaaaacaaggtaacttttttctttgtcctactcttattttagtaaagttaactttttttttttttttttttttttgagacggagtcttgctctgttgcccaggctggagtacagtggtacaatctcggctcagtgcaacctccacctcctgggtttaagcaattctcctgcctcagcttcccgagtagctgggattacaggcgtgcaccaccacgcccagcttatttttgtatttttagtagagatggagttttgccatgttggccaggctggtctcgaactcctgacctcaagtgatccacctgccttggcctcccaaagtgctggctggtattacaggcgtgagccactgctcccggccgtaaagttaacttctgaggcatttacatagcatttttttctcttgttctcattaacttgtttaatagcactttttattttggatattaatgtaatgtgtaatgttttatagcgtcttaataagaaccataggatttgctgtatctctttaataggtggaatctggaattgaacagtgttgttcagtttccttttcgttggtgtttgacttaacatgcactatcctggtctttctaacacctgaggccagtaattatccacacagtacctttataaggtagggggtggtatcaacatttatagataaattccaacttattgaagcctcactttccttaagcaacattcagggtcactaaattgggagaactgtcatttagccagaagtctgactccaaagttcagactttggagtataaagttcctccattataccccaggttcttgacatattgttagtgtaagaaactttgaatgataaattgagcttttgtgggtttttgtttgtttgtttgtttttgtgttttgacaagttctcactttgtcacccaggctggggtgcagtggtgaaatctcggctcactgcagcctcaatctctctgactcaagcagttctcctgcctcagctactttctaagtagctgggactataggcacgtaccaccacacccaactagggttgtctttttttttttttttttgagatggcatttcaccatgttacccaggctggtcttgaacttcttagctcaaatgatccacccacctcaacctcccaaagtgctaggattataggcattagccatcaggcccctcctttttttgtttttttttcctccttcttttttgtgagacagggtctcagtctgttgcccatgctctagtgcagtggtgtgatcgtagttcactgcatcctcaacctcctgggctcaagtgactgtcctgtctcagcctcctgagtagctgggactataggcacatggccctcatgcctggctaatttttgtattttttgtggagatgggctcattgtgttgtccaggtcttgaagtcatgagcttaagcgatcctcctgcctcagcctcccatagtgctaagattacgagcgtgagccaccacgcctagcccgaaaggccttcttcttcttttttttttttgagatgtagtctcgctctgttgcccaggctggagtgcagtggtgtgatctcggctcactgcaagctccgcctcctgggttcacgtcaaaggccttcttttaaaaatagtattcattatagttttggttccgaactagcatgctgaaacttcagctctcatatctaatgtaatttttttgcattgtgaaattatcttcctaagattttgtataaatcgggtgctgctgtttatcttgttgaagccttttaattgataccttatgaattttcttgacctttaaaatttaaatctatcctgagtgtattcaaaaattgtggttaggtttcttttgaataattctgttcagattgtgaggctaaatatgctttattttttgaaagattataagtttttgaaaaatggcagaaactagacagtagttgcggggagggagggtatcacacttttagcacttgtttgactgtctcctggttgcaggaggaccagtatgatcatttggatgctgctgacatgacaaaggtagaaaaaagcacaaatgaagcaatggagtggatgaataacaagctaaatctgcagaacaagcagagtttgaccatggatccagttgtcaagtcaaaagagattgaagctaaaattaaggtaatttaagacttttttttaatagtcttttcttgacagccttattattaatagtcctcaagtgacacttaggagggaactttattatagtgttttagcttctaggttgaggattgggtggtgggagagggcggatttgggtttagcatggcttgtaaaatttgttaattttataagaaaccagttttctgtcttacccattccaggagctgacaagtacttgtagccctataatttcaaagcccaaacccaaagtggaacctccaaaagaggaacaaaaaaatgcagagcagaatggaccagtggatggacaaggagacaacccaggcccccaggctgctgagcagggtacagacacagctgtgccttcggattcagacaagaagcttcctgaaatggacattgattgattccaacacttgtttctattaaaacagactattataaagctttaagttgtcaactttgttctaaatatcaactagcgcaagtgaatactgaagatttcttagtcagtttttaggggattttcggggaggggaaataggtaatgtatggagcattttcacttctaaatagttagatacagaaattaagtgcattgtatctttttcataatggtactatttagaagcccagttagtcttactgagcttatgcttcactcctttatgtttaaccatgtgtctacaagaataagtttgttttggaaagttgagctatagctacagctctagctatccagcagacttttcattatgacttacatggcaggagctctaattatgctttaaaaatctgttgtggagattgctttaaatgctccctgcctggtgtggggatggggtccccctctttgtgagggctggagcatggcacggcatggattaacacggcagaggaacaaaggtgtgctctgagcttcttcatatttcaccttcaccctcacctgtgttctcttccctctctcccaataaaagggctcccatta

SEQ ID NO: 37073 - DNA, 27222 bp, Homo sapiens
caccgccattgccgccatcgtcgtggggcttctggggcagctagggctgcccgccgcgctgcctgcgccggaccggggcgggtccagtcccgggcgggccgtcgcgggagaggtgagagcgctggctagaccggggccgaatgcggccggattcggggcgggggccttcagacctagggtggaacactgggatagggtgtggggaattcggaccgctgtgaagtgatctgacgttgggtgggagtctccggacttggggtggggaatctggatgggaactggggaattcggaccttgggtggggatctttggaccggggtggggtccccagactccttgtggaaagctgaggttgaagatctgtgctgtgatgaggggctccagatagcggtgagagatcccgcttcaagactgggttgggggtccagaccaggaggataagcctctccctggagtagggcttgacctggtgagggtgtggtagagtcacaggggagggtcccacttggtccttgggctgggatcagactctcagagctggagagttgcaggaggcctgggggagggtctgtggagccccagactcagagggccttggtgacttctccaacaggctccctgttggaggccttggggtaccccagggcctttccctgcaagagagaggctgctccaccaggaaggggcccaggactccccagggtcggggggatgtgtggtgtgcaggaccacgtgggaatgttagagaaaggggaagtcactccgggcctgccctgctaacagacctgctttttggatttttccagccagggatttttgtgtcctgttgctttttattgtttaaagtgaccctccaagcctgagggaccgtaggagctgccctgcagagcccagtgagacactagttaatgcagaaaaaacagattttacttggtaactactgacaacatgagaaaaagctggctccatgctgatttgtctagatgtgcctggagtttaaagggagagtgagggagtgggaaggggtggggactcagtagagttagggaaacagaaaatcaccaaaactgggaagggagggttggcccctgtgaaaccaactgatctgggtttgccactggggcttaccgaagtcaggcccccaacctcccacagagactgggagacaggggccccatcctcaggtgttggctggaacacacaggaaattcttgtggcagccttgaacttctcaggcaggcactttagagggggctaggatcgttctgggaatgtggccttgagctgttaggagctatgttagtgttcgttccagcctagataggccagggtgaggcccagtggagaaggggactctaaggagcctggctggagtgtggggagggagggtctttgtcagcactccccctgtgcaagaagagcagagacctgcttctttcctctcaacagtccccgtccattttctgttctgtgttgtgttcataaactaccagcgggaccatctgttgagacttggtagcaaaggatttttgctggatgatgcaagcagtcaagcatttaatgaggaaacaaaaataacaggccaggcacagtggctcatgtctgtaatcccagcacttttggaggccgaggaggatcacttgaggccaggagtttgaaacaagcctgggcaacataaagaccccatctctacaaaaaatttaaaaattagcccggcgtggtggcatgggcctatagttccagctacttgggaggctgaggtgaaaagatcgtttgagcctgggaggcggaggctgccatgagccatgatcttgcctctatactccagcctgagcaacagagagcccctatctttaaaaaaaaaaaataataataaaataaaaaaataaaaagaaagaaagaaataaaaacaaagatgaatggagctgttgataaacccagtttttgagcctacagggcagcagttgaggtttctggccgttgggccctaacaaggccagcaggggcactcagggacttcctggtgtgtggtgtgaagtctgtgatgatggcataggcattggtatcccagttgtggttactttctggagagagcatgtggcatgcaggagctggagggggggtcttcctgggcggcctgtgtagcagcagctccaggcacaaaggctgcccctggagaatctgttgtggttctgagttctttcaagtttatatcaagttttccggcttcagtctgcagggctgtttttttcagatcctgggggcaaagggcagctacaagaccacctgagtcccaatagggatttgagttcttggtgacaccaagtcagggaggagacaaattagaaatgtcagtctgaagagagtggtaggtagccagatactgaaggaaagtagatgggaggatttggtaagggctgacgtgtaggaaggcagtgacagtccaagtgacaggcagatcataaaacctcaaggataggccgggcccggtggctcatgcctgtaatcccaagcacttcgggaggccgaggtgggcaaatcacccgagtccagaagttcgagaccagcctggctaacatggcaaaaccctgtctctactaaaaatacaaaacattagccgggcgtggtggtgcactcaggaggctgaggcgggataatcgcttgaactgggaggtggggggctgcagtaagccgagatcgcaccactgcactccagcctgggcaacaagagcgaaactccatctcaaaaaagaattaggccgggagcggtggctcacgcctgtaatcccagcactttgggaggccgaggcgggtggatcacgaggtcaggagatcgagaccatcctggctaacacggtgaaaccccatctctactaaaaatacaaaattagccaggcgtggtggcgggcacctgtagtcccagctacttgggaggctgaggcaggagaatggtgtgaacccgggaggtggagcttgcaatgagccgagatcacaccactgcactccagcctgggcgacacagcaagactgcgtctcaaaaacaaaacaaaacaaaacaaaacacctacaaaagacagtgaactagactaggatctgataactcccaagggggtgttatatttctccactgaagcatagcatttctctttacaaacccttcccttttgattgaagataatcaaagtgagattattcttatttaccaaataattctggtctcattaaatttggcctgattatttacataaatgcagcacgaacagtaattgaccacacaggcctttttaagtttgctgaaacttttaatagggaatcttagattgagctttttaaagccttt[450 bp omitted]aaagataattgcttcaattttgtttagagaagtatcatttactataatattacgagtcattgataggttaagagaaaagggaaaggtttctttctttttttcttttttgaggcagagtctcactctgttccccaggctggagtgcagtggcgtgatctcagctcactgcaagctccgcctcctgggtttacaccattctcctgcctcagcctcccgagtagctgggactacaggtgcctgccaccacgcccggctaattttttgtgtttttagtagagatggggtttcactgtgttagcaaggatggtctcgctctccagacctcgtgatccacccgcctcggcctcccaaagtactgggattacaggcgtgagccaccgtgcccagccggggaaaggtttctttttttaatattcagaaaataaaacataaagagccaacaatattctgaacaaaagtcataaaaagactgtaatcatccttcagcagtttactcagttgcatgcaggtactgaattcttgttctgcttgatcttgggctagcaggtacatgaacccatcttttctcaaccagtggagatcctggctcagtgcagtcatgtgatctcaaagttaagaaatgctgtcacgcccaggtgcagtggctcaggcctgtaatcccaacactttgggaggccaacgtggctatatcacttgaagtcaggagttcgagaccagcttggccaacatggtgaaaccctgtctctaccaaaaaatacaaaaattagccagttgtggtagcagacgcctgtaatcccaactactcgggaggctgaagtgggagaatcgcttgaacccgggacatggaggttgcagtgagccaagatcacgccactgcactccagcctgggcaacacagtgagactccatctcaaaaaaagaaataaagaaatgctgtcagaagcctaccccatggtacctgtcatgggccttttcattggtccctttttgttgaagatgaagcactttgccctgtagctgattgcaagagatttcaggaaagcatcagagtaaaactctaatgacaaaagacttaaaatagtgtagttaaatatctaatgagagatcattacaaaatcaaacgatttacaaggaatgttggttgtttatgacacatagcattttaaataataaccagaatgatgattgctgttatatgaggacatgtcattggcagaagggtattcaccagtttgtgggaactttatacaatatctggaatccttatattaacatttaccaatatgcatgtaactcaaggaagtttaaatagcattaaaaaaaatttttttttagtttttttttttttttttttttttgagacagagtcccactgtgttgctcaggctggagtgcagtggcacgatctcggctcactgcaacctccgcctcctgggctcaagcgattctcctgcctcagccccccaagtagctgggattacaggtgtgcaccatcacacccagctaatttttgtatttttagtagagatggggtttcgccacactggccaggctggtcttgaactcctgaccccaggtgacctgcccaccttggccttccaaagtgttgggattacaggcgtgagtcaccgcgtccggccctaaataacattttttatttgacagcaccttgcatgaaattctgtagggtccagccctacagggtctgtgggtttttctccccgtgtgcagagatgagagatcgtagaaataaagacacaagacaaagagatagaagaaaagacagctgggcccggggaccactaccaccaagatgcggagaccagtagtggccccgaatgccaggctgcgctgttatttattggatacaagacaagggggcagggtaaggagtgtgagctatctccagtgacaggtaaggtcacatgggtcacgtgtccactggacgggggcccttccctgtttggcagccgaggcggacagcgagaggagacagcttatgtcattatttctgtatttcagagacctttagtactttcactaattttgttactgctagttagaaggcatagccaggtacagggtggaacatgaaagcggaccaggagcgtgactgcttaagcacagcatcacagggagacggttaggcctccggataactgtgggcaaacctgacactccacaagaggtggttgagcagagtcttctctaactcccacagggaaagggagacttcctttcccggtctgctaagtaacgggtgctttttctaggcactgacgcaactgctagaccaaggtccgctaagtaacaggcgtcttcccaggcgctgacgttaccactagaccaaggagccctctagtggccctgtccgggcataacagaaggctcacacgcttgtcttctggtcacttctcaccgtgtcccttcagctcttatcactgtatggcctggtttctcctaggttataattgtagagcgaagattattataatattggaataaagagtaattgctacaaactaatgattaacaatattcatatataatcatatctatgatctatatctaatgtaactattcttattttatatattttctttattatactggaacagctcgtgccctcggtctcttgcctcggcacctgggcgacttgctgcccacaaaattcaccattgaaataaacctaattagtttaacatctctcttataaggtcacaggacagatcctttgaggtcttccaggggccctccaggaaatctcaagtcagtctgagatcaagacaatgtcacaggccacatgcagtggttcacgcctataatcccaacactttgggagtccgaggagggaggactccttgagcccaggagtttgagaccagcctgagaaacatgctgaggccctgtctctacaaaacaaaaagttgaaaaattagctgggcatggtggtacatgtctgtagtcccatgtactctgaagactgaggcgggaggatcacttgagcccaggagttcaaggttgcagtgagctgtaattgcaccactgcactccagcctcagtaacagagtgagactctgtcactaaaaaaaatttaggctgggtgcagcggctcacgcctataatcccagcattttgggaggtcaaggtggacagatcacctgagatcaggagttcaagaccaggctggccaacatggcaaaaccccacctgtactaaaaatacaaaaattagctgggcgtggtgccatgtgcctgtggtcccagctacttgggaggctgagacagcagaattgcttaagcctgggaggcagaggttacagtgagcccagatcacaccatggcactccagcctgggtaacagagcgagactctgtctcaaaaaaaaaaaaaaaaaaaaaaaaatttaaagaaactttatacataaatccattcaatgattatgaggtcaattctagccagctttgacctcataacataaaatttcttttctgcagactttcttgaggccaggagttcaagaccagcctgggaaacatagggataactttctgtatccattcacagttgcttttgttttgagacagaatctcagtctgtcacccaggatggagtgcagtggtgagatctcagcttactgcagccttgacctcctgggctcaagcgatcctcctgcctcaccctcccaagtagctgggactacaggcatgtaccaccatgccaggctaataatttttgagtttttttatagaaacagggtttcatcatgtttcccaggcttgtctcgaattcctgggccattcaggctttgtcccatatttttcctctttttgtaattttacttcaggacaaaattacatccctttctttaacaaaaacactctacattctttgcatacttttcatataaaaacacatcctatcttcctcccatactttgtataggaaattgtttccctcattcttattgtttctaggagttttgttttcatatattgattataatttttaaccattagtaaccggtattttttttttaaagagacagcgtcttgctcttttgcccaggctggagtgcagtggcacaatcaggactcactgcacccttgaactcccgggctcaagtaattctccaacctcagccccctaaagcactgagattacaggcatgagtcaccacgcccggccataacttgtattttacaagtaaaactgggaagaagacaattggaaattgtctgtcatttaccagtttgttggcaaattttatgaatataccatcttataatctctagaggtatatcctttttatagtacaatgtttttaagtgccaagtacatgtttattaacagaccagaatacctttagccagtctgtaccatataaaaataagaagccaaaaagtacaaaaagttacgcttaataatgaatgtttcagcactttcttctcttcaggtattatttagatattcaatgaatgtctattatttaacttcacttagtatgactctgaggttgaaagttactgaaaacatcttgtaagcttttttaggccaatatattatcaaacgcaattaacaaaacacaactcactagtttatataagagctagttctcacttttttttttactctattttatatattttttcttttcttttcttttcttttttttttttttttttttttctgtagagacaaggtcttgctgtgttgcccaggctggtcttgaactcctagcctcaagtgatccacttaccttggcctcccaaagtgctgggattacaggtgtgagccaccacccagccctattttatatttttatctgaactgtgtttctggcaaattggacaagttaagggtcacttgctccatgtgaggggaaggctttctacctgtatttgtggataagacctttacgacttgttttgccctgatggatgactacatgtttccagtgagctcagctggttgcttttgtgggtccctgaggcactgcgagcccctgatggggcaggaagcctaaagttccagggaccgtggggagttgaggggctggagggggaagagagaggcctgcagcggggatccacaggtggaggaggccagacttgaagggggtgtctccttcaagagaaagtagggaagtatggaggtgataggaagggagaggcctgagaggagctagtttggggagatctcaagtatcccaaaggagccactgatgttccaaattatccttggtaaagtcacatcaacaaggaaggaagcagacagaggcgcacttgttccttgcagttttgttttgatgtgctgattaaagtagcgcagagggcatgatcagcagggctccagtaagacgctcccacgggaggagcaagaacacagaacagagggggcaagacagctccaccaggagtcaggagtgaatcccctctgggaacgaggcactaggaagaagaacttccagcccaggaggtaggtagcgttcagaagaagcctggggcgggcgcggtggcgcacgcctgtaatcccagcactttgggaggccgaggcgggcgaatcacgaggtcaggagatcaagaccatcctggctaacacggtgaaaccccatctctactaaaaatacaaaaaattagccgggcgttgtggtgggcacctatagtcccagctacttgggaggctgaggcaggagaatggcatgaacccgggggacggagcttgcaatgagccgagattatgccactgcactccagcctgggcgacagagcaagactctgtcccaaaaaaaaaaaaaaaaaaagcctgggactcttagcgcctcagagccttactcagaatcataaaatcattagaagcaatgtctgtcctcactgctgcatccgatattcttccggaccactggatcacaaatcaaaccatgtgactcccgcatgagcaggcagagtggagataacacggatcgctgtgtacactgtgtgctccggttgttgcatccgagggttgatcggatggtggttcccatccagatccaagtcctggcccctgatcacagagaaacacagctggacattaaagtggtgaggacggaaattataatatttggtgaccagtgacaggaggggagagagccgagctccgctccgagttgtgcaaagaagtggggagtggggaggaagaacagtggggactcagtggagtgaggaaagtggaaaattaccaaaagcaggaagggagggttagccttgggaaaccaatctgggtttgccacgggggcttactgaagtcaggcccccagtcccacagaggctgggagacaggggccccatcttcaggtgttggccagaacacaggaaattctcttggtagccatgactttctcaggcaggcgctttgaagggggctgggatcattttaggaatgtggccttgagctgttagaagccatgtgcagtatggcttacacctgtaatcccagcactttgggaggctgaggctggagaatcacttgaggccaggagtttaagaccagcctgggcaacatagcaagacgctgtctctacaaaaataatttttaaaaaattagccaggcactgcggcatgcccctgtgtagtcccagttactcaggaggctgaagcaggaggactgctggagcccaagagttcaaggttgcagcaagctgattgcaccactgcactccagcctgggcggcagaggtgatcacgccactgcactcccgcctgggcgacagagcaagaccctgtctttaaaaacaaaaaggccaggcaggtgcggtggctcatgcctgtaatcccagcactttgggaggccaaggcgggcggatcatgaggtcaggagatcgagaccatcctggctaacatggtgaaaccccgtctctaccaaaaacacaaaaaagttagccgggcgtggtggcgggcgcctgtagtcccagctactgggaggctgaggcaggagaatgccatgaacccgggggatggagcttgcagtgagccgagattgcgccactgcactctagcctgggagacagagcaagactccgtctcaaaacaaaacaaaacaacaacaaaaaaaaaacagccgagcgcagtggctcacgcctgtaatcccagcactttgggaggccgaggtgggcagatcacaaggtcaggagttcaagaccagcctgaccaacatggtgaaaccttgtctctactaaaaatacaaaaattagctaggcgtggtggtgtgagcctataatcccagctactcaggaggctgaggcaggagaatcgcttgaacccaggaggcggaggttgcagtgagccgagatcgcgccactgcactccagtctgtgtgacagagtgacagcccgtctcaaaaaataaataaataaataaataaataaataaataaataaataaataaataaataaaatgaagcagcagcagctttgttagtgtttgttcaaggcctgataggccaaggtgaggctcagccgagaaacgtgctcagaggagcctggccggagtgtgatgggggagtctttgtccaggctgctgccacggtgggcctcaggactcatggcctgggcgctgggggtggggctgccactcagccttgaggagagcaatgaggaggtcagattccactcacatccagtgcggtctggatgcaggcctggcccagagcctggtccagatgctggggctttgtttttttgttgttgtttttttgagacagagtctcgctctgttgcccaggctggagtgcagtggcactatctccactcactgcaacaacctccacctccacggttcaagcgattctcctgcctcagcctcccgagtagctgggactacaggcacccgccaccatgcccggctcattttttgcatttttagtggaaacagagtttcaccatgttggccaggatggtctccaactccagaccttgtgatctgcctgcctcagcctcccaaagtgctgggattacaggcgtgagccactgcacccagccggctttgtttacagtactcagcagctgccaaaatagtccccattcccaggcagggcaggctcccgggctcagtccagcggggcagatggccagcctgcacgtcaccccactaggcatgtccaggccctttctgcccctccctaaaggcacccctgtcctttctgtcccctccacactgagccaagccagcctccactcttgccccaggcctgccctctgctgggagccgggacactgagctcctgccacatgagcaggttgacctgcagggggcctccaagcaggtgccaaggcagaatcggatgtgaccaggagaacacccttgaaggataaagcgaatgtgcgaccaccatgcaggtctggcccatggaagggaggggagggggccccgacggggccacagtaaaggagtggaggggccccacaggcagggatggcccagctggccccctggggctgtgaatctgcaggtgcagtgcagcctcttgcctctctcagcccagcccttgcatctgcctcttggtgtgtctgtgaagacaaagtcaccgtggtccctgcagcacctggcttgaagcaggtgtgcagtccgtgtgaaagccttccctttagctattaggtattgagtcaaaaaaaaaaaaagccttcccctgagcctgggggcctggccccactgaggataccaggcgggggaggctacaggaggctgccctctgcctggccatctgaccttccattctgaccccttcccttccacaccagcccctttccctatgtagggtgcagtctttgttgcaactgctcacctctgccatggtcggatgagagcagccacggacaatgtctgtgcaattgtgcgttttttgttttgttttgttttgagatggagtcccactcttgttgcccaggctggagtgtaatggcaccatctcggctcactgcaacctccacctcccgagttctagcgattctcctgcctcagcctcccaagtagctgggattacaggcatgcatcaccatgtctggctaattgtgtatttttaatagagactggggtttcaccatgttggtcaggctgttcttgaactcctgacctcaggtgatccacccgcctcagcctcccaaaatgctgggattacagacgtgagccaccgtgcctggttgattgtgcgttctgataaagcttcatttacagaaatagcaggtaggcccctcgcagggtgcccagagcaggtgcactgtctcacctcttctcaggtgtcaccggggtgagaggctagtcctctgcctcctccttcctctctgcaggttggagaaatgacagcttcttgtactgggggttatgagacagtggcaggagggggacactcccagagtgctgccagaaagaggcgaggccccatctggatttgatggcatttttattgtggtgttgttttagagacagtgtctgtcgcccaggatggacgacatggtgcaatcatggctcactccagcctccaactcctgggcccaagcaatcctcccacttcagcctcctgagtagctgcagctataggcacaccaccatgcctggctcaatgggtattttgtggccattaaacttctggtcattcctttagattcccagaggctggatggaggtgagtggccagcccctgggtccagagatgagcgcggggcctggctgcagcctgtggggtctcccaggctggcctccaggtgtcctctcagcctgtccacaggcgctgcccaagcgtgtggcctacctggtgctgcctggcctgtctctacgcacctgtactggctctccctggattactggatcgcagtcgaatcccctgccagaatcctggtccccctttatcacaccggatcagccccaaagggcagggcttcttgcagcagttccagcctttgctgggggtttccagccctgttgagcaagccccaggtagggccctctgcagcccccgtgggggacctgtgtgccgagcagagctgccccgtgtgtaaacgcttagaactggcctccttcctgccatctgtgtcctgtttgtcatcacgcctgtggctctatgcttgtctccccgactgggccaccagccctgtgagggcaggatgaggcacgtccaagccacagtggctctcagtgtgcagggtgctgttagcattggttctgtgttctggaatagtgagaacagtgtgccccaaatggccagtggcctttccgagggtcactgcagccgcatgttggccctctgtggagaacggaggatgcacagccatttcagagcacaacctgaggtctcctgagcttgctgtgcagcccagtctttctctccgtggcccctggtagctgtctttctcccaggaggaggagaaagacaccttcctgagcaggaggatgtgggtgaatagagaccaaagtgtcaatcactcttctgacagaggtgatagcagaatgaaaaactgatggaccccagatctttgcaaagagaacaaagtcagtttctagttatctttctttcttttttttctttttttctttttttttttttttttttttttttgagatggagtctcgctctgctgcccaggctggagtgcagtggtgtgatctcagctcactgcaaccgcctcccgggttcaagtgattctcctgcctcagcctcctgagtaaccaggactacaggcacacaccaccacgcccagctaatttttgttatttttagcagagacagggtttcaccatgttggccaggatggtcttgagctctcttttttttttttttttttttttttgagacggagtctcgctctgtcacccaggctggagtgcaatggagtgatcttagctccctgcaacctctgcctcccaggttcaggctattctcctgcctcagcctcctgagtagctgggactaacaggtgcttgccaccaagcctggctaatttttgtatttttagtagagacagggtttcaccatattggccaggctgatctcgaaatcctgaccttgtggtctgcccgccttggcctcccaaagtgctgggattacaggcgtaagccaccacaccaggcccattttctagttatcttttacggattttttaaaatgagcctagaaaccaggtcatataattagtttattttttaatttcttatagagacagggtcttactatgttgcccagagtggtcctgaacgcctgggctcaagtgatcctcctgcctcagcctcccaaagtattgggattacaggtgtggccactgttccagccatagttcatattttaaaggatttttaagagtctcatttcactgatgttacttgcagtatatttatggaaaacattcctgtcttttttttttttttgagacggagtctcactctgttacccaggctggagtgcagtggcgtgatctcggctcactgcaagctccgcctctggggttcacgccattctcctgcctcagcctcccgagtagctgggactacaggtgcctgccaccacacccggccaattttttgtatttttagtagagacagggtttcactgtgttagccaggatggtctcgatctcctgacctcgtgatctgcccgccccggcctcccaaagtgctgggattacaggcatgagccaccgcgcccggccagcattcctgtcttttaaagaaagatgagaccagatgcagtggtgtgcacctgtggtcccagctactcaggaggatgccttgagcctgggagttcaaggctgcagctgcagtgagccttgatcacgccactgcactccagcctgggcaattgaacaggaccctgtctctaaagaaataaaataaaggcagatgaatgtcatctagggtgtgtccaatgtgagagagaatactgaccaggtgacagaggtgatggactctctagctctgcagcagactgctgggcagagaagcttgggcaggcctggcactgaggcccagaagcttcatgctctttagagccagaggtgtcaagcccagctgcctgtgtcctggccgcactgtgaggcactgaggatgccctcacacgtgcatctgcatgtggcgtgcatgtggcaagcatgtgcaggtgctgtgtgggcacgatcatgcctgccctctactgtgctggagaggtaagaccatcagccgtttcacagaggagggaatgtggacctcacgggggtctcatgagcttgcgagccgatggccaggcagccggtgcagaaggttcatccattttgatgaaccgtgaattcatctgtactttattcattttaataactgaatcatacctcattgtatggctctaccatgttttattatccattcaggtgctaacggatggaagggttgtttctacctgttggccattgtggatgatgttgctatgcatattggggtacgagtatctggtttagtccctgttttcaattcttggtatacacctaggagtagaattgctgggtcatatggtagttctattttaacttttttttatttttaatttttgtgggtttttaagaattttttaatatttgtgggtgcatagcatgtttaattttttttttttttttgagacggggtcttgctctgttgcccaggctggagtgcagtggcaggatcacagccctgtgcagcctcaacctcctgggctcaggtgatcctcccgcctcagcctcccaagtatctgggactacacgtgcggaccaccacgcctggctaatttttaagttttttgtagagatggggtcttgccatgtttcccagactggtatgggactcctgggctcaagcaatcctcccatcccaacctcccaaagtgctggaattacagtcatgagccaccaggtctgaccacatgtttaactttttgaagaactaccaaactgttttccacggcattcacaccagcaatgcaagagggttcccatttcatcacatccttgctaacacttgttattttccttaaaaaaaaaaaaaaaaaaaagccagctgggcacggtggctcatgcatgtaatcccagcactttggaaggccaagggggtggagcacttgagctcaggagactagcctgggcaaaatatcgagaccccacctccactccatctctaccaaaaaaaaaaaaaaaaaaaagctgggtgtgcggtggtgcacatctgtcgtcccagctacttgggggggctgaggcaggaggatcccttgagcccaggaggtcgagactgcagtgagctgcgaccgcgccactgcactccaggctgagcgacagagtgagaccctgtttcaaaaaaacaaaaaaaaagcacatttcaaacatacacaaaagcagagagaattcccctcggtcctccggcctgcaccccaccgccccccaccacaggggcattcaaaactgtctttttgcctctctgtaaggtaaggggggactcttgacgctccccagaccacacagccaaagtagggcgatcggatcatagggggtcccgagtcggacactgagctggcgtgcccactctcgagtcctgggaccccaaactaaaggagctgttccttttccccatggagggctgacggggcaaaatcccagggctgggaacatccgagcagctttgagtagcacaggtgggtttctacgtggctttctttaaagggaggcctgattctcggcttttcaggacccgccctccattttctcacttgcctgctctttcgtcctgcgaaactgggcagtggccggtgacagcgcagggtcagccctcggatggccaggtgggcgtgatcccaccctcctccgtggctgggtgggcgtggtcccaaagtcaattggatgtggtcccgcgtccctcccggcccagtgggcggggcctccccttctggggcctcccatcccacaccagcgagcagagaggagggtgggcggggaggccctacggggctggggcggggcggagcggaggtggttagctgtcgggaggtggggtgggcaggggccagggctctgttggtggcccggggcagccagtccctctgctcagggcttcagttcacactcacaagggaatcccagcgctcttctcctctggcggttgctggagggccttgtgaggtggccgtgggcactgtagcccccaggcactgcattgtggcctgggcgtgttggcctttgagcctttggccttgagcacttccccatcccccatggctcttggccgttggggcccagttggccgcagagcctttggccttgagcacttccccagcccccatggctcttggccattggaccccagttggccacagagccgcgggcaggtgggacaggcgggcactgggtgcctccttgcaccagccaggcccagcctgcagagtggagtgggccggtccctcctgccaggcaaaggaagggggcttcgggcccctccctgctgtggcctcctcccctctgctgcctcccactaggccctgggagacactgcctgcagatttatgaacagacagacctagagattagagattcaaaagccaaattcttacacaattcaagtattaacgcagatttggatttataatttgggactccaaggtctaccaagtaatttgctgtttcagaatagcccttttaatttggggtatatatttctaacactgttttttaaatatggagagtaaacaaaatggcccattatctgaccacacaaatactagtagtcattatagataaaccatagcagataaataatagtaaacaaagcaacaggctgtgtcataggaaatccccaccatgaagaaaggagcaaggtggaaagttctggctgcttcaggtctgcatggtccctctccaccatggttccccctgtcatcttcctgccagaataaggacactgtccttagggaagcaccatctcttgttttttccccacgagccctgtgggtcatggcacgtcctgccccgctgggaaacacagtgggccacgggtttccctgcaggcctgggacccttcccaagggtagcagcagaaggcagcacgattcccactcctgcagctgtggacaggggcacccccactgtcactgagccctgcaccgggttccatcacctgctcggggctctggcctttggccttttcctgtgagctgcatgttggccactgtgacctatctgtctcatcatctttttcttactggtttgtgtatgttcttggtaaactagcccttggtcttacacatcatttccaaggtactaaggactcttcaggggaaatacaacttgagcagagtggttccctcctcttgtggttcacaaggtgcaggtgcacacacacatagcccacagggcagtgtggacagggaccaggagactgcccctggggtccctggctgggggacactagtagggatgtcccttggcctctctgaggccttctgctgtctcttctgaggccggaaaggcgaagcactgccctcgccctgctagggaaggctcaggccaggctggccctatccggggaaggggctcaggtatctggaccttggtcatcgccaggttagggtttatgttgatgattatccaaaggcaaaattgatttccacagaaataacatctgctttgctgccgagctcagaggagaccccagacccctcccgcagccagagggctggagcctgctcagaggtgctttgaaggtgagttggccaacggaagccggggcagtgccagggtgggtacagattccggcccggtgcatgggcacaggtctgctgagcacatgtccactctgcctgtgtaaataggccacatggcctgaaatcccctagaagcctggtgtccgcatgacctccccctagggcggagcctctgcttccctgttctcttctgctctgtcctctggtgccctgaggctggcctccaggggtgtcccctctgtggccctaggcctgcctccttgcctgggtgtgcctttctaaaatggagcgtccagcagagagtgggatctcctatgccactgggagcccagggccccatcccagaaagacctctgagtgagcacaggggccctagaagaagtttccttgtgtccttcccgttttagggtctgtgacctgaacccctgggcttctgcctcaggcctcctgtgctctgctctctgcctgctgggtcccctcaccaggcttctgtctggttcccaggctacctgcctggagggtcacaccaggaggatttcaaacaggtttcaagtggggtcacttgccatcactgtgccccacgaggtacactgttgtgggcggcagggctggcctttctcatctgggacatgccacgttgctgttcccaaggggagtggtgagtgggtctgtcctggtgtgcctggcctggggactgccagtgtccttacttggacactcaatgaaaaggccacatgaatccctggggcgtccagagcatgggtgaccagcacgggctcaccacatgaggccaaggggctgcaccatacagcctctcctttggccacccgtgactacccccaactccgggccatggggcttccctacccctgggtgtcctctaagccagctgggagacaacagcctgagtccgtgtctgcttctgtattttgtgtggttttagaggatccctgggctgcctggggaagcacccagggccagggagtgtgaccctgcaggctccacacaggactgccagaggcacacacctgctctgtctacccgagggcaccagagggcacgagaaggctggctccctggcgctgacacgtcaggcaactgaggcacaaggctggcatttctgaaccttgcccctctgcaaacacaagggggcgatggtggcactccaagcaaaggggcgtgtgggtgctgcaggaggagcacagagcactggcgcccctcccctcccgccctgcagatgccggaggccccgcctctgctgttggcagctgtgttgctgggcctggtgctgctggtggtgctgctgctgcttctgaggcactggggctggggcctgtgccttatcggctggaacgagttcatcctgcagcccatccacaacctgctcatgggtgacaccaaggagcagcgcatcctgaaccacgtgctgcagcatgcggagcccgggaacgcacagagcgtgctggaggccattgacacctactgcgagcagaaggagtgggccatgaacgtgggcgacaagaaaggtggggtccgggccagcaggtgctcagctctgggacagggacccaggaccaggcatcaaagcccttacaggagaagctgttatcaccccatttccagggggctgggaaccctgggatatgcccagatagggctggggggctcctctggagtcccagggtgccagggtccctgatgacccctgcaggccctgctgcctgctgccccaggacaacaggcccccacactcacagggtctgacggtggtgcagttccccttgaactctgttctggccaccatgggacctgcctggggaccagtcagacaggttctcctgggcccgcctcccgcttgaacttcagcctggggcacaggatgtgttaccgggctcacggagtgactcagggaactagtgccgccccagggccccaaggtgggcggttcggtgattcagagagggcagctctgtgttaggacacactggggccagccaggaagggtggaaaagatagggaccagcgtgagcatagaggctaagggaccatgggagctccaagcgcgctcacagtggggaccaggtcctgggggctggggacaccagggaggtgaaatacccctccagcgggtagggagggtgggcagaggagggccagcggccaggcatttgggaggggctcctgctctttgggagaggtggggggccgtgcctggggatccaagttcccctctctccacctgtgctcacctctcctccgtccccaaccctgcacaggcaagatcgtggacgccgtgattcaggagcaccagccctccgtgctgctggagctgggggcctactgtggctactcagctgtgcgcatggcccgcctgctgtcaccaggggcgaggctcatcaccatcgagatcaaccccgactgtgccgccatcacccagcggatggtggatttcgctggcgtgaaggacaaggtgtgcatgcctgacccgttgtcagacctggaaaaagggccggctgtgggcagggagggcatgcgcactttgtcctccccaccaggtgttcacaccacgttcactgaaaacccactatcaccaggcccctcagtgcttcccagcctggggctgaggaaagacccccccagcagctcagtgagggtctcacagctctgggtaaactgccaaggtggcaccaggaggggcagggacagagtggggccttgtcatcccagaaccctaaagaaaactgatgaatgcttgtatgggtgtgtaaagatggcctcctgtctgtgtgggcgtgggcactgacaggcgctgttgtataggtgtgtagggatggcctcctgtctgtgaggacgtgggcactgacaggcgctgttccaggtcacccttgtggttggagcgtcccaggacatcatcccccagctgaagaagaagtatgatgtggacacactggacatggtcttcctcgaccactggaaggaccggtacctgccggacacgcttctcttggaggtgagccccaaccaggatggcatccgtgccagctgctgcccagagcccattcagtcagcctcagcctctccaaagagccaggcattccagtagagccctgtgtggacacagctcgctctggaggcaccacctgaggtctgggagtgtgggggactgaggaggccctgtggtgggtggagatgggtggggagctgggccaggggcctggctgggtggcctgttgggaactggggagccagctgcctgtgcaggtgcaaaatgggtggcagaagtggggtgcacaccccagaccagacaccagggcagaaacggcacaggaccaaggagatggggtggggaagggccgctctgggcccagcctgctctcccccaagcaagccactgctcgtgcaaagaaagcatgtgtctcctgcagatcttcctcctgaggccccatcttgtgcattcccccaacccagccccactggcgaggaccctgagtgccccgagtgaggctagacagcgggtggggctgtcctcgcttccctggggggcgtggggcactggtggcccttcacagactgatgcttaaggagcctcacatcagtgacacactgccccatccctccctggtggtcagcgacactgagtggctctgtgatcctccactgggcttgggacacccaccctcacggcctccccacctggtgctcgctcacctgcagctctcccagaaactggacactgctgttagcagccggactaggagcacgaggggcacagcccccatgcctggctaggtagggccgctggaccctggacacggattggaaggaaccagcactagcagaagcctgaggtgtgaaagggcagagaatgttccaggaacaatgggagtcagggcacacaggactttgggcaggtgaggatgaggttagacctgtcttctggagctgggctcaggggctcatgcctgtaacccttgcactttgggaggctacggcaggaggagcgcttgaggccaggagagttcgagaccagcctgggcaacatggcaaaagaaaaaatatatatatatattttagatggagtcttgctctgtcaccaggctggagtgcagtggcacgatcacggctcactgcaacctccacctcttgggttcaagcgattaccctgccttagcctcctgagtagctgggactacaggcgcgcgctgccacacccggctagttttttgtagtttagtagagatggggtttcaccacattggccaggatggtctcaatatcctgacttcgtgatccgcccgcctcggcctcccaaagtgctgggattacaggcgtgagccactgcgtccggccgtattccagctttcaaaacaacaaaaaacaacaaaaacttttctggaaagatccctgtcagccttgtggagtgtggagagggctgtggggagggcatttcagatgccctgaactcacgaggaggcactgaaccctggccgtggagagggaggacctgtagtggccaagggggtgggcattgggagggtgggagggagacctacaggccaagacagggtagctggaggggggctcacccctgacaaaggagcatgatgctggcaattgggtattgatggcagagagctggcactcagccagatgggcttcacttgggcaggaaagacacccacagctgggcctgcgttactgcggccgagtttcagcagctgtgatgtgggtgctaattacaggggcctgccttcatagaaaagtagcaaacattgcagtttagtaactaggaaactaatagttttctcagtgctgcttgcgcaaagctggtaattatctcaaaagaagcaaagtcatgaagtgggaagtcatgaattgggaatgggtgtccttgttaaacgcacatctgcacactcagggctggggccctgtgcccccttgtggagggttaggggacaacctggctcttgtgagggtctagccatcccctcagtgggttctgtgagcatcggaggcacgaggggtgaggggctcaggagcaggttgcaattcaaaatcaagggctgctttgaggaggcctctccaccgggctgctgtagtcaccaagtccagcccatgcccaaaggaagaggaatgagttcccccttaaaaaaaaaaaaaaaaaaagaaaaagacagagtcttgctctgtgcccaggctggagtgcagtgatgacatcatagctcactgtagcctcaaactcctgagctccagtgatcctcccacctcagcctcctgagtagctaggactaaaggcatgcaccactacacctggctaatttaaaaattttttgtagaaatggggtctccctatgttgcccagactggtctcaaactcctggcctcaagcgatcctcttgcctcaacctcccaaagtgctgggagtacaggtgtgtgcttggtctgaggctccaactttttgttgttgtttctcgagacagtctctcgctctgtcgcccaggctggagtgcagtggcgcgatcttggctccctgcaacctctgtgaggctccaactcttgaagggaggagagtctaaggagggtgggccagatgaaaaccacctcagcatagtgtcacctgctcctctgacactgtcgcttctccacggcattagattttcagtcctgctcagacgctgatgcatgtttagccagttctccaggtggtctgagtagctggtaggaggcttgcagtgtcgggcgacaggcaggacaggtgctgccttctttcccctcttgaccagtttcgtaaaggagtgggcccctggcagcctccaaaggtgacccatgctcctttctgcccttccctccttctttcctgtttaactcgtgcaggtgcagtggtctggtgtctttcagtccgctgacgtcttctgtatccctgatgaccagattgggctcctgagtcccctggcgcaacccgagaagtccaggagcccaggcccctcactcatgcattccctggcccagactggaaggcagccgccctgctcaaggcctaggccattgtcctcctcccgggtggcgctttgttctacgtcttttcagctgacattgctaggacatttttttttttttctaaatgaaaacacatcatgattcatggtggtacttcctgctcaactccggaccttggggctgtcccctgacctcactgaccttgcagccgtgtggtgtccatactgtcacatgaaagccccctgctttctctgcagcatacaggctggaaacgaccgccacccaccaccaggacagctgcaagccctgtgggactctccaggcccatcccagaggcatgtggggtcggataccagtgtttcaaggcacctgcctgcaaattgattttattatactttagatgtttgagattgcttgttaacttttgtttggtgactaagtcaaatttccaagacaaggtgactggggtgtcccttgccctggtaggtccttcctccccataggcaaacacttcctctcaaggtttcttgtttatgtgatgtaagcaaacccttttctgatagcatagataggcaagcatcctatgaggtttctcccgatagtggaccccacgggccatgccctatggctgcgtgtccagtaacaactccttccttctgcacagaacccaggcagaggaactctgtgtcctcccagggcccaggcactggtgaagatggggggtctgcaaatgcaggagcttggggatgtccagaactgaccccaaggggcaggcttgttgatgggaggtctgccccacctcagccctgcagggtcaccctggtcaggccaatattgtctccagggaccataccagcaacccctctccttgggtgcctctccctcataggcctgagttcctggcactgggtgttgagggccccattgtttccactcacccagctagcatttattgagcacctactgtgtgccacatgctgttctaagggatggatactcctgagatggatacaggagttgatgagagaaaggtccctgtcctcacggggcccatgttctgaaggtggcacccaagtcttgtacagtcctttcctgcaggagtcacgctgggcagaaagtggaaacctggccccaggggctaggcacaggcgtggtgccgtggcctagtgaggagcacccatcctggtttggggcaggttctctgggcacctctgaccctcacctcccccaccccccggtctgtttgcaggaatgtggcctgctgcggaaggggacagtgctactggctgacaacgtgatctgcccaggtgcgccagacttcctagcacacgtgcgcgggagcagctgctttgagtgcacacactaccaatcgttcctggaatacagggaggtggtggacggcctggagaaggccatctacaagggcccaggcagcgaagcagggccctgactgcccccccggcccccctctcgggctctctcacccagcctggtactgaaggtgccagacgtgctcctgctgaccttctgcggctccgggctgtgtcctaaatgcaaagcacacctcggccgaggcctgcgccctgacatgctaacctctctgaactgcaacactggattgttcttttttaagactcaatcatgacttctttactaacactggctagctatattatcttatatactaatatcatgttttaaaaatataaaatagaaattaa

SEQ ID NO: 37074 - DNA, 27222 bp, Homo sapiens; identical to SEQ ID NO: 37073

SEQ ID NO: 37075 - DNA, 9219 bp, Homo sapiens
aactccagggctagtgagctggaccggaagtaggtttctacccgaccgcattttacgtggtgctgcatttccggtagcggcggcgggaaatcggctgtgggagagaggctaggcctctgaggaggcgaatccggcgggtatcagagccatcagaaccgccaccatggtaaggagggcacaggctggcggcgcgggagcttccgagtctgttgtggagtgggaaccgcgactgatcggggaggaagccgtgggttggagccacttagggcggtgaaggcctgggccgaggccgctcggtctgggcgggaaagaccaggaccttggcggttcggctaggcatggggtcgaggaaaaggttggaaccggtgtcggaggccgaggtcgctcggcaggggcgagggtagaaccgcggctctcgacaccgctgtagccataattcctgggacccagtaggcactaagttaacttttgccgaataaatatatgtcccgggcttcggagcaggcactggagccgcagggggacccggtaaaaggctcagacttgcggaagtttgtgagtctgagaaagagttggcggaagtgggtggaaggggctcgtggaccacgctagagtctcgctaggtctgctggatggagaggagggcggaggagggtgatggcgaatggaggaagagctccactcagttgctcatcacgtttccgtgtttgcctgtgcctgacttctcaggcgctggggctactctctgaaatatgtttgcttccttcacagaggtagctggggacacataatataattcagtgtggtcattcggtaaaagtaacggcagcggggcggggtaagaatgttttctcaaatagatggttcctgagcagattcctaaaagattagcaagaatgttcccggcgaaaatggggggaatattacagacccggagaactgaaggaacaaaggctgaagggtaacaagatttaaaaagttactggatttttctgcgtttgttgactgagaaaaagttgctggaggagaaaggaagaaagaagggaagacgggaagaattggcaggaggctagttactaaaggccttgcatgttaattttacctcagtggtggtgaggcatgtcattgaaggatttaatttaatttatttttatttttttgagacggagttttgcttttgttgcccaggctggagtgcggtggatcgatcagggttcactgcaaactccacctcccgggttcaagcgattctcctgcctcagcctcccaagtagctgggattgtaggtacccgccaccacacttggctaattttttgtatttttagtagagacggggtttcaccatgttggccagactggtctcgaactcctgacctcagttaatccacccaccttggcctcccaaagtgctgggattacagccgtgagccaccacaccctgcccactgaaggattttaaccagcaaaatgacataagcttagtggtgtttagaaagattgctctagctctggcatgtatattcgatgggactggaagcagggaaacctggtaggatattgtttggataactggttagaataggcgctggattcattttgtctaggttccaacacagcttcccagctgtgaaactgggcaagttacttaacctctcctagcctcagtgacctcatctgtaaaatagggataataatgggcccaattttggggattaaatgagatgtactgtgcttatcacagtgccagatacacagtgagcacccagtaaacattagttgagctggaccagtgaatgttgccctaaaggttcagatcccttgtggttagaagctggttaaaatggtcattgaatggaaactgaaccacctaacctgagggaggctcgcagtatctttgtgtggagtcaagttttgtttttgtttttttgagatggagtctttccctgtcacccaggctggagtgcagtggcatgatctcagttcactgcagcctccacctcccaggttcaagcgattctcccatctcagtctcccgagtagctgggattacaggcacctgccaccacgtgtggctaatttttgtaattttagtagagacggggcttcgccatgttagccaggctggtcttgaactcctgacctaaggtgttctgcccacctcggcctcccaaaatgccgggattgcaggagtgagccactgagcccggccatggagtcaaggttttgatctgcatatttgcaggttcagaactttgttgtctgagctcacagagatgaacagatgtccatagaaggcacttggtgggttaggacttgggtatagcagtcagactgatgggaggatgatatacagatcaaatgccaggtgatttgtttatagagagaaatacaactgcttagggtacctgacagttcacaaagtgatacctatatagtcacttctttattttagcacattggaacccaggttatgaaagcagaaatgtttgttgggttaaagaccattatatgtccaaactggttagcaccctaaccatcagaagtttccctctgccaaatatagtcttggaggcacactaacaaattcttgatatgtggatttcatttttcaccttgaagctgatctccttcctgataacaagcttcttgttgattagatttttagtttcagccctattctagctcttcctttactcagtgtttttaatgagatttgaatgttccatagcacttgagtcacatatctataatctgcacactggtagatggctctagtatgtatgcattggattattttggggacaccctatactctcatccctgcaactgacacgacaaggagaaaggcaattataatatgagaaagaccgatttcaagggaagagagaatagcagattactgggtagaggtcagggctaaaacagggtggcatgggagaattcctaggaaaaggctgtgggtgggagactgagctaagaatctgttgagaaagttggacacatggacaagaacgccatgggaagttttggggagggccagaggtgcttgggtccaaaagagcagagtctcatccctgtccatttctccttgcagacggtgggcaagagcagcaagatgctgcagcatattgattacaggatgaggtgcatcctgcaggacggccggatcttcattggcaccttcaaggcttttgacaagcacatgaatttgatcctctgtgactgtgatgagttcagaaagatcaagtgaggagtggactgtggggggcggagactggaggatgggaatggattgagtgggtgggccaagcaatagaggtggtgatgtagctagttggttcttctctgtttattctccagttttagagggcagacttaaatggggacattgaacgctaagaaatctttttgagtccagcaaaccttgctctctagtctagcaaagtacaagttgtgaagggctgctaggctttttgtttctctcactttgcgtgcccctgggtactggggtaaagggctctcatgttctccccacaggtgtgtgaggggggagagcttgagtttctggcctcattgcctatttgtaaagctgtagcctaaagggctctcccaatgcagcctggtctgaaactgctttaagaagcctctgaccctcttcagggtaagtgctcagctccccatgtgggtttggggccagtgatttttgttggcatttatacaaacaattggagatattgtctactttgctacaattccgtaagttattggctaactcccttgccttgagtctcacagatcttaagcttttggcccattaaaagatatgatttagcttcccatcatgttttacattcaaggctacttgaggcacaaaaagatgatgtgacttccgtggccagcagctcttttgtcatatgcagtgtccatattattctgtcactcactttgaattccctttgattctccttggggctgatttcttctgtgacccaaggtcaagaagtatagtttaaaaatgtggtagggatgccttggtgccaggtacgtattagagaggggccaacagatgagcgtggagctactccaaagttccctcctgattataaaaaatgtttattggaaaatatttttgaaaatacaaagaagtctatgaatagaaactaaaataccccgaagggtttttttctaattatgaaaggacaatacatggttattattttaaaaaataagaaaatgtgagccaaaaaagggaaaaactgtccatccacagacaaccagttaatatactgtaaaatatcaaaacaaaatcttttgagttctttttttaaatcaggctattttttcccctttatttttaggatctagctttagcttttttccccactttcctatcctgttgcagttatttttcctacttcacatttatattttgttcatctttttctggttgttgctttttgggggtttctgtttttatgcttttgaggaacagatatgaaatttcaatttctgtgtatgtgaaatttctcttaaccttttccttctatggcttctcctatttctgatgtaagatgaggggcagaattataggcctgtgaggttgaattgatattagaaggacactgcacgtaagtgaggtgggtgggagtcatttgattggaattgtttaggcagcctcctgatgttggcaagaccttaagctgaagggagggaatagggtcctaagaaagaagacttggctgagggaagggccttcacggttgctgtggaatagcatttgggcccgggctgggctttgttgaccttgtcctatctcttggtcagtgtgtcctcttggcatggtaggaaacaggtagatagccacctaagaggttatgtgttcagcctgtagagactatccaggagggctatcttgggaaagtttgtgtactgtttgttaggagatgcagtataagcaaatcttggaggccactaggcaggtgaactttacccacctctaacactttttttgttccttctaaacctctctttaggccaaagaactccaaacaagcagaaagggaagagaagcgagtcctcggtctggtgctgctgcgaggggagaatctggtctcaatgacagtagagggacctcctcccaaagatgtaagtcagagcaggaagccttgtggaggaggggaggccctactgtgagccaggctctgtgttagattctgtttcattgcagttctcacaggcatcctctggattttgccccctttttcagataataaatgaaatcttaaagaggttaccctgcaagaggccgggcgcggtggctcacatctgtaatcccagctctcagggaggcaagaggcgggaggatagcttgagcccaggagttcgagacctgcctgggcaatatagcgagaccccattctccagaaaaaggaagaaaaaaaaaaagacaaaaaaaaaaaaaagaggttaccctgcaagaaagaagtggaaaaggggaactagaatttgggtatctcagactttaaagctctacctgtttctcagttgatgtacatagtgagtcagtggaggaagcacctgaagccatctgggtcagttcttaatgtgacgacaaagcctaggtagaccttaaaaagttgtaactccgaaacaataggaaatgtgtgtattttgttttgtacagttacagttcatagttactgagaatctaccttgcgccaaccacttcagtattttatttgatcctttaggtctctttagagataaattctcatcttataaatagaataaaccagggcttagtaacttgcccaaggtgccacagccactaagtggtgaaactgacatttgatctcagacagtcttgattctgtaaacaccaagctacacatagaaatagagcaggctttagagacctagtcaaatttgttttccctttccctttttcatttgaagggttttttttttttttttttttagatttttagatggagtctcgctctgtcgccaggctggagtgcagtggcacgatcttggcttattgcaacctctgcctcccgggttcaagtgattctcctgcctcagcctcccgagtagcggggattacagatgtgagccaccacgccctgccaagacgttattttaatcaaaagagaataatccttttaactttttaaaaatccacatatattatctggatttttttgtacttaacacatagtgggcatatattatgttgttctgtgttttcacttaatgttaacatttttctagttgctcaacacttttaaagtcaagttaatgactgagattttctcaaatgagtacagagtagtttatcctaatcattttcttttttggagatttttacgtttttgccttttccagttaaaaatgtctgcaagggatgttagcatatcttggttcaaagtccatgtacatattcaaatctcttagtacctacttccagtagaattggctggtctaacataacccatcataaacctttgtgatcacaaccagttgtaccataaccatgtcatttgcagataaggcaactcagcccgggattgtgggattatttgtccattgtcacctagcggattagaatcagctgggaatggatctcatgtccctttaatgccttgcctgctgaaccctgagtggaaccctggccctttgctcttggtttaactttcacaggagtgcatataggtggttgagttgtggcatgtttctctagacttactcttaagttctaccctgcttcagggataactcatagtcttggatggaggaagaatggtgttggcacacatggagaggtagtatttataagctatttcgatagtatttataagctatttcgaggggctctcttggcaatgatattccaaagtatacttctgatcttcagatcactgggcatcagagcatatttgtttatttttcagactggtattgctcgagttccacttgctggagctgccgggggcccagggatcggcagggctgctggcagaggaatcccagctggggttcccatgccccaggctcctgcaggacttgctgggccagtccgtggggttggcgggccatcccaacaggtgaggagttggggaaagggtaccacctcctggtggctaaaataaaggataaaggggagggtccatagttttaaaagggtccagagtgaccaacctgtgattgtcagactatcagtgtttcactgtggtttatacatggccctagaagcaagtgaaaaggataagttgccattgtaaattatgttgatgctattaaagagatgtacgaattagccaactgtatttaaggaaaatatttccatgacagcatttgaaatcatgagtcatatttgaaaatgcagttgccttctctcacttggattggacatgcttacattcaggtctagaagatgggagttgggcattcaagcttgatctttcccgacatgtggttttggatgggaagtctggtgctgagagttgtagcattaagggatttggtgtctgttatttcccactgtccttccccaagttggggaggagagtgggaagctgcattgtactgtactcttctaactctttcttcttatgtcctcttaggtgatgaccccacaaggaagaggtactgttgcagccgctgcagctgctgccacagccagtattgccggggctccaacccagtacccacctggccgtgggggtcctcccccacctatgggccgaggagcaccccctccaggtgaggagcccataaggagaccagtgctaattgatagaagatgccttagctggattaatgatgagatataaccttgactgaagctgatgatgagtttgtataattaagcaggattactctgagatccagcgtggctgactgatgagactaggtggacaagagccattgggagccctgggtgttaggctcaaatgtcagttttctgggagctgctgagagggtggaatggtccatctatctcagaacttggtggaaagctttgtagtttttttgctaccttttcaagatagacacttgagctatattcttggggcttttctcttgcaggcatgatgggcccacctcctggtatgagacctcctatgggtcccccaatggggatcccccctggaagagggactccaatgggcatgccccctccgggaatgcggcctcctccccctgggatgcgaggtaagtgcctgcagtggtgactttggcttctttccctagagcctagtgggataggaaatggagggaagattgcatttagatcatatcccatgggctttcaagccttaaatctagggaaatccagaaaggaaagagaagagggaacatttcttaaattgggcttacctcccctcttagaaaagttagagcagccatgcacccagggtgtttctcaatatctaaggcagcggcctcaggacacaatgaaataatgcattctgaggatccctaacagaagttatgagattgtcttatgctctttggtttgacagtgcctagtaattaagagggggctctgggctttgctgtactattatggatttctctttaacttcagttggagaaattctgagatcagtccccacatggatgagaaaataggcccccagggagtttggactccaagcccagtgttctttccctataagataacccatgggcaaacttggtgacccctgtttctctagtctggattattcctctatgggtttttatagacataggaacccagtcagcctcagagtagtccctagttagcacatatgccatgtatacccctctcctcactcgattactgcagggcgtgggaggctggggcagggttggggattcaagttgcagatcaggcactgactaaacttcttactcttacttcaggccttctttgacccttggccacagagtatggaagtagctccgcagaggcgtgggctcgattcctcagggccacgttaccacagacctgtttgtttcttatgctgttgttcgtggagtctcatgggattgtctggtttcccttacagggccccctcccccgggaatgcgcccaccaaggccctagactcatcttggccctcctcagctccctgcctgtttcccgtaaggctgtacatagtccttttatctccttgtggcctatgaaactggtttataataaactcttaagagaacattataattgc

SEQ ID NO: 37076 - DNA, 11763 bp, Homo sapiens
gtggagggggcagttgggcggggataggccgtcctagctaaggtggtaaaggccaataactcttcaggctgcctctcctcgaaaagtcatcttctcgcgaacctttaaaatgccttcctccccaagcacctcaagggactagaactgagtgcttcatttgtcttttttcctccttgcaaaagtcccgtttgccaccatggggatgtaccaagtgagaccgagtagggggaacgagtggtgattgacgcgccaggttactggccactgctcacctaggcgctagcaaacttctgccaagatcggaactgagtactaaacagcctccacagttctccctggtgccgtctccggcttggcgccgcatcctcctctgggctcgcgatggccgcgtcccctcccgctgcggacgggtcctttggtacatgcagtccgaggtgagtcccctcctttccacttcacccttccgagcgcctgcgtgcgcatgcgcggagcgcggcgcgcgcggcggttgggccgttggctgttcggccctgggatccgccgccactccgcgatcagaccgctctgtgccgcgagccgccgtgagcactcggattcaagccggcgccaacgagtccgggggcatcgcccgcagcggccaagctcatggccggctgagcgggacgccgcctccgcctcagccaccgccgccgccgccgcctcctcctcctcagccggcggcggcccgggcccagcaaccatggctgaagactactgggacgggcgcctgcggcgaacaggaggagaaggaggtcgcgcggcctcatcccgggccgccgccccaggcgccgccgcgccggccccgcggctctgaggttgctcgcgcgcccccgccggtgagcgcgtccccgaggcgtggaggctgcccctcctccttcagaacccacctcgggcggtgcccaggggtctgggctgcggggctggcaggtgcccccacccccggcgaatttcccagaatgcaccggggcggggggtcatttggggcctccctgaccttggccccgccctgggcctgtcctgggagctggggttgggtagtgctgtgggtgctaatggggacctgggggagtcaaaggaccaaagggtgtggaaatgggtgacaatggggtgaaagacttgggggggttgctgatgggggtcggagcatgtggcagtaagcctcacgccaataagtcgtgtaaggttcaaggccccgtgtgtgcttgtggaaggagggcggggtgcggagcgggtgagggacccgagggtgtataacggggggtagggtgtcgaggaagttctaagacatgctcatagggattatgtccgcagagaggcccggtgtgtgttcatgggggacagggtggcacaggtaccagaacgtgtgttggtggggtcagggctctgaggcctggtgcgtggcgatgaggccctggatggtgttaatactgcgtgtctgtccgtggggcctgcagtgtgtgagaatgcagtgtgtgcttgtggagggcaggtagctgaaggactcgagtgtggtgtgtgcgccagtgggggtcatggctgtagagggtgtatgcctgtggcctcgaaggtctaggtagtttgggacccagtatatgctaatgagggcagagtggaggaaggacctgagggtatctaacggaggaaggactgtggaatacctgagcctggcctaaaggagatgagaattgcgtgtctgtctgggcccaggaaggagtggtggggaagtgtcttagcactgtcagaggcttagtggacgaagggtaaaggtgatgtgaggtgtgagtgtgtccatggacacagggaatgtgagtctcgagggcacactaggaaggagcagggtaatagaagtactggtggttgctaatgtgggtttagagacatagaggcacttcaatgtgtgccatttcgagagtcagctgtgtgaagtctggaatatgctaataagcatcagaaccttgtgaagattgtgcccttgtgtccgcggaggaccagagtatgttgaggttccagggggtgctactcgggggtagggctgcggaggggatctagtgtgtaataagggggatcagggctttcatgaagggatctaagtgtgaaccaacaaggattatatctgtggagatatctctgagcagagagcaatagaggacaggaatgtgtgatgatctcggtgtgctaaagtggattacagctagggagggctgaagtgtgtgctaatgggagtcagggctgaatgagacctgtgtgcactaatgagggtcaggccatggtagaacagtgtgtttgtgtgtccctgcggaatagggctgagtaagggttcagggtgcactaatggggaggcaggactgtgtgaggcccggcgtgtgctaatagaaatcaggcctgagtgaagactcagtttgtgctgacagaggggacaggacagtggaaggactggaatgtgtgttaaggatggtcgtagctgtgaaggggcctgagtgtgggtaacactggttagagatctatctgtaaggttcactttatgttaatagcattcagagcagcatgaagaaggtccagtgagtgctaatgtgggtcagctatagagtaccccaagtgcatgttaatagaggtcagaatcatgtagggggaacagtacgttaatgaggggagtcagtactatggagaaggtaacaagcagctaggccagggaggggcccaagaatgtggtggcaagagttacttagaggaggctaagtgtgtgctgacagagttcagggcggtatgttatgtgttagggctttgaatgctgatgggtatatgagataatagcaggtaagatgtagtgaggcctccttgagggtctagcgtgtattaatggggatcaggacatagggtgcgatgaccaagtccttagtggttggtgtgttgagtatccttgagtatgagagtagtctgaggatgggtgtatgtctttggggatcaggaagggtcaggcaggacatgtgccttttttggggtaaggttttatgtccagtttcttgctccctccttttttgaaatctaaaaagctcattcaactgaaatgatatttaaaagtttccttgcgtataaatgttcaattatctctgttcacaggggcatgtctgagacccccatccccctttctgggagtgttatgtgatatacagattttacaccccatcttcctaaaatcccaaaaaactgaactccagagcatgtccagcccttggggtttccagttagaggtcgtggacccatggctcctcctggcttcctccccatcctccattcagccctacttccagtctcccccagcccctccactactccctgtcacaacatgcaaagcaactgggtatctgtgccatatggggacacaaggttgtctttgggagctggccatgctttaccttccttgccttaggcccagtattcagcctcccaggtcaggatgttttgtggttatcctgggttctccatggatggacctcatcctgtatctgaggtctttctgctagggtggcccctacccctcctggggatagtgagttcagccaggtgggggcgagaactgctgggggaagcacctgatttcaaggtagcagatgacccatttctctcctcaaatccagccccagtctcatcctcgacctcctatctagctctacttcccttgggcccagggccatcttaggccctgctgtgagtccagatggttcctgggtcaggtctttccccctccttgctggcccagagcccaagaggaagcagaagacggctggcctaagccttttggtggccccattcccttcagcaatccatctaggtcatcttcctgtcgatgccagcatccctgggctaccttgtttagggttgttcaatgaatagcagggactcatcacctcagcagaggttggtcctaggccctcagccccctgattcacttatttctgccataagcactttttgagcatctactctgtgtcagtcactattccaggtcctcaggatatagccgtgacctaaacacagaaatctaccctggcggagctgatcttctagttgtggcggtgaggagatagacagtaaagactaaagaaaccaataagtaggtggtgtcatttctgaggaggtaatgagtgctggggggataactggcaaggtgagggagttcgggatggttgagattttaaatagggttattcacagaggcctcatgaaaaaggtgacctttgagcaatggcccaaagggagaggggagtgagccatttcgaaatttaggggaagggtgttccaggtaccaggaacagccagtgtaaaggccccgaggtgggactctactgggtgtggttgcagaacagcaactaggaatgatggcgggggggtgtgggggtgggggggggccgtgggcaagaggcaataggggcaaatgaggtaaagaaacacctgtgggccacattgaggactggggcgtgtatttggggtgatgaaaaatgtacattcttgagtagaggagaaatgtgacttggcttgtaaaagtctagattggaccctaggggtcctaacctgatcaaaccgttctggcagccctgagaagagctggtgtacactgagacccccccgccctccacacaatcccacccagtggttgggtctgggcaggacaccctgacacacgctcccctccccccccccacctgggtagatgaatgggatgatgcagtggttgtcatgacgatgagtgctagagaagtcaggaagagggtccctgtggccacagggaatagtctgccttggcctttgagggtggtgctaggggaactatgccactctatggccgtgctcgagaccatgtcacccatccttcaattctgggcacacgccctggccgacccatggctgggcccatcactgcagctgtacctgagaagatctgcaatggagccttctgctcctgcagtggggcttttcccctagatcccaacaatccatcgttagggcccttgccctcaatcagccacctaaatctgagaactcaggtgggctacgtaggagcagggtcccagtggggctggctgtgtgggtgggcaggtactgacaaagatccccatccatgctgggtttccagaactcctgagtggctctggggtccatagtggttgagtgagcactgacaagttcatgtcagtgccccctgctaggctgtgggctttagggaacccatggtgatcaagcaaatgctaataagagacccatttccatccttgtcccttgctcagatcgccatggatcggatgaagaagatcaaacggcagctgtcaatgacactccgaggtggccgaggcatagacaagaccaatggtgcccctgagcagataggcctggatgagagtggtggtggtggcggcagtgaccctggagaggcccccacacgtgctgctcctggggaacttcgttctgcacggggcccactcagctctgcaccaggtgggtccactggctatcccctctcccatatggccccaggctgcttcccaggtgttgcctcctggtcacattcctcattttcctctaaattttctgccctttctctgccccccatgtgctctcttctcccccttccctcccatcttctctcaacaccgtctgtctatctgtccatctgcgctcctcttcttgcctttctgcccaggccccgtggtgggggacagaaggtgccttgcctgtcacagctgccccaaggctccctctgcccttctgccctctatgatggcctcctcagtcctctggtacctgcctgccctgggcctgccttcccaggacccttggcttcccctgccaccacctagctgccggctctgagctcagcttgcccttggaaggaagggttccactaggtgacttttgcttccccaccccccagttcaacctgccctagatgtacctgagcttccctgggctcaggtacatcaccctctccccgagggactccaggtttcctgtgggggccacgtgcacacatgtgtgatgatggaatatgtttcgtgggggatggggtgtcctgtggttcctgaccccacctggcctgccctacccctctccctgccaccagagattgtgcacgaggacttgaagatggggtctgatggggagagtgaccaggcttcagccacgtcctcggatgaggtgcagtctccagtgagagtgcgtatgcgcaaccatcccccacgcaagatctccactgaggtgcttgaccccgtctggatggtggaggaactggaaaagggggttggacctggggaggtggagctcatgatcctgtttctctcttgccttacctgctaggacatcaacaagcgcctatcactaccagctgacatccggctgcctgagggctacctggagaagctgaccctcaatagccccatctttgacaagcccctcagccgccgcctccgtcgtgtcagcctagtaagcaccttctgttcccgtcctctcctttttcttctctcccagacccttctcctgagccagctttaacctgcctcatttgtcccacagtctgagattggctttgggaaactggagacctacattaagctggacaaactgggcgaggtgagaggcaaataggaggcccatggtggggatgaaggtcagtgggaactcctggaatctcatagcacctctcctgtcacacttcctcacattccagggtacctatgccaccgtctacaaaggcaaaagcaagctcacagacaaccttgtggcactcaaggagatcagactggaacatgaagagggggcaccctgcaccgccatccgggaaggtacacacccccatcccatctgccccaggcttccccaacccacccctggcgcacacactccataatgagaacaaagactggttctaagaccccccaaaacactctggctttcatgggaatgcctgtcacccacatatccaggtaataatcagggtaaccaggaatctgttcccatttggataaaaggtagatgaattgcaaaccagggtttggttctgagaacacccctgaaagtgctcaccagtttatttactgtaacaatttctagtcagaatatcacatggaatgaatttgaattgcactgaaatttagtgtgcaaattcgatttcacgcgatgctgcaggcctatgtactgagggttggagccaggccccttcccagaaaccaaaaacaggttgtgaaaatctagtgtcacatgagcctggggctgcaatcccaggttcttgctccatactctcctctgagtcttattttccacatctgcaacatggagacacaactttcttctggcatgaggcgggttagagctggtggctccgaggcattaccctgaactgtctagagaaagaaagaaaacctgggcttgtccctttctagtccttgtcctcacctctgtcctgagggtaggaccctgactcttcccctgtcccactcccatgcttcctgcagtgtccctgctcaaggacctcaaacacgccaacatcgttacgctacatgacattatccacacggagaagtccctcacccttgtctttgagtacctggtaaggttgagtggcagtaggtcccagggggaggtgaggagaaggccaggagccataggaagtaaccctcattcctgtaccacctcttctttcctcaggacaaggacctgaagcagtacctggatgactgtgggaacatcatcaacatgcacaacgtgaaagtgggtgtggggcaggaagcaggggcacaagggggcccccactcacccactccaacccacaaatctcccagaaacggacttttccctttggctttttttgctaggagcccttggagggcactgggaccctgtcctcttttgtgtgacaaggctctgggcctagtgtctgtgtttgggaggggagcagtgcctgctgggggtcgggctagtggatagtctttgacctctgcctgccattcctgggtccccagctgttcctgttccagctgctccgtggcctggcctactgccaccggcagaaggtgctacaccgagacctcaagccccagaacctgctcatcaacgagaggggagagctcaagctggctgactttggtaccactggcctcccctttcttattggctccccagcctcctactttcccatgaccacttagtctcacttcccttcagccttgccagattttgcctaggacaccctcagtctcaactgcactctccccgagactttgcccatgactccctcattctagctgtcctttctctgatttccaggcctggcccgagccaagtcaatcccaacaaagacatactccaatgaggtggtgacactgtggtaccggccccctgacatcctgcttgggtccacggactactccactcagattgacatgtggtaaggacaggtggaagtgtggcaggggccatgtggtaaagggggtggcttggtcacaacagccacccagccagctgcctttctattcactgtgccctccctgcccaggggtgtgggctgcatcttctatgagatggccacaggccgtcccctctttccgggctccacggtggaggaacagctacacttcatcttccgtatcttaggtgaggaggcatgggccctaggcgctgtggagacacacggggaggacctgtgaaatgtttgggataactcctcttccctactaggaaccccaactgaggagacgtggccaggcatcctgtccaacgaggagttcaagacatacaactaccccaagtaccgagccgaggcccttttgagccacgcaccccggtgaggctggtgggtgggtgggcgttaggggccagagtgtccaaactcattttaaatcaggtctctttgtccttgtggcagacttgatagcgacggggccgacctcctcaccaagctgttgcaggtgagaccaccttgggtcagccttgggggtatgggattccaagtgtggggaaacagggaccccccccctcaaaccaggggcagggtctgaggtgggcagagagacctacttgttgaagatatcaatactatccccctccccgcacccccactcagtttgagggtcgaaatcggatctccgcagaggatgccatgaaacatccattcttcctcagtctgggggagcggatccacaaacttcctgacagtgagtggagctggggaatggaccggccagcgtggggactgggaaacaggactgctggggccagctggcgggttgtgtaggattctggctgtgccacctctacgtggggggacatcttgttcacgtgtgtgatgggttgtatttgttatgaaaacattttttagttttcagttccttttacctttcatgaaaaatttaaaacatacataaaaatatatgcaatagcactttactttttttaaagtagacatttccttacatgtgctaaaaaatgcacaaatcataagtatactatacaatgaattttcataaatgaaacacatccttgtaactagcacaaaagtcaagaaacagaatgttaaaagctccccacccccagctcccttgcatctccttcagttattcccagccccttcccaaagggtggccactgttttgacctctaacagcaaggataagttttttctgtccttgtactttatagaaatagaatcacatgtgatgttctttttatatctggcttttaaaaactttttaatatggatattttcaaatatatgtatttatatattagtcaaagtaatatgatgagtccctaagtactccagtgagtcatcaattcatggtcaatctggttttatctatattctctctgattattttgaatcacatccaatcccagacatcatagcatttatccttaaataatttcagcatatacctataaaagatttttttaaaacaacaatattattatcaaacctacaaaaaacatttgctcactttccctatcttcccactggattaatatataaagcaaaccccaaacaccacccatcacctagacttaacaggtggtaattgcaataccataattcacttgacaaagttaataatgatttctttgtgtcatgtaatagtctatatttcatcttccctggttgtagctggtttgtgtatggaattgtttgacagataaaggtcaagcctctcagagaaggggcagctttttctaattcttcccatggggtcatatggggctggtcctagatgacctcatgggtcatcccccacttctatgtctcccccatctgtagctacttccatatttgcactaaaggagattcagctacaaaaggaggccagccttcggtcttcgtcgatgcctgactcaggtaggtatagccccttgtcttcctccctgccccacccacctacctgcttacccaccaacagccatctgctctgctttcccccacaggcaggccagctttccgcgtggtggacaccgagttctaagccacagaccgaggccccagcaggcagcggctggagggatgccacacccctcacagggcagcccccaactacatcttccctgcttactctctgcctacctgcctgagccatgttcacctgcccacttgtcccctgctgcctgcccaaacaccccaccattggcctgtcaacccacccattggcctgtctgctgggtgctaacaaagctctcatcactccttcacttggtctgtctgtctctgtcttggtagttgccggtggacagcatggccgtgccagcctcccacactgaggccaggtctaccccccatcataccagcccccaggaccactaccccacggccagccaggggtccagagctagcccaggctggggatctcgactcagacaagatggtgacaatgccttgagtctgaggcatcctctgcctgctttcctgcctgccccacctgcctcatattgtgtgggcctttttttgtttgtttcattcattgtttttttttttttaattattttaaatgagatttttgttttttttaaatgcaatatctctgtatacagactggctgggccccaccccctgcgtgtggccctcccacagtattttgtgcaatgaagccctgctcccagcctttcagagacagggacacagcccctatttggaaccctgatcatcaccagaccctgggattggctatgggaaagcatgccacagccactcgccttcctacccccgcccgccatccccagttgcagggggatctggggactaccagagactctgggaaatggacaaggtggggggccccactctttctctcctgcagtcccgtagctggggcctccttccttctcagggtctccccagcccagtccccttgctcccatcccactcggtgctgttgggtaggggccctgccaggaactgaccagctcagcgaggagccataatgtgcatatgtgcacaagcagggttgggggaggggggtgtgaggggttgtgcccaggtgttgccccctatctcctggggagggtgaggcagggcagggacagtctccagggtcagtccctggatgggtggttacctccccttcctccaccctaagccctggggccctgaaatggggtgggagggcaggggtgggagccctcctagtgggtttggggggttgggttcctgaatgcaccataatcgctgtatgaaatattaaaaagtctaaagtg

SEQ ID NO: 37077 - DNA, 6053 bp, Homo sapiens; identical to SEQ ID NO: 35600

SEQ ID NO: 37078 - DNA, 3432 bp, Homo sapiens
agcggcgcagggcaccatgggaaacggacggaagctccattgagccaaataagttggtgagaaggttcccgacgcggcgatggcgagaagcagagaaatggacctggggaggggcgtgcggggtgcggtagggttggatggaagccttggcgggccaaaaccactgcggcttcaaaatccggatgcgccggtatttgaggcggaggcggggctgtggggggaggagggaggctatggcgctcagagcactgtgggacactgtaggccacgtggggcggaacggaaacctcgcagggtcagaccgtagcgacgcgggaagtccggacgcagtagctccctgaagcggaggcgaaggggagtttaagccccagcggcggcaatggcggagaggcccgaggacctaaacctgcccaatgccgtgatcaccaggatcatcaaggaggcggtgagcagctcggggggggcggacgaacgggcaggagggaagcaggtgctggaacggcagctttgctcacccccggtctcctcgcagctcccggacggtgtcaacatctccaaggaggcccggagcgccatctcccgcgccgccagcgtcttcgtgctgtacgccacatcctggtgagcgggacagaggcataagggaggcgcggggatacctggctgggagttgctggctgggagcctacaaaccccaacgattgtgttctccctcggtggggacatgttcacagtcctctgccagtttttacaagttctgaagcaaaataacacaacaaaatcactttgctttagcttttttgtgcagagaagggaaggacttatccctgtcacaccaaaatccatacatgtaagaggcaggctttcccgttccacctctgggtgctccttttcccactcacgccttacaaacaagagggagtctgacagcctttctcttctctcagtgctaacaactttgcaatgaaaggaaagcggaagacgctgaatgccagtgatgtgctctcagccatggaagagatggagttccagcggttcgttaccccattgaaagaagctctggaaggtaacgagcctcttgtcttctaaaccacatagaagatggtcatcctgtgtgacctgttcaccaggccctgagccttctcagcgcgggtccctttaagtccagtaagccagcacttgatgtgactcgacccagttcggtgggcaccacctcagatctgttttgtaatgctgagcaagttatttttccttctctgcctccgtttttgtttttgtcttgcttttcttgtttttgtttttttttttttttttttgagacggagtcttgctctgtcacccaagctggagtgcagtgatgggatctcagctcaccgcagtctcctcctcctgggttcaagcaattctcctgcctcagcctcccgagtagctgggactacaggcgcacgccaccacgtgcggctcattttttatttttgtagagacggggtttcaccatattggccaggctggtcttgaactcctgacctcaggtgatccgcccgtctcagcctcccaaagtgctgggattacaggcgtgagccaccgcgcccatctgcctccgtttttccaattgtacaatgtaattagctcctgcagtccgtctggctcactttcagctctgtctcctaaccccttgttccgtccttacagcatataggcgggagcagaaaggcaagaaggaggcctcagagcaaaagaagaaggacaaagacaaaaaaacagactcggaagagcaagacaagagcagggatgaggacaatgatgaagacgaagaaaggctggaagaagaagaacagaatgaagaggaagaagtagacaactgaaaagggcgggagactgtggcaccttggaaggtaccacttgaaatgagacgtgctacgtgtttctgtgaagcttttccatgctgggcagagtagtctcaggcaaaagtgcctgaaaagatcagaataaaaactgactagaaataccgtcaaaaccagcacttaccaaactcagagcatctgagtagcagaatcctgttttgcttcatcaatctgaaggttatggccttttgacaagagggattctgaacgactaaattagtcagtttgctcgcttttgtttacttaaatgtatggttagatggtttttgatctgcagtcttccctagtcccccaaataagtaataataacttccatgctgcctgctgtgttccagatcacagaggcagccaaggctcaggaaaaactggggctttgcttatggtcagcctatgtttgattgcacagtctttgacaatagtagcttactaagactgctcagaatgagtaagctttaggaaactactaaaatgctgtgggagaataacaaaatccgttctctctcttcacttgacagaagcattaactgaattttgtttttcatagacccacttggcccaaaacctttctatattgcctgtagatgatcggcctgctggtgtggtagtaatctgatcacagatattcttaaatcagcagtgtggaatggtattagtcaaacatggtgccagtgtcttttacaaaaacagatggcatagtgtcagatgtaccttactctctgctactgtacagctttaggatttgtcatcacctcccggaaggtgtaaaaccccaggcttcctcttcttgtagtccatctcccagacttgtgactatggcttttcattcttcaattcatgacgagtgccaaacttgattttctctaggcacagctttctccctctgtgcctcctgcttcctttctctctcctgcctctcctctgctccccatcccactttctcatctgcctccttttctcacttctgtcagtctgtaagctttgataacctgcttaatactccaaagtgtgagttcctctgatctcttgattccttagttctaatctcacgttttgtttttaagagatggagtctctcactctgtggcccaggctggagtgcagtggcatgatcatagctcattgcatccttgaaatcctgggctcaggtgatcctcccgcctgagcctcctgagtatctgggactacagatgcgtgccaccaagcctggctaattttgtctcatgtcttctaaaaattattttgtgaagccccttcacaaaaaaccttaagggaaatctgatggtgctcaggaatctaactctccctaaaccatcctctttaactgcttctaaaatatctctgttggcctttcttagcctttttctgtttccattcagtgctccaagcgctttttgtttctaagttgagtgcttggggtttgacaggtagtgacgtgtagtttgacactgttaacttgttaaatacagtgaaaagtttgtgagtgaagaatgctgagaagattgtaatgctttgtacaaataaaagtcttgtt

SEQ ID NO: 37079 - DNA, 11730 bp, Homo sapiens
cggaagcgcagagctccgctggtgccacgtctatccccttacatcctcctaggacccggtcggtagtcgtcgccccagcccgccgggggcgcagcgcccgagccgcggccctcgagacgggaccgagagcatcatgggcagcactgtcccgcgctccgcctccgtgctgcttctgctgctgctcctgcgccgggccgagcagccctgcggggccgagctcaccttcgagctgccggacaacgccaagcagtgcttccacgaggaggtggagcagggcgtgaagttctccctggattaccaggtgaggccgggcgcccggcagcgctcccttctccctccactcccaggtctcacctggacactggctagcccctgactggaggcgctcgaattagccacaggctacagggaggctgcatggggtgggagtccccggagaccagttgacttccccgtgaggaggaaggtttgggtcatcagggcccacccgagacgagcctggccagcgaggaggtagtcagcgccgcaggtgcgagcccgggatggggacgccagggcggatcccgcagcctggggagctggccaaagagatatccgcaggcccccgagacactaaccaacggcagttctgatcggctggacacaggctctctaaccccagtctcttagaccaccttgtgccttcgagtactgaaaaatggcagcaagaggaagtgggctcatagttttagtttattcctcccctctccagcgtttaaagttggagtgaggtgagggcagcagaagtgagaatgggcactttggaaaggagggatcagtgcagccattgaggcctggcggtgtttacaaggagcggtgtggctgcaagacttggctcttgccatatggcttagaaaagctcagttcctgtattcctgtctcctttgagagatcccgtggcccacaggtgacaggagcaggtcttgagtgagtagtctgccccgatatttagtgagcaggtctagggttgggggccaagtgggcatcatactcagacagctatctgcttgtggacgcatgctgataggcacttcagaaatgaggggccacgggcagcaggaatgggggcaagctatttgaccagttcctctgtggttagaggcactgaaggaagcttgcgcttggagacaacttctatgtggtagtctcagtcactgatttgtccactttcaggtctttgtggacaacatgcaaattgtgactgggttaacatgggcaacctaggtgcaatgacaaaaagaatgataattctgtggttgcagggacctcagatgtcatctggtcactgccagggcggaaatcccttgtcaaagtgtgtccagcctgggtttaaacacacttagcaacaggatactcactgctttttgcaaagcttgctgagcaggactagtaacttttgtccggacaaagaggccatttaaatttggaagcagatggaggccattgaccgtgtcctttgatggatcttggttatagccattgcctacctgtgagattttgctttatgtgggtcttatttttcttatgttacaaggagagtttgaactaaatgattcccaaagactcttccaccgctgacactcagaaattccatgaatacttcgatcaatatttttcttctccttgcattcagtcattaataatatattgttaatagctacttgacccattcagcaagccaagaatgacccttgctggtggggggagggggaacacctgtctgttattggaacggagaagcaggaggtgcagcatgcatgctctagggtggcccccaaatcagatcccacatctccactgcaaccccagggggttagtttgcagtctgacgattgtccagtaattggctggcacttttggggcccttgctaaatttatgttggacaccgtgctaaacactttaggtgtgataacttattgactcctcacttcatggataaagacatatcctcagagaataaagtaacttgtctagggtcacatggctaatgagtggcagtgccctaaatcagtgatttgctgtgtgtcttgtgttaagtattgaacaaagataaagaatcggtggcatctagttgcattggaatagtttcttggacatccctcctcatcttgctcttgatttcgggaagctttatcagcaccatctcaggaagagcagttatcctggggtatgttcattcatgcttcagaatagtgcaataggtaaatgtttaggcactggaaccaaaagctctcaaggcagatctcatctcaccactttctcttgtgtaaccttagggaatttacttaaccttggaacctcagtttcttcttctgtaaaatggaaaggattaggctcattgaaaccctgcagagcaaacttgggagtcaggcaggcatagattcaaatcttagccctttcactttcaagcagtgtgaccacagccaatttatttaaccttgctcagccttagtaaaatgagaagtggcgtagcacctgccttagaaagttttgaagatgaagtgacagaaatgtttgtagagtctgatcacagtgtctggttggcatttggtaagtggtggttgctcctttgataacagcaatttttttatggttgtcaggtcatcactggaggccactacgatgttgactgctatgtggaggacccccaggggaacaccatctacagagaaacgaagaagcagtacgacagcttcacgtaccgggctgaagtcaagggcgtttatcagttttgcttcagtaatgagttttccaccttctctcacaagaccgtctactttgactttcaagtgggcgatgagcctcccattctcccagacatggggaacagggtcacagctctcacccaggtgagtgaacattagcagttcggggctgctgaaccccctagcgtgttcctcttcattggcctctgtctaggctggtggtgggagtcatcatccatccagctcccagtctggaagtctcagggttggttttgtctctttcttcatacctagtcctaaaggatgccatgctcttctttcgatcttcctttccactctctaaccaggtccctgcagtactttcctctgacattcctgtctctactctttcattcccactcagtcttttgcacagtaccactttcgaagtacctgtgtcatgtgtctctgcttatatgatgtgcctgtatcataaagaccaaagtcctactttgtgtggtgtattagttaaggtaacacaaggtgctgtaacaaaataaacaccaaacatcaatggcttaacagaatagaagtttattctcatgcataatctagaaaaggttggtggggagctttcctccatggtgtgactcaggaatccaggctcattctttcttgtcatctttctgtcttcccttagggcttcagggtcttctgcctgtagctgccaaaggaagagagaatgagaaaagcccatctacttcttaaaagcccaggcccagtgggaatacgtatcacctgctcatgtcccatgggtgagaacttagtcatgtggcaaagctggatgaaaggaaggctggcaagtagagccttagcaacagctccacactatggaggagaaacggtgacattttggggggatagtcatgtctgtcgcccatggctgtcaaggttcattattctctgatcccatcctccttcgtctgtcttcccttctgctatttaagcccctccttccctttcatatgcaggctgggggcttcctgagggctaggaccctgaatgatttacttttgtatcctcagtgcttcagtgcataaggtagggcacaggaaggagctcaccaaatacttgtgaaatgactgtcagggcccagggaaacctgtaagacaggaataaccatcgatagcagcacgtgtgccagaaccaaagccacagcgtcttgaactttcaaggaggccagatgatcttctgggccgccttccaaggtggcatccttcctctgtggctctgggcacactcacgagtgcctgtggattcatttgcccagtcttccaccttccctaagcagttggaggctagagctgcactgttcagtacagtagccagtgtctaaatttggctatttaaattaattaaaattaaattaaaaattcacttcctcatctgcaccatagcaatactccaggtactcaatagtcacaggtggctagtggccatgcatagaaagttccattgtccaaaactgggtttgatctttgggcttttggcaacatgacttctgttagaagatccagccgagggtgtgtattgtgtgtaagatcttttgcaaccgatactcatgagagttctgttggccactgttgagacagcctctattgggaagattctgtaagtctccaaaagctgagctgaagaacttcccccttaaccagtagaaaacaaattggtaggaaaagccttaaagaattaggtcaacagagacattctttcctggagcctgagcagtagtttgattttgttgcaggaaagagtgatttatgcttcccttttcttatatcttagaacctcttctttgctcctgcttagcctcaaaagagccgtttccttccacttctcttaccccgccaccttgaaccatctgtgcctgcctttgagagtacttgcttttatgccagaattcactcagtctacacattgtgccagccgtggatggctctgtgcctggtactgggcaccctgcaaggagcgcagccctgcaagccagttggctatggggcactgtggtcagagctgtaattgaagcgccaggagtcttgaggaggcactgatgaattcttccaggagtcaggaaggcttcacttgaaaatgtagaagcttggccttctaggtgaagagaacaggtgagatttatggagtgtaactttcattcttctcgccagcgctttttatcttgcttggcatgggtccccctttacccagcagctgctgtctcgcctctccccagacttcttgcagcacagtggtgagccagaggccatggtttctggcaagaaagtaagtattaggtgaaagaacaggttccatagtgaccagggcccaggccagggattcaggtccaaaggacttgtttcaggccggagttcaggaaaaccaggctcctaggagaggacctgggccaggagaatgcgacttcaggaaagccaagctcgaggggcttccaggcttcctgagaatctgggaagatcctggtcagagctgaaggtttctgacagaggtcaaaggccaagagctacctccctggtgatctaggaaggattaaaggttttcttaagtgctctgatgccagcttctacttccctgtctttgagttcttgaagaatttgaagaagcagatacttgggtcaggggaggcctgatgaggtgagggctgcaggaatttgtcagtggttacagactgaagacctcggcatccgctggtggctgggacaggatgggatgtcagcgtggagatggaggaaagggatggtgccagaggtgggatgggtcagggtgtcctagagaccgacagtcaccatgaagtggcaactataatccctgtgaggctccaggacactggaagccagccaggactggtggtcttagcagggcggaaggtcacacacgaggagacctggggactcgtggcctggaaaaacaggaccctgaaaacagaggggttctgttggttttctgctgggtgggaagctggctgagggactgcctaactgaaattttgtggtaacaggctgaacaagtttgctttagatgagcactaactgaagatctcagcggatggggaagtagcatgtttttgtggtgagggtgagcatccaggtagctgtgattcttggggatgattctcggggatgtattgctctggggtctcttgcagcgtctgtgcaaggtcctgaaggcgtctgcaggtgttagttgccaagaaagctgtagagtatcacctgttgctccgttaccctcttggaactggtccctttgctatcactgatctgatctgagattgttcctttaaaggccacgaggcctcttcatgcagtctccgtgccggtttctggcctgtgtcgctggatctaggcctttaaagtgatgcttcacataaatatctgactcatcctctgtcttggtgtctacacctgtgatttctgtgtcctccctcttctttttcccttcctccttcctctccagtgactctgggtcctgggagaaggctggagatgctgaccagtactgctgaattcccaggccagggcctacggtccaaggagtccccagtcaagtgagtctagttgtacactttgtttctgaatgagtttgtgacacataaacttggagaatggaattatagcctggaaaatcaaatgagcccttccacagtgttctctgcggatttgtacatacaaacatgtatgcatatgtgtacatatgaatacatatgtgtgtgtgccacacatacatatacacatatactacctatgaccatgatacatacatgtatacacttatgtgtgtgtctccatccctcccactgatttcaagaatgatccactttgttatgaagtcctgtgatttcagtgccatcaatttccctccagtccactcttccctgacatggcgaccttcttaaccgaggcctgcatcttctcttcccagtagaattgcagccacctaagtggtttccctgcctctaaactggttcgcatacatccctttctgcatcatagctgccagaggcagattctcgtaaagtgggattccgatcttgccaatcttctgctcacagagccacacgataaagtcttggacctcgaggccctttactgtgagcttccacctccccacagctgcttctccacgcatccccatcaccatgtcagtccctgatcccagaccaggccctgtacagttctttgcctgtgcttctgctgcttgggatgtgttctcagcctggtgacgtcctgcccatccatcagggctcagcttgtcgtgtcccatgtcaagtactccatcttctctggcaggctcagcatctttctcctggggtgttcctgccgctctgcatacccttctgttgttggctgtttatactgcattctagttgagtaattttttctttaaattgggaactttctgagacccaggactgtgtctggctctgattcttaattccctgggcctagcacagtgcctggaaggaaagtaagcattgagtaaatgtttgaatgaaggaattagtggaagtgtgagctattcaaactcagccatgatttgaaatccttgtaacctcatcctacaagtgtctatcctgagtcccccagccccaccttcaatcctttgtgattttccagggatcaccagggtgatgtaaatacagaacggatttgtgttaccaagtctgcctgtataggtagtgcctggcagggagcactagggaggcttctagaaatggcatatcttgagttagctttgacacaggttcacataggttaagcccgactccacattgacctctttcctgcttccttcccagtttagtgtcctgttccatctgtgacagctgacatgctttagtgagctttggaagcattccccggagagctaggaggagcaaccacaaatgcgaccattgtccccagtgcagaggcctacacctgagctttcttttctggtggttggcctttgaagccagttggctttggaagttccctttggagtcaacttcctgatgtctggaacccttcttaggatcatttgttcctttttcaatatcaaatgtctgcaggtatagcccacctaccaaatgcagggaagtgaagaagtccaatgctgactacactccagttgtgaaagatgatatgtagcccaaaataatagaggatagaggatgtcactgagaaaacaggacagaggtactcatgggggacaaataggcttgttcttcacttgctattgctccttgagctggtgtacccagtctaactctatcagttccatctgatacacagtgatcatgccacctttctacgtgtgacatttcaccacttcttacacatggacctggatgagagggccagccactgtgtgcaggagagtcccatagccttgggaggtagacctgttgccagaaagagggaagctgctgccctgtaatgcagaggcagaagggaagcttttgttcttccttacatagtctagttcagctcctagaatggcccagaattaaggatacccaatgaggcaagtaagggtaacaccattgtttggcagtggtttcctgtttgtcttctggaagtggtttaatgtgagagagaaacaagggttttggggaggtgtagggtccagccccacagggtggatgggttttctccctatgtgtggagacgagagattgtagaaataaagacataagacaaagagattaaaaagaagacagctgggcccaggggaccactaccaccaagacgcagagactggtagtggccccgaatgccaggctgcgctgatacttattggatacaagacaaaggggcaggctaaggagtgtgagccatctccaatgattggtaaggtcacgtgtccactggacagggggcccttccctgcctggcagccaaggcagagagagagagagaagagagagagacagcttatgccattatttctgcatatcagagacttttagtactttcactaatttgctactgctatctaaaagcccaggtacacaggatggaacatgaaagaagactaggagtgtgaccactgaagcacagcatcacagggagacagttaggtccccggataactgcgggtgggcctgactgatgtcaggccctccacaagaggtggaggagtagagtcttctctgaactccactgggaaaagggagtccccctttcccagtctgctaagtagcgggtgtttttccttgacactgacgctaccgctagaccacagtccacttggcaatgggcgtcttcccagacactggcattaccgctagaccaaggagccctctggcggccctgtccaggcataacagaaggctcgcactcttgtcttctggtcacttctcactatgtcccctcagctcctatctctgtgtggcctggtttttcctaggttatgattgtagagcaaggattattataatattggaataaagagtaattgccacaaactaatgattaatgatattcatatataatcctatctatgatctatatctagtatcactattcttattttatatattttattatactggaacagctcgtgccctcggtctcttgcctcggcacctgggtggcttgccgcccacaggaagggaggtcacagagtgacttggtcttttctagtttattgtactgtactttacaaatagtttgcctttggagtttgggaactgaagtgagtgtctggtgcatgctttgtgaattcctctagcctgagaactcactgataggatagaattttctaggtcttggatacatggtggtttagaggctgcctctgaataagaactcaacgttttcccacaggcataatgtgttgtctattgctgagtaactaattactacaaacatagtgtcttaatgcaatactcacttattaccgcacagctctgtatgctgtgagcctgggcaggttggccagattctttggggtctcccaagcctgatgtcgaggtggtggcaggttgggctcctacctggaagctctggggaaggatctgctttcatgctcattcaggttgttggtggagttcagttctttgtggttgtaggactgaggtccccatttccttgctgactgttgtaccctcaacgcctggaggcctttttctggtcctggcaagtggtcacctccaccttcaaagccagtgtggcacattgaatttttctcatgcttcagaactgtcttgacttcttctgcaactagctggagaaagctcctggcgtctgagggctcctgtgatgggatcaggcctgaataacctccccatcttcaggtcagctgtgtcatattaacgtgatgcagtcacagaggtgacagctcatcatattcacagctttctggaattagggcgggggaccttggtggtggtgggaaggacattttcagacttctgcctaccacactgaatatttttgcaggtaaagaaagttatgatgtagtatgtgttacacatgagcgtatgtgtctatgtagtgcctgtttatatatatgtgtctttgcatgtgtgtgcatgtgcttacatacatgaagcgtgtgtcttcatgtgtttgtgtttatacataaaactataggcagcaattacataatagaatgagcatgagcagtggattcagagtccaaacacaactgtggtctagttcacactttgctgtttattagttgtatgactttgggcaattcgtgtagcctcttggagcctcagtttcctcatctgtgtgtgggataagccctcgttaacagtgagggtaatgatccgtgcctatcaggagtattgtaaggattgaataagagagtatagggcagtgcttgaaagcataggctcaggactcagactctaactcagccacatactaactgtgtgactctgggcaagttacttaacctctctgagcttcaattaggcttgttgtgaggattaaataaaaccacgtaaaacccttagcacagactcttagttagcattcagtggatatcacctaggatgttgacaacagcatttgctgtttgctggatcccacatttgtctatgggttagcagtgtgactgcttttctcttcctgcccagatggagtccgcctgcgtgaccatccatgaggctctgaaaacggtgattgactcccagacgcattaccggctgcgggaggcccaggaccgggcccgagcagaagaccttaatagccgagtctcttactggtctgttggcgagacgattgccctgttcgtggtcagcttcagtcaggtgctactgttgaaaagcttcttcacagaaaaacgacccatcagcagggcagtccactcctagccccggcatcctgctctagggcccctcatgccccaggctggagcagctctcctaggtcacagcctgctgggctgggtcgcgtagcccagggtggaggcagaacgatgctgctgtggtagccctttgcctttcatgcccatgcttgattcttgcacctcagcagctgaaggtctcagagaccagtaatcagaaggcatccgactgcattaagtgtgcagcgctgaaaagacatttacaactaggccagggattagccactgtgggagggtggacaggcaatggttcagtggcctggctgttggcaggaactccaagtgcccaggcctcttgggcagcttagggccctgcctctgtttcatgatgcatgggtcatttgtcttgggtgtcctatcccatatggagaagaaaggggctctaagttctggctcttctttctttggggttctctgtacctgaggaaaccaggccctgggtgactttgcagatctgctcaccctcggtgagcaacagtgtcagccatgcaagcaggacagaatggtgactgggtgcccttggtgagctgtgtatttcctaggaggtagaaaactgtgggaaactgtggctaataaaaactaagtgtgagcgtcctggag

SEQ ID NO: 37080 - DNA, 30639 bp, Homo sapiens; identical to SEQ ID NO: 36855

SEQ ID NO: 37081 - DNA, 37929 bp, Homo sapiens
tcccggcgggctgtgcggcccggctctccggcggcagcgagtgccacgtcccaagtgctacgcggaggattagagcaggcggtgcgctgggggcgggagcagcgcggagcccggctcggccacaccgatcgcccgccgccatgggctcctcgcaaagcgtcgagatcccgggcgggggcaccgagggctaccacgttctgcgggtaagggctccgacggcggccggggagctgcgggctggaggcggggccggccgcggggaggcggaggcccccatgggctccttcacggggcagccaggcccgatcccgcgaaggagcggcggtcgcgggcgctgccttggtcgaggctggttccggaggccgctcgcatcccacctccgcggagcgccctgggcacggggtccgcggctgtaggaggacgggctggagctggaggcggctgccggcgactcggccagggggcggccctgggaaggggggacaaccttgctctttttccgcacggccttctctctcctccaccccccctcatttttagcttccaaagttaggaagggcgcggaggcaacgtctccaaagtggtgactgtgaaggcagcctttgcgctttcctaggagagggatccggacccgcagtccggaggcggggcctgcggcggcaggtgttaaatcacctcggcgccggccgagtggcctgaaagaccagcagggcaggagacggaaaaccaaatggcctggaagtaggttcgacggacttaaacagacttgattttgaccagacttttcctttcccgtgccactcctgaccctcccaaaccttctcaagatttcctggagtgggaacttccgttctgttccgattgctgagggtgtggtttagattataaggtttagatccacagtggtaaagaggtagtgcagagaaattttttttaaaaatcggagtatataaaggaaaacaaccctagcttaacttccaggacgcagagaaacatagtatctcaaaaggcgtcagctaagcccctacctatgaacggcctgggcctgggtggtacaaagcatgtggtcttttcctcatggaaccgggcgactttagaagtagcattgatggttgtttgctgtgacacctgtgtgagtgttaacatgaacagtcaacagagtggccgcagcgtgtagcgccatttaggggtgtaatagagtgtcactcaatattagctcctcacaggcaagaacgttttcactgaaagtaagagagtgcacttcctggtgctaccttcatttcctgccctgggtcccatgttttaggtgagacacattcttaaattgcccagctgtctatgtgatagggctgagacagatcatctttctgatcttccggattatcgtgtctattgcctttccattacactaaaaatccctcctctgccatactcttagtaggaaagggtgattttttttttccccgaaaggaaaagggagcctataaataaaccgtattatcttcctatccccttctgctaaccaaacacccaagagccacactgagagaggaaatggaaggagaattgtcagttcccaaatgtgaggtgaaagctgtgcttttctttctattatctggtctgattttgagttctctaccctgggatgttacccagtattaccagctgtttctcacagtgaccgattgtggtcatgaatccttggggattcatgatatttttataatacatgcactcagggaaactcagtaaaacacattagtgttaataagcaaaaaaaaaaaaaaaaagtcgcgtgtttgaaagaaagccatacacatcaaaaggattccaacttagtgactgcattccgacataaaatgagtttgtattttctttatgtaagtgcagtcaagtgaaacagcattcatacatattcagtagtgcagatgtgttattaatctatacatctgatttttagaaaaactagggacaaccttagttaccaatctgcatctggagcattaatgttgcacacgatgaaataattcttatttagttagacttttactaaagagagctttaaaatagtaatgatctagtttaggagaattttgtgtctgccttcctaagaccctctgcccctgattctgtaattggttttcttatctttgtttttagagggaaaagtgctgtgttaaatcttaacatgtaaaaatgtcttcctttcatttgttattgcctaaatggacagcgatatatttcattgttagattaccaagcttgtaaactggagtaactgtggcaggaaaattttgaataaaatcacccatattcaacaagttctagaacgatttaattagaagttagttttcttgaataaccaattccctggccaatcttgttgtagtaaaaacttaatatgattgactgggttttgaaataccaattataataacatttatatccactgctgtcttttgatttcatgagtccctataattcagatagattgagctttccatttttttcattatttttcaatatccatctaaaaatatttaggggacagcctttaaatggattcagaagttctgctatgagcagtgtagttcctttttatgtgttctgtatgtatgagtgcatattttcagattgtgatcatattgtgtacccaacttcttatccccactccagagtaaccactgtggacagttttttacatagcctttcagatatattttatgcttataaaaaagtctctttggccgcgcacagtggctcacacctgtaatccccactttgggaggccgaggtgggcggatcacctgaggtcaggagttcgagaccagcctgaccaacatggtgaaaccccatctctattaaaaatataaaaaattagccgggcatggtagtgcacacctgtaatcccagctacttgggaggctgaggcaggagaatcacttgaacctgggaggcggaggttgcagtgagctgagattgtgccattgcactctagcctaggcaaaaagagtgagacttcttttcaaaaaaaaaagagtctcttcttcttccacccttctctctttctttttgttaccttgtaatcatgatccatgctgttgcacacctcagtcttctcagttgttgacctatcttggcagtctttctgtagtagcaagtggccatctgcttcatgctttcagttagctcacggtagtcttttgtaccatagattggttaaggagtacctcctggtgttgaacatttggttatctagtcttctgttattataagtacatatttacaaccttaaatcctactttttgttttcccataacatacatccttttcccagattactgtattgaattttaatggtagctgtctgtagaaatgttgatctttattttagtaaataactacattgttttctgatcatcaacatgtgtccattagagaacatttggatgtggtaaaaaagtacagcaaagaacctgaattacctgtaatcccaccatctaaaggcaaatactgttgaagtatttctcttagtctcctttttttcctgggcctaacatcgccccttagccatgtttcacaaagattttgaataatatgacgtattcaaggactatatggccaaaagttatcttaagaggttaacattacaaccaaaatagccaacagctgagaaattgttaaacaaatcagggcctaaacacagatagaatgctacacattcactcaaaattgtgtttcagacaccctgtgtgtgtgcaggtacatttgagtgcttaggaaaataaagctgaaaggtaataaacaaggttgtctaaaaaattattagtggatggtgactttttttttaactttaatatattttctaggatttctgaagtgatcattaaatacttgtatagtcacccaaagtgtagatatgcaaaattacttttaaaaaagaagtggactcctagtggaggatttaaaaatttgtgtagaagtctttttttaaaaaatagcatttcagatttccttatatagtgggtcagatttgtgctcactatgaatggcacttttattttggtcctccaatcctaatgtaaggcaggaaaaatgttagggcttctcagtttttgaagttattgtaagttaccccctacatgtgaactatgtttaatatcaaatttttgcctatattttccattaattatccagtgaacccaacaagaccattttcaaaattaaattaaaccaaaatatccaacaggtgagaaattgttaaacaaatcagggcctaaccacagatagaatgctatacattcgctcaaaattgtgtttcaaacaccctgtgtatgtgcaggtacatttgagtgctcaggaaaataaagctgaaaggtaataaacaaggttctctaaaaaattattagtgacatagttcacaaaattaaatttttggagtgacctcacagatgcctattataggatctgcttttaaattaaaatattcatattctgttccacacttaaaagagatggggaatagctgagggcatactttctggagcaagtattcagtgtggagactgtgtggagtgtggagacatggaaaatggcattttcattctttctcatgcttgcttctgggagagattttgaggtgatggatattttgaaggaagggtcattgacatgaaatgtgtcacgagtgtaataacaggtttttatcttctgagctatttgctgcagactgggtaacatttaggtgttctcagagaagcaagtgactgcaagtggaattacttctatagaaaatgcaatgcctacaccatatcttctatcatatggaactgctctttttatatatttttttctattttgtcagagatgaggtctcccaaaggtactgctctttttaaatggtgcctaactaacctatctgcaatcctgttgtgatgggatttcaatttagtacttattttgaaaaaattaatttctgatattcaatagtcattgtcttctttattcttctaacagtctttctcaaacttttgaaactcataccctgtttttttttttgttgttgttgttgttgttttgttttgttttttttgagatggagtttcgcttttgttgcccaggctggagtacaatggcgcatctcggctcactgcaacctcccgggttctcctgcctcagcctcccaagtagctgggattacaggcacctgtcatcacgcccagctaatttttgtatttttagtagaggtggggtttcaccatgttggccaggctgttctcgaactcctgacctcaagtgatccacccgcctccacctccgacaagtgctgggattacaggtgttagccaccacgccctacctcatcccctaacacagaaatctcactctggctcccttctcactcattctggaaacaatgggtaaaaagaaaacagtagggttatttggtattgttttctatatataaagttataattgtgaaacctgaagagtctgaccctgcccccagaattgatctctccttttttttcttttttgtttgtttgtttgtttgtgagatggagtctcgctctgttgccacggctggagtgcagttgtgcaatctcagctcactgcaacctccgcctccgaagtccaagcaattctcctgcctcagcctccagagtggctgggattacaggttcctgccaccgtgcccagctaatttttgtatttttagtagagatgggctttcaccctattggtcaagctggtctcgaactgctgacctcagctgatccacaggcctcggcctcccaaagtgctggtattacaggcgtgagccactgtgccaggcccaaaattgatcttttctaataaaaggcccagaagttgtttaataaacattcttttaaattgctttcaaatgtaggaatcaggatgtctcagtttattgaagccatggaatacaatgtatataaatcttgggatacttttaggaattatatcattgaacataaactttttctaatattaataggccttgaacaaattagtagtttcatgttgattatatacactttttttttctttgagatggagtcttgctctatcacccaggctggagtgcagtggcgcgatctcagctcactgcaacttccgccactccagttcaagtgattctcctgcctcagcctcccaagtggctgggattataggcacccaccaccacacccaactaatttttgtatttttagtagagacagggtttcaccttattggccaggttggtctagaacttcagacctcaagtcatctgcccacctcagcctcccaaagtgtagggatttcaggtgggagccactgcacccagcacccccaacgccccacctcttttttttttttttttttctttttttgacacagggtctcactctaggctggaatgagtagcacagtctccactcactgcagcctccaactcccaggctcaagtgatcctcccccctctcagcctccccagtagctgggactacaggcacacaccaccatgcccagctaattttttgtattttcggtagagatgggtttttgccatgttgcccaggctgccctcgaactcctgagttcaagcaatccacccacctcagcctcacaaagtgctggggttacaggcgtgagccactgcgcccggcctgtatatgctttcgtacttatgtgatgaggtgtgttttaatgcctgcgctatcatcctcaggattctcactgggggagatctgctgttagtggttaattatggtttcagtaagtagtagagtgtacaacactgattcttctgccttctgggtcagatactaacagggctttttaataattcctctgcaaattttataaaaattgagcttagaataaccgttaacatcagtgtgttcattttgcttactttaatattctattgaaaggattatatatattgattgattcactataaaatactaatgtaaactaggaaatagaaagtttgatatgtgcttttgaaactgacttttttttttttttttttttgaagcagggtcgcactctgtcactatggctggagtgttgtggtgtggtcatggcccactgcagccttgaactcctgggctcaattaatccttttatctcagcctcctgagtagcttacaggcatatgctgccacgtctagccaattttaaaatttttttgtagagagatctttctatgttgcccaggctggtcttgaactcctgggctcaagcgatcctctcgtcttggcttcccaaagtgttgggattacacttatgagccaccacacctagtcctaagtagttactttgagagactgtacatttccctgttggcattgcaaataaatttactgtagcatgaagataattattctggggttttgttctctcttttaagcatcaatgagagaaggctcaagcacattgtcagaaataaggaagcttaagccgggcataatggtgtgcacctgtaatcccagctactccaatcaggagactgaggtgaggtgggggcccaagagtttaagaccacgctgggcaacataatgagatccggtctcaataaaagcaaaattgtcacttgaccaaggactttgaggctgcagcgagctatcctcacaccactgcactccagcctgggtaacagcagcgtctctaaaattaattaattaattcgttaatttttttaaaaaaaatttaaggctaggtgcggtggctcacgcctgtaatcccagcactttgggaggctgaggcgggtggatcaccgaggtcaggagttcaagaccagtctggccaacatggtgaaaccccctctctacaaaaaatacaagaattagaccggcatgatggcgcgtgcctgtaatcccagctactcaggaggctgaggcaggagaatcgcttgaaccctggaggtggaggttgcagtgagccgagatggtgccactgtactccagcctgggcgacagagtgagactccatcacaaaaaaaaaaaaatttttagagacccggttttgctctgttgcccaggctggagtgcagtgtcacagtcccagctcaccgcagcctcgacttcatgggctccagcagttctccctccctagccttccaagtagttgggactacaggtgcgtaccaccacagctggctgattttttgaagggacaaggtctcgccacattgcccaggctggtctcaaactcccgggctcaagtgatcctcctgctttagcctcccaacgtgctgggactatagctgtgagccacatccctgccctaattaattaaataaaagtaaaatccaggctttgtggcatgtgcctgtagtcccaggtactcaggaggctgaggtggaaggattgcttgagcccaggagttcaagagtagccgtggcaaaatattgagagcttgagaaagaaaaagaaagagagagggaaggagggagggaagggaaagagggaaacaaaggaggaagcacctggtacagtgactgtcacctgtaatcctaacactttgggaggccgaggcagagtattacttgaagccaggagtttgagaccagcctagacagtaaagtgagatcctgtctctaaaaaaaataaagacagaaggaaagaatcttgttatctttgtggacatgagtacattgagaaactatcatagtcaaccaccagagaccacctttgggaactggattctagtgccagctctatcacttcattctgtttccttgagcaaccctttgaactgctttgaaaagcttcagtctttgtatctgaaaagtgcagataatagcagagccacttctaccttttccactaaaaaacacattagatactgtgtatgaaaataatgaaaacaattgagcattattaaatctctttcttaaaacaacgctatctacctccttgattatcctgtgggttaaatgagatattccatgtaaagcacttaacttagaatgtggaatataataaggattcaaatgttagctgatgcctttattactagcatttgcattattgtgtagaaccagtatcgtggcaatactagctaaaatatactactgtagttgtaaacatttttagtatttttatttgattaagcaacagttactttttgtctgtgtacctaacctgtactttactgctgtttaaaacgtaagtttgaggtcagatctgacccattaattttagtcatataggcacacacataaatggtgcctgttaatttcctctgatcctcatttttaaggaaattgttttttaattttaaacggggagtgccagtatccttttcattgcattgctacagtgttactacacacattaattaaaatggctgaaagagtctatgcaattaaaatgatcttgctgtatttgattttcttcattgtagaatctatagatagcttagcaacagttagacttatttcatggtgggtcattcaggcttacagattacatagttagcctcctcatttttgcagctaaagaaaagaagcacaggcctgtaatcccagtactttgggaggccgaggcggtgatcacctgaggtcaggagtttgagactagcctggccaacatggtgaaaccttgtctctgctaaaaaatacagaaacttagccaggcatggcagtgggcgcctgtaatcccagctacttgggaggctgaggcaggagaattacttaaacccaggaggcggaggttgctgtgagctgagattgcatcactgtactccaacctgggaacaagagggaaactccatctcaaaaaaaagaaaaaaagcacagagaagttaatctgatttgcccaaggtcacagagcaagttttctttccctaagaaacaaatccctaagttatttgaagaatataaaatgagttcagaagttgtcagagtttttgcttcttttagagcaaacttcaatttctttcgatgttgtttttctaatgtacagatcttttctggaaaactattatgcaataatgggtttttatttccttttagttgccattacaattttattttaaattgcttgaatgttaaaaattatgtcagggttagtgtcaggagaacatgtactttgctttgttttggaagaacatgtgaagacaatgttttagcaggtgaggcttgaactcttctagtctactgcaaaattatttaccacacatttgtgtcaagacccaaataaggaaacttacccatttgcagacatagaatatagtagtctctccttatccacagtttgactttctgtggcttcagttacctttggtcaactgaggtccaaaaatatcagatggaaaattccagaaataaacagttcataagtggtagattgttctgttttatattattagttattgttgttaatctcttactatgcctagcatataaattaagctttatgataagtgtttgcatatgggaaaaaatatagtacagtatatgtagggtttggtactctgcaatttcaagcatccatgggaggtcttggaacatatcccctgcagataacagggactactatagctccctcaccctcctcactaaaaaaaatgcttattataaccacggaggatttaggatttctttttattatatcacattcccagatcttttcccatcattttgatcacctacgcacacatatagtgcatgaggatttatgtttatagttgaggtgggtcatcatttaggtattgcttggattgaatttattttctagtcttgtttaacatctccactgtttttaaaagcagtacaagagggagagtgttagaagagatgatagtgtagatagtcattcaatggggcttttctgcattttatgtgtggaaaaggaatatatggtgtagtaataaaaaggagacagttatacattctagtaagccaattttatggtataattttcattgtcagaaaacttaaggaagataatttacatatcagccagaaacatggataagtgtgtctttgtgtatcacctagtgcagcatgtagtctggtgatatcctgtgtgctgcaagttgccttgtggtttactttctttgttactttaaggtagaaggtctgtatacctcagctgaaggtatgtaagtcagtagaccagtgcagttgggagaatgccccctgacacccaactccacccaaacacttcttccctcttactctgccattcctccctcccccaagtgaagaattaaagagagaaagaggtaatgtgaaatgacccaaacctagcataagtagtagtagttgaacattcttaatcctggaagaagagatgaatgcttcactggaaagcaatagttaggtctgtgtgttaaaagaaaagaaaagtttaggctaaatctggtaaaacttttaatgatacgggatcagaagtggagggaaaagtcaagaagtgaattgcttttttttttttttaccaggaacttaatggagcagaagtattaacggtatcttgtaggacagcttttcctaactttatttttattgtagctcaagccaaaaaatgtattttccattgcaaccagtacatactacatttcatgaagaatataggcctttattatatcatgcatttttgacagattttctattgtgatattgtgttttgatacttgtcttttgtgacacactaaattgatttcagaacctactgaaatcatccactgtagttgaatgacaccactttagggattatttctataaagttggtgattaaaaaatccagcttctaatcattgatgcaaatttctttttatgtaatagagatgcccctttactgtgcagtttcatcataagcttctcatttttgctcgttgaggggtaaaaactgtctagcaaatatcatcttgtttattgcagccgttttttctagaatgttaggagagaagcatttctttcacgctgctgtagtttttattttgtaagctaacctcagatgtatagtttgaaccttacaactgccagttaatgtgttcataatttcttctacctatccatgttttggtaatatatctttttataattattattttgtaagcataattgctctttagtattttcagctgctttattatgtttcttaattgtcaaagtaaatcgtgtggccctaagaagaattggaaaaaaaggcattggaaaaagtgtaacctcagtatacttgttttgatacagggagcatcttttaaggctttatattaaaagagtgcacacaagtgtatagcttggtgaattttcacaagcaacacacttaatgtaaccagcctcttatccctttccagtgacatcctgcacaactcccacctccacaggatgaatatcctgatttctaacagcatagatgagtttggcctgttcttgtactttgtataaggggaaccatgtgctaggtactcatttgtatctggcttcttttgctcggatattgcttgtgagatttattcatgtatattattgtagacctttcatgtcattaatgtatttggtgccattgagagaatatgccaatatttattaacctgttgatggggatttttgtagttttcagtttggggcttttataaatagtgctactatcaacattatagtgtattgcttttagagaacatgtgtatacccatttctgttgggtatatacccaaggttggaatatacggtcaaaaggtgtgcatattttcaatattaatagatattgccaagtcatttactagtttgcattctaaccagcagtaattgaggtttctaaatgtcctacgtcctcactaacacttaatatttttcgtctttttaatttcattcattctgatagatgtgtagtagtgttgcattgtggttttaatttgcatttccttgatgaccattgaagttgagcacattttcatatttatagatcacttcagtatcctgttttgtttagtgtctgctaaaatcttttctccatttctctattgggttgtctttttttctgttttaagcaactttattgtgataaaagttacataccagaaagttcagacttctaaagtatacagtttggtgggtttttagtatattcatagagttctgcaaccatcaccactgcctaattccagaatctgtgtattactccagaaagaaacccatatgtattagtagccattcccccattcttccacccacaacccctcataacaactaatctgctttctgtctctatggatttgtctattgcggacatttcatattaattgaatcaaacaatatgtggtcttctgtgactagcttctttcacttagcataatgttttcaagatttatccatgtcatagcgtgcattggtacttcatcctttcttatgggtataccacattttgtttatccatttatcagttgggggacatttgggctgtttctacgttagggatattatgaataatgctgctataaaatttgtgtacaggtttttgcatggagatatattttcattttccttggttatttgtatacctggagtggaattgctggatcatgtgataactttgtgtgtaacattttgaggatctgccaaactgttttccacagcggctacaccattttacattcccaccagcaaatgtatgagtgttccattttctccacatccttgccaatgcttgttactctctttttaattatggtcattccagtggacaagaaatagtatcttgcggttttattgtctgtctttctgaacgctttacagtagttcaagatttcttctggatacagatcctttgttggatatgtattatgtctttttactttcttaattataccttttgatgagcagaagttcttagtgtagttcactttatcaatttattttagtttatggttagtgcattttgtgtccagtttattaggaagcctttgcaaacttgaaggtctcaaagatattctcttatgtttttctctacagcgtttattgttttacccttgaccttttagagctgccatccatctggaattgatttttgggaggcaacatttgaaaaaatggtttgtctctctttcctgctaacactttacaagttttattttttctttttaagagtaaaaggtatttaatatggttgtaaaaataatgttgtgtccaggaattggttagctataaagacttaccctcagatggtgattgcagagttaggaggatgagcttaagatttcttggccttctatcataggcttgagacttagctaggcatttcataaacttaactcattgaatctttacaacattcttgtgaagaagatggcgttatcccttacttgcaaatgagaaaattgaggcccagcgtggtaaataaactttaccaagctcacacagctaataactggacaaaatcatggcttaaaaccaactcagtctggctctaaaagtctattattttttcactgtatataatcttttaaaatcttatttatttatttatttgtgagatggagccttgctctgtcgcccaggctgaagtgcagtggcgtgatcctgactcactgtagtctcgacctcctgggctcgagcaatcctcccgccttagcttcctgagttgctgggactacaggcaattgccactatgcctggctaattttttaaaaaatttttgtagagatggagtctcactttgttgcccaagctggtcttgaactcctagcctcaggagatcctctcacctctgcctcccaaagtgctgggataacaagtgtgagccaccgtgcctggccttaattattaaatttacaaatttaacctgttcattgtaaattgctttgatatttggcccagtaataaatgttaaatggtctgtggagccaagtatatatagacttttagttaagatgacttgaagaaagcgaagataaattaataatcaggagatctcataggggatagaaagtattgaagtggtaatctgatgcttgagagattacgtgccaggagattcttgtcagtggataacattgcaagagaaacttacctgtgtcagtgtttggtttgctatgttgtagatcatattttccatgctacaaaatataggaaatttcctttaggtatatgagggtcaaagagaggatttttctagggcactctctgctgacttcctagcagtaattaagatacctacctatgtaattgtgcagatactaatgatgtaaataaatttaggaaagaagttaatttcaagggccattagaaacagagaggaaatcgatgttagtaacaaatgaaatagaaaaatagagctagggaaaggatcaagtttattttagaattcaaatttagctattgaatcatttttgaattataggaaaaatacttctgatattggaaaatttccatttcagacaaatagtttaaactttatactctaaagtttatactttaaactttataagggtggcctagtaagaatcagtatgcagggtcagctttctacatgagtgattaccttataaaagtgctgtctttagccctttttaactaaaaggtaaacttctggcagtctcagtggcaaagtctgaaattgatcagtgacctagttgagttctagataaaatgctattaatagttttttagaaacattcagattcagagaattaggtgattagatgtgggctttattagatgagaaactccactctgaggaggcgcctgaggatctgtgctgttcattccctttcacacctgaggcctttcacatctaattgataaccacctaataggcatttcacatctagttgatctgactttgtccccagtagctgtgacttgacctcacttttcttgtgactccaggcagccactactttacctttcagagttgccatttgagaagaaatatgctattttgagtcctagacattttatttgataacatacagaatatgaaataacccccatagaaaactgagtatacagaaactaaaagctgggtatggtgacgtgcccctgtaatcctagtgctttgggaggctgagatgggaggatcacttgagactaggagttcgagacctgcattggcaacatagcaagacccccatctctataaaaaattaaaaaattagctgagcatggtggtacactagaaaaaatttaaaaatcagctgcgtgtggtggtgcgctagaaaaaatttaaaaattagctgggcatggtggtgcacacgtgtcccagctgcttgggaggccaggagtaagctatggatgcaccccactccactacagcctgagtgacagagtgggaccttgtctcaaaaaaaaaaaaaagaagaagaagaagaaactgaacacctttaatagatccctttgatatttaacttatttaatttacaaaatgatttggtcccaaatttgcagggaaacataaaaaacatgatcaaacagttttagggagttagacgttgaaccgtctatatagggcaactattctttactgttatcaaaagaagaatatcaagttttacttcttctgagacaatactataatttggcgtaaataaaaggtaacattaagaggtaatgaacaattctgattgacactggtattagaaggatgtattttaggaacaatctgtgttccattttgaaagtattaaaatgacttgttactgtataaatagctgtagctttgtgtatggttgaaagtgtatctgtcatttgctgctgttatttgcaaaactgactatagaactatttggactattatagaaagtcaacctataaatatcaatgcaaacttttgttcttgtggaatagatttttttttgttttgttttgttttgagacagggtctcgccctgtcccctataccggagtgcagtggtgcgacctggactcattgcagcctcaatctcctgggtgcaagtgatcctcccagctcagccttccaagtagctgggactacagaagcatacccccatacctggctaatttttttgtagaaacaggggtctccctatattgcccaggctagtctcaaactcctggactccaatcctcctgccttgtcctcctaaagttctgggattacaggcatgagccactgcacctggccatggaatagttttgacagcacttaataatatcaagcagaataaaaattccttgggaaaatattttggaaaaaaaatgtggagtggattatattttttattttttgtcatatttctgttactagctactaacattttactactgtaaattttgaaaatttgacagtccattatcaaatatgggatgataaacatttgagttgttgagaagctaagtaatcttttttattctatgaacctatgaattatattaaaagtaatctcactctttcatttaaaggccagtaaatgtagctctaccccttctttccagccttttgttagactaatagtttcaagatggacttttggccggatgcagtggctcacacctgtaatcccaacacattgggaggccgaggcgggcagatcacttgaggccaggagtttgagaccagcctggccaacatggtgaaaccatgcctctacaaaaaaaaaaaaaaaaaaaattaggcggtgtggtggtggtgcacacctgtaatcccagctacttgggaggctgaggcacaagaattgcttgaacccgggaggtggaggttgcagtaagccgagattgtgtcactgcactccagcctaggcaacagagcaagactcttgtctcaaaaaataaaaataaaaaagatgaatttttgagtttaacttccaccattaggcagctatggaatcataagcaagacatggtaattttttttaacctatcaaatgaaagaattgcacaaaatccctggtttttaaaccttcttggagttatggagaaaccctttgagaatctgatgaaagccaccaatatttacaccctgaaaactgcttattcatataaaagatagtgtgtaatttcaggagctgtagtattctctgaagccatccacagacctcaatttaagatccctggattagaggatttctgggttaatcctagttttcaaagtctataattctctatttctgtccacactactctgttgtctagctacgcatgctgtgatcctcattcttcagactcctgcttcgggtgtttactcatactgttttgtccattttcagatgtccttcctacccccttgaccatctttacctttgaatgttctaccctctttttaaaccacaattccttatcactttttatgtctgaagcttcttcagtcagaattaatctttcccttagaaccttataccaaatagcctttagcctgtttggttttacattatagtgattagagggctgtgtatccattgccccttcctcttctcacctattcctcaacagattataaatgtcttgacatacgtgactatgtgcctgtatttgctttgtaactgagtggtgccttgctagtagtagtcaaggaataattgcttgaatttgtcacttaattgtagtgactgtctgctgtgtcccctgctaattgctgagaggattagcccctttctcccaaaaaaggagaaagtggtgcagaaatagaaccacagagggaaaacctcatatagaagatgaactaggcccggtgcagtggctcacacctgtaatcccagcactttgggaggttgaggcaggtggatcccttgagcccaggagttcaggaccagcctgggcaataaggcgaaaccctgtctctacaaaaaatacaaaaattagttggacatggtggtacgcacctatagtcctcccaggtactcgggaggctgaggcacaagaatcgcttgaatcagggaggcagaggttgcagtgaaccgagattgtgccactgcattccagcctgggcaacagaggtggagtctgtctcaaagaaataaaataaaaatataaatagaagattaacttaaagaatgggtagagtttagggagctggacgggcattatctgggagagatgaagagaaatgagagaactagcgtgtactgtatttcattatcagtgaaattggtctatttttactgaaaagagagattcggcttacaattttcacctaagctttacattttttatttttgtcgtttttgtttccgcaggtacaagaaaattccccaggacacagagctggtttggagcctttctttgattttattgtttctattaatggttcaagattagtaagttcaactttctgtagttttgtctatagtatttgtaatctctcaaaaatggaatttttcagatgacctgagatgggtatttattagttacaatcattatgtgtagtatgccaatttatagaaataatcatgtattaataaacattgaaatatctataatattataccttatgctccactgattatcttagggaagtctctagaatcagtggagtcttttatatgttaaatatttaatttttataagcagaaagaaataattaagatgtaaaagattgctttttaaagatgtcagacttctgttggttgttgacaaatggattactagaaagattcattctctcatctcattctctcaaactcgtcagttttcttggtgctaagtttcacaatatatgaataatgttattagaaccagacagagagatgtgctccaaagtaccaaattaaaaccactttttataccttgtttagagtttacccataataaagttctaagataaagaaattatataatctcagcaaattcttaggacagtagccacttggttggtttaatttttcgtaacagtcttaagttttcgttcattacttacaacatctctgacatataaataaaggccaacatctggcctttatttgtttatgaaatgaaatatttaatatgctgtttctactttcttttctatccagctcttaataaagcatgtatttagaaatagagtccaaaattaaacgttaaccccagtaaatgttttagatttttataatcaaagtcatcacaacttcgttagtaatgtgacttcttatggcatattttgtttttacacattgaagccctagatcattctaaataatgttgggttgcaaattccataatccataatgagctattagaaaaaagtcagtttcaagttgttgctaacgtaagagttcttaatttcttgacattcttttacatagaagaaaatttaaatgttggtgaaacctttgttgaatgttttatttatgttgattattaatattactcttatagggccataggatgcttaagctaacattaaatttttatttactaaggaatgtgatttctatgtgttcacagaataaagacaatgacactcttaaggatctgctgaaagcaaacgttgaaaagcctgtaaagatgcttatctatagcagcaaaacattggaactgcgagagacctcagtcacaccaagtaacctgtggggcggccagggcttattgggagtgagcattcgtttctgcagctttgatggggcaaatgaaaatgtttggcatgtgctggtacgtatcaactgtgaactgttactggaggttcatgaagcagtgtggaaagatgttttaacaatggttgtttctggcttaataagattgtaaggatattattaataggcaatttttgccaaaaatcagcgttcattgctttttaagtatggatcaatttttttttaagttgaggaagagaagcaaatgtacaagtttaagaactttttctaatgatttattcattataagatgtgttagagtagatagctacaaaaatattttaaatatttgttaaatattatgtaatttttatgctcagaagtttaaaatatattctgtagtttctgacatctgacacatctctagcaagacagaagtatacagatttaaaaaatcaacataattaaaaattggactataaaccttggaagattattttatatatattaattttagggtgtgtgtttatgtcattctaggaggtggaatcaaattctcctgcagcactggcaggtcttagaccacacagtgattatataattggagcagatacagtcatgaatgaggtaattcgtgtgtttattcatagtgagaactatataaaattttctcattgaggtttgagttgagaaagatatttgcatgctttgcatttagagttaaaatttcagtctttgctgatcaaaaataacttaagcctcagggtgttaaatggaacatctggtaggtgtcttattaggtatagctgtgaggaaaaacacatactgtgcggcaattgcacagattttatgtgtaatatacagaaatctttgcatacctgaagtctaaatcaaattctcattttcaattgttcattgatttcattttctcttcccctttttgttcagtgacagcattagctcagctatattacatccttttccttgtctcttagctagcggaagtatacattgctaaatcaaaaatgagagaaaaggctgggcacagtggctcatgcccataatctcagcactttgggaggccgagatgggagaattacttgagctcaggagttcgagaccagtctgggcagcatagtgagaccttgtctctacaacaaatacaaaaattagccaggcatggtggtgcatgcctatagtcccagctacctgggaggctgaggtggaaggatcacttgagcctgagaggttgaggctgcagtgaggcaaaatcatgccactgcactctagcccaggcaacagttagagagaccctgtctcaaaaaaagaagaaaaaaaaaagagtgagaaatgaggtgcccagacaaccaggtcttaataatgggaagtaaaagcagaatatgtagaactcgggtgtaaaagaattgtactaagagtgccaactagatcttaaggaactggccataaagccttgtatgtagtaagtaggctttgcttgaattaatatattgaattaaacctgcttgtgatttttatgtctggggcagggcccagaatctgtatttttttcttagatttctcaggtgattctgatagccaggtttgagacacactgttccaaagtatggtaacgtgaaacattttctcctgtgacacttttgcagtctgaagatctattcagccttatcgaaacacatgaagcaaaaccattgaaactgtatgtgtacaacacagacactgataactgtcgagaagtgattattacaccaaattctgcatggggtggagaaggcaggtaaggtcattttttagactaagttatgactgcttaaacataccagtcagatatgttgcagacattgattgtttttattttgaaagaaattactggtttattttaagactcctcttaaaaaaaagggaagagctagtctagaatattgaaaccaatttttttaaagtacatatctagggaacatagtatatatactatagtccttttctttactaacctaagagctaacagcatttctttttaattgagaaattattgcgcataagccataattatagaaaagcctagaatttggaaacattccacatgttttcaaaagttctaatcccatgctgggaaaaggataacttagttgctgcaggcaggaaaagcttccgtttgctcacagtatctttacccacactacctgagattctccagctgaatgtttcgccacaagtattctaacttgttgcagtttgagaaaagtaagatagatgtgtcatccaagagtctggcctatatggggcaatacttgatcaaattatcattgtccattgcccaggtttgtaaatgcccagaaataggatctattcgaggcattcaaaatttattcattacaagaggcacttcctcatataaactacatttgcagagaagctgctatatttgaatgacaaattttcagtttgcaatagaaaaataccccctctctagttagaagaatactcaggtcagattagtaccacaagagtgcctgctgagcatggaatcaaactggaggaagagattctgtggacagtgaagaccaacagcaaagaacatcacatattctttcatttttaattatgttaactaaatttggctacattctttggaagacattttttcttttgatgtgtttaatactgtcagttggccattgcattagctaggcccatacagaacattttcgtcagtctgcctctgaccatgcatttggtctttttgtgcttctgtttttattccttcctcagaggctgaccacatttcatttattaaatcttatttctcttaatttcattcttaggctgtctttaagtttgcccagggtcttgctgttgcctcaagtgcattgtctattaccacttaattactttgaccaataagcaccttgttttcaaatgtagctacctctgaaaggccataattgatcactataaattatttaatctttatttctctaaatcccagtccagtgagaattgcagggttttgtttgtttgtttggagacagcgtcttgctctctgggctggagcacaatcatagttcactgcagcctttaactcctgggctcaagctgtcctcccgcctcagcttcctgagtacctgggactacaggtgtacacactgtacttggctaatttagaaactcttttttagagatggggccttgctttgtttcccaggctagtcttgaactcttcgcttcaagcaatcttcccaccttggcctcccaaagtcctgagattataggtgtgatcttccatgcctggccgaattgcagttttgattgtgagggaagaagggaagaaggaacaaataattgtgagatgaagcatcattgtgcatatcagactggtaaaggaggagctaggcctggcatggtggctcacgcctgtagtactaccgctttgggaggctgaggcgggtggatcacttgaactcaggagttcagtaccagcctgggcaacctgaagaaccgttgtctctacaaaaaatacaaaaattagccagatgtggtggcatgcacctatagtcccagctactcaggaggctcaggcgggaggattgcttgagcccaggaggcagaggtcgcagtgagccaagatcatgccactgtgctacagcctgggcaacagaataataaattgtcttaataaataaataaataaataaataaataaaattaaaaaggctgaagttggctactgcctgctcacccagcttttggtggcagtggagataatagatgatgtggcaggagaagggcacagaggtattcatgcatggcctactctgaaattgtcaagttgtttgggaaataaaagacatcatgatggaaacataagttggaacctgattatggagagccttaaataccacggtcaggacttccgatatattttgagcagttgaggctgtgataattgtatcagtaaggggttttgggttcaaatggtaaaaactagctgtcaccatcataagcagataacatacttaatgatatggattagctcatataatcaaggaaacagctgaagaaccagatgtagaaaggacaggactcagaaaacctagggatttagataggaagaagtatttggcaatgtcatcagcattcattctactaaacccatttttgttttttctctgactcccaaggtttgcagccatgggcaagagaaattggcctggctttgaccatgagccattcccttggtttgggcagggcagacactctgattgacaatcctaccagcactgcacacaacagcagagaagtaattccccaaagggaggaaagagaaaggaatgttgagaagacatcagactagaaagaagcaatgtgatcacatcttactagaaaaatgcctctggtggcagtgggaggatgaaatagaagagatctgggttgaacatacatgactgatttgtgtcaggttctgaaagagaactatggaatgtgtaaatgatgtcatcatacagacgtgcttagagctcttcagtggaaaggctgtatcgatgtcatttgtttagcgagtaatcatcaaatgtctgccatgtgccggcagctatgaaggcagtaaacagacaaggtctctgcccttcaggaccttaacattttgttgggggagatagatagtaaataaatatgcagtgtgttggatggtgatgaattcttgaaaaataaaggagtaagggtgatatccacagtggagggcagggtgttgttttctgtggggtggtctgggagacctctgcttagatgacattatctaaaagaatagaaatttgtttgtttttatcttttaaaatctcaaagaagggagtgcatgttcagggcaacttgaatctatgctcttgggttacccgccccccccaaaaaaaacacctcaaagaaatacaagctgtgatagataacaacgttaagaaaaaaatgtttttatagcctaggatgtggcattggatatggttatttgcatcgaatacctacacgcccatttgaggaaggaaagaaaatttctcttccaggacaaatggctggtacacctattacacctcttaaagatgggtttacagaggtaagatcacgttcctacctgagtatatcataaagtttttaccaaaacgagtcacgtgtttcagtgctactatatggcagtagcactatgaaaatagggtagacgatgagttaagtattgattgtgttacatttgaggttcctgtaaaatacctagatagaggttagatatgtgagtctggattttaggaaaaaggacagggctagagatgcagatttgggaatcatcagcaaagagagggtaatgtaacccattggctgttaggaaacctgtactgctagggattgggtctgggtgggtcgccatcttgaaaatctggatgggcagagatctagcaaaggaagctcagcaggaggccagagggaaaaccaagcttcaagaaatcgaacacagtcagccatgtcaggtagtgcagagaagtcaggtgaaaggagtgaaaaaaaccatgtcctgggcgagagcaatttcagagacttgccaggggacaaacaaactgcaggtcagcagagtgaataggtgaaaaggtgctgctagctgttgcttattgtttcaagaaacgattgagaaaacaaggagagctatgtgtgtgggggtcatgaggggagtgaaggggctattacaggatcaaagtaagactttttaaggaataagagatacttgagcaggcttacagggcttttgaatgtttcttaaggaggtatctcagggcagttaactcttgtctgcaccactaaataaaaaccaaatacccaaaaagaaaatgctgctgttgtaaagacaaggctgctgccactgtggttttgtctacacagtttggccatcttcagttctagaggaactgaagctcttctttaagagctgctgggaagtttcacctccaacattggctcatggccagagccaatatagttacatgttcagaccccaaccaccatatccactggccctaatcagggctttcccagttgaacctctttgggtagtctgagaagatgacagtgactagcagctgggcaaagggccagaatacaggttgtctcggaatgtactgaagggcactggagctgcagaaggtgggttattcagaaatgaaaccacccatctgtagagtccatagagactcctttttttcttctcctgaaaagtggagatctggctgccacatttattcactgatgagaaaatattaaatgcactcatgaggttggaaatcttgagaagtctatcatgtattaagacttccagctgatttctttcctgagcaatgaaagttaaaacaaataaaccagctgggaattcaggaaagcagtggtggtttaaaggttgaataaaatgatttccaggtggtgaggaaagaggagagagtagaatctcttctagtgtggaagtatgaagaacagcatgtgcaacttggggtagaagccatgtgtctcaagactagaagtgacaggagagagagatgcttacagtgcatggtccgtgacatgtaccaaaattaggagggagtgtctggaggcagacgtgccagatgaagcttgtgacagctcatgtgtgaaccaaatatctatctgcagggcaagtaagagccaatatttatattttctttgaaataaacttaagtaatctttgtgtttttttttctttttttggaaggtccagctgtcctcagttaatcccccgtctttgtcaccaccaggaactacaggaattgaacagagtctgactggactttctattagctcaactccaccagctgtcagtagtgttctcagtacaggtgtgcagaaaaatatattctgttttcagtctattttatgtaatattattgcatagaattttaaaaattgaccagacacagtggctcacacctgtaatcccagcactttgggaggccaaggcaggattgcttgagctcaggagttctaaaccagcatgggcaatatggtggaaccacgtctctaaaaaaaaaaaactttttttaattagccaggtgtggtggtgtgcacctgtagtcccagctcctcgagagcctgagatgggaggattgcttgagccttggaggttgtggcagcagtgagccgtgattgtgccactgcattccagcctggtcgacagagtgaaaaatttaaagaattttaaaaaattattttaaaaaaatttttaaaaaagaatttaaaaaattaatgccagtgtaccttgaaaactgcatatgtactctgtgttgacaggtcctggctgtgaaagcttgttctaaatcaccatgtggatacacacggggtttaaacttcttccctgcatattttagaccctgagctttccttagattctacaacttgtaaagccaggactctgagttgaaattctgtttaactgctctggttactcaacacgtttgcgtgtttctgaagtagtaggcactgaggatgcaaaagtgagtaggaactcctttctgaggagctcagtcttgcttaggggacatgtgcctgtctccttccttttctttttttttttgaaacagagtttcactctttttgcccaggccggagtacaatggcatggtcttggctcactgcaacctctgcctcccgagttcaagtgattctcatgcctcagcctcccaagtggcagggattacaggcacgtgccaccatacggcagccaatttttgtatttttagtagagacggtttcgccatgttggccaggctggtcttgaactcctgacctcaggtgatctgccctcctcggccttccaaagtgctgggattataggcgtgagccactgcacccagcctccttccttttcttcatcccttgttctacctgatatagtcctttttgtttgttttgggttttatttatttattttaaagctttctcaagataaaatgcatattaccatacaattcacctgcttaaagtatacaatccagtgtttttttagtgtatttgtagagttgtacaaccaataacctcaaccaatttcagaatattgtatcacaccaaaagaaaccctgtacgcattatcagtttttctgaagttttagtttttatgtttttgtagggctggggtctctctgttgcccaggctggtccctaactcctggcctcaagtgatcatcgtgccttggcctcccaaattgttggtattacaggtgcgagtcatggctcctagcctcattaataccttttatttctgggctgtcttaaatatttatattcacaatttgtttatatcccactttgttctgtaatggacttaaaacagcctaccaagatgcagtagtaaggttgacagtttggtgtctagaattggtctcctaggttctcatcccagctctttagtcctggttttatttctctagatgaaatttaaaatttcaaacatacacaaaagagctggaattgtataatgaaccccatcacccaactttatcaattatcaatattgggatatacttcccctttgccttctttgctggttttctttttttccagctttatcgataaataatttgcctaccataaattaactcacaataagtaaacaactaaatgatttttagtaaattcatagaattgtgcagtcatcaccacaatccagttttagaatgcttcctagatgaaattaagtattaatgtcatcagtctctaatcatagagttggaagggaacttaaagtttatttcattcaagcagtatgagtcctttttatgatattacgattttttgcctacatctcatcacataattctctagtttattcctgaatagacttagtaagggtagggtagtgtacttcccaaggcagcagcccatttgagtctgaattgttcatatttgttttagagtaagcgtgtttccagatgctctttttttttttttttttttttaaaaaaaaaaaaaacagactctgttgcccaggaaggctagagtacagtggcactatctctgcccactgcaacctctggctcccaggttcaagcagttctcctgcctcagcctaaccaagtagctgtgattgattacaggcacgtgccaccacacccagctaatttttgtatttttagcagagatggggttttgccatgttggccaggctggtctcaaactcctgacctcaagtgacccgcccgcctctgctgccccaagtgctgggattacaggcgtgagccactgtgcccggccctttttttgaggcagagtttcactcttgttgcccaggctggagtgcaatggcgctatctcagctcactgcaacctccgcctcctgggttcaagcgattttcctgccccagcctcccgagtagctgggactacaggcgcacgccaccatgcccggctaattgtttgtatttttagtagagacggggtttcaccatgttggccaggctggtctcaaactcctgacctcaggtgattcacccgcctcagcctcccaaagtgctgggattacaggcatgagccatcgtgcccggccccagatgcgcttctgattttaggcgatagttgacatgtctcttcaagccccagtttctcttcgacattttaaatctttcctcattacgttgtagttatacttgtattgtctgataaacacatgcacggagctccctggcttatggcactgcagagaaatggcttcttgactgttaaagacaaatgtaaataaagcactaattgctcaaaagagactgaaagaaattgacatcatcacttttgagtaaataaatttaaaaagactaaaatgttctagcatcacaacacgtgagaaacaactttttgatgggcatttttcagtcttcacttttcattatattgcttgcaaagtagcctatacattgtaacagtgtaatacagtagcctatataatgtaactgtagagacataaaagtaactatagagaaataaaagtatatgtatttttaaacttttttgtggatttgaagatttttggattataaaatttttagaaaagattttgaagtggcatcgatcattgtgacctgcttgatttttctgcagtgtatcacctttttcttttttttttttttttttgagacggagtcttgctctgtcgctcaggctggagtgcagtggtatgatcttggctcactgtaacctccacctcctgggttcaagtgattctcctgcctcagcctcctaagtagctgggattataggtgctcacccccatgcccagttaattttgtatttttagtagagacagggtttcaccatgttttccaagctggtcttgaacccctgacctcaggtgatccacctacctcagcttcccaaagtgctgggattacaggcatgagccaccgtgcctggcccaagtgtatcaccattttacatgctatgtattttgatctttctcctttttcctgcccctcattagaatgtaaatttcctaaaggttctgatttcttcatgttgtaaagtgcctcagtgccttgaacaatgtgtaacatacagtaggtgccccccaaaaaacttgaatgaatgaccacactcaactatccattcaactccattgagaatctgatgaaagcaaagaacctgccttcgaaaaattgttgtatacaattttaggagcttcacagaccccctgaagcccacttgtgggccctagatttagaattcctgtcttagattgagtcttcctggcttagatttagtcagttatttttgaaacttgtgaatgtatctatcctttaagaatgaaaagaaacttatgtgaaagactttattgggaaagagaagaaattggcttaaccaatccaagctgcttttgttttcttaaaaccgagatttcaaaacaaatataaaaaaattatagcattgctattgtgtgtgaccattaacaaagcacacactcactaacattttggtacagagtagagaacagcttcttttatttcagtgaaattatgcagtctgggatccagtagagcatttgccagtgcttcagttagacttttcttatttttgcttgcctctgaattccgcagaaaagtagataaatgaataaataatagactgcctgcatggttggttcatacttttaggcacaatttattcccgctaccatatgtaagcagatctgtaagacaaaatctggaatctatgctagataaatgaaaatgagtgctaaataagtgaaaggtgtgctttcatttattgtttcgacatcagcaaaacgtcccactggggtaggtggtaaacgtgattaggtggtatcctgaggcttacttgtacgtgaggaacgtaacctcctcaagctaatgttagtacacgtttgtgttagacttcaaaggactgtcacagaacctaaggtcaaaaggaaatggacattcaggaagccaagtcattctctccatcctagaggttcatctgctcttttgtctctttcaggccatctatgtcattcttttctttcacagactagcattcactgtttcacagggcacatggtccccctgcaacccctggcttacgtggcatcttagtttaggagcccagttgagattgactagaatccttgtgtcccatatacaaatttctaagacagttttctaatctagccctgcttgggtcaggtgtaaacctcttgtccagtgagctgggctggggtgggactgcacggcctcttgccctcttgtcacaggctctggtaacagcctttgttgagagctgtgggcagagtcagtgaatctgccgtaaagggtgatggacagtcagttgcagctggaaatcgggaccaaatgaagacctgaccacggggcaaggagggactgcagattgtcctaatgtgttctgttcatttcttgtcgactaaatttgttagaaatgaaaagattgtgctttctttttaggtgtaccaacagtaccgttattgccaccacaagtaaaccagtccctcacttctgtgccaccaatgaatccagctactacattaccaggtaaccaccaggggactagagatgtggctgataataacagtattactgatatttgcatcttaaaaacaatgaaaaatattatacctgtgtggtaactttttatgtcttttaatctcagtttatctctgcaataagtttgtgataaatgagagctagggcaactctccttagtaaacaaggaaccagagatgtcatttaccagctagttagctgccgagcctagtgctccttacccccagccagcggccacctactgcccctgcagctctacagtgcagcatcggccaggaataaggaatctgcagaagtccattctccactgtctccttagtgaggatttcctggcagtcattcgtgtgagcctgaagagaaggcttcttatttggtcttcagtagctctaacattaaattaaatttttgtgtttttctcttcatattcccagtgaagaccaagtccctttatccagccaataataatcaaatactattttagtgatcaaatatactttcattgtgagggcttttaatgtatggctaaaaatgtcattatccaagcatattaagccatgaaccaaatgtgtgcacacacacaatgatgaagcaagtgtgctgatatgtggacatgtgggaatttgggtgaaaggtggattctttttactacttttgcaactgtaagtctgcagttatttttcagaataagaaattttaaaagtcatagagactgtaaacctcaaccatcaaagaaaaattcagtttcattatctgccatatctactgaaacaaatcagccttttctccaaggcgctcgggccatcatcgttcttattccagagtgttaagagtattagttatttattttcatcttcacccagttagccacctaatctatctaatcacttaggtagataaatatatttcaattaagtgaaattttgttatttatattgttatgatacacagctgccacacattaggtggacttctggtactgtcacttagaagtggctgggattgtttttaatacacgaggatttatttcttccccaggtcaagtgatttctctttttttcttttctgccttctcttcaggtctgatgcctttaccagcaggactgcccaacctccccaacctcaacctcaacctcccagcaccacacatcatgccaggggttggcttaccagaacttgtaaacccaggtatgttgcagatctcaccctcctaggactctctctaataaaagttttattcaggaatgcccatcctcttcagttttttctggagagagcaaatcagtttaacagatttcagctacttcaaataaatattcatcttttttgtttaaaaagcttaagaggatcacgcctgtaatcccagcactttgggaggccgaagtgggtggatcacctgaggttaggagttcaagaccagcctggccaacatggcaaaaccccatctctactgaaaaaatataaacattagccaggcatggtggcaggtgcctgtagtcccagctacgcaggaggctgagacagaagaatcacttgaacccaggaggtggaggttgcaatgagctgagatcacactactgcactccagcctgggcaacagagcaagacttcatctcaaaaaaaaaaaaaaaaagcttaagaggaaagaagaatgtctctcagtccccgctgctactgctgctgctgctgctgctcctcctcctcctcctcctccccctcctcctcctcccgcccccctcccccgccccagagtagcagtaaagcacagtggagtggccctgctgcactgactttaatgaaagtgtacaggctgcctagtggaggcgaatgaattccccaccattctcatcacccctgctcagctggctgggcttgtattttttgttttgtttagtttttttgagacagagtcttgctttatcacccaggctggagtgcagtggcaccgatcttggctcactgcaatctctacctcccaggatcaagccatcctctcacctcatcctcccaagtagctgggactacatgcacataccaccacacctggctaatttttttgtattttttgtagagaaggggtttcaccatgttgcccaggctggtcttgaattcctgggctcaagcaatcttcctgctttggcctcccagtgtgctgggattacaggcatgagccatctcacccagccagtattcttcttttgtaaaaaaaaaatacatataaaaaaacaaacgtgaatattctccattatttacaaatgcttttatactcaaaactatgggaaattttagctggagatgtctacggtagcagatattccaagtgtctgcactcagattttctgtctgaaaatgaagcagcagcttcctacaagtccatgcagttaatgatcagcataccttaacctttgggagggctgacttttaataggtcatctcagtagttttataggcccgtcagtgatgtcagtgaatgatcttacagcaccatggtgtgcatcgtcaccatcttgtttctgtctagatgataattgtccctcttgtaacactcaccatctgtgtatattccttaacctacttagttttcaggccaaaggtttaaaaatgaagtactaggccaggcacagtggctcacgcctataatgccagcactttgggaagccaaggtgggtggatcacctgaggtcagaagttcgagaccagcctgaccaacatggtgaaaccctgtctctattaaaaatagaaaaagtagctgggcatggtggcaggtgcatgtaatcccagctactcgggaaggtgaggcaggagaatcgcttgaacccaggaggcggaggttgtagtgagctgaggtcgcaccactgcactccagcctgggtgacagaatgagactccgtctcaaaaaaaaataaaaataaaaatgaagtactagtagtagtcaaactaccatttactgtcgcagcgctcaccccaccttttgtgccctgtattcttggctcctcctctgccctttccctaaatttgacaggctctaagtagtgaggatttcaccagctggtggttgccctgaacctgtgctttacaccctgcctttcctttgtttcttgaaataattctcctttccttcatatgcattttaatttttttttttttttttttttttttttgagacagagtctcactttgtcattcaggctggagtgcagtggtgtaatctcatctcactgcaacctctgcgtcctgggttcaagcagtcctcccacctcagtggccttgtagtctctagtagctgggaccacaggtgtgtgccaccacgcccggctaatttttgtacttttttttagtagagacgaggttttgctatgttgcccaggctggtctccaactcctgggttcaagcgatcctcccaccttggcctcccaaagtgctggggttacaggcgtgagccaccacgcctggccttgcattttaaaatcatcatcatgagcccactgagtgtaatataaatagttatcaatcacaggttttaagcaaatgctgagtactcctggtgaggacagtggaaagggcgagaatccaggcccctcccttctgctgccttcgcaggagggttgcagcctacctctccctgttgtctgtcaagaatgcagctgtaactcagcttgcagctggcatgggtgagcatgagtccccctgtctgacatccagtgtagctgtgtcacctgctgggtgggctgctatctcttctgactggaaggatcctatctatctttcttccctgagccagtttcccccagtgctgggccaggttacatggagcctagaagttgagaacctattccttcaggcagctgcgattgtagggaatagttaaccctgccagggcctctatctggaaatcagccaaggttgtgatttgtgttacctcctcaacttcagtttccttaatgaaatgtaaataaaaatagccctttgacaatgcctgctgtcctttcagtgctgggaggatgtatgatctatgccgtttttgtcctaggtctgccacctcttccttccatgcctccccgaaacttacctggcattgcacctctccccctgccatccgagttcctcccgtcattccccttggttccagagagctcttctgcagcaagctcaggagagctgctgtcttccctcccgcccaccagcaacgcaccctccgaccctgccacaactactgcaaaggcagacgctgcctcctcactcactgtggatgtgacgccccccactgccaaggcccccaccaccgttgaggacagagtcggcgactccaccccagtcagcgagaagcctgtttctgcggctgtggatgccaatgcttctgagtcaccttaactttgaaccattctttggaattggcgtggtatatttaaccacgggagcgtgtctggaaacgcaaactatcattaatttcatactagtttgtaccgtatctgtaggcatcctgtaaataattccaaggggaaaactaaacgaggacgtgggttgtatcctgccaggttgagtggggctcacacgctagggtgagatgtcagaaagcgcttgtattttaaacaaccaaaaagaattgtaagggtggcttgctgccaggcttgcactgccgttcctgggggtgtgcatcttcgggaaaggtggtggcggggcgtccactaggtttcctgtcccctgctgctccttccgtaagaaaatgaaatattctatgcctaatactcacacgcaacatttcttgtactttgtaagtcgtttgcgagaatgcagaccacctcactaaactgtaaacggtaaagagatttttacttttggtctccgtgagtcgcatctctactaaggtttacacaggaattccacctgaagacttgtgttaaagttctacagcgcgcactgttaactgaacgtctttttcttcagcctatacgcggatccttgttttgagctctcagaatcactcagacaacattttgtaactgctgctgttgctttctacatacaccttataaagtgacatttcaaaagaaataaggtgccacagttttaaaccagaaggtggcactctgtggctccttgtagtattatagctatactgggaaagcatagatacagcaataaagtacagtaattttactttttttcttgtgttacatctaaattacaacccttaattgccacgtgtgcacttactactctccagtatgtcttattactctccagtatgtcacgcatctttaacttttcacgtcctatgtttgctttctcccatttttaagagatggtaagttaactggaattgatttactgaatgaaattaaatgcagatatccctgtttttgaaataag

SEQ ID NO: 37082 - DNA, 37929 bp, Homo sapiens; identical to SEQ ID NO: 37081

SEQ ID NO: 37083 - DNA, 17655 bp, Homo sapiens
acttagcggcacgcaccacagctcgagcaccgcccttccggttggagccattgcaagccccccccacgccccgcccccctcgctaggcgctcgccacgcccatgcctccgtcgctgcgcggcccaccccggatgtcagccccccgcgccgaccagaatccgtgaacatggcgaacgaggtagggcccgttgagcggagggccctgagtccaagggagggagtgcatggcatgggactaggctgctatcctcgggggcgcgcgaggctcggcgcccaagacgggatctggctcttggttctgaaactgggcccccagcgagcggctcagaggggcagaaagagaaggaagctttgtctcggctcttcagttgggaagcagctttctttgctgcttctgggacagtcggaacggggtgggggggtgggagagccggagagtggggggcaggggctggtcaggtcggtatcccagtggaaatggcttaggagcggccacgcattgcttcttacacgaaattaagtaactcgctctgggtcattcttgcagcttgcatacttggcagagctgcagccagatcccgtgcttctaactcctaggttgcttgtgttgcataattgagcctacgccttaattattgtgcctccaaggagtgtattttggaaagacccctacgtccctttcagaaacattttcgagcacttaaataccaagagatttatattccctctagtcctcacgtaacaaacacctctgcgaggtgttatccccatcttaccaaaaactgaggtttgaggttggttgtgcttggtcacaccaacgatggcgagctgggattccgacccaggtctgctcctctatgacaaattcataaaatacaaattagacagtaaagaaaggcagaaattacgaataacatactcagtctaaagttgctgattattttaatgttttgcaattttggacattttctagtaagacaaatggccttaaacatattggagtttgaaagaaataaactctaaacagtctttcagacttaaactggtagttgcttttccttattactgagtgtctttattcagagaaggtgaaagattataattgttactatagttcaaatgttgaagtagggccatttcccgcggatttagagtggggctttgttttgcttagaattgtcagtaaaaggaaaaggttaggctccattaagacattttttaaaggggagcaggccatcaaatttagtattcttgtttctttggattcctatgttgcataacttaattgttagtattctgaatctgacttgtggagttgaaatttatggcacattgaaatgaaaaaggttctaatgcagtgtctgattctttgtactatgagatttaatatctgcaatttaattttaaaaacgatcatttccacatttccaacctcaccaatttacagaggccatttccctcccccccccctcccccgccagttcagacggagtttcgctctttgtttcccaggctggagtgcgatagcgcgatcttgggtcactgcaacctttgcctcccgggttcaagcgattctcctgtctcagcctcccgagtagctgggattaccggcgcccgtcaccatgctcggtatttttgtatttttagtagagacggggtttcgccatagtggccaggctggtctccaactcctgacctcaggtgatccgcccatctcggcctcccaaagtgctgggattacaggcgtgagcccctgcacccggcctacagaggccattttttatatctctatgtagttcacctctcctttccctcaaccgtttgttctgttgctaccaataactactaacttattttgcaaagctatgctgtgccaaggattgtgttagggacttcatattctttttttttttttttttttttttttgagacgcagtcttgctctgtcacccaggctggagtgcagtggcgcgatctcggctcactacaagctccgcctcctgggttcacgccgttctcctgcctcagcctccccggtagctgtgactacaggcgactgccacctcccctggctaattttttgtatttttagtagagacggggtttcacctagccaggatggtctcgatctcctgacctcgtgatccgcccgcctcggcctcccaaagtgctgggattacaggcttgagccaccgcgcccggccagggacttcatattctttcttattcagttctcacaatcaccctatatgtaggtgttttaccaccatttataattaccttttcctcatccttcagtatcctggttagaagtgaagctctcccaaaccaagcaaagttacactcttaacctactttttttgctttctgtattactttgtgcctgtctctttaaatcacactctttgtaattattaactttaaagtctgtctcctgtaaacccagtggcttacaacctttagtctgtccacacatttctcaagtgtaatgtaaactaattagaacctttctcattacgtgtgattctcttgtaatggagggtatacatgactataatctctaaagcaggtctgtgtgctataattagtcacgtgtaattttaaattttcagtagcctcattaaaaaggaaaaagtgaagttttaatattttaattatgttaaattacattatttataatgttgttataaataaactaccatttcaacatgtaagcagtatttttaaaaatactgttgatgagatatttttacttttctttgaactaagtcttcaaagtccagctatatttatagcatatctcagttttgtttgtttgtttgtttgttttgagacgatgtctcgctctgttgcccaggctggagtgcagtggcacaatctcggctcactgcaacctccacctcccgggttcaagccattctcctgcctcagcctcctgagtagctgggaccacacagatgcgcaccaccatgcccagctaatttttgtatttttgtagagatgaggtttcaccatgctggccaggttggtcttgaactcctgacttcatgatctgcccaccttgtcctcccaaagtgctgggattacaggcgtgagcagccaagcccggccagtggtcattttctaagagctcagtagtcatatttggcaagtggctgctgtattggccggtgcagttacaagggatatagctcctcactgttacactcctaatcctccttcccaccctgcagttttgcaccaagccggtggtattcagaacagcctgagcaaaagaatttcttcaggcatatgttaagcatgcagatttcttggaccccatgccagacctgctgaatcagattctctcggaacttgtgttcttaacctgcttttgcatatgcactgtagaaggccattaaatatttgatgagtacaactttttaaccaaaagatacttttctatctgaccaggtaatcatctcaattaaatcatttttgatgtatactatttgtgtgaaatctaaaaacatatcacttggaagcatatgtttctttgtgaatctgtgatatactttttaagattagcattaatctgtatctaaattggctattaagtagttacttgtttaggaggataaacagcttattcccttttttccccacttcaggttatcaagtgcaaggctgcagttgcttgggaggctggaaagcctctctccatagaggagatagaggtggcacccccaaaggctcatgaagttcgaatcaaggtaatgatacatttaaggcactgggaaaaaaagagacacaatgaggtctctggatagatgagtagatctgagatctgcagaggataaatcccaaaggacagtgtcaaagaaaaggtgttgaaagtcatccagccttacaatcacaacatccttctcttatctttcacctttgcagcatgcttctccatctcttttagttttgatcttgggctgagcagctatccccatgggtcactggattattgcaatttatcttctgcagtttaggtttaaggtaactctgtaggatactcatttttctgctgattagataactttaaatatatgctgacacgttagaaacaaaagaagaaatgttaccagaaaggggtccttattctgaccccagagagggttcttgtacctcacgcaagaaagaatttggagtgagttcataggataaagtggaagcaagtttattagagaagcaaagaaataaaagaatggcttttccatagacagagcagcagtatgggctgctcaaccgagtatacatatagttatttcttgattatatgctaaacaaaggatgggttattcgtgagttttccaagaaaggggtgggcaattcccagaactaaggattcctcccccttttagaccatatagggtaacttcatgacattgccatggcatttgtaaactcgtggcactggtgagactgccttttggtgtacaaatgcactatgattagcctataatgagccttgaagatgaccagaggtcactttcattgccatcttggttttgatgggtttttgctggcttctttaccccagcctgtcttatcagcagggtctttgtgacatgtgtcttgtgccaacctcctatttcattctgtgactaagaatgcctagcatcctgggaatgcagcccagtaggtaggtctcagccttattttacccagcgcctattcaaggtggagtcgctctggttaaaatgcctctgacagaaatggtcttcagttttgctacagcgacttaaacaagatttgagaagaggctcctgattgaatagagtaataagcaaatgaagtcagcttgcttagagagctttaaaatgcacccaccctggcggacaagggtagggttcagggaattcattattctagtgcttctcaacctctggtggcagagaaatgatgttacccttggagagaggcatattgtacaaggtagccagctggagagatctttgaaaccttggcatgtagaaaacttcatgtgtttagcattctactactctctacttgttttgatataaaattagtgctttagagtagtgatcattaacattctaggaagagagtcacagcaaaaaagagctgtgacttggagtatacttcccctaccatctcactttcaaaacacaccacacatactggctcatgctcccaaagatcacaaataccaggtggagcagaccaggaccaaataacgtctttttatcttttttttttttttttttttttttttggagacagagtttcactctgtcgcccaggctggagtgcagtggtgcgatctcggctcgctgcaacccctgcctcccaggttcaagcaattctcctgcttcggcctccctagtagctgggattacagatatgcgccaccacgcctggctagtttttgtattgttagtagagacggagtttcaccctgttggccaggctgatctccaactactgacctcaagtgatccacacgcctcagcctcccaaagtgctgggattacaggtgtgagccaccacacctggcccaaataacatcttaaggtcctttgcaacccatacacaggaatttgaaatcatataatagtgtttttttcttcaaattcagaaattaagctgactgtgattttgccactgaagatgtttgtcctggatgtattaagtgcccatacagctcaatgggtattcattgtgctcattgagctgtatggacacaatgagtacagccatcttccctgcaaaactgcagacaggtagcaaagattgttacgttgtaagtggatatataagccaggagcagagacgcataaatagaaatactccaagattttgcctttctgtgcttttggtggctttaaaatataagttacggctgggcatggtggctcacgcctataatcccagcactttgggaggccaaggcaggcagataatgaggtgaggagttcaagaccagcctggccagcatggtgaaaccccatctctactaaaaatataaaaaattagccaggcctggtggtacgcgcctgcagtcccagctactcagaaggctgaagcaggagaatcacttgaacccaggaggcggagtttgcagtgagccgagatcatgccactgcactccagcctgggtgatagagcgagactcttgtcccaaaaaaaaataataagttacttgaaagccagagagatagagataacaggcttatttaaatagaacttgtatgtggtttgtaaaaagggagttggttcctctgaaagttctgaaatttggtccagactcaagcagactggcctatttcagaaatagtcattacctctttaaaaatcatatttcccagctgtcatgaggaaactagaagtgagttggattccacctgttttgcacacaggcgatggttctctccatgcttgaaggcatagtgcccataaaatgaccttgtttaccttctcttgctaacgcgcgctgaaagggggactagatgttccctatttcgttgcatataaatgcaccattgcttttatgtaccactaaaaaattgctgccaattctaattgttaagatgccatggattataagcacatgctgattttagagaggttaaaatatgaaagaaatgtgtcttagagtcaatgaaatatagtattataataaaatgacttttcttgtatctgtacctctgaattgcatgcacacatacttacacattcgttgttttaatgtcctgatagatcattgccactgcggtttgccacaccgatgcctataccctgagtggagctgatcctgagggttgttttccagtgatcttgggacatgaaggtgctggaattgtggaaagtgttggtgagggagttactaagctgaaggcgggtaaggagaatacttgaaccacttgtttaataattttggcttattcctatggggaaattgtttttctgataaaactacccactatttatgaataggtatcatctaagtagattgtcaagattaagttgattcctcatctgggaagcacaaatatttggatatttttttctctctgattttgcagactactgtttttgtgaaacttttctaagtacatttccaaaaccaattttggcatattaagcaagaatttttagagatgcatcaatgaagcaggattttgaagcatataacttcattgttcttcagttattgtttaaagagtttcatttagataaaaatattgaaacatactttttgcatggtcagacagtatctgaatgatgttacctaggtaaagttctaagacttgaagtttttaactttgcaaagccacatccgttgacaggaatttgcaagggctgatgttttcatttagaaatagatactacctattcaggatgtctttgcatttgtttccaggtgacactgtcatcccactttacatcccacagtgtggagaatgcaaattttgtctaaatcctaaaactaacctttgccagaagataaggttagtatctttttatgttcttcttaaaacacaagtgctgcgggataattaaggaatcacagagaccgaggggttgaggaggaattatttaataatttaggttcattaacccagtcggattaacgttcaaaggactgagtcccgaacaaagagtcaagctaccttttaagcatttcgtggggtggggggagacctttgtagggggagcatattacagaagcaagaaacaaagacagttattcaactgagacatgcattacatcatttcttatttttcaaggaacaacgtgttttatgatttgagatgatctgtctagtgaccttgcagctgcacagctagagaaacagagtcttcacaatgcgtgggaaagggagagagaaggctcactagccacagaaaaacaggcagttaattttaaaggactccagctctttctcttcctcagggggagttgggttttcttacatacaactgagtttttgcttacacattctttaatttcttttaattcctgttccacaaggtcatattaacaatgataagaataaataattgtgtggcagtttatgtagtgcattgtacatcagtggtttcattccatctttataacaacctcactactatccccattttcacagatgagagaagactcagaaattaagaggttttgacacagagagggtacctgggcacagcaacagccttctctaccatttgcggttttctgcctaattgtgcaactgaagaaacatttatttttcacatgaggaaatgtgtagcttgtagaggtggctgatttaagtaacttgtgcagctctcaaggggtgtctgccttctgtctcctttctaccccataaaagaaagaagcggggggatgtgaagagaccaggggagtgactccaccttatgcctcaccctggtctcatcttgcccagctgtggtaccctatgttaaccttggctggtcttcacaaaggcgactggaccctgggccctccctgtcccaggatcccctaacccctaccccagaatggtttgtcataatctggaaatttgttggctcatttttctttcaactcctttatttttcattgaacaaatctctgcttttgaagagttgaggttatctgctatctttttttcttttctctccctccctcctgctgcaaagaaaagaaccaataagttttagggatttttgtgtgtatagacattgtcatccggatgtaacttgctttgaagcagtgtttctgttgtgagtgtctcttactgtaaatatttgttcatatttttgtgaattcagtactgtgtaccattgtattaatagtaactttttataaagcaaaccataaatatactgacttttcttacagataaaagagaaactaaaggggtgtgcccagtatcaccagccgttaagatataaaacagaattttctgtacccattctcttcacataacagcaggctaaatttgccaaaccatgtagtaaggaaagacgtgcttctgagattaaacgaaatcatttttatgaaccactgcccagtaagtgagagtaataaaacttacccactaaggctattaggaagactgcaggagataacctaactccttgacacagaaaaggtagttgtttttattgtactaggtaacaacactgaaagaactacctctttgaggaaatttaagatccccttgtgtgtgttccgtttttttttttaattgaagtagagcatgcatattataaagcacttaaggtgtatagatcttaagtgtacagctcaatgaatgattatgtatataaacacctgttgatttgaacgtcacccagatcaagatagagaaccctgccagcacccgataagctccctcatgtcccttccaagtcagaacctacctccctcttaggtaaccactgtcctgattcttcctttcactgtgaccttgtataaatagagtcatgcagtgcatgctcttttgtcaggtttcttttttttcataatgtctgtgagatatatccaagctgcatatgcgtcagtagttccttcttgttgctctgtcttaatccattcaaaataccagtattgatccattctcctgttgatggacatttagattactcccagttttgggtggttacagttaatgctgctaggaacattcttatttatacatgtcttttgatggatataggcattgctttctcttgagcattttcttgagattataattgctgagtcgtaagatatgcatctacagctctctcgtgtacttgtaccagtttacacttgcaccagcattgtatgggagatccatttgtttataatgccattgacaaaattagtttatatttttggaaaacaaaattccatttattttataaagcaaatccagttactttggtaaaaccagaaccaaaaacaaaaaaatctaatcactttgaaagggaattttaaacgcagtctgaaagattttgcaacacatcaaatataatagtggtgatgggttctttgtgattgtaaccatttaaattctttcaaagcataaaatgtattccacatcaccttttgttcaagaaactcctctggaatacagtgatttctcacattaaggaaggctaaacaaacttaaattgttctcattaagatatagcagttatttttagtcgggtgcagtggatcacacctgtaatcccagccctttgagaggctgaggcaggtggttcacttgagtccaacagttagagaacagcctgcacatcttggtgaaaccccctctctataaaaaatttaaaaaattagctgggcttggtggcacgtgcttgtggtcccagctgcccagtggctgtggtgggaggatcacgagccctggaggttgaggttgcagtgagccatgatgtgccactgcattccaacctgggcgaccgagtaaaaccctgtgtcaaaaaaaaattctttctgatggagctttgtcacctcttctttgtttctggtcatatttatttttctctcaaaggaaatgtatttgctcttgaatctagagacagtccattttctcttcatctgtatatttattcatatgtatgttcgaaagagtttaagagtatacatcaaattatagtgttcagcctgggcaacatagtgagaccccgtctctatgcccctgtagtaccagctacttggtactgagatgcaggaggatcacttgagctcaggcaatcctcctgcctcagtgttcaaggctgtggtgagctatgcactccagcctgggctgtctcaaaaaaagcaattatagtgtttattttatttaaaataacataattactaaacatcagttctgtgccagacacaatgctaaagcctcatataacatctcattagacttttatagcaatttgtaaaggaagttacctatgtttctcagcattttctagtgagaaaatgaaggcataaagattaattaacttgctcagatcacacaggatttgaacccaagtgctctgactttagggtgggtcctcctaagcaagatgttacatcacctctgtttagaatagcaaaagtaatttttgttaccatttattatatcagtggcctttgtaagctttttgggttttctttcctattggtgtaaccaagtcacaggcaaaacaaagtgaagaagtaatttaacttgcattattgaggactgttagttacacttcagaaaaatgcctcctgaaagatataaattagccagtttggctatctgttttcattagttgatctggttaatggtttgtaatctctacttgcatagatactggttttgactttatcctttatgatgttatatttgctcacagaggttgttttatttttttttatttttgagacaggatctcattctgtcacccaggctggaatgtagtggcacagtcacggctcactgcagcctcaaactcctgggctgaagtgaacctcctgcaggcacgtgctccgctacacctggctaattttattttttgtagagatagggtgttgctatgttgcccaggctactcttgaaatcctggctccaagttgtcctcctgtctcaactttccaaagtactgggattataggagtgagccactgcacctggcccaccgttttaatgatgggattttaaaataattccatctgatccataagttgtaccttttaaaatgagttcagtattctgacagtatgatctagaaggatagtgaatattggaaaagatggataagattataaatatcttataaatttcctttataaggcattgctgcaaggtgctaaattactaatgaatatatttgaaattgtagtttacaacactttcttaatatttactggtcattatttttaaaacatttctttttcctgtgggttttaagaaacctaattccaacttgcctttttcctttttttttctttagagtcactcaagggaaaggattaatgccagatggtaccagcagatttacttgcaaaggaaagacaattttgcattacatgggaaccagcacattttctgaatacacagttgtggctgatatctctgttgctaaaatagatcctttagcacctttggataaagtctgccttctaggttgtggcatttcaaccggttatggtgctgctgtgaacactgccaaggtaagagactgacttgggttttttgcttctgccttctaatttaattcagtgaaactttcctggaatagtgaaattggccaatctgtatgaaacccagtgattctcttgactctggtagaatgagtactttataaactttctttactcctagttggagcctggctctgtttgtgccgtctttggtctgggaggagtcggattggcagttatcatgggctgtaaagtggctggtgcttcccggatcattggtgtggacatcaataaagataaatttgcaagggccaaagagtttggagccactgaatgtattaaccctcaggattttagtaaacccatccaggaagtgctcattgagatgaccgatggaggagtggactattcctttgaatgtattggtaatgtgaaggtcatggtgagtatgggcttcattcctttttagtttatggaactgctttttttgaagtgcagttttagattaaaaattgttttgttttggcaaaggaaaagtctcttaataagaatttttctagtgaaagaaggggaaaatatctatttgaactacaatgggaaatgatacaagaacagctcagggaaggatgagaaaagatgtttctttgcctttcaatgcctgctaagtgcatgtctcatgaaatgaaaagacagaataaagcagttgtgcagagcatgatctttggaatcaaatacacatccacttactaactcagtgaccctgaacaaacagcttctctcaacctcagtttcctcatctgtaaaatgcaggtacaggttgaacatctatccctaatccaaaaatccaaaatgctccaaaatctgaaactttgagcaccaacatgatgctcaaagaaaatgctcattggggcatttcagattaggaatgctcagctaataaatacgatgcaaatattccaaatccgaaaaaacccaaaattcaaaacactctggtcccaagcatctcagataaaagataatcaacctgtagtaacaacacctacttaaacctacatagacactcagtaaaagtattactattaattctgctgcctgctttttaaaattaaatcttttagagttttgaactacagtttactttttaaaatagaaagcaaataaacacttcaaattattttaatttatgttaatatttaaccaggttaatttgttaaaataaattgttcaggccgggcatggtggctcacacctgtaatcccagcattttgggaggccaaggcaggtggatacttgaggccagccagggcaacatgacgaaaccccgtctcaactagaaatacgaaaattagctgggtgtcgtggcgcacgcctgtaatcccagctactagggaggctgaggcacgagaatcacttgaacccaggaggtggacattgccatgagccaggatcatgcactacactccagcctgggtgccagagggagactcttatctcaaaaaaaaaaaaaacaacaaaaaaaattaaaatataaattgttcaataacattgagctcactaaatgttaagtttggccttttgttgccattatctttaaaaactatgccatctctagaagtttcgccagcagttgttctcaggaaaatgcactgacttctgtgatttggtcatatctctgtgcctgcagagagcagcacttgaggcatgtcacaagggctggggcgtcagcgtcgtggttggagtagctgcttcaggtgaagaaattgccactcgtccattccagctggtaacaggtcgcacatggaaaggcactgcctttggaggtaattcgatggatgagatgactgcattttctcttttgttagttgcattggcagatgtttaatcccagccacctaattttttttatattaacaagaatcttcatgagttccttctcattataagttgttgcatgcaaggctgttttattagaagggattcagactcaatcactatttacccctgggacttgggggggagggtggtgctcacctgaaacataggaccacttggtgcatattctataaaagaaaaatatcaatattctgatagtgaggaagtagttatgggtatagcagggacaggaagttgattgcaaagtaagcaaacagcagtatcagccatggtgtgtttcttgtggacccaagtagcttgttacatttttattcatttttccaggagtgcagtgatcactggatgtgatcatatatctgtctgattttagcagtaaccaatattgagtctcaaactgaaaatatttaattggacaaagccttatcataaaatcaaaaagctgctagactgatcatttttccctttgtgatcctaaaaagtccttggtggtttggggttgcggggaaacagtttctatcttttccatggttgctcagccagaggagagaaaagatgtcacaacatgtttgtatttcccaacagttgtgaatgaatgagtctaaagtttttaaagggctttaaaaatatatatttatatttcatcctcctcctaaagaaaaaaaatcacatagtgtgtgttttgaatgatctgtgtttaacgggttgtcttttaaggtcctctacctcatattatgccagcttttttgaaggccagaagaaaagatttggaaaatatgctaaaatgaggggtttggccaaaatcttcgttctttataactacagaatttgccttagaagatgtcaatctgacttgacctcctcttcaaagctctagatacatgtcacagcagagtatcatagaagaaactttttaagccatgtatgctattcgggggtatcattttggagtccatagctgtattttaaagggcattctaagcctggctgatccaggggatcttgctagtaacctctaactgaagcctcattctagcacatgctggttgggaaattcattgtatcattgaggccccttgcattgctgatctaaagataatagaagcttttgtctagagaacaggagtgactgtggtcatctcagttaccaggacatttaaaggagaaagaaaaaatccctaccatttgtggggaaagaataattagtggagaatataagagaggagatttggaaaaggctcaaaagaggtttgaaatatcgttgaaagcatccttagaaggtgagaaggcttcttgttgattgtattccttctttagatacagtgagaaattgaagtacctaattttatttaaaatcttaccatttagtcgggcctggtggctcacgcctgtaatcccagtactttgggaggctgaggcgggtggatcacgaggtcaggagatcgagaccatcctgggtaacatggtgaaaccccatctttactaaaaatacaaaaaattagctgggcgtggtggcaggcgcctgtagtcccagctacccgggaggctgaggcaggagaatggcgtgaacctgggaggcagagcttgcaatgagctgagatcacgcaactgtactccagcctaggcgatagagcgagactccgtctcaaaaacaaacgaacaaacttagcatttagctaaagagttctacttcatttttcagtttcatagttttctgttctgatatgctatccctatttcattgttaaatttaaaaccaaggaaataaagtcctgtattagtttttttcttccttgaatatcatgattatagaaatctttgctgatgtggacctaaataagcttgttgttgagacttccagagttctgtcctgggtagtttaaaagtctcaattggccaaaactttaatgaggttttagtaaatcttaatacagaggaagggaaatttcaaaagtatttacttcttcactgaaaggtgttggtcaaattcttcatctccatgctattttggagtttctcattactctttaactcatcaaaaaattcattcttttaaatgccttttgtcctcagctaagtaacaagcatactgcagaaatttgttgaataaattaatgtgtgatttcttttaggatggaagagtgtagaaagtgtcccaaagttggtgtctgaatatatgtccaaaaagataaaagttgatgaatttgtgactcacaatctgtcttttgatgaaatcaacaaagcctttgaactgatgcattctggaaagaggtaggctttctctttatatatcatagaatgtaataatgatgttgagtttgaggggatggagagtcgaaaaacacaattttagttgtcttaaaggtatcatttaaaacttagtatgttgcttccttttacagcattcgaactgttgtaaagatttaattcaaaagagaaaaataatgtccatcctgtcgtgatgtgataggagcagcttaacaggcagggagaagcgcctccaacctcacagcctcgtagagcttcacagctactccagaaaatagggttatgtgtgtcattcatgaatctctataatcaaggacaaggataattcagtcatgaacctgttttctggatgctcctccacataaataattgctagtttattaaggaatattttaacataataaaagtaatttctacatttgtgtggaaattgtcttgttttatgctgtcatcattgtcacggtttgtctgcccattatcttcattctgcaagggaaagggaaaggaagcagggcagtggtgggtgtctgaaacctcagaaacataacgttgaacttttaagggtctcagtccccgttgattaaagaacagatcctagccatcagtgacaaagttaatcaggacccaagtctgcttctgtgatattatcttgaagggaggtactgtgccttgttcatacctgtaccccaaattcctaggatggcatctgcccttcagggggcactaaaatgtattattgaaacagcattctgggcttaaataggtgtatgtatgtgttggttgtgactgtactatttctagtatagtgaactacatactgaatatccaagttctcagcacctacttttgtcaaatcttaacattttgccacttcgagatcacattgccattcctcccctccagaggtaacaattatccacaatttgatgtttatcattcctgtgttgttgtactttcactgtgtataacctaaaccatctactctttagtactgttttatatatttttaagcctcatacttgctcattctacagcttttttcactcattattgtataattatatctgaagctctcgttcattaattttagtcctgtgtagcagaattcaattacgggaactaccataatttatctgttctccagttgaaggcatgaagttgttgccagtttctgtattataacactgtagtggaacattcttctgcattgggctcactgcgtgttacctaagacgtatcacagaataaacacatttagccttatagacattgccaaattgctcttcaaagtaaatgtgagtttttgtgaattacatgagtatggaatggtgttttattatgactttagtttgcattttcctcaa

SEQ ID NO: 37084 - DNA, 31931 bp, Homo sapiens; identical to SEQ ID NO: 35595

SEQ ID NO: 37085 - DNA, 31931 bp, Homo sapiens; identical to SEQ ID NO: 35595

SEQ ID NO: 37086 - DNA, 4512 bp, Homo sapiens; identical to SEQ ID NO: 35751

SEQ ID NO: 37087 - DNA, 12488 bp, Homo sapiens
gaagctctgtttggtgctttggatccatttccatcggtccttacagccgctcgtcagactccagcagccaagatggtgaagcagatcgagagcaaggtacgcgctaccggggaaggccagggtgccggcgccgcgcgcggcctctgtaactggggaaggcggtggcgggaggtggggaaggcggtggcgggaggtgcggaggccgcccctccgcatcgccaggggaaagggacgcggcgtctcggcctgggactgcgggaagcagcggcctgggcgcgcccgaggcggtggagcctgccctggaggaagggaggagaaggacgagggtcccctggagggcggagtggcggtgcccagcgtttctcgcaccctgttcctcgggggattgcacgcacgcggggagcgtccgggggatgtgagagcgcagacagcgtgaggagtccccacgctgcgcctcctgcaccctcccgtccgggcagccccgactggaggaagatgagggaatggaaggggtccgcccttggccccccatctgtatccagattcaggccccaggcaaggatagggagggcccttgcagaaggcacgggtcggtggccgccgctgcctttccgtatgtgaagtgatccacccgcagcgggggtagtgatctccctttgggagcgggtctaggccggagacccccgcctgcctccacccatgcccgaccccaaaggtgacgcgtgctgtatccgcactaagggggcggattgcggctggagaccccctggcacgtgcaggtctgtccaggaggcccgagggccccaggtgaccgcgaggaagtgaggtccgggccgcgcccacgggactcctgtggcgcagggcgcgtttccggcagcagtggctttggaatgactgagtccccaaggttgggcccgggggcctcggctgccctgcccgtccatgattcaccctcagtcggtgggttttgctggagccagggttcctcctgggagcagccgcgccctgctgcctgctcgccgacctatcggtatcccgatcgttgttttgtcctcttaaaaatgcccaaggcgaaacagccttcccatgtttgaaagttattgcaagcctaaaaccttgtagactgggaaacccagagcctaacgcgcagtgtctagtccaatgtagccactccagaaatatttgttaaatgcagcgtcagaaaagtgagtggaggaaattgatactgctcgaacggtagaagacccctcgccagcgcctaccctgcgattacccctccctacctgcgggaagcagaggagggcgggtcctcgcccgcctcgggtgccctgacctgtttggtgccgggtgggcttcggaaacagaagtgtgtctgcaatgtgtccccgatccttttgttcctttgattattattgactctcagtgttttttcctcatatgttgattgccactgtcatcttttatcttcctctcaatcagttttttcttagtgggattctcattttagcagccctcatgtgttgaaaagatccttagtagtgaattgtctttcatatactttttttccaagcacctattgtgtgacaaattattaatccattcctggggaagggagtggggctgggattctgttctccagggtctggcaacctcagtataacccaactgctaagaaccccctccactgagccagaagacctttgagtggtctatgttagttgtcccaaaatccagacactacaaacaaagttgattaggatttctggagcacacagtttagtcctcccagttgtcagagcatgtcagagcaccttcctcctctaccagtgacaaaggtgtacaagggtgacaggaactttaaaaaaagcactacagcctggggcccaaaggccctgataatcaattaatcctcaaaataacaatccaaagtcattgatcgaaagttacactaatttgattgttatttgtctgttagtttgtttttcgagatggagttttgcccttgttgccctggctggagtacagtggcgcgatctcggcccactgcaacctccacctcctgagttcaagcgattctcttgcctcagcctcctgcacagctgggattacaggcatgcgctgccaaaatgcccagtaattttgtatttttagtagagatggggtttcaccatgttggtcaggtttgtctcgaactcctgacttcaggtgatccaccaacctcaggctcccaaagtgctaggattacaggcgtgaaccaccacgcccagcctgttatttgtaaatgttgaatacatgttacattttcatcctaatgggctaaatttgcaccatttgccattcagaacaattctgtttctgaggtactctgttggtgctttagggccaactgggatctatttcagagaggaatggaataattgactgtaaatgtgatgaggaagaaataaacacttttaaaaaaaatgacacctaccatttattgaactcccatctacaaggcacttggctaagtacttcagaaaccactcacacttattaccctcagagtaggtatgttgaggcaacgagatcttagactcttgctcctatttaccccaactacactgttctgcttcccccagattattggtgtcagtgatggagacatttattaatcctgttagtttctgggagctagaaattgtgatttcttcttagtaatacaatcttgaataattttcaagctgatacccgtttagaagtatcagaagagaatttgtacatgaagcctgcacatacgtggggtgtaactcatgttcagttaggctaaaagttattgttgcgtgcctcttttcagaattttaggtacttgtgcttaaatttgattcagaactgttttggaaaagccttgagtatgtttgaaataccttccctcttgaaagtaatctcaagtttttaataagggttaatcatgttaaaaaaacaaaaatgtctattcaaccagacattggcatttcttgaccttttttcctgtcttacctggatcttgcaataaaggatgcctggtttaactttcttgaaaatcacattagggaaggctttgaatgaaattgatctggaacaataagtgatgatttggaaaaacaattgctatacttctatgtaccctgctgcagctctccccatgtctccacctctagaggtggggttcagggatttgcataactaaaaaatttatgaaagtgttgtcctacctttctcaggaacaccatttgtgaattattttcccaaaaacgaggtagaaattagaaatctagagaagtaactattagtacatgaggtcatattagtgttttcttgttgggtttttttttgtttatttggttttttatcttatggttttttatttatttgatttctttctttacgagacctcttgtggcggtggggggcggggaatgttcatttttttttaaacctatttgaccagcattgtttccttgaagaaaacctagatttcagatacagatgtttatgttttgatttatcttaattgctctggtttggtttttgggtttggtcagcactaacgtactaatgtggttaaaatgagtcctttgttttgggaggccaaggcgggtggatcacttcaggtcaggagttcaagaccagcctggtcaacatggcgaaactctgtctctactaaaaatacaaaaattagctgggactggtggcagaggcttgtaatcccagctactcaggaggctgaggcaagagaatcacttgaaccccggaggcaaaggttactgtgagccgagatcaggcctttgcactccagcctgggcaacaagtgaaactccgtctcaaaaacaaaacaaaacaaaaatgagtccttggtaactagaatattcggttcccagggttacagtatctagatagtaaataattcagggaagttagtggtaagagatttcttgatcatttctactgagaattttatttaacaagcattccttatgaaaaataatatctatgaaaaatttccttcatgaggaacgaaaactttcatttaatgaatgacaagggtatagttttaaaataaagggcaaaaatcaaaggttggtaaacgtgtgatctcagctctggaaaccccattatgcttatgtcaacggtgatgtctgagtgttgaggtttgggaaaggtgagtttccttgacttttcaaaaaattttagattttcgtatggtccaccatagacaaatgagtttaatcaaaagtcatagcttttttttttttttttttttttgcgacagagtctccgtctattgcccaggatggagtgcagtggcacaattttggctcactgcaacctccgcctcctgagttcaagctattctcctgcctcagcctcctgagtggctgggactacaggcatatgccaccacgcccagctagtttctgtatttttagtagagacagcatttcaccatattggccaggctggtctcgaactcctgacctagtgatccgcccacctcggcctcccaaagtgctgagattacaggtgtgagccaccatgcccagccaacttttatctttaagtaacttgtgatgtttcaattgcaaaatcctatgcctttgtgacttcaagtgacccctttcataatccataagtgtttaatgaatgtctaccatatacctagccttgacatggaaacatttttaatacaaatgtctatttttattttccttttgtttggtgtagagaaaaaatagccagttcacaatattttataaaatagttatgaagagaatgtcagtatactctacacatatcttgtttcatcttatcaagtaacactaccaacaatgtatagaatttcttcaaactgagttttatttggcttgtttggggatttttttttttttttttttttttttttggctaaaaagtaggtcctgaaaggaggacctccagaatgtgctttgtgtcattgtgtcgagtctttcttttgaaggtttaatatttaactatttatttaatataagcttttcttttgctgttagactgcttttcaggaagccttggacgctgcaggtgataaacttgtagtagttgacttctcagccacgtggtgtgggccttgcaaaatgatcaagcctttctttcatgtgagtattaaacaatgtctgctttgtaagagatttgtgttttttgagttggtggtcacagtggtaggaaagaaagacagttaaaggattttggtttcggtggggggatttctttggctggatctttggtctaaaagtagtagtataacaaataatttaggtttgatacatgtagcccattgaaaacaaattttagaagttaattttgtcttaaatagttctttttttccccacattgaaacatgggccttatttgaaatcccagcctcagaatttgatatgccaagctgttttatactaagaaaaatttgatttagagaaaatttatgtctcttagatctatgtctccaaagatctaaatttttggatctttaattagtctctacttttattaagtttccatttaagaagcttgggtatgttgattgccattacctagttctaaatctttttggatttttcattttaaattttccagtccctctctgaaaagtattccaacgtgatattccttgaagtagatgtggatgactgtcaggtatgtagctggaaatatgagatactgctgagcttttcacattggcctttttctctgaattgcacagtgcttttttccataaatatgtcaaataattctagaactgtaatcctatctaaaaagttctatctcagaagagcaggcaagttaggagcttaatcctagctatcgggagctgtatatcacatcctaaagtaaacaaaaataaatgagtgagacttctgaatcttatcggccacccacctttctaaaaccctacattctactttacactctgagatgtgcaataaatggagattgaatttagctatgatcattacatccataggcttgatggagtcaccaaattatgagaccgcttgtagggctctttgtgaacttgcagtagcatgagaacctgcatttgcaagcctattctagtcttggttgattttagtcaattagaaaccacaaatgttttaacaaataaacaccaaggtacctgagagaataatttggaagaaattccagggttggttgtatttaacaaatacttgttttgcactaggtatataccaggcactgttctgggtggtttttaagtatcagttcatttaatcctgagtgctgttatcatccccattttatagatgagaaaactgaaacacagaggttgttcatgaagtttcagtgagtatgtggctgaactaggatttaaaatgaagtggtctggcttcccagcccttgaccttaagcactacccatcggaggatgctctgtcttgtgggtgtagatcgggtgcttagcacatgaccacagacctaggagagcgggttgaggaggtatcacttcggggccctttacagatatgtgagcattttcacttagccctagtggagaaggaaaggcgatgggggaagggtgcagtgtggcaacagaggcgctggacctggcttccagtcctggctcactagcatctgcttaggccagtcactcctcttccttgagccttaagacctgccccatcaacctcccaaggttgcttattcattgagcaaacatggaatatccaataaagggtgaagggtcacttaaaacaggcatatggcagtgctctctaaacatgggagggcgcaacaaccccagattgtgtattcttagccagtttttgactctgtgccttgggcaacccctgccttggcttgtgctgtcttctccatctggcctgtcctttcctttcctacctgactaactccttgtcatgagcttcaccccttctccacttaccgccttgtgtgccctaagtacccagtgaatcttggcaattattataatgatctttatgtctgtcctttaccattagtctcagtagattcctaggatcagagaccctgtcttaattcacgttggttgccccttcacctagcacacctgccttgcatgtagtataggtgtggaatgaatgaatgatgaatgtgatatggttgttaagttactattctagatgtgtcccagagttgtttttttttttttaaaaagagtgtaattgcatttttgtgaaaaatccttatcccttgttttaatcaaacttagtcttattaaggtcaatttagctaggggaaaattgcacctggaatagagaaattctaactgccactgatcctatcagatagcaacttgattttttttttttttttttttttttttttttttttgagatggagttcactctgtcacctggggtggagtgcagtggcatgatctcggctcactgcaacctctgcctcccgggtttaagcaatcctctgtctcagcctcctgggtagctgggattacaggcatgcaccaccatgcctggctaattttgtatttttacaaaattaaaaccccagtagagacggggtttcaccatgttggtcaggctggtctcgaactcctgacttcaggtgatccacccacctcggcctcccaaagtgctgggattatccaccacgcccggccttgatttttatttgaaagcaataataggtgccagatgccatgataagccctttgcatgcactatgtcatttaatcctcacgataactatacgagtattttttattagcaccctcattgaacaggtaatggcactgcagcacagaaggtaaagtcagtctcttgaggcagaccaatgcaccatactgtactgaggacaggtcttcttactgcctttaggaagtacagtcatgcatcacttaatgatgaggatactttctgagaaatgttaggcaattttgttgtgcacacatagagtgtacttacacaacctagatggcatagcctcctgtacacctaggctatgtggtaaagcctgttgctcctaggccacaaacaggtaaggcatgttactgtactgaatactgtaggcagttataacacaacagtaagtatttgtgtatctaaacatagaaaaggtatggtgaaaacatgatatgaaagattaaaaaatggtatgcctttataaggtacttgccataaacgggacttgcaggactgagaggtgctctgggcgagtcagtgagtgggtggtgagtgaatgtgaaggcctagaacctgtagacgttataaacactgtatgcttacaaattttatttttaaaatttcttttttcagcaataaatttattgtaacttttttactttatagtttttttatttttttaactctttaactcttgtaataacacttagcttaaaacacgaatgcattgtacagctctacaaaaatattttctttatatccttagtctataagctttttttaaaaagactttttaaactttttgttacaaactaagattcaaacacatacattagcctagaccaacacagggtcaggatcatcagtatcactgtctcccatccccacatcttgtctcacagaaaggtcttcagggacagtaacatgcatggacctttcatctcctatgataacagtgccttctcctggaatgcttcctgaagggcctgcctgagcctgttgtatagtaactgtctttttaaaaaaataagtaggagtacactctaaattaataatgaaattaaagtaaatacaaaaaccagtaacgtgggtgtttattatcaagtagtatatactgtccataattgtagtgatatgcttttttaagtgaaagcaagtttattaagaaagtaaaggaacaaaagaatggctattccgcaggtaaagcagtctgtagtggtatactttgtatgtaattgcagcgcagatttgtttgcaccagctaatgcgatgggctatgacattaacccatcactaggtgagaggaatttttcaacttcattataatcttatgggaccaccacatatatgcaatctgttgtcgatctaaatgttatatggtgcattactataggtgtgcaaagcactcgaggacttccgtatgacagagctcctccttcatgtctgcttggtgcaccctgatcaccctgaatgtatcttttttttttttttttttgagacagagtctcactctgtcacccaggctggagtgcagtggtaccatctctgctcactgcaacctccacctcccgggttcaagcgattcttctgcctcagcctcctgagtagctgggactacaggcagccgctaccacaccaggctaaatttcaactttttagtagagacagcattttgccatgttggccaggctggtctcgaactcctcacctcaagtgatccacccgtcttggcctcccaaagtgctgggattagaggcatgagctaccgtgcctggcctgaaagtgtcttttaaaaccttgaagtgaccctctgacaaactgaggaactttaactttgcctccatagattgatagaaaagtatgagtagtagcccttttgaaaatgatagaccaaccttatttctctgacagccaacagggttatgatacttattttataaatggtaacctccctctgacccttacttggagtgagttttcaatagtatgcattcaataaacattcaccatttttattccagccattactgtccttgtgcctcttactggaacctgtactttcatgctcagcaggtgtccagcattaaaagaaaaagtaaagattacctagaaagaactcctcaacagtagtgccacccaccatcctagaggtcgtcatagtgtttgtagctggcctttcttccccttgagaattctccgttggtttccgtgatttggttatcaacagtcctgcctgctcgcttgctgtcctgtgtagcttttgctgcttaggtgctgagtggttctatatttctttcccagtcctcttttgagtgcctggctgacattttcaatctctattgggctccaaaccaaaccagtttcgtggtattgtcctccaaaccttgccctcttatagcatgaacaatgtgttgagcatggggtattataagagttctcatttagcattccacagttgaggaatgtgtgttacttcaattacctttgagctgtagaaaaatctttagctgtggtaacagccacttctaggagaggagaaaatacggatcaactagcccaatttgcgatgttaggaatttgtcgattttcttagtaggatggctttcaaaggttagagcatcagagtcacctgaagcccgactttaactgtaatggtttaagatggggttgatggggaaacttgtagtacccctcaggtaattctgatactgcagcaaggtttgagaattcacaaagtctttttatttttcctcccgagatagtctcattctgtcgcccaggctggaatacagtggcatgatctcagctcactgcaacctccgcctcccaggttcaagcaattgtcctgtctcaacctcctgagtagctgggatgacagatgtgtgccaccacacctggctaatttttgtatttttagtagagatggggtttctccgtgttagccaggctagtctcgaactcctgacctcaggtgacccaccggccttggcctcacaaatcagtttttaattaaaaataagcaggaggctgagtgtggtggctcacacctgtaatcctagcactttgggagcccgaggaaggtggatcacttgagctcatgagtttgagaccagcctgggcaacatggagagaccttgtccctataaaaaaaaaaaaaaaaaaatatatatatatatatatatatatatatatatatatagtgtgtgtgtgtgtgtatatatatacacacacacacacaaaattagccaggtgtggtggcgtgtgcctgtagtcccagctactggggaggctgaggagggaggatggcttgagtctgggaagtggagattgcagtgagctgagactatgcccctgcattccatccagcctgggtgacacagccagaccctgtctcaaaaataataataatcagtaaacccagtgtggggttattcctttagattactattattttgttcttgaacaattgatttttatttttttagactttttagcctttatataatcattctgtgtactctgccttcataataaaactggaaaaattatgagcaagaaataagaggtactagttctgaggaatagttaagattatcatactgagtccaattgtagcagaattttttgttgcttctttgtatgatacttaaaatagttgaaaatttgattggattaaagagcatattggatcgctggagtatctgatgctagtaacattctgaacattctgcctgttaatgtgcccgtcaaaggaagtaaatattaataaaacttcttcattgagaatataaccggtttggcttttgtaatgccattatattcattatattaattttcatatgctgaaaaatgtcctcatgcggaaatgtggggtacatgacagggaaaagtttctggttttggattacttctgtcaaagctcagtactcgcagtcttgtatttaatcctctccctttgctactttccctaccaggatgttgcttcagagtgtgaagtcaaatgcatgccaacattccagttttttaagaagggacaaaaggtacgtacatctgacctttaaaactctaactgggcaataggaaacccagtataagtgaataaatcactggagtgatgttccctttaaagattgaggcatatcaccaagttctgcttttaagaatttttaaatatgccaaaattcattggcttaagtacataatgtgacagctaactgaaaatcaatctttcctagaactagtcctatttatatcataaagcacatagaatttcttagacttgggcagttcatttgttgttaagtattgtgtaaaagaaaatttgtacttgagccttttgacttttctcttgatattttttctttgtttataacttaaatgaactgtatgttattcagggaagtttactttaaataagattatacttctttttccctccacccctattcttccttcattctatgctgaatacatatttatacatatgtatatatatacatatgtatatgtatatatataaatacatatttatacatattttatgtataaaacagtgctacagtgctacgtctaatgtcaattcaatattctcttaacaggtgggtgaattttctggagccaataaggaaaagcttgaagccaccattaatgaattagtctaatcatgttttctgaaaatataaccagccattggctatttaaaacttgtaatttttttaatttacaaaaatataaaatatgaagacataaacccagttgccatctgcgtgacaataaaacattaatgctaacacttttt

SEQ ID NO: 37088 - DNA, 56780 bp, Homo sapiens; identical to SEQ ID NO: 36874

SEQ ID NO: 37089 - DNA, 10287 bp, Homo sapiens
gctcgcggggtgacgtcacagcccgacgcgccacccagctgtttttgtgctcccagctctagcgaaaagccgccggtatttctccatctggctctcctctacctccaggcaggctcacccgagatccccgccccgaaccccccctgcacactcggcccagcgctgttgcccccggagcggacgtttctgcagctattctgagcacaccttgacgtcggctgagggagcgggacagggtcagcggcgaaggaggcaggccccgcgcggggatctcggaagccctgcggtgcatcatgaagttccagtacaaggaggaccatccctttgagtatcggaaaaaggaaggagaaaagatccggaagaaatatccggacagggtccccgtgagtgtagaggagcggaggggatgggaggggaagggcccgcgggggcgggggcgggtagtcgagatggcttccctggggcgcccaggcggctctggagaagggaggttccgagaattacttaatcctgaacgcccttcagtgccagagccaatggacgtccagactgtagagcttttaaaaccccgtatgcctgggccccgaaccccacttcagggctgacggcgttttgggggccgagccgccgtcttcagtgactcagcaacccacacacggtctcagcagctgagaccgtgtgtgggttgcggtgcacaaaatagggcccctgtgggcgagactggttagatcggggccatggattggctgcctttaagaacgcagggacattgtgctgtgcggtgaggtttgcgcaaacccagtcgatttctgccttggctggttctcctttaatgaagttgactttggctctcatatcattggtcttgggacgaaaaggttcagaagctattcagtaattttcttgcattacagggggttaggggagcacaagacagtcctggcctggaaaacaaggtcacgttctctgcccaacagccctcttgcctcatcgttctaggctccggggcttgtgtggggacagccagcctcctcgtgttgatttctgatcacctggtacctggtcgcgataaggcaggactgagacgttttttctccgttttggacaccggcttaagtagttaaaactaccgcaggcagtgagtaggaacagaaaagtattaggtatctttcagcatccgggcgttttccccattaccccctcccccgcccacttgcctggtgtttctctaatgcaggctgcgcagccgaattggagggcagaatatggcttaagtggtagggggaccagcagctgttggattttggaaatggaggagcggagattttaaaattgtgctctttatcttcaggtaggaacattagtattacgtgtcacataatggtaaaataattgctgttatctgatgtcttttcttgactcacagccactctgggtttcttctctaatccttacctaacgttcgtggttttatagctaccagaagccaccagggccttagcccagcagtagaaacctcttgtaacccttttcctttaaaaagaaaaaaaagtcattagggctcttcattccccaggaattacaaaaaggttttcagcttatagaggggtgagctaatcccttactcgggaaaggatcctttacaaattactttcctggtttctggaccttggatacctgaaaattttgcccagttctggtgataccaatcttttgagcaatgatatttaaaaaatacaatcaagttttattgatagtttaccctagcggtattataagtactcagtctgtaatcattgacttacttccttacacgattacccgttctacagatggagtattcaaagcacaaagaaatgcagtaacttcctaaaggtttcacattgctgatctgtggttgagctggaattccaaccctgtctgaaggactgtggagctctcgggtatcttaacctccatgccatattgtttctcagtttctaatatagttgtattaaccagaattaatgacgtgctgtggactttacactgttaagtattggaaatagataaatatttatgtgcattcactctgaatattttagagcattctgttcttttcctgctcatagtttggtgttaaatgttttactcctgtgataatttttaagccattaagcctgtcactcagatttcagctttcctagggttatgttttaaccagtggtgagctgctcccaaggtgaccagtctgtgaccttctttctagttatgacgcaggttccttgatttggttctagttctgggaattcattgcatccttgggcagaactcttaatcgtgctgtgctagagtgtcttgtttacagaaaagagggttagagtaatgattcctgaagcccattccagcttgaccattggtgttattaaagcaatggcgtaccctgactgctcgcataaccagaacttagccccaccaatatttcttcagagccagcgttgaaaagaagaggtgtgcttgtgccttcagagaggaagggttggtgggatcttgaaattatcttcaaagatacaacatatcaaaaaaactgttaggaacagattgtctattttaaaaattcataaccctactgagtattagtcacattttacaaatgaggaaaactgagacccaaagaggcaaagcatctagcccaggggtctaccatagtgaggagtagagctgggattcctggaaacttaaccttggtactgggaaaccaatattttaatgattacccctcccccttctcttcctctccaaacccctcccttccctccaggtattgccctctgctttatcactttctttatctgtcttcctttgtggtttttatctcttactgctaggtgtccgagttcctttggggcacaatgctagcctctttctgccttttccttttaattcctggcttacgttaccctatttcagtttttatttttaaatttaaaatgtgatcatgtccctctggtcttcctggttcaggattttttctacaagaacacaaaacaactttttgttttgttttgtttttgtttttgttgtttttttttttactaattttaatttgttccttttaatttaaaaagttcaaactcccccccaagttaattatgttagataattctttataatttatgaagcattttcctgtaaaatgttatttattactcacattcacatcatatcaataccatgactttgttaaagacgtgttagaaagttttcttttcaagctgggcacggtggctcacacctgtaatcgcagtacttccggaggctgaggcgggtggagcacttgaggtcaggagttcgaaaccagcctggcatcatggtgaaaccccatctctactaaaaaatacaaaaattagccgggcgtggtggcatgcgcctgtaatccctgctactccggaggctgaggcaggagaatcgcttgagcccaggaggtggaggttgcagtgatccgagatcaggccactgcacgccagcccgggcgacacatgtgacactcgacctcaaaaaaaaaagttactggaatactgaagctgagagagaggttacgtgacctgttgaagatcacacagccactagaagtactcatacagttttttttttttctgcgtcttcacttttttttctgcatttcccatatgttctaactaaaatgactatattttcttttctttttttttttttttttttgagaccgagttttgctcttgttgcccaggctggagtgtagtggcacgatcttggctcaccgcaacctctgcctcccaggttcatgcgattctcctgcctcagccttcctgagtagctgggattataggcatgcatcacaatgcctggctaattttgtatttttagtagagatggggtttctctatgttggtcaggctggtctcgaactcccgacctcagatgatccgcccgcctcgacctcccaaagtgctgggattacaggcatgagccattgcgcccggcaatgattatattttctaaactaaaagtctaaagctcatgattttacaatagatattttctgtttggtaagttttagtgtattaaaaatatcttttaaattttgataaatctagtacagaaatacatgatttttttacaacttgaactatagaagtatataacgtagacataaatcccttaaaatcctaacaatcgaaagcctaaagctcatgattttataacagatattttctgtttgggaagttttagtgtataaaaaaatcttttatatttttatagatctagtacagaaatacatgatctttattagaagtatataatgtggacattgaaaatcccttaaagtcctaacataatcaatatctataaatggcttgttgtgctgacatcatattataggatatcattgtcagacttgttttaacactgtttcttttccatttaataatgtttgaacaatctttacagttcttggaaattttgacaaagatttaaaccacgttattggtacctttaataaatggtatttatgagaaataataacttacaggtgatcaggaccatatgagaaaacccagttttcttgatgctctaattaaataccagaaggtggccaggcacggtagctcacatctgtaatcccagcactttgggaggccaaggcaggcagatcacttgaagtcaggagtttgagaccagcctgcccaacatggtgaaaccgcatctctcttaaaaatacaaatacttagccaggcgttgtggcatgtgcctgtaatcccagttactcaggaggctgaggcaggagaattgcttgaatccgggaggtggagattgcagtgagctgagagggagccattgcactccagccttggtgacagtgagacttcatctcaaagataaataataaataaataaataccaataggtatatgtcctatagtagatcttacaggtaacctgtaattacttaaaatcaaagttctttttacttttcatcatatacaatctctagtttatttttattttagtaatgcagctataacctcatgaagcctattttttttgtataattttataaggggtggggggataagaaatgaaacaggtgtcctgggcctagacagattcatttccagtagtaactaggcaactctagggtgtagaaggaaaaatactagattgccttctgtagttttcattcctactctcctcctcttcttccaggtgattgtagagaaggctccaaaagccagggtgcctgatctggacaagaggaagtacctagtgccctctgaccttactggtaatgctctttgccttccctgacccttcctccggtgaaaaaactctctagatcctcattacatgcatgagattgtgagattgagaggcagtacatacttgaaggaagtgagtgggatgctctggagttatctgattaaaaaatgactcaggctgggcgccctggctcacgcctgtaatcccagcactttgggagactgaggcgggtggatcatgaggtcagatcgagaccatcctggctaacacagtgaaaccccgtttctactaaaaaaaatacaaaaaattagctgggcttggtggcgggtgcctgtagtcccagctacttgggaggctgaggcagaagaatggtgtgaacccgggaggcagagcttgcagtgagccgagatcatgccactgcactccaccctgggcaacagagcgagactcggtctcaaaaacaagaagactcaatagttctttcccatcaccatgtcttgttggattttgacacagcaaagcataagacattgaaagaaaggatcagatgcccattatttaaaccacttttattttaattaattaattaattaattaatattattatttgagatggagtttcactcttgtagcccaggctggagtgcagtggcatcatcttggctcactgcaacctccgtctcctggattcaagcgattctcctgcctcagcctgccgagtagctgggattgcaggcacctgccaccatacccggctactttttttggtatttttagtagagacagggtttcaccatgttggccaggctggtcttgaactgctgaactcaggtgatccacccgccttggcctcccaaattgctgggattacaggcgtgagccaccatgccccacctaaaccaattttaaaattcagctttggctgggggtggtggctcacgcctgtaatcccagcactttgggacggggatgtgggcagatcacctgaggtcaggagtttgagaccaggctggccaacatggtgaaaccatgtcttcattaaaaatacaaaaattagctgggtgtgttgttgggcacctgtaatcccagctactcaggaggccaaggctggagaatggcttgaacctgggaggcagaggttgcagtgagccgagatcgcaccactgcactccaggctgagtgacacagtgagactccgcctcaaaaaaacaaaaaacaaaaaaaaaaaaccccaaaattcggctttgttaattgtgatatcaatttgttccaaaaagaaaaccagtctggcttcttgagaggattatattttagagtttcctgattaaatacatcttcttaagctacatttttttaaactaagttttgtagattttgtttgagattataagacatatattcattgttgggtgtggtggctcatgcctgtaatcccagcactttgggaggctgaggcgggtggatcacaaggtcaggagtttgagaccagcctggccaacgtggtgaaaccccgtctctactaaaaatacaaaagttagctgggcatggtggcgcgtgcctgtaatcccagctactcgggaggctgaggcaggagaattgcttgaacctggggaggtggagattgcagtgagccgagatttcgccattgcgctttcagcctgggtgacagagtagaactctgtctcggaaaaaaaaaaaatacatatattcagtcttcatcgtgatccttaatggaatacacactgcatccaggacacactggaaagattttgttgatttgctccagagttaataggtttgaatatcagccatctagaaaattttcagtattctcaagtaaaggcaaagcattgaaccttgtttaatgccccaacactgaggtgactgactgtgctaagatgaccagagtccagtggacccctttccattgctaagtttttcttagggagggtctggggatggaaagagtttcaagtcaggtttagacagtgatgggaatgttttggtctggatgcacatggtattccttcaacgtagtcctcaggctttgagtggatatgctaacatgaggtctgagattgaataagaggggaaaggaggaataaattccactatggcaagtcagggactgtgtgggcttccgagtttccctttttattttgaaagctccaggccggtatttggctcttctcagatggtatataaagctggtactgactctaaggtgaaaaaatgcaattgaatttttttccaggacttacccttctactaattccttgttttcttactttcttttctgcccttttcttcttccatcatccagttggccagttctacttcttaatccggaagagaatccacctgagacctgaggacgccttattcttctttgtcaacaacaccatccctcccaccagtgctaccatgggccaactgtatgaggtaatggttctggttgcacaatactggatgccgtccagtgcagtctggcatcctctagcccttgttctagatgcgttgataacacatctgagaagtggggcagaaggtgttatttatccggatcctcttacatatggcagtgtaaggctctgagagattagatacctcttgttttttagggattagccactctactagatttaatccttctgaaatcttgtctgactatagtcttgtctgactatagtgttttaatgctggactgtttattgaaacagcaggaagtgattcctgatagcaaaagttccaaagcgtcagcccatcgcagttcctgctattctggttggtagcatgtaatttgtaatgcattcagaatccagttcattattttactcccatttagcaacagattgagaaagcacgtaatagtaaagccagctccttctaactctgaggccagcctctgccaactgaaggattctccccacagtcagcttcttctatgaactctgaagttttggcttaagacaaccacattgatactaaacaaggggaaacttttcttagaacaaaactaaaactgtgaaacagattccacattatctgggcacaatgaatcagataaaatgaaatataaaattaaggcaaagtctgtaaatggattcatgtcttaacagataaactcaggaggaataatttttatgtgatgtggtttaattggaagtgtcagaatctgaggaaactatagtgaaggactttattattactgaaaatataacctgggattataactattgttttttgcagtattttgcataagatgcttccttctcattgtgctccgttaatgaattacgtaaacttctaataatcctgaatctttttttgcatagcatatattccctgttagtatatgtcccattatatatccatctgtggtatctatgttccccttgctaggagtgagctctttaagagtgaggactgtgccctagtcatcttcatatccctgatacctatgtgtaatatgttttcaatgaaggatttttgtttgtgaactcagagctcaaagtgtaattccaaccacttctccctatcctttgctcctcttttaaatggggactaatgataccttccatacctgctttacaaggttgtgtgaggctcagcatcttagagctaatgaatgaatatgttttctaaactgttgtcttatctcttcccctaggacaatcatgaggaagactattttctgtatgtggcctacagtgatgagagtgtctatgggaaatgagtggttggaagcccagcagatgggagcacctggacttgggggtaggggaggggtgtgtgtgcgcgacatggggaaagagggtggctcccaccgcaaggagacagaaggtgaagacatctagaaacattacaccacacacaccgtcatcacattttcacatgctcaattgatattttttgctgcttcctcggcccagggagaaagcatgtcaggacagagctgttggattggctttgatagaggaatggggatgatgtaagtttacagtattcctggggtttaattgttgtgcagtttcatagatgggtcaggaggtggacaagttggggccagagatgatggcagtccagcagcaactccctgtgctcccttctctttgggcagagattctatttttgacatttgcacaagacaggtagggaaaggggacttgtggtagtggaccatacctggggaccaaaagagacccactgtaattgatgcattgtggcccctgatcttccctgtctcacacttcttttctcccatcccggttgcaatctcactcagacatcacagtaccaccccaggggtggcagtagacaacaacccagaaatttagacagggatctcttacctttggaaaataggggttaggcatgaaggtggttgtgattaagaagatggttttgttattaaatagcattaaactggaattgacaagagtgttgagcatccctgtctaacctgctctttctctttggtgccccttatctcaccccttccttggaatttaataagtctcaggcatttccaattgtagactaaaaccactcttagcatctcctctagtattttccatgtatcaggacagaggtgtcttatgtagggagggggcaagtatgaagtaaggtaattatatactactctcattcaggattcttgctcccatgctgctgtcccttcaggctcacatgcacaggaatgctacatgatggccagctgcttccctccttggttatcatccactgcagctgctagttagaaaggtttggagggatgacttttagtaaatcatggggattttattgatttattttcacttttgggattttgtggggtgggagtggggagcaggaattgcactcagacatgacatttcaattcatctctgctaatgaaaagggttctttctcttgggggaaatgtgtgtgtcagttctgtcagctgcaagttcttgtataatgaagtcaatgccatcaggccaaggaaataaaataattgcttacctt

SEQ ID NO: 37090 - DNA, 19668 bp, Homo sapiens; identical to SEQ ID NO: 36793

SEQ ID NO: 37091 - DNA, 51995 bp, Homo sapiens
tctgcttccggggcgcgggtgacgcgacgacggcgacactttgctacggagtgcatcggacgtcgaagcctagagtctctgcgtctttccctcttccgctgcctcattcctttccttcctagccttggtcgtcgccgccaccatgaacaagaagaagaaaccgttcctagggatgcccgcgcccctcggctacgtgccggggctgggccgggggtgaggcctggggcggcgcgcgaggggcggggacccggctacaggagcgcagtgctttggggcgtgtttgggggcgggggtctatggccgcgcagtctgaaagacgcttggtggatcggcttaatccctgcaggaagcaacgggctttggggtcaggacatacctgtgtgtgcaccctgcttgccgcctagatgtgacacattgactctcagcccagtgttttggtctgtaagatgggtaatgctgtatacggtctgcagtgaggagtagaggaatctgacgtgtagtggaaacacgcgaccaccttcctcaggtcgggctgacactccccccccccgcccgcccgcccgccccgccttaagcgtgcctgggtcctctatgcctgcaacacagatgaccaccgtgcgttgctggataagtgagcagtcgttattatcctatttggctattcatttgatgaggaacactactgggtttttcttggtggtggtattatattggaatctgtggggcacacacaagctcactaaggagggtttgctattaccataaataagtacgtaaagaggaccagatttagaacccagtgcttaatggagagtagcattggagccaagtttagtaagagagctggacttagggctgtagaaacggtgacgatagaagagaaactgacattctgcgtgtgggagttcaaaaaaagtgaggcaaggaggaagcccagggaacaggagggagtccagtgtgagtggaatgtacagcgaatagaatagagctcaggaggttggaggggccttgagcgtcaggctagagctcctggagacgttagaaagatcatgacccttcagaattattattattattattattttttgagacaaagtcttgttctgtcgcccaagctggagtgcaatggtgcgatctcagctccctgcaatctctgccccccgggttcaagcagttctctgcctcagcctcctgagtagctgggattataggtgcccgctaccacgcccggctaatttttgtatttttagtagagacagggtttcaccatgttggccaggggggtcttgaactcctgacctcatgatccacccgcctccgtctcccaaagtgctgggattacaggcgtgagccaccacgcccggcccagaattttttactcagagctgtgttttgggaagaatcatctggcagagcatgggttgaagtagaggaaggctaaaggcagggagaggtaacttggtttccagctgtgatgggagtcatagtctgggaaggagggattttgaaagtggattcattagtacttggggacagacaggatggggaaagtgggagagggaggcaaaaattacatcatggtcccgtggcatctgggacagctgttatcagctgaaaccccccagagcagctgtaaggtgggcacggaagagctcagtgtgggccaagttgggtttaagggcctggttggatgtggagggggagatgatcgaagccttagggtggagagagattgccttggtaacatcatcagggtaggctgaaactttcaggtaagcagagaagatcagaagtgtttgagactgcagttcattgtcaccaggatctttggaggtttcccaaaggtgttagaaaaagaggtgttagtaagtgataaccaggagtggagaagagcacaggaacagagttattcagacacccggtgtcttgggggtctcctgcagcgccactggcttcaccacgcggtcagacattgggcccgcccgtgatgcaaatgaccctgtggatgatcgccatgcacccccaggcaagagaaccgttggggaccagatgaagaaaaatcaggctgctgacgatgacgacgaggatctaaatgacaccaattacgatgaggtgagatgtgtccggctttcgtggctcctccagccagtctctgggagcagctgacctaaccagtgtgtgttggtgtctgtaatgaatggcttggagtggctcatgcatttaaattttagctattcatggaacatctttactgagagtgagagggagcaggaaaaacacggagaaatgtgcactttttgtccctcagaagagatgttcttgcaggtgttaggaccactgccttggcattttctattgcccagtcttttttttttttgagacggaatttcgctcttgtcggaagagatgttcttgcaggtgttaggaccactgccttggcatttcctattggccagtcttttttttttgagatggaatttcgctcttgtcggaagagatgttcttgcaggtgttaggaccactgccttggcatttcctattggccagtctttttttttttttttttttgagacggactttcgctcttgttggccaggctggagtgcagtggtgtgatctcagctcactgtgacctctgcctccccatttcaagcgattctcctgcctcagtctccaagtaactgggattacaggcatgcgccaccatgcctggctaattttgtatttttagtagagacagggtttctccatgttggtcaggctggtctcgaactcctgacttcaggttgtccgcacgcttcggcttcccaaagtgttgggattacaggcgtgagccactgcgcctggctgccagtctttaatgataaaaacttaaagtggaattggtgatagtatttgctttttttagctttagtgattgccctctaaacagacatctaaagaaaaacttcagctgactgaataccgattaactgtcttctaacagatgacatttttcctctgaggaaaatttttaaaaataattttagttttgaggccaggtgcggtagctcacacctataatcctggcacttttggaggccgaggtgggcggatcatgaggccaggatatcgagaccatcctgtttaacatggtgaaaccccgtctctactaaaactacacaaaaattagccgggcatggtggcatgtgcctgtagtcccagctactcgggaggctgaggcagaagaatgctgtgaacccgggaggcggaggttgcggtgagccaagattgcgccactgcactccagccttggcgagagtgcgagactctgtctcagaaaaaaaaaaaaaattagttttgaaataattttaaatttgcaggaatttgcaaaaatagtgcccccccaaaaaaaagtttctgcatgtctttcaccaagcttctcccgatgttacatgaccttagtgcagttattgaaacgaaggagttaacattgacacagtactattaactaatttgtcagtcgtatttgcatttcatgtttttccatgaatgtccgctttctggcttaggcttagtccaggatcccccattgcatttcgtcatgtctccttggtcccttccaattgggggtctcctctgtcttccatgcccttgacgcttgaagagtagtcaccagttatatggtagactgtcccttgatttggcttcgttggctgaagaaaataatttagcaagtatttcacaagtagagatctccgtttcgctggtggggatggtgttgaaggaaaagctgacctctacacgtgttgtttgcttctcagtttaatggctatgctgggagcctcttctcaagtggaccctacgagaaagatgatgaggaagcagatgctatctatgcagccctggataaaaggatggatgaaagaagaaaagaaagacggtaaaagaaattgttgcctttcacaatatttatccaagtttaaaaaaaagttttgtggccaggcgcagtggctcacgtgtgtaatcctagcactttgagaggctgaggtaggacgatagctagagcccaggggtttgagaccagtgtgggcaacgtagggagacttaatctctacaaataatttaaaaattagccagatggtacacacctgtagtcccagctacttgggtggctgaggtggaaggaccgtttaagcccaggaggtagaaactgcagtgagccatgatcattccagcctggttggcatagtgagaccctgtctcaaaaaaaaaaaaaagttttgttttgaattgttttatatttggagaaaagttgcaatagagtatgtgtgtctgcttagcttttaggccacctgagggtcttggtctgtcgtagccatgcctggataagcactgggctgttacagaacagccttagggcctgggggctgcagtggagagcttaagaactcttaagtttttccagaaatcagcagaattttgtggattacttttacgatacatcagggttaccatctttgaaatgaaaagggcctactgacttgattattatatgttgagtaatttgcaaatgaattaaagatgttaaatgacacatacaagctaccaagattgaaccatgaagaaatcccaaacctgaacagaccaataaaaggtaatgagatcaaagctgtaacagaaagtgtcctagcagagaacatctcaggatctgattgcttcattgctgaattttaccaaatatttgaagaagaactaataccaattctactcagactattctgaaaaatagaggagggaatacttccaaacttattctacagaaccagtattaccctgataccaaaaccagacaaagacacactgaaaaaagaaaatgttaggtcagtatccctgatgaacactgatgcagaaatcagcagaatactagcaaaccatattcaacaacacattagaaagatggttcatcggctgggcgcagtggatcacgcctgtaattctagcactttgggaggccgaggtgggcggatgatgggtcatctgaggtcaggagttcaagaccagtctggccaacctagtgaaacccagtctctactaaaaatacaaaaattagccgggcatggtgggtggtgtacgcctataatcccagctacttgggaggctgaggcaagagaatcgcttgaactcgggaggtggaggttgcagtgagccgaggtcacaacactgcactctagcctgggagacaagagcaagactccatctcaaaaaaaaaaaaaaaaaaagatcgttcatcatgaccaagtggcattttgcccaggggatacaagtgcaagggtggttcaacatatgcaaattaatcagtgttatacatcatatcaacagaatgaaggacaaaaaccatatgatctttttttttttttttttgagacggagtctcgctctgttgcccaggctggagtgcagtggcgcaatctcagctcactgcaacctccacctcctgggttcaagtgattctcctgcctcagcctcctgagtagctgggactacagttgcccgccaccacgcctggctaattttttgtatttttagtagagacgggatttcactgtgttagccaggatggtcttgatctcctgacctcatgatccacctgcctcggcctcccaaagtgctgggattacaggcgtgagccactgcgcccggcctaatcattttaattgattctgaaaatgcatttgataagattcaacattccttgatgataaaaactctcaaaaaactgcatatagaagaaacatacctcaggctgggtgtggtggctcacgtctgtaatcccagcactttgggaggctgaggcgggaggactgcttgatctcaggagtttgagaccagcctaggcaagagggtaataccttttctttacaaaaaaatacaaaaattagccaggcttcgtggcacacacctgtagtcctagctactcaggaggctgagatgggagaattacttgagcccaggaggcagaggttgcagtgagctgagatcataccaccacacttcagcctgggccacagagcgagaccctgtctcaaaaaaaaaaaaaaaaaaaagggggggggagcataacacaataaaagctatatacagctggatggggtggttcacgcctgtaatcacagccctttgggaggcccaggcaggcagatcatttgaggtcaggagtttgagaccatcctgaccaacatggtaaaaccctgtctctactaaaaatccaaagattagttgggtgtggtggctcaggcctataatttcagctactcaggaggtggaggttacagtgagctgagattgtgccactgcactccagcctgggcaacacaatgagactgtgtcgcaaagaaaaaaaaaagccacatatggtaggcccacagctcgtatcatactgaatggggaaaaactggaacgcaacaaggatgcccactttcaccactgtgattcaacattgtactggaagtcctagctagagcagtcggaccagagaaataaataaaagggcatccagattggaaaagaagaagttaaattatccttgtttgcagatgatatgatcttatatttagaaaaccctaaagactctaccaaaacactattggaactgacaaattgattaaagttgcaggctatgcccccaggtgtggtggctcacacctgtaatcccagcactttgggaggctgagggtgggtggatcacctgaggtcaggagtttgagaccagcctggccaacaaagagaaaccctgtcactattaagaatacaaaaatggccgggcacggtggctcacgcctgtaatcccagcactttgggaggccgaggcaggtggatgactggaggtcaggagttcgagaccagcctgaccaacgtggtgaaaccctgtctctactaaaaaaattacaaaagttgccaggcgctgggactcacgcctgtaatcccagcaccttgggagagtgaggtgggtggatcacttgaggtcaggagtttgagaccaggctgaccaacatagtgaaaccctgtctctactaaaaatacaaaaattagctgggtgtagtggcacacgtctgtaatcccagctactcaggaggctgaggcaagagaattgcttgaacctaggaggcaaatgttgtagtgagctgagattgcaccactgcactccagcctgagtgacggggcaagactctgtctcaaaaaaaaaaaaaaccaaaaaacaaaaattagccgggtgtgggggtgcacgcctgtagtcccagctagttgggaggctgaggcaggagaatcgcttgaacccaggaggtcgaggttgcagtgagctgagattgcaccactgcactccagcctgggtaacagagtgagactccatcttaaaataaaagaaaatatccatactacccaaagtaatttacagattcaatgcaatccgtatcaaaatactggggacattattaacagatagtgaaaaaatagccaggtgcagtggctcatgcctgtaatcccaacactttgggaggctgaggcaggtggatcacttgaggtcagcagttcgagaccagcctggctaaaccccatctctactaaaaatacaaaaattagttgggcatggtgacaggtgcctgtaatcccagctacttgggaggctgaggcaggagaatcacttgaacctggaaggcagaggttgcagtcagctgagatcgtgccattgcactccggcctgggcaacagagtgagactccgtctcaaaaaaaaaaaaagaaaaagaaaaaataattctaaaatgtacatggagccaaaaaagacccagaataggcaaagctatcctgagcaaaaggaacaaaactgggggaacacttgacttcaaattatactacagagctgtagtaacaaaaacagcatagtactggcagaaaaacagacacatagaccaatggaacagaatggacccagaaacaaataggtacctctacagtgaactcattcttgacaaatgtaccaggaatatttattggggaaaagacaatctcttcaataaacggtgctgggaaaactggatatctatatacagaagaatgaaactagacccctctctgtcaccacatacaaaaatcaaattaaaagactttaagacctcaagctgaaactactagaagaaaacattggagaaactctacaggacattggactaggcaaagatttcttgagtaataccccacaagcacaggcaacgaacggaagccaggtgtggtggctcgctcccgtgagccaagagtgcgctactgcactccagcctgggccacagagactgtctcaaaaaggaaaaaaataaaaagttctcattatagaatattaggaaaataagagtaagtatgggtaaaagcataacatttattcataagtctagaaagtaacagttaacattttggctcatttcctctttctgttgcttttttttatcttggctcactgcaacctctgcctcccgggttcaagcaattctcctgcctcagcctcccaagtagctgggattacaggtgcctgccaccacgcctggctagtttttgtattttagtagagacggggtttcaccatgttggccaggatggtctcaaactcctggccttgtgctccatccacctcggcctcccaaagtgctgggattacagacgtgagccactgcgcccagctctgttgctttttatacatgtaatcataacttcctgtgatgtatgtagaatgttttattttttgaagataattttagaatagtaaaatatagttcttctggaattttatttattttttatttttttgagtctcccaggctcaagtgattcttctgcctcagcctcccaagtagccgggattataggcacgcgccaccacacctggctaatttttgtgtttttagtagagacagggttttaccatgttggccaggccggtcttgaactcctgaccccaagtgatccacccgcctcagcctcccaaagtgttggaattacaggtatgagccaccgtgcccagtcttgccacacactttaaacaaccagatcttacgtgatgtaaacttgctgcctcgaggacagcaccaggccatcaggggtctgccctcaagactcaagtggcctcccaccaggccccacctcaaacattgggaattataattcagcatgagatttcatggggacacagatgtaaaccatatcctttggcctcccagagtgctgggattacagacataagtcaatgtgcctggcctggacatctttttagaagctcgttattaaatcattgtgcataaattttatacctatagtaattaaacgtgaatggcattgcatttcacttttttttttttttggatacaggatcttactctgtcacccagggtggagcgcggtggcttgattatagctccctgtaaccttcaattcctggctcaagcgattctcctgcttcagcctcccaggtagctgggattacaagcacgtgctaccacacccagctaatttttcttttttctttttttttttttgagatggagtctcactctattgcccaggctggagtgcaatggcgcaacctcggcttactgcaacctccgcctccagggttcaagtgattctcctgcctcagcctcccaagtggctgggattacaggcatgcaccgccacgcccggctgatttttgtagagatgggtatttttagtagagacggggtttcaccaatgttagccaggctggtcttgaactcctgcccttgtgatctgcctgccttggcctcccaaggtgctgggattacaggcttgagccaccacgccaggctcacacccagctaatttttgtctatgttgcccaggctggtcttgaactcctggcctcaagtgatccacctgcctcccctaaccttggcctcccaaagtgctaggattacaggcatgagttactacactcagccctacattttaaaaattgattggaacctccagggttaatgcattttaaaaaacatcaggctgggtgcagtggcttacatgtgtaatcctagtaccttgggaggccaaggcaggaggaccacttgagtctaggagttcgagaccagcctgggcaacatggtgaaaccctgtctctacaaaaacaaaattaaaattagccagttgcacatgcccgtagttccagctacattcccaaggctgaggcaggagcatcgcttgagcctaggaattagaggctacagtgagctatgcttatgccactgtgctccagcctgggcaacagaccaaggccgtgtctctaaaacaaaaacaaaacaaaaaacagcaggtgacacggacccatgaagaaagccattaaattaaatgtttttaaaaagtagtgtacttggccgagcacggtggctcacacctataatcccagcactttgggaggccgaggcgggcagatcatgaggtcaggagatcgagaccatcctggccaacatggtgaaaccccgtctctactaacaatacaaaaattagctgggtgtggtggtgcatgcctgtaatcccagctactcaggaggctgaggcacgagaatcacttaaacccaggaggcggaggttgcagtgagctgagatcgcaccactgcattccagcctggtgacagagtgagactgtctcaaagaaaaaaaaaaaagtagtgtacttattaaaactttttattctgaaaactgtcgtaatacaaacaagtaggaagaacagtactgtgaataccatatcctcacatgtagtctcaacaccgaagtgcaattacatgggttatgttctggcacatagagctgtgcagctgagctgagttggttagaggtgaactatttacttggaagagaaggaagcaaggaaggaaaggtgggatgagttcagtagagtgtttggagtgtttggtggtaactaggatagttactgtttttccttgtaggtgtttttttgttttgttttgttttgttttgttttgcgacaaggtctcgctctgtcgcccaggctagattggctcactgcaacctccacttcctggattcagatgattctcctgcctcagtctcccaggtagctggggattacaggtgcccaccaccatgcccagctaatttttatttttatttttatttttttgagacgaagtttcactcttgtcacccaggctggagtgcaatggcatgatcttggctccctgcaacttccacctcccaggttcaagcaattctcctacctcagcctcctgagtagctgggataacaggcatgcgccaccacgcctggctaattttcatatttttagtatagatggggttttaccacattggccaggcttgaactcctgacctcaggtgatctgcccacctcggcctcccaaagcgttgggattacaggtgtaagccaccacgcctggccttcttaggtgtttatgggatggtcctacctttgggattttgtgaattttcaagcagtaaatatacacatgtccaaatggaggtatttagatcaaagtaagatcttttttttttattttaatgaatttctacatgtttttatttggtggataattgaattagtagacttacgaatgtatttatatttatttatttagaggcagagtctctctgtgttgcccaggctggagtgcagtggtgcgatcttggctcactgcaccctctgcctcctgggttcaaatgattctgcctcagcctcccaagtagctgtgattacaggtgtgtgctaccatgcccagctaagaatgtattcatagttaccttaaaatatatttgatttgggctgggtgcggtggctcacacctgtaatcccagcactttgggaggccaaggtgggtagatcacaaggtcaggagttcgagaacagcctggccaggatggtgaaaccccgtctctactaaaaacacaaaaattagctgggagtggtggcgagcacctgtaatcccagctacttgggaggctgaggcaggaaaatcacttaaacccaggaggtggaggttgcagtgagctgagattgcgccactgcactttagcctgggtgacagagcaagactccatctcaaaaaaaaaaatgtgtgtgtgtgtgtgtgtgtgtgtgtgtgtgtgtgtatatgtatatatatatatatatatttgatttagctactaagagtatggaattgttctttttggtgatttaattgagatggataataaatttgcttcagaacagacatgcagtgtttctgatgtgtgcatgttttatttcctagggagcaaagggagaaagaagaaatagagaaatatcgtatggaacgccccaaaatccaacagcagttctcagacctcaaggtgagccgatgaagcggtgaatggtgtgcggtttctaacgctctcaccctaacccgcagagactcagactgctcttacgtggaatttatgagactttacgtttttaatttagggggtcattgcttagaagaagaaagtgtttgcttcagtatgtttaattatatgtgtgtaaaaaaaaacccttcccctactgtaaaaggtaggacaaatgaacttattttctttgtaattttgactccatttatacctaagattttcttttttcttttttctttttttttttggaggcagtctggctctgttgccctggctggagtgcagtggcgtggtctcagctcactgcaaccttcacctcctaggttcaagcaattcttgtgcctcagcctcctaagtagctgggattacaggtgcctgccaccatacccagctaatttttgtatttttagtaaagacaggatttcgccatgtgtaccaggctggtctcaaactcctgaactctagtgatctgcccacctcagcctcccaaagggctgggattacaggcgtgagccaccacgtctggccccatttatacgtaagattttctaaactgtgtcccctgggctttgagagaataatttacattttagtgaagttgaacagatccaataaattgatttttcttttctttttcttttttttttttttttgagacggagtttggctcttgttgcccaggctggagtgcaatgacgcgatctcagctcaccgcaacctccgcctcccaggttcaaacgattctcctgcctcagcctccctagtagctgggattacaggcatgtgccaccatgcccggctaattttgtatttttagtagagatggggtttctccatgttggtcaggctggtctcgaactcccgacctcaggtgatctgcccgctttggcctcccaaagtgctgggattaacaggcatgagccaccgtgcccggcctaaattgatttttctaagtgaagtagaaaactatttttggggctgggtacagtggctcacatctgtaatctcagcactttgggaggctgaggtgggaggatcacttgagcccaggagtttgagaccagccttggggagaacctgtctttacaaaaaataaaaacttagccaggcatggtggcccacgcttgtggtcccagcaacttgagaagctgaagtgggaggatcacttgagcctgggaggttgaggctgcagtgagctgtgattgtgccactgaatccagcctgggcaacagaatgagacccatctcaaaacaaaagtaaaaaacagttgctgcatccaaatcccttctaaagcttggtgatctggaggctaggggtgagagagggcatggtcctacctgggcacatgaaattctgtcagagaattaatgtttttgggggctggatatttccagaggaagttggcagaagtcacagaagaagagtggctgagcatccccgaggttggcgatgccagaaataaacgtcagcggaacccacgctatgagaagctgacccctgttcctgacagtttctttgccaaacatttacagaccggagagaaccatacctcagtggatccccgacaaactgtgagcttccaaaaaagggcacatgtggcccatttagtcctgttagatcagtggcaggaatggtgggtggtgttggattcaatgcttctgcaggtcatggctatgctgtggccgagtctgtctgcacagctgtgcatatgtcaggccactggggaagtatttcagagagtaaatttcttgggcatgcagtgcaaaccgttgttttattcttgcctttcctctcttcccctccagcaatttggaggtcttaacacaccctatccaggtggactaaacactccatacccaggtggaatgacgccaggactgatgacacctggcacaggtgagctggacatgaggaagattggccaagcgaggaacactctgatggacatgaggctgagccaggtgagtttgtcacacagcattttcctgtggacaggtttagacagtttaattttgttttgttttctttttctccttcttcttcttctcctttttcttctcctccttctcctcctcctccttcttctccttctcctttttttttttttggcttgatttttgcctgaataattccgcagatttttaaaattttgacccagagtcttgctgtgtcactcagaggctggagtgcaatggtgtgatcttggctcactgcaacctccacctcctgggttcaagtgattctcctacctcagcctcctgagtagctgggattacaggtgcccaccaccacacccggctaatttttgtattttttgtagagacggggttttaccatgttggccaggctggtcttgaactcctgacctcaggtgatctgtctgccttggcctcccaaaatgcggggattacaggtgtgagccactgcacttggcctttttttaaaatataaaataataattttttaaaaagtgtgtttttttcctgcctctcagtaaattgtcttgtggccctgcatggaacgtgtactttgatctggagactaggtgctctagacaccagtgaagtacagaactctttctgatatgcatatcagataccacgaaggaacatactacttttggcctggccaacatggtgaaaccccgtctctactaaaaatacagaaattggccaggtgtggtggcgggcgcctgtaatcccagctacttgggaggctaaggcaggagaattgcttgaacccgggcgttggaggttgcagtgagccgagattgcaccagtgcactccggcctgggcaacagagtgagactgtctcaaaataaaaaacaaaaacaaaaacaaaaagtggcacaatcatggctggctacatacagccttgacctccctgggctaaggcgatccttccacctcagcctgccaagtagctgagattacaggcatgtgccaccatacccaactaatttttgtattttttgttgagatggggtgtcactaggttgcccaacctgggctggagctcctgggcacaagtgatctgtccgcgctggcctcacaaagtgctgggattacaggtgtgaactaccatgcccagcctgaaatttgtttacatagaaattgtaaaactttttgggccaggcactcatgcctgtaatcctagcactttgagagaccaaggtaggaggattgcttgaggtcaggagttcaagaccagcctgggcaacatggtgatggtgagactctgtctctacaaaaactaaaagaaatagctgggcctggtggtgcctgtagtcccagctgttcgagaggctgaggtggaaggattgcttgagctagggagtttgaggctgccatgagctatgatcgcgcctctgcacaccagcctgggttacggagtgagactgtctcaataaataaataaaactgtcacagtaatttttttgtggtaaaatatatgtaacacagaatttaccattttaatcattcttgactgtacataccttcactgacataattatgttcatgttgttatacaacctcatcaccattcatctccagaactgttttcatcttcccaaattgaaactccgtacctgttaaacattgagtccccgtgcgctttctccccagcccctggcatccaccgttctctctgtttctataaatgtcactactctctggatcttatatgactggaatcatacagtatttaccttactgtgacaggcttatttcaattagctcatggtgcagcatgcgtcagcatgttcttttttttttttttttttttgagacagagtctctctctgtcacccaggctggagttcaatggcatggtcttggctcactgcagcctccgcctctcgggttcaaatgattctcccacctgagcctcccaagtagctgggactacaggtgtgcaccaccaagcccagctaatttttttttttttttttgagacggagcctggcaccgtcacccgagctggagtgcagtggtgtgatctcggctcactgcaacctccacctcctgggttcaggtgattctcctgcctcagcctcccgagtagctggaactataggcgtgtgccaccatgtctggctaatttttgtatttttagtagagacggggtttcatcatgttggccaggatggtcttgatctcctgacctcgtgatccactcgcctcagcctcccaggatgctgggattagaagtgtgatttttttgtatttttagttagagatgggatttcaccatgttggccaggctggtctcgaactcctgacctccagtgatccacgtggctcggcctcccaaagtgctgggattacaggcatgagccccggcgccccggccagcatgttctcagtttaaggcaggatgagacttgactctttggtgtgtgtggaccgcattcgctcatctatgtagaccgcattcgctgacctgtttattcgctgacggacacttggaccactttcaccttttgactattgtgaataatgctgctgtgaatacgggtgtacagatatttgtcagagaccctgctttctattctttcttttttaataaaaattttatttatttttttttgagacggggtcttgctctgtcacccaggctggagggcagtggcgtgatctcggctcactgcagcctctgcttcccaggttcatgtgattctcctgcctcagcctcctgagtagctgggactacaggcatgtgccaccacgcctggctaatttttgtatttttagtagacacggggtttcaccatcctggccaggctggtctcgaactcctgatcttgtgatccacccaccttggcctcccaaagtgctgggtttacaggcgtgagccaccacgcctggtcaaaaattacacttttttttgtagagacagaatcttgggaggctgaggcaggaggattccttgagcccaggagctggaggctgcactgagctatgattgccactgcactcctgcttgggtgacagagtgagaccctgtctcaaaaaaataaataaaaatatagatcttggacagacgcggtggctcacgcctgtaatcccagcactttgggaggccgaggcgggcggatcacgaggtcaggagatcgagaccatcctggctaacacggtgaaaccccgtctctactaaaaatacaaaaaaattagccaggtgtggtggcgggcgcctgtagtcccagccactcgggaggctgaggcaggaggatggcgtgaacctgggaggtggagcttgcagtgagccgagattgcacaactgcactccagcctgggcgacagagcgagactccatctcaaaaaaaaaaaaaaaatagatctttttccatacagaagaaatttgttattatcacaaggtgttgtctgagtgaaatgaaggctgttttccttctccttctgactgctctctcagggttgtgggaggggcaccagggaccctctgagaactttgttttgcacctggtcatgtccagctgactcttagcttggcctgtctcacaggtgtctgactccgtgagtggacagaccgtcgttgaccccaaaggctacctgacggatttaaattccatgatcccgacacacggaggagacatcaagtgagtgctttgcagaatcgctgggctgggatggagactctagttgcctagggtattttggattttatatggacagtatgctgtcaaaatgggacatggcggttctaagaaatgtaaagtggagtagtttgttttttccatttgaaatgtatctgtatccattcattgcgtacactcaatgtgttacatatgatactgcaaagtccctgcctgtgctgggcaggaaagcagctggctgtgtcccacatgtcccatctggaccttcggttctcagcgtttgtctgcggggaggctacagaggcttggaatagtgcgcactgaggttttgagttggtttttgtaactcaggacatcaggactgatagttcttacattgtgactgtgaagtgggtgccctcatcccaggtctcgggtgcacccctgacagcatggcctgatgccgtgtgcactctccctctcatagtgatatcaagaaggcgcgactgctcctcaagtctgttcgggagacgaaccctcatcacccgccagcctggattgcatcagcccgcctggaagaagtcactgggaagctacaagtagctcggaaccttatcatgaaggggacggagatgtgccccaaggtgaggtatttcctgggaggcgtttcctgggaggctgcgtgattgtggcccctacgggagtaaacttgttagagcaaatctctttgtcttttggtattgaaactacagacaatagggcaggctgggggaggatgtgaaaagcagccaagggctttttcctgcttgttttcatgtggagtgaaggctaatccaccactttttttttttttggagacggagtctcgctctgtcacccaggctggagtgcagtggcacgatctcggctcaccgcaagctccacctgccaggttcacaccattgtcctgtctcagcctccagagtagctggcactataggcgcccgccaccatgcctgaatccaccacgcctgaatccaccactggtttgacggcaggctaagcttcattataaagagctcagttggtcagctcttcacccgcctaatggtggccagtcacggtggctcacgcctgtaatcccagcactttgggaggctgaggcgggtggatcacttgaggtcaggagttagaaaccagcctggccaacatggcgaaaccccgtctctactaaaaatatgaaagttagccaggcgtcgtgacaggtgcccataatcccagctattcggtaggtggaggttgcagtgagctgagattgcaccatgctgctccagcctgggcgacagagcgagattccgtctcaaaaaaaaaaaaaaaaacaacaaaaaagaacgacccgagcagatgtgcagtctctgctttgtccatggagttgtcctgaaggaaatcatgctcttttcacaaagtggtgtttcattttttttttttctttttttttgagtctcgctctgttgcccaggctgaagtacagtggcgtgatctcagctcactgcaacctctgcctcccgggttcaagcaattctcctgcctcagcctcctgagtacctgggattataggcacctgccaccacacccggctaatttttgtagttttagtagagacagggttttgccatgttggccaggctggtctcaaactcctgacctcatgatccacctgcctcggcctcccaaagggctgggattacaggcgtgagccaccgcgcccggccattaggtgttcttcagtcagacatatggtagccatgttcccaagtgtggttataagggggcgactcctggtgcaggtgtgttagaggctgagctaattggctttcgtaaattctggggcccgaggatctgctctggagatctgtgcctgctgccctgttgcggcttccagcctgcactgagccttattggtcttatctcttgcctcacagagtgaagatgtctggctggaagcagccaggttgcagcctggggacacagccaaggccgtggtagcccaagctgtccgtcatctcccacagtctgtcaggatttacatcagagccgcagagctggaaacggacattcgtgcaaagaagcgggttcttcggaaaggtgagcctccctcggaggtgctgctttctccctccttggggcccctcctctcagcagctttcctgctcctggctcaggcttttggtgagagtggataaggaaccagggacatttttcaggccttttctcaggctgggttgcctctgcccttggacccccatgggggagggatactgtggtgggcaagttcccatcctggaagggatgcttgggttgagccctcactcctgcctttttccagtgtgtgatcttggatgcttgggcggtcactctggtccaggcttccctcatctgcagggtgagaacaacggtagctcaaagcctgtgtcctggggctctggagatggtctgtgtgaagagctgagccggcacctggcacgtgcagacccgttgtgggtgttactcattttctctcctgagaaggcaccagagccacacgttgattgaactctttcctgctgctgacgaggctgtgccttctgctcccgcgatgcagcgtgtgccgtcagctcaggtcagataacgacagacggtgtgcctaccaggcaacctgattccatccagggattcctgccagggtagagcttttgtgggtagtttgtttatttttattactgtggattcataaaaggagcactgtttctcctgtcactggaagtgtgtagtagatgctgctcttgaactgggtccagaacgagtgctagtcagggggctgttctgaagctaatctgtgcaggtggcttcttttttttcattttttgttttttttttctggttttttttttttttttttttttgagatggagtctcgccctgtcgcccaggctggagtgcagtggcgtgatctcggctcactgcaagctccgcctcccgggttcacaccattctcctgcctcagcctcctgagtagctgggactacaggcgcctgccaccacgcctggctaatttctttttgtatttttagtagagatggggtttcactgtgttatccaggatggtctcgatctcttggccttgtgatctgcctgcctcggcctcccaaagtgctgggattccaggcgtgagccactgcacctggcctatgcaggtggcttctatccatttttttttttttagacagagtctcgctttgtcgcccaggctggagtacaggggcacgatcttggctcactgcagcctctgcctcccgggttcaagtgattctcctgcctcagcctcccgagtagccgggattacaggtgtgcgcctccatgcctggccaatttttgtatttttagtagagatggggtttccccatgttggccgggctggtctcaaactcctgaccacaagtgatcctcctgccttggcctcccaaagtgcagggattacaggcgtgagcccctgtgcctggccttttcttttcttttttttttttttttgagatggagtctcactttgtcccccaggctggagtgcaatggcaccatcttggctcactgcaacctccgcctcctgggtttaagcaatcctcttgcctcagccttctgaggagctgggactacaggcacctgccaccacgcctgcttaatttttgtatttttagtagagacggggtttcactgtgttgaccaggctggtcttgaacttctcacctcaagtgatccacccacctcgacctcccaaagtgctgggattacaggcgtgagccactgtgcccggccagattttttttttttttttgagacagcgtcttgctctgtcacccaggctggagtgcagtggcacgatcttggctcactgcagccaccacctcccaggctcaggcgatcctcccagcttagcctcccaagtagctgggagtataggtcccacccccatgcccagctatttttaatttttggtagagatgggatcttgctgtgttgtccaagcttgtctcaaactcccatcctcaagtgatcctcctgccttgatctcccagagagctgggattacaggcatcagccgtcgcatccagcctattcttcctgaatttatagcctaggaaaaataaagtgtattttatggaatcaagggcagttttcagtgagagctttccagctcttgtttttccaaatgtctttaagcgaaatatcccattgaggcttctgtgctgataggaccgtgcagatgagggctctttggtagaaagccccttatcaaatatagtttcattcacttactgtctacgtctgttagaagacaggtgaaggctgcttgcctgtgatgcatgttcccccgaccctgtgcactcacatgtgaacgtgctttcctctgtcgaggctggtttcttgaccgcagcccagctgctcagtgaatgctcagagacagcctcttttatttttttttattgagacagagtctcgctctgtcgcccagcctggagtgcagtggcacgacctcggctctctgcaagctccgcctcccaggttcacgccattctcctgcctcagccccccaagtagctgggactacaggcgcccgccaccaggcctggctaatttttttttgtatttttattagagatggggtttcaccatgttagccaggatggtcttgatctcctgacctcatgatccacccgcctcggcctctcaaagtgctgggattacaggcgtgagccaccgcgcccggccagagacagcgtcttataatgaggtggccaggaacagaaagttagcacctgtctgggtttgtagaaatcagtttatcttttttcagctaggaagaaatagttctttgatgaagagcccatgaaagtctgggtaattagtattgtttacttagaaaagctctattgaattcttcctgccacagtttgatgaatgatcatgaatgtctttgtggccactccctgctcaccaccagattgtctgggttcatttccagttggtttggatttggagatgggagtatgctgttggaggcgggggccttcggggagtgttgagggactgtgtttccacggctgttctctcagggagtggcctcctggctgtgctctctcaggcagagaagctgggctaaggtggaatgaacccaggatctccaggatggcctttgccgctgccctaatactggtcctggcctgccctttcccaagagtgtttccaaaaactgtattcttttcctggggtgaagcccagcactgcttcatttggttattagcaaacacttacacgttgcttgaagggtctggtttttgaaattaagatgacagctacttccactggtgacttaggacacctgccagccagggagcctggcagtgcatggtctctgtgagctctgggtcgctgttgggctgagctgacaccttagtcctttgttgggagaatgggcgttttgggtgctgatcttgagacctgaggaggctgagtaaccttaggcatggtgcttggcctctgagcttccatgtcttcctctgtaaaagggaagagggctttcaggattggggagggtgcagcatgtgagcttcctggccagggtggggtgtcccacgtgcagagtcccctggggaggcccgactggcagctcccctacaataatgcactcacatgctgtgtactccgctagttaatgcagatgtgtggaagtggagttattttacactaacgccatatgctctggcctgtgaagcgtggcatccttcagtggccgtcgccagcgtgtccctctgggggcacaggaatggcacagttcaggttgagggtcttccctgcagtcacgtgacccccggagagcatgttggcctctgcacggtcacgtcttcatggctgtgtctagcattcagaatactcttctgttctaggccaacttcaggggtgtgtgcttcctccacttctgctcataaagtcacactccttgaaggccattgtatcatggtgtgccatgtggcttccgaaagcacctggggaaggtgaccttgttggttttagtgccatgcctgtgggctgctgatgagatgccatggagatatgtcagctctctcccaaaacttgaagacacagagtcctgggagtcgtaagttaatgactccataaattgagtcccgcatgaatattctgttctttagagacgcgaagttcatctccaccaatgtacaaagtattaagggaagtagttcatatttagacaaatagagcactcatctcccacgcagtcgaggtgagagcgcacaggaaaaacaactgggtcgttctgtgtcttctctctatgcctagtcgcctggttggaggttaggactttccttctttactgctgtgccctctgctgtcaccctgcttggtcagggttcttgacctggatgagtaacccaaatcttttttttgttttagacagagcctcgtcctattgcccaggctggagagcagtgttgcaatcagctcactgcagcctcaacctcctgggctgtagtgatcctcctgcttctggctcttgagtagctgggaccataggtacatactaccatgcctaaataatttttattttgagacaggatcttgctctgttgcctaggctggagtgcagtggcatgatcatgggtcactgaagcctcaacctcccagactcaaactatcctccagtctcagcttcctgaatagctgggactccagggacataccaccatgcctggctgagtttttaatttttcaaagagacgaggtctccctgtgtcatccaggctggttttaaactcctgggctcaagtgatcctcccacctcagtctcccaaaatgctgggactgcagatgggggccactgtgctcagccaggacccatatctttatccccaaagggtctgacttgttggtagttttgcttttttggtggctgtagttcccattaacttttactggtaaaagcagaaatactaaactgtttttaggactggcctctagatagtctcccacagtgggtggcagcaactcagtctcgctttgggagtcagggttagcctctccagccagggctggtacatgaggaggccagagggagctgtggtctgcaccctggttggcacatactccctttggagtagctcgtagcttgctcttttttttttttttttttgagactgagtcttgctctgttgcccaggctagagtgcagtggcgcaatctcggctcactgcaacctccgcctcctgggttcaaggaattctcttgcctcagcctcccaagtagatgggattacaggcacctgccaccacacccgactaatttttgtatttttaatagagatggggtttggtttcactgtgttggccaggctggtctcgaactcctgacctcatgatccacccgcttcagcttcccaaagtgctgggattacaaatgtgagccaccacacccggcctttggaccagctctcttgacaggagggtccaaggaggcggagacgggactcttggcagtggagacgggacttgtggcagcggagatgggacttgagccattcagacatcactgtttattcctagacccgtgtgttctggctgtgagatccagccgggattggtgtctattcacagcatttgtggcatcctactgggctgccaggccatggctctgagtgatgggcacatggtaagaccatgttctgcctgaatcggtgaattcatatagcttcgtcttctggccgtctttcagttggtcaagtggacatccagataataaggccaggggtgtcagtgccagtgtgctgtgcagaaccatgcgtaaaccacagcagacttttgtcttctcagtcccttgaccctaagggactccccagaggttgtcagtgtgggctgagggaggaaagcggttgagcagccaccagtgcaggaggcatctgccccatagcttaggcagctgtgctgcacctgccttccttccacaccatctcctgggtgccatttccaccctatgaggccactgctgcatctgcccaaccttgtggcttggtctgtcagtaacacctggagtgggcagcaggttgctcagtcattttatgtcccttagctgagtgttcattccctgccagggcctcacagccagcctggggctgtttctcagcaggagagcaggtacctgcaggagagctagctcacttgccctctcccctccccgcctcccctcccctctgcctcccgtcccctcttcccctccccgcctccgcttccctccccgcctcccctcccctgccctgcccttttcctcttttttttttttttgagactgagtctccctcttttgcctaggctggagctggagttcagtggtgcagttttggctcactgcaacctccacctcctgggctcaagcgattctcccacctctgcctcccagctagctggaaccacaagtacatgccaccacgcccagctaatttttgtattttttgtagagacagggtttcgccatgttgtccaggctagtctcgaattcctgggctcaagcgatcctcccacctcagcctcccaaaatgctgggattataggtgtgaaccaccacaatcagctgcctggcctaatttctttttcttttttttgagttggagtctctctctgtcacccaggctagagtgcagtgtcacagtctcagcttattgcacctgcgccttctgggttcaagcgattctcctgcctcagcctccccagtagctgggattacaggtgcatgccaccatacctggctaatttttgtatttttagtagagacaaggtttcactgtgttggccacgctggtctcgaactcctgacctcaggtgatctgcccacttcgacctcccaaagtgctgggattacaggcgtgagctacgggctgtacctggcccggcctaatttcttaacatcattaaatgtctactgcattcatatttttccagctgtcatgtcagtacctgcacgggcacatgcatgcataaccacatgcacacatggttggtttgaatcaggatctaagcaaagtctgaacattgccgtttggttgatgtcttctctcggtttgttgatggaattgggttgtttttccttgagattcctcacatcagggtttgctcactgcagcctgtgagattgtttcatgtgggtctcgtttcctgtatcctctgtttcctgtatcctcttgtaaattggaaggtagatttggagactcataagagtaagctttgtgttttttttttctttttttatcaaggaaatattcgtggcaatgcaagcagcgtcaggagctgcagaggctgtcactgctcagtggccccagtgtccttcatggagttctccacagcctttcagctcctgcctttggcagtggctggtgacccgtgcccgcatctgttccttcattagggtgtgcaaaacggtgacattataattaggtcactctttgcttttattgccagaattattcttaagagaagaattttcctatatccatgatttggttattctgagtttatttgggaaagacagaatagatatttgatttgcttcctttcaactttcgggatgatgcgttgattctctagcattctccaaaggtgactaatggtctcttggagctttgttatgaactattgaatgctgtggtatttcatgggtttgaatacattgcaggtaatattcttaatatgcttattgaccttcagactctctgatcattgtccagtggaagtctcttctagtttgctcttgaattttttttaagttttaggtatttttatttaagggaaaacatgtaataatgaggtattttaggtcgggcgtggtggctcatgcctgtaatcccagcacttcgggaggccgaggcgggcggatcatgtggtcaagagatcaaaccatcctagccaacatggtgaaaccctgtctctgctaaaatttcaaaaattagctgggtatggtggctgcacgcctgtactcagctacttgggaggctgaggcaggagaatcgcttgaacccgggtggcagaggttgcagtgagccgagatcacgccactgcactccagcctggcgacagagcgagactccatcgcaaaaaaaaaaaaaaaaaaaaaaaagagaggtatttcagacactggcattttttcgtaaatatttgaagtgaattacgtagatcttaagtgtgcagtttgatgtcttcacaagtgcatgcacccctgtaacccacactcgaccaaggcatagagcatttccagggtgggcaccgtggctgacgcccataatcccagcactttgggaagccgaagcgggcggatcacttgagatcaggagtttgagaccagcctggccaatatggtgaaaccccgtccctactaaaaatacaaaaattagccaggcgtggtggtgcgcacctgtagtcccagctaccttagaggctgagacaggagaatctctgaacccaggaagcggaggtagcagtcagctgagatcgtgccattgtactccagcctgggcaatagaatgagactctgtctcaaaacaaaaacaaaaacatttccatccccgcagaaagtcccctggtgcctctcaatcaatccatactatccccattcgttggcagtcatgcttctgacttattttaccaagattagttttgcctcttttcagacgtcacataaagggagtcatatagtataaactgttttgggactggtttcttttgttcagcatgtttttgaggttcattcccgtggtcactggtttcctgagtcctgttgatatgaccctggcagtcttcagtcacttccttgctttctgctaccacaagatgctccgtttgtccttgtttgtgtctgccccagacctgaaggaagccacataaagggcaggtgtgtggtccctgactgtcaaccagggaagtccgtctcatcctgaccagcagcatgctcaccacatgagcctcctgtttttatctccttttctgtgacgtggtttctcgtttgacctttcctagccctcgagcatgttccaaactcggttcgcttgtggaaagcagccgttgagctggaagaacctgaagatgctagaatcatgctgagccgagctgtggagtgctgccccaccagcgtggaggtgagtctggcgggctcagggccaccagagcccaaagtggccaaggcctgagcccaggttcagtgtctggaagtgatgatacaagtggagcattgagctcactcaggctgcaatttctgggagcagaaggccctgtggaaccccaggatgccgttctgtacatagccgctaggcagggtggtcagtggcctcagctagctgtgctcttaatggacgtgcagggagaatcttagctcatacctgaccactgcagaaaattctctgttgggcagttgctcaggggccatttcctctcagcagcccagagtttgtcatgggagccgaaggtggcagcgtgatagaaaacattgctttctgtcagctccgcatgactgctctttgcctctaagctaagtgggatttctttggttttaagcattccagttcacagcattctgtgcagtgatttttagtcttggttttatgatacctagtatgtctttaattatcctaaggggtattgtgaaattctccaaacaacattaatcttattttatttacataaaaatgaataaagcccgtacacatcttagggatggaatgctgcagaaccaagggtctgggaacttcaggaggctgaacacccttctgtgtgtttagcctgtgagggcagtagcctcatcctgctcgtctgtgccagcccctggtatcaggtctggcgtgctgtgtgcctggaggctgtgtttgtgaacattcaactgagaatcttttgatgctcacgagagtcactaaatgagtcagaagcataaaggaacagttggtcaggtgagaagtgctgctgtggacacttctcaggccatgttcagatggttctcgagagctaagaaagaacgtggtggccaacgctggagggtgggtcgctgtctggcctgcagctgtccccccagcacagtgtcctctcctttttctcgtgtcctctccgcgtagctctggcttgctctggcaaggctggagacctatgaaaatgcccgcaaggtcttgaacaaggcgcgggagaacattcctacagaccgacatatctggatcacggctgctaagctggaggaagccaatgggaacacgcagatggtggagaagatcatcgaccgagccatcacctcgctgcgggccaacggtgtggagatcaaccgtgagcagtggatccaggtgggccgcaggcgggtgtcgtggtgtctgctttaacagtgcacatgcagcacgtgagagtcccacgcaggactgggggttgctggatggtactggggagtcctgtgccaaaccagaagcaggcacaggtgtgaatgggccctgagggacctgggcatgcccactgtcgctcttgatggattcaggcctggagttcgtcttggggtgaacacttcagaagccctttcagtgtgtgcacacctgactgcatttctttgctagtagaaatgatacacctacgagaggaggacaggaagtctcatggcttctttctttgctagtagaaatgatacacctacgagaggaggacaggaagtctcacggcttctttctttgctagtagaaatgatacacctacgagaggaggacaggaagtctcacggcttctttctttgctagtagaaatgatacacctacgagaggaggacaggaagtctcacggcttctttctttgctagtagaaatgatacacctacgagaggaggacaggaagtctcacggcttctttctttgctagtagaaatgatacacctacgagaggaggacaggaagtctcacggcttctttctttgctagtagaaatgatacacctacgagaggaggacaggaagtctcacggcttctttctttgctagtagaaatgatacacctacgagaggaggacaggaagtctcacggcttctttctttgctagtagaaatgatacacctacgagaggaggacaggaagtctcacggcttctttctttgctagtagaaatgatacacctacgagaggaggacaggaagtctcacggcttctttctttgctagtagaaatgatacacctacgagaggaggacaggaagtctcacggcttctttctttgctagtagaaatgatacacctacgagaggaggacaggaagtctcacggcttctttctttgctagtagaaatgatacacctacgagaggaggacaggaagtctcacggcttctttctttgctagtagaaatgatacacctacgagaggaggacaggaagtctcacggctttctttgctagtagaaatgatacacctacgagaggaggacaggaagtctcacggcttctttctttgctagtagaaatgatacacctacgagaggaggacaggaagtctcacggcttctttctttgctagtagaaatgatacacctacgagaggaggacaggaagtctcacggcttctttctttgctagtagaaatgatacacctacgagaggaggacaggaagtctcacggcttctttctttgctagtagaaatgatacacctacgagaggaggacaggaagtctcatggcttctttctttgctagtagaaatgatacacctacgagaggaggacaggaagtctcatggcttcttttactcttcccctctcccccacaccctttttttttttttttttttgagagggagtctttctgtcacccaggctagagggctagagtgcagtggcacgatcttggcttactgcaacctccacctcttgggttcaagcagttctcctacgtcagtcacctgagtagctgggattacaggcacccgccaccatacccagctaatttttgtatttttagaagagacagagtttcaccatgttggccaggttggtctcgaactcctgacctcaagcaacctgcccgccttggtcttccctgtcttttatctttgtctgtagacttaaggctatagaaaagtttccaaagatgatctaacttaggaagtagggcttgggttccctctaatgccttcttttaaggagtcacccactgagttatgtttctctcaagaaaaataaataatgaaattactattttctgttatattttatgacagtttgtctttctttccttccttcctttcttcttctttctttctttccttctttctttcttgagacagggtctcgccgtgttgctcaggccggagtgcagtggtgcagtcatggctcactgcatccttgacctgggctcaagcaatcctcccgccttaacctcccaagtggctgggactacaggcgtgtgccaccatgcttggccaattttttttatttttattttttgtcttgttatgctgcccaggctggtcttaaactcctggccttaagcaatcctgccacttcagcctcccaaagtgttgagattacaggcatcagctgccatacccagcatatgacaggttattaagctataactagcgttctacagaatccacccatttaaagtttacgattcagtggttttagtatattcacagagctatgcgctatcaccacaatcctagaaccttctcatcaccccagaaagaaatcctgtgtccgtgagttgttgctccccattttcatacctctgtagccttttgtttttgtttttgttttttttttgagacagggtgggtctctgtctcccaagctggagtgtatggtgcaatcaatcttggctctctgccacatttgcttcctgggctcaagcaattctcctgcctcagcctcctgagtagctgggactacaggcatgcgccaccacacctggctaatttttttctattttttgtagagacgcggttttgccatgttgttcaggctggtctcaaactcctgagctcagatgatccacctgcctcggcctcccagagtgctgggattacaagcgtgagccaccgtgcctgtctaaccttgtttttttactttctttctctacacatttttttctggacattttatatacagatgttcaacttatgggcttatatcctgataaacccattgtaagttgaaaatatcataagtctaaaatggatttgaggctgggtgctgtggctcacacctataatctcagcacattgcggggctgaggcgggtggatcacttgaggtcaggagtttgagaccagcctggccaacatggtaaaaccctgtctctactaaagatacaaaaaaattagccaggcatgatggtgggcacctataattccagctactcgggaggctgaggcaggagaattgcttgaacctggcggaggcagaggttgcagtgagccgagatcgtgacactgtactccagcctgggcaaaagagcgagactctgtctcaaaaaataaataaaataaaataaaatgaaataaaatgcgtgtgatacacctaacctactgaactttacagcttagcctgcctacgtcaaacatgctcagaacacctaccttagcctacagttgggcagagtcatcgaacgtaaagtgttgaataactcacgtaatttattgaatgctacgatgaaagtgaaaaacagactggtggtttgagtcaaagtattgcttctactgagcgtggtggcttttgcatcgtccgacaccgtgagtggaatcacacgacacgtggtcttttgtgactggccttaacttagtgtgttttcagggttcctccatgttgtagcatggaggtattgaaatcctttgcctacttttacattggattgtgtctttattatggtctatgtattatttttgtctgttgttttattattgagttgtaagagatgtttttatatattctggatatattgtcacttatcagagacatgatttgcaactacagatggtccctgacttcccatggtttgacttttgccgtggttcaaaagcagtttgcattcagtagaaactgtccatggaggaagagccagcgcagtttgcgttcagtagaaactgtccatggaggaagagccagcacctttgccgcaggcccctgagggtctgggtgctgggtccttgccccacgcattcttctcaccactgacctttgtgccagcgtctctgcctcagatccttgctcttggctctgctttctgtctgggatggttttctggtgctggcagggccctgggagggtctgggaggcatgtggctccggttgcactttgctcacggtccatgtcgtggtcccccatgttggcatgccgcagtggtgcctgtgctcctgcaccctgttgctctggctgggttattgttctcttgttggtagacacattctcttgcacacatgggaatatatttgtcacatgaatgccttaaagtagaactgctgggtcaaatatgtgcctgttttattttgatagagaatgagaaattgccctccatagagatatgtgcttctttgcagtataagatttatgcccccttcaccaagtgagccagtcagcacatgtttcaatgttgctcatctgatacgtgcacaatggtacttagaatagtttaattagcatcttgaaaataagaataggggctgggtgtggtggcttatgcactaatcccagcactttgggaggctaaagcaggagggttacttgagaccaggagtttaacaccagcctaggcaacataaggagaccctgtatctatgaaacataatgtaccattgagcatggtggtgcatgtctgtgctactcgggaggctgaggtgagagtatcccttgagcctgggagttggaagctgcagtgaactatgattgtaccacagcacttcagcctgagtgacagggagagaccttgactctctctcttttttttttttttctgagacgtagtcttgctccgttgcccaggctggagtggagtggcgtgatcttggcttactgcaacctccgcctcccgggttcaagtgattctcctgcctcggcctcccgagtaagctgggattacgggcacccaccaccacgcctggctaatttttgtattttattttttagtagagacagggtttcaccaggttggccaggctggtctcgaactcctgaccacgtgatccaccctcgacctcccaaagtgctgggattacaggtgtgagcccccacacctggctgagaccttgtctcttaaaaaaataaaataaaaaggctttacatttcttttcacatgtttgaaagttgtttgtatttttattttctagtgaacagtgtgcctatgtcctttgtgacatttctctattgttttttctgattggcgtgcagtagactcacttcctcagatccccagtaggcagtgtcagcatcttgtgctgatgtctgtcagttttaaccgttcaggaactccgtactccccgttgggaatctgcagctctgatttccaaaatcacaaataagttttgtgttcctctttcaggatgccgaggaatgtgacagggctgggagtgtggccacctgccaggccgtcatgcgtgccgtgattgggattgggattgaggaggaagatcggaagcatacctggatggaggatgctgacagtgtgagttggcaacaggggcctttgtccgtaatatggagtctctgcttgtgggaacagcaggcaccttataaactactaggctattttaaaactctttttttttttttttaaatctgagacggggtcttgctctgtcgcccaggctggagtgcagtggcgctatctcagctcactacaacctccacctcctgggttcacgccattctcctgcctcagcctcccgagtagctgggactacaggcatgtgccaccacgcccagctaattttttgtatttttagtagagacggggtttcaccgtgttagccaggatggtcttaatctcctgacctcgtgatccaccccgccttggcttcccaaagtgctgggatcacaggcgtgagccaccgcgcccggcctcccagagtgctgggatcacaggcgtgagccgccatgcctggcctcccaaagtgctgggatcacaggcgtgagccaccgcgcccggcctcccagagtgctgggatcacaggcgtgagccaccgcgcccggcctcccagagtgctgggatcacaggcgtgagccgccgcgcccggcctcccagagtgctgggatcacaggcgtgagccgccctgcccggcctcccagagtgctgggatcacaggcgtgagccgccgcgcccggcctcccagagtgctgggatcacaggcgtgagccgccgcgcccggcctcccacggtgctgggatcacaggcgtgagctgccgcgcccggcctcccacggtgctgggatcacaggcatgagccgccgcgcccggcctcccagagtgctgggatcacaggcgtgaggcgccacgcctggccgcagatttgctttcttactctgttcgctctcatgcacttacctcttatttttttttctggaactgtttgacaatgaatgagttgcagatgtggtgccctttaccttaaacactttggtgtgtatttctttaaaagaggacgttctcttacacagccatagctcagttatcaaaatcaggacattgatgttgggacagtgctgtcaggtaacttcagaccttactcaaatctcacccacaggctgggcatggggctgacgcctgtaattccagcactttgggaggccgagatgggcagatcgcttgagctcgggagtttgaaaccagcctgggcaacatggcagaacaccatctttacagaaacaaaagccaggcatggtggtgcacgcttgtagtcccagctactcaggaggctgaggtgggaggatcacttgagctcaggagtttggggccgtagtgagctgtgattgcgccactgcacttcagcctgagtgacagcaagaccctatctcaaaaaaagaaaaagtctcacccgttgtctctgtgtccttttagcagaagaaaaaaccaactgtcttctgtgaggaatacagggtcatcctcaggctagtctggaagagagcctcagcctttgttgttcctgagtgtgaattttttgaggaccacgggccagtgatgctgtagactcctctttcatctggttctctgtggtgtctcctccgggttgggttgaggcttcttggtgcatcatacggagaggtgtgcacctgttcaactccgaccgtctggtgcgggcagtggccgcaggtgtttccactgtatggttgctgtttgtttctttgttattattaataagtattttgaggatccattaatgatgcttcttggcctgaatcagttatttctgtggtgtttgctaaatggtgattttttttaaatctttttttatatattaaattttttttgtagaaacagtatctcactatgttgtccaggctggtttcgaactcctggcctcaagtgatcccacctcagcctcccaaagtatgtaggattacaggcgtgtcactgtgcctggtcacacctgcataatgattttgtgaacagtttctcttacattttattagttggaattctacagtaacgaagagcttcactttctccttcatccgtgtgcgttcacttccttccatctggattggtcaatggctcctcctttggtccttggaatcagaccccactgctggcattgaccgtgtgatacacacatgattcttttgcaccccgtgtggcgtgacccagagcttgtgtgccggctgggccatcctcctgccccatgtatgctaaaatacacacatcaatccttaggtgagttaagacgcagggcagcggtaatagtttttgttgttggttttttttttttttttttttgggacagagtctcactctgtctcctaggctggatggagtccagtggcacgatcttggctcactgcaacctccgcctcccaggttcaagggttcaagcaattctcctgcctcagcctcctgagtagctgggactacaggtgcctgccaccacacctggctaatttttatattttttatagagatgaggtttcgccatgttggccaggctggtctcgaactcctgacttcaggccatccacctgcctcagcctcccagagccactgctcctggcctgtttttctcttattattttgtcatctctttcacatacactggagtaagcacagctgtttttcaaagtgctcgtgatgctagagtaaggaggacagtgttttctgtgcccagaagtgtgctgtggtgctgcttccctcccggacaccagggccctgggcacagcatcacttgatcctgtgggtgttcaggccactctcgggttgcttgtgaaggtccaaggaggcgatggagaatctgaaatgctttgtcaccaaccctcaggacttggatcagaaatcacagagaggggcatagaccagagtgctctatccagggcctgaccctcaccggcatcctccctgaccccctcagatgctcctggtcaggacacagtgcctgaggcagggcccttgctggtttctgtgctggttgagtcagactgaagccatgtgacttgggaggcatcaggtctgagtgaagaaatctcagtgacatccccactcctcgtcctcctgacccattttcatgctggggctccttaactgggaggctcactgttgtcccttcctctcgtagaaggcagctgttcctctgggaactgttcttgggtgcccctgtgtggggacttggacagctttgagctgccagtccagatctttgccattgtcatgttcatagttgcaaaactttgttcctgacccacttcctggtggcctctcacttaccttcagcaacaaactccttcttggtacaagaatcctttcagcggccgggcgcagtggctcatgcctggaatcccagcacttttgggaggccgaggtgggtggatcacttgaggtcaggagttcgagaccagcctggccaacatggtgaaacctcgtctctactaaaaatacagaaattagctgggtgtggtggcaggcgcttgtaatcccagctacttgggaggctgaggcaggagaactgcttgaacctgggaggtggaggtttcagggagctgagatcgcgccactgcactccagcctgggtgacaaagcgagactctgtctttaaaaaaaaatcctttcagcatctgcagggcgcagaggacggtgacttgcccctgtgtgaggctgagtgggaacaggtgtctgaacctggcccagtgagtctccaggtgtcatgatcgccagtcagacgaacccccagaggctttagcgctgcaaatggtgactggcttttttgttttcttttgttgttgatgctaaccaaaagataaagtcattcttgagtatagggaaaaaaaagcctgaagaaaatagaactgtgtttactgtagttctgttgagtggatgggttttttcctgtttgtattcacttgtcttttacaggtttctaattaatgtaactttttatcgtggtaaatatatactatacctaatttttttttttttttttttgagacaaggtctctctctgtcgcccaggctggagcgcaatggcgcaatcttggcaccctgcaacctccgcctcctgggttcaagcaattttcatgcctcagcctcccaagtagctgggattacagccatgcactaccatgcccagctagtttttgtatttttagtagagacagggttttaccatgttggtcaggctgatctcaaactcctgacttcaggtgatccacccagcttggcctcccagggtgctggaattacaggcgtgagccaccgctgtagccactatacctgatttttaaaaaagaaaccaatatgtttgatctgcagttacagcatgtgtgtgtgtgtgtacacgtacatatgcctgggccacagccctctgtgtgtgtgtgcacttgtatgtgcatatggctcggccacagccccatgtctgtgtgtgcgtgtgtgcgtgcacgtatgcctatgccttggccacagccccgtgcgtgtgtgtgtgtgtgtgtgcatgtatgcatatgcctcagccacagccgtgtgtctgtgtgtgtgtgcgtgtgcatgtgtgtgcatgtatgtatatgcctgagccacagccctgtgtctgtgtgtgcgtgtgtgtgcacgtatgcatattcctcggccacagcccccgtgcatgtgtgtgcatgtatgcgtatgcctcagccacagccctgtgtctgtgtgtgtgcatgtatgcatatgcctcagccacagccccgtgtctgtgtgtgtgtgtctgtgtgtgtgtgtgcacatatgcatatgcctcagccacagccccatgtctgtgtgtgcgtgtgtttgtgtgtgtgcgtgcacatatgcatatgcctcagccacagccccgtgtctgtgtgtgcgtgtgtgtgcacgtatgcatatgcctcagccacagccccgtgtgtgtgcgtgtgtgtgtgtgcacgtatgcatatgcctcggccacagccctgtgtgtgtgcgtgtgtatgcgtgcacgtatgcatatgcctcggccacagccctgtgtgtgtgcgtgtgtatgcgtgcatgtatgcatgtgcctcggccacagccccgtgtctgtgtgtgtgtgtgtgtgcacgtatgcatatgcctcagccacagccgtgtgtgtgcgtgtgtgtgtgtgtgcacgtatgcatatgcctcggccacagccctgtgtgtgtgtgtgtgtgtgtgtgtgtgcatgcacgtatgcatatgcctcagccacagccctgtgtgtgcatgtgtgtgcacacctccatcacctgcagctagtgacttgtgcacctctcgcaggccaaggaagcagcaagcagccccatgtgcccctttttcagtgttcttgtttcttgtcctcatcctcaggcttgtctctttcatgtacactggagtaagcacagctgtttttcaaagtgcttgtaatgctggagtaagaactacagtgttttctgtgcccagaagtaggtttcccagtcctggattgtggttctactttctttctggagggggaggacagagtgtgactctgtcgcccaggctggagtgcagtggcgtgatctcggctcactgcaacctttgccttctgggttcaagtgaatctcctgcctcagactgccgaatagccgggattacaggcgcatgccaccacgtctggttaatttttgtatttttagtagagataggttttcactatgtaagttaggctggtctcgaactcctgacttcagatgatccacccgcctcggcctcccaaagtgctgagattacaggcgtgagccaccgcacctggcctggattgtggttctaattagataaaacactgtggtacaccttctagcagatatcatctttcagaatcgtatgagcctggggagggcatcatgccacttgttctgtggccagtgctgggctgcccattctcatgtctctctctgctctagtgtgtagcccacaatgccctggagtgtgcacgagccatctacgcctacgccctgcaggtgttccccagcaagaagagtgtgtggctgcgcgccgcgtacttcgagaagaaccatggcactcggtatgtggtgggacccgcctgcccaagggtgctaatgaaacctccagctccatttgtgtagccctgaatttaaacctctcatgtctgctcatccagtcttgtgcccatttgaggtctggccctctggttgtgatgaaggattttatggcatttgggactttgcaactggatccatctttatagccccttctgggacagcaatgataccattttctagctgagaaacaaggaaccccgggggcccgtcctgctaagtgtcctgtagcctgaggagtggcctgggtatagacttgaggctggagcccgcgtggcccatggccgagcactggctgcagcggtgggtggggcagcatctgggctcaggcaggcatattttccatttaagctgtgctggctttgggttttgactggtttttgtgctcagaggaggtccttgacaattttatttaactgcactctttaattgaaaacatctttcaggtccgctttattggctgtaaatgctgattaaatttggcgttgcagtttattgttttaaatggatagctctcaagggcattgggctcgtgtccccacgcaccctctgtccgtcctctcccaggtcctcgggtgatgctccctgtaccaggtgaggacaggccctgctggtttcactggggctacagctgagaatgttgagccattgtctctttgcttttctggtgtgatttaatctcagcctcttcagggtgtctttccatgtgtcctcctgaagacctggccccctccccatgcccaccagctggtctgtgtttgggagtgatctcctttggggacgttttgaaatggctgccatggtgcccctctgtagaaggtcacctggggcagtctgagtgaagaacagggcggtgccaggtgtaggctgaggtctctcggcccgtgacctgaatatgaactgctgcccttgacccctgggcacagtgggcagtgccctccgacttccctgccttctcccgagtgcatgcttgcagggatgaggagaggcagtagtgctgggggagctggtcctctggagagcacggttgctttgctggcccttgctccacacagtgtgattgtgtgtggtcactttgtcttgctgtcgcactcactgaggcccaaaggggtcattgatgtgactgagggtggtgggccacatgagagtccaggagcatcagacctgatgcccacggctggcagttttgctcaatagtgacctgaaatcactttcttcctataagataattcttttggatgccgggagagtgaacctgggatcataatctttatcagtgggtccggggtgcgcttgtgctctgtggttcaagatgaaaaggcctcccctgtcacagactgaggttattgctgcttccaggacacacggctgtaaaaggttctcttgtgaagttcgtctctccagctctgctatttaaacaatgcattcctttgtagaaccctcttcagtagttgattttagaacctttatggagaggaaagatttccccacactctccccattgtaaaatctggtcaatcatttatagcatcgaactttggagcagtaactgtctttctggcgtgcccacgccatggctgagtgtgatgtgtgttctggtttatggccctgcctctggtgaccgtggcctcttatcttgcagggagtccctggaagcactcctgcagagggctgtggcccactgccccaaagcagaggtgctgtggctcatgggcgccaagtccaagtggctggcaggggatgtgcctgcagcaaggagcatcctggccctggccttccaggtgggtgagggttgcctgtgtggtgaggggcctgtgcacacaggagctgacctgggtgctgactggggcctgaaaatctcccacatacaatgtggcacgtgctgttgttggggtgcactggagtccaggggctgctccacaggagcaggggccgtgaaggggcccgagagcaggaaagcagcccacctggcagatacttacctctcggtccccccactcagtgtgaccacgggtaaatgtttcagaacatggaacacggggtcacacaggctgagggcgcccttatgtgaatggatgtattcagaccgcctcactgagccaggcctgagggtgcctggttgtcatgaggggggtgtgtgttttttttaagtaccttgtctttattttcacatataacatcctaatagtttataacatactttttaataagctatagaatgctatataaaagtctgttactgtagctcaggctaatatcatagagtgtgcccttctttgagcaaataccatgagaggggactggcctgggtttaacctttcgctctcagctgcctgtttgagatggcatcactcctgtgagtaactgcagcgtcccctccacctgcccgctctctgcctgtcacgtggcttccttccacccgctctcttgggcggctgtgctgattgggacgcattcagacagccctgggcaccgggctggggaggctttgagggcagagcctgcgtgtccactgggctctgggctgtgtgagcttccgtggcttgtggacgccttctccacatgtcagtggcaccctgggagtcctctctcctgcccatgtgggctcatgaggacaggacagctggcttcccttcatcaagctcaggggaaagagcgaggttgcgtgtgatgagtctaccagtataggatgcgagtgccccattcaggggctttgagagggcgtgggtggatcctgggtaagatggccctgcacctgcccccgttattgctcgagtgctttagcagcctcttcactgtcctcactgtaccagagtgaacatgggcctgtgtgtttccaggtgagtctggattcttgcactggagtcggctctgtcatctcctccctgggaagggcttggaccagactaatcctgtagcagagcaaggcctggctcagttcctgcctgcctgcttttgattaagtgtgatcaggcgctggtccctgtgttctgacccctcttgacgctgctgtacttgcccttcaggccaaccccaacagtgaggagatctggctggcagccgtgaagctggagtccgagaatgatgagtacgagcgggcccggaggctgctggccaaggcgcggagcagtgcccccaccgcccgggtacgcagtggcaggcagggctgggccgtctggggtgcatggtgtgcacatgcgggccccacgcctggcttgggtggtgatgggagtgagatgacggcaggcaaacgagaccacagcacactcatctttgtgatgtgactaaaacattcatgtggccgggcgtggtggccgggcgcggtggctcacgcctgtaatctcagcactttgggaggccaaggcggacagatcacctgagggtgggagtttgagaccagcctgaccaacatggagaaaccccgtctctactaaaaatacaaaattagccgggcgtggtggtgcgtgcctgtaatcccagctgctcgggaggctgaggcaggagaatcgcttgaaccccgggggtggaggttgcggtgagctgagatcgcgccactgcactccagcctgggcagcaagagggaaactgtctcagcaacaacaacaacaacaaacatgttcatacggccgggtgtggtggctcacgcctgtaatcccagcactttgggaggccaaggcaggtagattgtgagatcaggagttcgacaccagcctgaccaactctgctaaaaatacaaaattagctgggtgtggtggcttgcacctgtagttccagctacttgggaggctgaggcaggagaatggtgtgaacccagcaggtggagcttgcagtgagccgagatcgtgccactgcactccagcctgggtgacagagcgagactctatctcaaaaaaaaacaaaacaaaacaaaaacatatatttatccccaccttttgtgtacacaaacaggctatgaaaagcttacaaaagtacacacagtactgcaggtaacagtgttgaggatgagtgtaccatgaagcacgtaccctggagctgatgccctgcgtgacagtgcatgtctgccccacaggtgttcatgaagtctgtgaagctggagtgggtgcaagacaacatcagggcagcccaagatctgtgcgaggaggccctgcggcactatgaggacttccccaagctgtggatgatgaaggggcagatcgaggagcagaaggagatgatggagaaggcgcgggaagcctataaccagggggtacgtctctgcctgcaccctggggctgcagctgacccggcattcacaaaactgagccccctggtgcagggtcattgcccttcgcctctgaggagatgtggagggctgggggttacagctgatggagctgcagactcaggacccaaaccctggtcccctcgctgagttctgtgcttttccttatatgaagctgcacacactgctcagaagtgcagagtgtggcacacctgcagtaaaggctggtacgtacagacctgtgtgcacaggtccacagcaccaccgcacacctgtacacccacaaatgcagagtgtgaggggtgtttttccatggacatggcagccctgagggactcggtcacccactgcagatgagaagctgggcatggctgtgtcccagttcttcatagacaccacctgagctgctctcttacttgttggttgcagttgaagaagtgtccccactccacacccctgtggcttttgctctctcggctggaggagaagattgggcagcttactcgagcacgggccattttggaaaagtctcgtctgaagaacccaaagaaccctgggctgtggtgagtcctggagggggcagcctggcctctgggcacagcttccccatcaggtgggccgccgtcacccagctgcttgtgtggagtcactcgtgcagtgcttccaggctcaggggcttggggggcggtaggtgctggccatgaaaaatcacggtccctgccttaggagagttcggcctaggtactgtgacaggcctgtagatggtttgatgcagtttaatttgtgttctgatggagggcgcctgggagagggaggggttaatgatggctgggacgagggaaggatggaccccggagagccagctccacagaggaggtggcgtggagagccctggaggtggacaggagcctgctaggtgcaggctctgttcatggaggtgctgcgtccagctcagggtgacggggctggagcactgtgcaggcactgccgcagacaggcagcttctgggtgccttgtgcggccctggctctcccagtctggtcttgtttgttctggatgccttcacctgcatctggacagcgtcaggatctgaggtcttgccttggggcggttgccagtggggctggcagggatgtgggccccagcgccttgtttctgtggtggatgagctctgctgtggagggaatggagtttttgctgctgtgactgggtggagagccctttcagacaaggcttcccagaagctaccagaatatgtgctgttggtagacggctgtgggacctccgggggcctgtctcctcaggttggagtccgtgcggctggagtaccgtgcggggctgaagaacatcgcaaatacactcatggccaaggcgctgcaggagtgccccaactccggtaagggggtgccccgactccggtaagggggtgccctgactccggtaagggggtgccttgactccggtaagggggtgcttcctggcttcccagactccgcagggctggcacttcctgagggagtgggggctcaggcttcagacggactttattaaaatgtgtagtttgtgtgaatcatttcagtcaaaagtttcagctatactcggccgttaagacaacttaatgaaattcttggcctcaaaatgggagaatttgatttcatttctgaagtgttatcatttctttttcttttaaaatttaaaagaaattggccaggtgtggtggctcatgcctgtaatctcagcactttgagagactgaggcgggaggattgcttgagtccaggagtccattgcttgagaccagcctggccaacatggtgaaaccccgtctctactaaaatacaaaaatgagctgggcatggtggcgggcgcctgtaatcccagctactcgggaggctgaggcaggagaattgcttgagcccgggagtgggaggttgcagtgagctgagattgcgccattgcactccaccctgaatgacagagtgagactctgcagggtgtccagtctgtgccctcagggctgccatggttttgggtgggccagagtgctcatcctttgtggttctccttgcacaagttctgcgagccgtgtgtgggaggcccctgtcgtggtctgaggacgtcccgggttagaatctgtaggctgggcacctttccggaaccagaggctggagtgcaaatctttgttctttgtttctgaattataggtatcctgtggtctgaggccatcttcctcgaggcaaggccccagaggaggaccaagagcgtggatgccctgaagaagtgtgagcatgacccccatgtgctcctggccgtggccaagtgagtggggcccccacaggattgctgaacctcggggtcctaatgggctctttttccagagtctgtctgcctcttcctggtcattgtaaagatgcccggcagcagggtgggcttccccgatcctcggctgccgtcgctcctgctgtggtctggggcaggcgcctctcctggcagacacacctgagggtgccgtggtcagagactcactggggacgcatgtgattcacactggtgcgctggccgccgggtcacagactcactggggacgcgtgtgattcacactggtgcgctggccgccaggtcagagactcaccggggacgcatgtgattcacactggtgctctggtcgccgggtcagagactcactggggacgcatgtgattcacactggtgcgctggccgccgggtcagagactcactggggacacatgtgattcacactggtgtgctggccgccgggtcagagactcactggggacgcgtgtgattcacactggtgcgctggccgctgggtcagagactcactggggacgtgactctggaaccttgcaggcagcagcgggtagccatggggcagagcatgcagactctaggcacatgtgggcaaagacccgccaggtgtggggcacagcagggagctcagggccatccccgacccccagggtccctgtttccttctagaaagaggatgacagtctgggaaggagctgggcctgagtgtgggtcaggaggctgggaagtgaccatgtggggtgaagggagttcttggaagaaccctgggttcctgaggctgcagctcaggacgtgggctcacctggcagaggtggcgtgtctggccccaggagctctcctgtgtccggcttcccctccacctgccccgccatgggtcatgcagagacaacagccttcctagtgctggcttttgattctctccatcccttctccccagcactgggtggcagtggtgcttggtctccagaggtctgggtgccgcccccacaggcttgcctgtaggggcacctcctctcccctgcccgcaggcccccgacagatgagagaggctccccacagggaggcttgtgtctgcctggtgctaccttggtcctgccctgtgcgttcacctcccagagtgacttctgggtgacactctgatagtgcagccataaaaccttataaaaggctttgctaaagtaaataagtcactccttgctattcccaagccagtgttttgtgtgtctgctatctgggtttgtgctctttaaatcacagtttatctaacaccgggcaattaagaataccacaaggcttaaaaaacaatcaggttatcagagtgtgaaattattccgtttggcaactgagacgaacccgaacagctgcccggagtggaggctcctcgtgttgtctcttgactacggtgcctctggctccagggggaggtgaccctgaggagagggtggcagcaacgcagagtcccgggcctgccagcatgctcagcagccagcgcccgccatcccttctccagcagcgggtgggggtgccatgcacacccttacctggcctctcatagcatggacctcttcgggcccggtttttcaggtgtgcatgtgtctggcaggcacggcggtgtgaatccagtggcctgagggctgtgggctgcaggcccaggcccttgtgctgcctggagcccatcttctcagtgttcactggggttgctgctggaggccgggtggggcaggatgatccagcaggtgtctcagtgaggagctgaaactgtataactttccctcatcaaagttgcagtttaattttgtgtcaggtttagtttcatctccttgtatctgaccctaattttacggagttggaagatctttccctgcgtgtgaattttttaagaaacagtttgggacaggtgcggtggctcatgcctataatcccagcactgggaggctgaggcaggtggatcatgaggtcaggagtttgagaccaccctgaccaacacagtgaaaccccatctctactaaaaatacaaaaattagccgggtgtggtggcgcatgcctgtaatcccagctactcaggaggctgaggcaggagaatcgcttgaacctgggaggcagagcttgcagtgagtcgagatcgcgccactgcactccagcctgggcgacagagcgagactccttctcaaaaaaaaaaaaaaaaaaacaacaaaaaaaaaccaatttggttagacccgtgaagggcagcttcaagttaatgatctggggtaattatttctggatcagccgaggccctgatcctcaggccttcttgaggggagcaccagggctgcgggtcagggatgaagctgatggccctgaagccgttcccctgccccagaataccgtcctgcagccactcactctgggttcacgtccttctgctggaacaggctgttttggagtcagcggaagatcaccaaggccagggagtggttccaccgcactgtgaagattgactcggacctgggggatgcctgggccttcttctacaagtttgagctgcagcatggcactgaggtgaggcccctcgacagaccgccgctcagtgccttctgggactgtggcggggagttccgccagccctgggggctctaggaggtggccacggccagcgtgactctgcccggggtcgggaggatggaccgggtgtgtggggcacagaatcctcgacacctccccacaaggcagtctctgcctccacatccgttttctggttatagcctcacagctccacaccctggaattgaggcaccctgtccgttagggtggcctgtctgctggagtattttaacgagttatttgctggctggagcctgggctcactttaggaatgggaatggagttggcctttttcttgggcctgagcctgagtgtggctttctaggacagcctgggcagcagcccctctgctcccacccgccccgctagagccaagcgttgtctgagctgtgctggaggcagtcaggctgtcctggtcctccctggaaagtgttgccagcccacgtgaaccctaactccttgtttggagaaggcagacgtgagcacttgtgtgaggcacagacatggggagcctggctcagttcctcatctgtgggctgaggctggtggggtccatgctcctcaggaggtggggctcctttgaggaacacacctgaaagagccttgccttccggtgcagggcctgtgccctctggcccgccagttggggttggtgctgccagggccaggtctgcaggggccaggcgagaagcaggcgaggtccggggagtagcgtgggaggacccctgcctgacgtgccctgtggtccccccaggagcagcaggaggaggtgaggaagcgctgtgagagtgcagagcctcggcatggggagctgtggtgcgccgtgtccaaggacatcgccaactggcagaagaagatcggggacatccttaggctggtggccggccgcatcaagaacaccttctgattgagcggttgccatggccggtctccgtggggcagggttgggccgcatgtggaagggctctgagctgtgtcctccttcattaaaagtttttatgtctcgtgtcag

SEQ ID NO: 37092 - DNA, 127539 bp, Homo sapiens; identical to SEQ ID NO: 36634

SEQ ID NO: 37093 - DNA, 5177 bp, Homo sapiens
acattctcttttcttttattcttgtctgttctgcctcactcccgagctctactgactcccaacagagcgcccaagaagaaaatggccataagtggagtccctgtgctaggatttttcatcatagctgtgctgatgagcgctcaggaatcatgggctatcaaaggtaggtgctgagggaatgaaatctgggacgatagactacgaagcattggagaaaagacctatggacatttggaagataatgtgtggagtgaaagaatagtgtgacaggtattatgtggtctcgacagaaagtataacaaattgtggtttggtggagttcttccctcaccacaaactgaagtaagtcaaatttggtttagagggtcaaaactgagttgtgtattgatgaatagcaaggtcctgctacaagccaaactgggggtgggggtgggggtgggggaggaagaatattttctggcaagcattaacaagttatatttctgggctttaattattctttctggaaaattagtaaaattaaaaactaaaaaccacacatagttttgctagaattaaatgaaaaaaaaaaagttattagccctgttcttatctgaatacatgatacagtagttattttttggagtgtaaatcctgtcggtatatattgagcacatatattgtgttgaagattactagaaggaaaagtcatcaaaaagcaacaatttaccccaggaaaaggggagggaaggcatgctgatatgagttgcctcatgggacagtgatagccattccctgccttcccatctccatggtacagcagatcttatatcatgttaacttagtaatatttccaagagagtagaaaaataagtaaggaaatggggaatctgatattattctctctcatctccagagcaacattggtgctgttgtaaagatgtactgtagaaaagtattcttcacccagcgtgacccccacagaaggtgtcaggtagacttgaaataagcaaagtaataacccagctcccatacccatagtggcaattgtagatttctattgccccaaaagagccatacatagggatacttacctagaaagacagaggatcttcccttggtttgtgaagaggcagctagtatatttgtgtgtgtttgcatagatgcaaacggtaaataaattcctaggtttatcaatacacagtcaaacattaaaatctctcatcttggctgggcacggtggctcacgcctgtaatcccagcactttgggaggccgaggcgggcggatcatgaggtcaagagatcgagaccgtcctgggcaacatggtgaaaccccgtctctactaaaaatacaaaaaattagctgggtatggtggcacacgcctgtagtcccagctactcgggaggctgaggcaggaggattgcttgaactcgggaggcggaggttgcagtgagctgagatggtgccactgcactccagcctggcgatagagcaagactccgtctcaaacaaccaaaccaaaacaaaacaaaatatctcaccttatctttgaagactaaggaaaaaaaaaatctcccactcatcgatacactccacagaggcagcatactctcccagtgtagctttctcttttcatgttcattattcccttggtgttggttattctcaatgtcaatcataacagaacatcttccataataacagtcccaatttaaggagcattaagataaaaggtggaattgccaaggtcaatccagacgagaaccttctcatagaggtaaccaccgtgtgggtttggatgctgggaagcagggggactatgacgctacaaggtctcagtcttaatttttggagtacttcagtccccaggtatattttccatagatttggcccttaaataaagagaagcttctgactctaaaatgtaaacagtgcttgttacagtcttgttgatatattaagaaattactcaccttatctcatttaatcttaaaaacaaacccctgacaggatcaaaaccacagcagggctacataataggaaaactatacataaataggtagaataatctgctcaggatcactaggtaagttgctgaataagaattcaagatgtttttgatcccagagtttaaaacccaacctttcaaacagcgtttctttcttcttagagtacaatgttctgagaaagagatcctctggaattctggcctaagtgtatttaatgcccgggtaaagaaagtgagagaacatttctctttaggggctgctgctggatttctaaaaagaaaataatttctcagctagtaacatggagccaaacaacagcttcacaagactctgggttctttagccctcatctccttcaatccaccctctttataaccagtccttcttgtttttcccctcccagctttgttcagcagcatgcccttcacccagaccttgtcttgtcactcatccctactcgccatcattctttcattcctcttggcccaatctctctccactacttcctgcctacatgtatgtaggttattcatttccctctcttgattccccccacccaactctctttctccatttcttgcctttcagaagaacatgtgatcatccaggccgagttctatctgaatcctgaccaatcaggcgagtttatgtttgactttgatggtgatgagattttccatgtggatatggcaaagaaggagacggtctggcggcttgaagaatttggacgatttgccagctttgaggctcaaggtgcattggccaacatagctgtggacaaagccaacctggaaatcatgacaaagcgctccaactatactccgatcaccaatggtacctccctctctgctgcactcctggacatgggaatccatagtttgaaagtagttgcttcagctctttgtgttagattattgtaactgattttccctccaagggtctaaccttgccattaacaagccccaaattctcatgccagaggtctgagaactttatgggtttgatcctatcttgttgtgctcaagtcttgtctctgtcatccatggtctcctacgaagtcattgccctaagttcatgctgggggagccagaagggaagtccttggatatcttatacctcaatattggctcaatttcttggggagggggtgctgtcagagattgttatctgaggatgtgacatagatttctcagggcacaatttcaactactttttcagctttagggtttttagatacgtttgtaccacaattgagcatgggagggagaggggtgagcctaagcagtgatggctgatttctgtcatgtctgtcatgtgtcccccagtacctccagaggtaactgtgctcacaaacagccctgtggaactgagagagcccaacgtcctcatctgtttcatagacaagttcaccccaccagtggtcaatgtcacgtggcttcgaaatggaaaacctgtcaccacaggagtgtcagagacagtcttcctgcccagggaagaccaccttttccgcaagttccactatctccccttcctgccctcaactgaggacgtttacgactgcagggtggagcactggggcttggatgagcctcttctcaagcactggggtatggaccaacactcaatctcctttatttcaaggtttcctcctatgatgcttgtgtgaaactcggtgttctaactgtttcataatatctgctacaattaatataactgtcttctcctactatccagcttcctcctttttttaatctgtaattctctcaatacatcattctgtcttcctcttctttaatctatgaataacttttctctttattaagaaccctacatttgattctgagtgttacttcttcccacactcattaccatgtactctgccttatttccccccagagtttgatgctccaagccctctcccagagactacagagaacgtggtgtgtgccctgggcctgactgtgggtctggtgggcatcattattgggaccatcttcatcatcaagggattgcgcaaaagcaatgcagcagaacgcagggggcctctgtaaggcacatggaggtgagttaggtgtggtcagaggaagacgtatatggagatatctgagggaggaaaacagggtggggaaaggaaatgtaatgcatttaagagacaaggtaggaacagatgtggctcttgatttctctttgctagaacgaatcagacattcgtatcatctggtatcccaaagcttcagggtctgtcatccctttctatagacgggcaccttgatcacggctccagtcttagaaatcatctccagtacctaaaaccattgtttcacattagaatactgagtctagggatctagaaaatacattagaatatggagtctagggatctagaaaatactgagtctagggatctagaaaaataagcctcaagatttgggcacatcctagcttgtatttcctggggcaggtcatcagttcagaagcatttccagatcctggctcctttcaggttagggtcaattcattgcatgaaatgggaatctcttagaggccaatgcctgcttttgcttctttagtctcaaatgtagtatgagaaactctaaaaaaaggtaaagcatggttgcttattatgttcagttggagagtagggtatacagttagttcatgttggaaaggttagatgaacattgaaagaattttgcaaagtcaaaggattaagagagaagaggaaggaatctgaagcaaggagctcaaaactgatcttcaactccttggtaactatgtgtgtcttgctataggtgatggtgtttcttagagagaagatcactgaagaaacttctgctttaatggctttacaaagctggcaatattacaatccttgacctcagtgaaagcagtcatcttcagcattttccagccctatagccaccccaagtgtggatatgcctcttcgattgctccgtactctaacatctagctggcttccctgtctattgccttttcctgtatctattttcctctatttcctatcattttattatcaccatgcaatgcctctggaataaaacatacaggagtctgtctctgctatggaatgccccatggggcatctcttgtgtacttattgtttaaggtttcctcaaactgtgatttttctgaacacaataaactattttgatgatcttgggtggaa

SEQ ID NO: 37094 - DNA, 22002 bp, Homo sapiens
gtgacaaccggaagcggaagtgaaaatgggtgtccctgctgcctcttagcaacaagaggggtcaagtgacacaaccagctgactcccgtagaggaagacactgtggaggccagttctggagctattgcagcctcggttgcccggccggggacccgagccgaaaagttatcgtcagaatgtcgggcaaagaccgaattgaaatctttccctcgcgaatgtaagtaaaggaatgggataagccgctttcacaggtttaggaacccggagcgcggtcccttcagaccctgggccacagtgagggtccttgtttcctgggaggatcctgagcttttcccaggttcttttcttgagtctagggcgaggcttcctgacggcctcttcgcgcattcctcctgagtgaatcaggctggacgaagcgatcccagccggtaggaaaaggcgcccggccggcgggcttttgtggaggtctgctgtctttattcattaatggattcatccattccacatacccttattgagccgggcactggatttatataactgaaccgtcgccacctctgccctacagagctcacagtttacgtagccagacattcgtctggaaaggccaaggaggttttaataaatgctctgagaagggaagtttactgaggatatagaagaggtccctaagccaaagtggggatggaatcgaatcgccctagcatagccctcggattcgatcttggatccccttactcattttccaagatcccgccaaatgtcacctgctgtgagaggatatccctgtgtttctgaggcactgcttttgctctctcaccgctgcaccttgttcagacctgtgttaataccggtcatcacgctgtaaagtagatatttgtttatgtgtctttctctcccactagactgtgggctctctccaggatgaaagagtgtcttaatccatagaaggtccacaaaaaaatatttcttgaaagaactcatgcttgggaatacgctcagttgtgggctgcctttcttttggggcctgaattctttgtcaggaaaatggcatatcactgtaggtgtttggctagtttgtaaggaaaattttgacgttttctcaaatgtgcctaacaacttgctccctttctcctcctcatcctgtttatttttatttagtttgttgtttgtttgttttaataagagacagggtctcccaggctggggtgcagtggtatgatcagagctcacagcagcctcaaacccctgggctcaagtgatcctccggcctcagcctccctggcggctgagattatagatgggagccaccgcgcctggctttccctttttcttttcagtgaggaagcagaaaatcagttttgaccctgacatttagacccttttattgtggtcctatctctgtgggggtgttttgttgtttttcctcattctgtcctttgagagaatctgaggatgcttaaaataaaagttatattcaaacctgaagcccagatttctttctgcccggtgactaaatagctcttaatgaaatgaagtttttaaattttttaccttcacctgttgactttctaatagctgtttgcactaagtaggcagcaagctagttgtggggaaataaagatgaggactatcccgaggtagtgacaactgcagaactcctaggacgtgatgactcagtcaaaacttctgcactgaaagacatcgacactagtttatcttctagcaatgtaaggcctgcccctagggtgaccccaggccgccccccgccgcccccgccattaaaatgcctgcctgaaaaagctcaaagctagggggagaatttactgtttgttctagtcaacacctaattgatagacccctctcgttccctttttagagcatttacgaaacaggcttacaattgttaatatgtatctcttccaactctgaagtgtcccttcaagtatctttgagagccatttctttgaaacgtaatcatcaggagggataggggctttgtctcccagtctgtgtgagaggatagaatagtaacttactaattgccaggtagtatggcgtttacactgaccaacactttaaggtttctcttctctgactcttcttgcggctggctccctgccactcccttactctcttttttaaaatggccagtcacctctgcacaaatgagaattgagctcagccctttcccctactatcagtggtttactgaataaaatctgttttcactactttaacgaatgtctggctgggtttatctttgacagcagtcagaataacttttttgtttttactttgaaacttttactttgagactaagaggcaaaaatagacatctttgggcttaggtaagaaaatgataggctcatgaaggtgaaactactatttgaaagctctcagcttgctgattgagaggaaaatcaggtgcaggaaataatctcttctctaaatattttccccatggctggcagcaggctttttgtcatgtagtcagatgtctttgattcagctggaagaaaagtcatcatcctagctaaaggtcaaactttttgagtaggactgagcagctctgaaacatgtaaaggagcaagttttaaaagccataggctagaaaatatactggcagcttgtttcacagacatttccattcaacagtattattctgtgatgttactttcacccactttcgtaccagagaaagcaaaaacaattgtagagtggaagtaaaagacgcatgaaaaatttggagtcaacagaagtccactaaatccaggttctgctacatattagctgtaagtgtgcacgctgctcttagagtttcaggaattaaaattgcccatttcacaaagatgccattccctaggaggaaaataaaattaacatggtaaattcaattttatcaaccagtttaccttttactataaactggctggaatatgcagtactacaatttgacttaaatttgatccagctctttgagcccaagttctagtatttactatcaacaatacattatgttaaatgcacacattgagatggatagctccttctcaggctggaaactaaacgaccttcacttgataagacctcttgtgagaccagtcagtgcagagtcagccagtgataattgttctctttaaggggaggcacatgtttggggtacagtgaacgtaggttggagccttagtttgagcattgggaaagtcagtggaatcaaaagtctggttcaagtccctgccctgccttttcttcactgagtaactttgagaaagttgttttacttttctaagcctcatttttctaatctttaagttaatgtctaaagtccctttcagctatagaattgtcttagtgatcttagccctatggtaaaagattccagtataatttaagaatttggccaaatggtgtttgtttgtttttgtttttttttttttgtttttgtttttttgaggcaggttttccctctgttgcccaggctggagtgcagtgacccgatcttggctcactgcaacctctgcctgccaggttcaagtgatttttgtgcctcagactcctgagtagctgggaccacagggatgcagcaccatacccagctaatttttgtattttttggtagagatggggtttcactatgttggccagggtggtctcgaactcctgacctcaagttatccacctgcctcggcctcccaaagtgttggtattacaggtgtgagccactgcacctggccaaaaaagtttattagtacatgcgattttaaaacaccagtcatatgaaattatatccccttaaatcactgtgtctaggttatactgtgtctaggttatacaaccttattgttgaattttattacccaaacacttgtttttttgagaccgagtcttgctctgttgtccaggctgcagtgcagtggcatgatcacagctcactgcctcaacctcctgggctcaatcagtcctctcaccttagccttctttgtatatgggattaccggtgtgccctaccatgcccaggtaattttgatatttttttttttttgtagagacagggtttcaccttgtttcccaggctggtcttgaactcaagcaatctacccaccttagcctcccaaagtgctgattatagacataagccactgtaccacttaccttatttagagcattcttcctaaggtcctccaggtacttttcattagctctttttcctgcctgaaatactctttccccggaacttataactggctcctttggctgttctagtctcttaagagaggctgttcctgatcacccaatctaaagtgaacaccatgtttgcttctgtcataattccttattttaattttattgtagcatgtactactgcatggtatgacattttatttctagtctttttttttttttttttttttttttttttttgagacagggtcttacttctacatcctcgaactgggctccacttttttcattattaaattgtatctggcatatggcagcaagaacagaaatgtcagtttctgcttgactttggtattggggcttctgatggggaaaaaaattgaaacaaggaagtgaggagacttcagtgtaaatttagcttgtcatttctcaggaatcttacgtatgtcatttgttacctagtcttttacaaattaataaaatgattgctgttaggatcttgattgatgatatcaaaacatgttaataccacacttttaatagaaaatgtggtaaattattgtggtataaaaaatgcaggccaggtgcggtggctcatgcctgtaatcctagcactttgtgaggccgaggtgggcggatcacctgaggtcaggagttcgagaccagcctgaccaacatggagaaacctgtctctactaaaaataaaaaattagccaggcatggtgacgcatgcctgtaatcccagctactcgggatgctgaggcaggagaatcgcttgaacctgggaggcagaggttgcagtgagccgagatcgcgccattgcactctagcctgggcaacaagagtgaaacttcacctcaaaaaataaaataaaatgcaaaaggtacaaaagaatatagtagtaaaaagtaaatccatatttttcatccagtcccatttatcaaaggtaactcttgccagtttttgtgaatcctttctagaactattctctgcatctatataagcacattttttccttactttgcataaataagactgttatatagacagcacatgcctatataccttcgtcttttttaatgactgtatatcattccatcataggtgaactctgatgtatttagcatttagcttgtttctcccttttgctattaccataaggctggagtacccatcttttaaaccttgcacgtgtttttgtacacatgtgggaataaatttgtaggataaattccgcaaagtggaattgttggtcttgaaaataattgcatttaaaattttgatatatattagtggatagatttttaaatccttaatatacctccagtggaaactaaaacaaagatattattttaacttacaaatcaaataagtatttaaactatgttggcatcataaaataaggctcctgataacatttatgatgatttaataaatattccagatattgattataaaattgtttctgttgtaaattaataaacttttcatttatggaacactgatggtagaaatctacattattggaaaaccagttgtcttagtccattttctgctgctataacaatacttgagactgggtaatttataaagaaaaaaatttatttggttcatggttctggaggctgagaagggtgagggccttcttgctgtgttatcccatggcagaaggcgagggtgagagagaaagcaagaaagggtcgaacatgcctttttttttttttctaaagggacagggtcaggtgcagtggttcatgcccataatcccagcactttgggaagctgaggctggaggatttcatgagaccaggagttagaggctgcagcaagctatgatcataccactgcaatccagcctgggtgacagagcaagaccccatctcaaaaaataaggagtcgggccgggcatggtggctcatccctgtaatcccagtactttgggaggctgaagcaggcagatcacttaaagtcaagagttcgagatgagcctggtcagtatggtgaaaccctgtctctactaaaaatacaaaaaaatatagctgggcttggtggcatacgcctgtagttctagctacttgggaggctggggtgggagaattgcttgaacctgggaggtggaggttgcaatgagtcgagatcgcgccattgcactccagcctgggcctcacagtgagactccatctcaaaaacaacaacaacaacaacaacaaaaggagtcttgctactatcttacccatgctggacttgaactcccaggctcaagggatcctcccacttacacctgtagctgggattacaggtgtacccagatgaactcacatttaaaaccaacccactcctgcaataaggaacccagtcttaccataatgacgttaatccattcatggagggcagatcccagatgacccagtcatctcttgatggtcccacctcccaacattgttgcattggagattgtttccaacacatgaagattagggacatattcaaaccatagcatcagttaaacctgtcagctacaaattctctatatagtctcactttcatcacatcaaaggataaaggataattttaacactggtggggagggttttttttgtcttttaaacaatgagaatagatgtcttaactttgtttatgtttatatagggcacagaccatcatgaaggctcgtttaaagggagcacagacaggtcgaaacctcctgaagaaaaaatctgatgccttaactcttcgatttcgacagatcctaaagaagataatagaggtagaatgaacttttcttagaatagtatttattttagaaaaatccagcatggcccttggcatttttttttttgttgttgttattttaattaatttttttctttcaaaagtaaaaataccattataagtttaacaagtgtcaaatatcaaatagttcatttaataaaatccaaactctttaatcttgcctgcaaagctccacttgatctgattggccccccgcctgcctctcttaccttatttagagcattcttcctaaggtcctccaggtacttttcattagctctttctcctgcctgaaatactctttccccagaacttataactggctcctttagctgttctagtctcttaagagaggctgttcctgatcacccaatctaaagtgaacaccatgtttgcttctctcacaattccttattttaattttattgtagcatgtactaccgcatggtatgacattttatttctagtctttttcttttttttttttttttgaggcaaggtcttactctgcagcctcaaactgggctccagtgatcctcccacctcagcctctcgagtagctgtgactacaggtgcatgctaccattctcagctcattttttttatttttagtagagacgaggtctcactatgttgcccaggctagtctttttgactcccgggctcaaacagtctttctatcttggcctccgaaagtgctgagtttacagtttttgtgttttatttttaaacctgtacgtacttaacaaaagcattttctatgagtgctgtttttatttttatttttttattttttgtggagatggggtcttgctttattacccagggtggtctcaaccacctgggctcaagtgatcattccacctcatccttccaaagcactgggattacaggtgttagccactgtgcctggccctgtactacttttgattatttgtgaagttaaggagcttttcatgcttattgacaatttgattttcttggtaaatgtcttctttttttttttggtagaggttctatgtgtattctgcctaatgtgtaaaatgttaaaaatattttttccacgccttttcttttaacttaaaaaaaaaagttaatactaggtgtggtgactcatgcctgtaatcccaacactttgggaggccgaggtgggaggatggtttgagcccaggaatttgagaccagcctgggcaacacagtgagaccttgtctctacaaaaaagaagaagaagaagaagaaaattagcagagtgtggtggcatgcacctgtagtcccagctacttgggagcctgaggcaggaggattgcctgagcctatgagtttgaagctgcagtgagctatgattacaccactgtactctagcccaggcaacaaagtaagaccttgtctcaaaaaataaaaataataaaaagttaaaaatgtttttcctttggtcaaatctgttggtctttttctttatatagcttctgagttacatataaggcttagaaaagacctaaaatgattaagaaaatattatgccacattttcttttgttgctttacagttttttttctttaaacctttatcttaattatgtctgaattttgggggcagtatgatgtgaggtaggtagctttatcattttgtactgtatagacagtagagtggtctctttactaaatttccatatagacctggggttgtttctgaatcctctagtctatttcattgacttaactgtcccaaaccagatatattaatatttccttattgtagctgtacctttttaatacttgggaaggcaactccctacccagctgacccagtttttcttctctttctgaaacattattgaatattctcaaacattaaatattccagatgtactttaaaattaatacaccattagggttttgactgcaactgcagtgaatttaagagattagtttgagtaaatcagcatgtacccattcaggaataatataggtccttcagtaaagattcagttttctgtttctcaatgcatttattctgttttaattataaaactcatagtttgtaatattgttagtgatcataaccaaaactgttaaaaattggaaatttctgtttgtcgttatcaaaccaatatttacatgcacagccagcataaaatactgatggttattaaaggaacataattatgatggaatatttccttgtaaaaggcttggttgaatctgctgttggtttatgcttttccagactaaaatgttgatgggcgaagtgatgagagaagctgccttttcactagctgaagccaagttcacagcaggtgacttcaggtaaggggactaaacggggtgttttgaagcaaaacaaagtgatttcagtctcataatttcatttaaaaagcattttttaatttagaaataagcgttaaggacaaatgatatagtaataataagaaagaattcttttaaccccatcaccttaactccactgtcatcttccacatgtaattcttacatagttgcaggcgcaggatacttagtattttagagtccattttcatttaacgttgtatcataaacatttttccttattttcaacatggctgtatgatctttctcaagatgtattttttttttctcctaatgctgggtatttgggttaattctcagttttttggaatattagggaaagtgcagtgaacatttttacacatatgtatttttgtttctactgaattattcccgtaggataaatttttgagaattggattatttaaaaggcatgaacttcatggctttggtgacatcagtaaatcctttacaaagcatacaaaatagcttgcaaatgtgttatgccaatttacatatgttatgtaattctccaaataacactatgagataggtaaggcaagcattgttattctcagttttaattaaatgccttcctgaggtcacttggctaattaggggcagaggcagaagttgttttcaaggtttctgattttattattttcctaatgacatgatgcctattatctaggagctttcactgctcttgggccttaataaggccctttgaagtggtaggctttcatttttgccagtgctggtaagatcacagcttgcattgaattttctagcagagggtggagatcaatcaatagtgtataagtggtatgtgagtgttttagggtggttatggggaagatactttctataatatttatttttgttttgttttgagattgggttatgagactggctaatttttgtatttttgagtttcaccacattgcccaggctggttttgaactcctggcctcaaacaatcctcctgcctcggcctcccaaagtgccaggattacaggcgtgagctatcgcaccctgccaggaaggcactttctggtaacatttgagaagtcacacaaagccagatggaacatagtttccagggtaaaggaattgaacgccagcttaaccaattcaatagcaaacctagaaaggagttttctctatctcacactagcagaagaatccttaaagttatatccatgtagcacacctctgactgaaaacataagcaatccacgaactttaaaatcattctttgttcttttcttactgctaatgttttgaatattgttcattctctgctttcagaggccctcctctagcagtaatgacttttctccctttttggaaaaaggacagttatcaaaacatacttaattgtgacatctcactcttggtctcatttaatgttaaaactatccagtgggtccctgtaggtttatttctgaagagtctgctaaataaagtctttctctttttctgcagcactacagttatccaaaatgtcaataaagcgcaagtgaagattcgagcgaagaaagataatgtagcaggtaacgtttcaaccttttagaaaccctttggggagaaaagaggtgacattttaaaattaacctgtttatacagcaagatcttaatgtcctagtttcttccttctacttagaacaagttgattggctttacatgttaaaatcattaacaaccaggtttctaattactcaggataacttgacttttgtatagaagtgaacacttaagaaggcaggttccggctgggcacggtggctcatgcctgtaatcccagcactttgggaggccgaggtgggcgaatcacaaggtcaggagttcgagaccagcctggccaacatggtgaaaccccatctctactaataatacaaaaattagccaggtttggtggcacgcgcctgtagccccagctacttgggaggctgaggcaggagaatcgcttgaacccgggaagcggaggttccagtgagccgagattgcaccactgcactccagcctgggtgacagagcaagactctgtctaaaaataaaaaataaaaaaataaagaagtcaggttccactggatgtggtggctcacacctgtaatcccagcactttgggaggctgaggtgggcggatcacaaggtcaggagttcgagaccagcctggccaacatggtgaaaccccatctttaccaaagaatacaaaaattaggccgggtgtgatggctcacacctgtaatcccagtgctttgggaagccaaggtgggcggatcgcctgaggtcgggagttcgagaccagcctaatatggagaaatcctgtctctactaaaaatacaaaataagccagacgtggtagcgcatgcctgtaatcccagctacttgagaggctgaggcaggagactcacttggacccaggaggcagaggttgtggtgagccgagattgcgccattgtactccagcccaggcaacaagagcgaaactcatctttaaaaaaaaaaaaaaattagctgggcatggcatgtgcctgttgtcccagctactcaggaggctgaggtgggagaatcacttgaccccaggaggcggtggttgcagtgagctgaagaccacaccactgcactgcagcctgggcgacagagtgagactctgtctcaaaaaaaaaaaaagaaggcaagttcctaaattcattaattgaaaccaattacaattccatacttaagctcttgatttttgagtttgatgaaaaagaaacacagaaaacagtgattaagaaacagaatttaggccaggcgcggtggctcatacctgtaatcccagcactttgggaggtttaggcgggtggatcacctgaggtcggaagttcaagaccaaccttaccaacatggagaaaccccgtgtctactaaaaatacaaaattagccgggtgtggtggtgcatgcctgtaatcccacctattcaggaggctgaccaggagaattgcttgaacctgggaggcagaggttgcggtgaggcgagatcacgccattgcattccagcctcggcgacaagagcaaaactccgtctcagaaaaaaaaaaaaaagagagaacttaaaggtttatgaatccatgtatgcttctgtgtttaacaggtgttactttgccagtatttgaacattaccatgaaggaactgacagtaagtgtgaaactttttgtattactttgtgtctctgggatttcctgtttcctctttaaatgaactaagttctggaaaatggtgctagatgttgagaggttcctgagttagaaatcctcttatttgatatagtcaggacaatagttgatcagttaatcaaaaggtcttaaggccgggcacaatggctcatgcctgtaatactggcactttgggaggctgaggcaggcaaatctccatctctacaaaaaatataaaaaatcagccaggtgtggtggcacgtgcctgtagtttcagctacttccagggctgaggagggaggattgcttgagctggggaggtagttgcagcgagttctgatcacgccactgcactccagcctgggctacagagcaaaaccttgtctcaaaaaagaaaaaggtcttatgctaggaagtcataaaacattatacatatcttaaaatatttcaatattttatcagaaatatatcaatgtagaatcacttgctatttaaaaaatataaggccttttgaatatgaattcactgattagacttctgtgttgtttttctgcatatcctacacccacaatgcactgcttataattcccagtttgggtctctttaaagtcaaataagatcttagacactgatgcaacctgaatgctgattctttctagatttttatagcccacttccactttttaaataactgtcttattcattccattcctagtttgacagcatattttctttccaaagtaaagtattaacttttttcatagaaacaatattcttggccaggcacagtggctcacacctgcaatcccagcactttgggaggctgaggcaggtggatcaccttagcccaggagtttgagaccagcctgggcaacatggtgaaaccccgtctccacccaaaaagttacaaaaattagctgggcctggtggcatgcgcctgtggtcccagctactcgggaggccgaggtgggaggattgcttgagcctgagaagtggagcttacagtgagctgagatcgcaccactgcactccagcctgggtggcagagtgagaccccatctcaataaataaataaacaaataatattctttcttttggcacttgtatttccttgcttcatgtgatatttaattaaatcatatagaatattaagtacatttcatacgaagaagtagagcattctagagagagtcacctgttcacagagtgtcatcgtactctgggcatcaggcagtatgattttcaaagggaataaggggcatcaagctagtgaagtgaaggttggttaaaagcttcctttgtagttatatttagaatagtattcttgtgggaaactgtatttagtagcatgctcctatagtgtttggggagtgagataggcacttcatgtttacattcaatgaagattagtgaattcatctttccatatttgttattattctgaattatctccttttggggaattttatagggaagatattttactctaattaaaaatgttgtctgactggtcctttcaggttatgaactgactggtttagccagaggtggggaacagttggctaaattaaagaggaattatgccaaagcagtggaactactggtggaactagcttctctgcaggtaagtagcaaaagacctggagaactcctgtagtttgatttgtaacagtcaagtggaggagagtcaggtcttgagtcagcatatactgtgctttgtacttttaactgttcccatgatcctatgtaaagcaaacataatattttgatttctgaagtgatggcttttgtaccattgtccctactttttaaaatttatgtattttttatttttttgagatggagttttactcttgttgcccaggctggagtgcaatggcgcgacctcggctcactgcaacctctgcctcctgggttcaagtgattcttctgcctcagcctcccaagtagctgattacagacatgtgccaccatgcctggctaacttttgtattttttgtagagacagggttttgccatgtttgtcaggctggtctcgaactcctgacttcaggtgatccacccgcctcggcctcccaaagtgctaggattacaggcatgagccactgcacctggcccctacttttaatttaaaaatttatttatttttcgaaatggggtctcactgtgtcacccaggctggagtgcagtggcataatcccagctcactgcaaccttaacctcctgggcttaagtgatccgcccacctcagcctcctgagtagctgggactataggcatgccccatcacacctagctaatttttgtattttttgtagaggtggggtttcaccatgtcgtccaggctggtctcgaactcctgggctcaagtaatcagcccgcctcatccttccaaagtgctgggattataggtatgagccaccacacccggcccctgcttcttcttgttaacaaaatgtatgtgctatggtacactcttgttttttttgtttgtttgtttgtttttttctttgagacagaatcttgctctgttgcccaggctggagtgcagtgttgcgatcttggctaactgcagcctggatctcctgggctcaagcagtctcccgcctcagcctcccaagtagcttggactacaagtttgtgccacctcgcctggataatatttttgaattttttagttgagatgaggtcttgctacgttgcccaggctggtctcaaactcctggcctcaagaaatcctgccatctcagcctcccaaagtgctggaattataagtgtgagccacctcacccagcccagtttcactctttgctaagtaagaatagcaagttgatactagatttaaatgtaaatgtaaataaacatcgtttgtgcatggaagaccattttttcccctatgtggccagttagtatatatctaggttattaatgcttgattctttcttgtcatttttatgttgttatttaggtgagactatagtaaacaaattataatagtgtcaactcaagtaaagcctgttgaagcagaaatgatttgataaaggtttattgaaagccaaatgtgaggattgacccgggaagacaccaacaaagttgggtgtgttctagagtctgctacaagttggaaggcttttatgggaaagtttaggagaagggaggactcctcatacccaagttgtccttttcattggcgagtacaatacagaggtcacaatcattggctacagattacaaatacaagctaaaatgttctacatgcaagtaaatcatgaagtaaaacttcatgaatcagaaacaaatcagtgtcattttcagcgtcagtaggttgcatattaatcagtatgtcagcagtctgagaaacttaagatttccttactcagggacaggatgtaaaccatgaatcataagatccctcaatctgcccaggcaggttaatttggaaacctaccaaatgtgacatgtaggttatcaatagcatggaaatagtgttagccctatggaaatctcacaagaattttgtttttgttttgttatgaagagacagggtcttactctgtcacccaagctggagtacagtggcacagtaatagctcactgcagcctcaaacgatcctcccatcacagattaccaagcagctgggactacaggtgcatgctactacacccagctaatttttaaaatttatttcttgtagaggcaaggtctcattgtgttgcccaggctggtcttgaactcccaacttcaagtgattctcccacctcagcctcccaaagtattggggttataggcgtgagccatgcgcccagcctaagaattttgttttttaagcatgccaaaaagaagttgtcttggttctcaaatgttttctacaagtgcagtcttagtggagtcaagtgatcagggaatgattaggaagactttgtgcttacattattaatttgttcttattttagacttcttttgttactttggatgaagctattaagataaccaacaggcgtgtaaatgccattgaacatggtgagtattaggtactgtgaggtgctttgtcacttgtccataccctccacttgtcgtgaaactgctagaattcagggactgtactgaagactgaaagatgaataagatgcttcccttgcccacagtgcaaagagagaagtgtgtccatagtaaaaaaaaaaagtgttatgaagtgttctgatagaagtacttgtatgatctgggggagttacacacataggaaagtggtgacttaaaaattatggaatgttttcttcatttccagttattcatgcagttatttaagggtaggaatatttctcaagatccttagtgttttctgtagttctttctaatggttgagtgatgcaactttttgagtacattaaatatttaactttaaatcagtataagccattctccttgatttctaaaaaatttcccatttgatgcacttattttccatctcttttatttcactatttaaaaaatatgactgcttagtgttgatggtactttttgctcaataaacttagtttttattaaagaaacactcaattttaggtaagaaagcaaaatttgaagtaaagaaattcctttgcttgggaatttctatattaatgctagtgagaaatatattaactattatattaactatgtataatatgatatattaactatattgttagaaatatattaactgttatattaactatatattaactatattaatgttagtgagaaagttacctcattttttaaaaaacctttttgactgcttgctagtgccaggccttgtacatgaaagtggaagcaaagaaaaaaaaaaaaaaaaggataattcgtagttcttaccctcagagttcacattctagaagctgaacaggtaaactatgtaaagtcgagcctaatgacgtaaactcaatcgagcattctctctgctcgattttttaacagttgattgctactatatttaaaataacatctgtgcttcaatgttatatattcatagaattcagcacattcagtgttgtatttgttatggtccaataggttatctatgcatagaaaagacactagaagggtatacaccaccatgtttacagtagttactcttttggatggttggattatactctattttactttttttctttgtgtttttttttattttattttatttatttatttatttatttatttatttattttattgatcattcttgggtgtttctcacagagggggatttggcaggtcataggacaatagtggagggaaggtcagcagataaacaagtgaacaaaggtctctggttttcctaggcagaggaccctgcagacttccgcagtgtttgtgtccgtgggtacttgagattagggagtggtgatgactcttaacgagcatgctgccttcaagcatctgtttaacaaagcacatcttgcaccgcccttaatccatttaaccctgagtggacacagcacatgtttcagagagcacagggttgggggtaaggtcatagatcaacaggatcccaaagcagaagaatttttcttagtacagaacaaaatgaaaagtctcccatgtctacttctttctacacagacacagcaaccatccgatttctctatcttttccccacctttcccccttttctattccacaaaaccgccattgtcatcatggcctgttctcagtgagctgttgggtacacctcccagacggggtggtggccgggcagaggggctcctcacttcccagtaggggtggccgggcagaggcgcccctcacctcccggacagggtggctggcctggcgggggctgacccccccacctccctcccggacggggcggctggccaggcggggggctgaccccccccacctccctcccggacggggcggctggccgggccgggggctgaccccccaacctccctcctggacggggtggctgctgggcggagacgctcctcacttcccagacggggcggctgccgggcggaggggctcctcacttctcagatggggcggctgccgggtggagggtctcctcacttctcagacggggtggccgggcagagacgctcctcacctcccagaaggggcggtggggcagaggcgctccccacatctcagacgatgggcggccgggcagagacgctcctcacttcctagatgggatggcggccagtcacagacgctcctcactttccagactgggcagccaggcagaggggctcctcacatcccagacgatgggcggccaggcagagaggctcctcacttcccagaccgggtggcggctgggcagaggctgcaatctcggcactttgggaggccaaggcaggcggctgggaggtggaggttgtagcgagccgagatcacgccactgcactccagcctgggcaccattgagcactgagtgaacgagactccatctgcaatcccggcacctcgggaggccgaggctggcggatcactcgcagttaggagctggagaccagcctggccaacacagcgaaaccccgtctccaccaaaaaaatacgaaaaccagtcaggcgtggcggcacgcgcctgcaatcgcaggcactcggcaggctgaggcaggagaatcaggcagggaggttgcagtgagctgagatggcagcagtacagtccagcttcggctcggcatcagagggagaccgtggggagagggagagggggagggggagaggaagagcttctttgtgtttttattttccaagttctctgcattaaatgcacattaattttacaattaggaaaaaataactgttatacaaatgagcactgataatttgaaaaaaggggtttgaagttctcacacatattatttttttttttattctagtcatcattccccggattgaacgtactcttgcttatatcatcacagagctggatgagagagagcgagaagagttctataggtttgttgaaattggcagttattgatcatcttttgttttccatattccaaaggctgtatttgctgaatgacttgttggtttatgttctttagaattagcacagcttatgttttattctgataaataagcagcaagaaatattattaccagaagttgtggaaacaaatctgtcaaattttacatgtacctataacatggcatttccaaaaacttaggcctttcagagaaactgtttaggtttgattttttttttaaatatatgttttaagatagtcaaatgcagtagtgaaaagtggggaaagagtagaacaaggagtttgatctgtaactgattgtgcgtaatagagagaactcattacctttggacaagccaagactgaattattcttttttttttttttttttttgtgagacagagtcttgctctgtcacccaggctggagtgcaatggttcgatcttggctcatgtgtcaccatgcctggataatttttttgtacttttagtagagatggtgtttcaccatgttggccaggctggtctcaaaactcctgacctcaagcaatccacctgccttggcctgccaaagtgctgggattacacgcatgagccaccgtgcctggcccttgattattctttaaaatgaaatgatgatttagattgggtgcctcctacataaaaactgagagaagaaactagaattcagctgttattcaacaaatatgtatttcatgttcaggagaaggtataaagcacctggaggcattaccaaatagtatataaatcacgccattagagaattagcacagcacttggagagaaattatgcatgtccatgaattggttatgaacatttagagtcaacaggtataaatactaaactggtagtgtacagggatctgtatactcggttcagagaaatgggaggtaggtgagggcaggagtatttaggaaaggcatggggggtcttagacctggagttagcatctaactatggtctataatcttaattatcaaaggttagtttctgtccttccatgatactcagggttgtgttgagccaaaattttaaaaaaatgcctgaatgctcaaaatctgttccattcgagaatggatttcaaaatttaacctaataaaggcttctaggctgggctcggtggctcatgcctgtaatcccagcactttgggaggccaaggcgggtggatcacaaggtcaggagttcaagaccagcctggccaagatggtgaaaccctccgtctctactaaaaatacaaaaaattagccaggtgtggcagcatgcgcctgtattcccagctactcgggaggctgaggcaaggaattgcttgaacgcaaaggtggaggttgtagtgagccaagattgcgtgcgccactgcactccaccctgggcgacagagcaagactccatctcaaaaaaaaaaaaaaaaaaaggcttctgtctcaggttaaatcagttattagcttaaaattatgtatttttagcttaaaattatgttttttaaaaaggattataaataaattactgaaaatgaaattaataaaagtaccaggtttttttctaggtatgtgtttattatccttgttacaaaactcaaagaaatcaaatctacttaatattgaaacagtgtttaaaaaatccacccccacctgtattttacaggttaaagaaaatacaagagaagaaaaagattctaaaggaaaaatctgagaaggacttggagcaaaggagagcagctggagaggtgttggagcctgctaatcttctggctgaagagaaggacgaggatcttctatttgaataatctttcctgttctggttctttgagaaaccctaacactggcttcattttaattcacagtgtgtaggtttgatttgtgtggctatttattttttggcctaagaatttcactggttgtaaaatttacctagatgtctatttatgggattacttttgcagaatcataatttagcaaccatttatcatggatgaaagagatctgtaaaacctgcccaggaacttacagaatttactttgcagaagcgttatcatactccatttacatctgtgttacacgtgatctgcttaccaagcatattaggaaatacctcttaggaagcattagcggtctcaggccaattactgtggagcagctttcattcctacccacttgcaaaccttggcgctgttgtctgagattgctgcagccattcttgttaccatggtacttctcaaactttgtgaaaacctgcacttttccttgcatgacaggttcctgtcttgtctgtcatgggagccattctgccaatttaaatgcgactgtggtataaacagtaaaatgatttaaaagtaagtcattccgtttttattaatttactgttaagtcatgttctcatgctcagatcagtagtgtcagccagagctttctctgcagacatgtaggaagtgggtagctatttttcccactccatgtattagagttttacaaaaaggcttacttttgagacaactgttgcattttggggtactaataaatgattgccgatgagtt

SEQ ID NO: 37095 - DNA, 895 bp, Homo sapiens
ctctccgccagaccgccgccgcgccgccatcatggacaccagccgtgtgcagcctatcaagctggccagggtgaggtgggggcccgaatttgggggcagggggagggattagaggagccaaacgggccgggtctgaacccagcttctttcctccaggtcaccaaggtcctgggcaggaccggttctcagggacagtgcacgcaggtaatcgggtgggggcatttggccgactgccggcgacctaaaccctgatgtgacctctaccctgccctaacccctgccagccggaatccgggagccgattctcatttcatcacggggttctgatggttccctttaacgatctgtattctggccccgacacgttctctgaattcatatctgcttcccactccgcggtgcctttccgcggcccgcccttacttcttcctccactccggtggggacccgtaggtgcgcgtggaattcatggacgacacgagccgatccatcatccgcaatgtaaaaggccccgtgcgcgagggcgacgtgctcacccttttggagtcagagcgagaagcccggaggttgcgctgagcttggctgctcgctggtgggtgcaaagaggacacccctttgatagacctttggttggtggtagggaggcttcgttaagcccagggtgagagggtttgggaggcagagtctacatacagagactgacaagagggaggcgggagtttgccaattgctgcggggcctgtcaacatctcatgtttgggtctgtttacagggtcttggatgtcgggttcgaccacttggccgatgggaatggtctgtcacagtctgctccttttttttgtccgccacacgtaactgagatgctcctttaaataaagcgtttgtgtttcaagtt

SEQ ID NO: 37096 - DNA, 6679 bp, Homo sapiens
agggcgcgggagcgcggagcgagtttggttgcacttacaccggtacttaagcgcggaccggcgtgtccttggacttagagagtggggacgtccggcttcggagcgggagtgttcgttgtgccagcgactaaaaagaggtgagagcgggtcgcggaggccgcacctggttagaggcagagctgtgggaggcgcgcacttgcgagcgaccgaaacccaagcggggagcattcgagtggagcccgcgctgggtgggagggcggggagtgaagaccctggactgtggtcagaccgagctgggcgagtaacggcttgaggtgcggcggagccctaactagggacaggtatggtctcggtcagggactggaggcggcttggatacagatccgaggaggaggcggcctcttccgtagtggttgctgaagggctatggaaatgataggcaagacttccctcctggaaagccgaagcttagagcttcacgttcttcttcagagggcaaaagctgttgctcttctaataaggggccagttcttttcgtgggcacatgtttcttccgtcagtcgttctgacatcctagaaggagtttcatcaatcaccttgaaaccgacctggacgggtgacctcgtggtcgccccaggagatcacaggtaggggagttgggatgtccccgggggaccgtgcagcctgcccctgagctcccattcacaagttcgagtgtcaagctactcctgtgacctgggcagatagaaacagccaggaccgctttttaaacatttgtgtgctttgcgttatcctcagggagaggtggctttacattgtagtaagattaaatggttaggtctttttaaaagttgcggttgtggtgattttggcttaatgtgttcgcccttgagcttcagatctgtgacttcgtgaccatgattgtctcttctgaaactggagtttgaattaggttccctctttgcttgggctttaacgttccttcacgtatacacacaaaaatacgtttttgaggaggtactcctaaaaatgtttttggtattaaagaatatttggtataaagagtattaaagcaaaacaagattcattctggtatttaatgacataaattagcaatggattggtaattaagtggctagagtggtcattcatttacactgtatttgttacctgaggaaaaatttactaagttgaagctttcgtttttagaattaaatatgggtgatgttgagaaaggcaagaagatttttattatgaagtgttcccagtgccacaccgttgaaaagggaggcaagcacaagactgggccaaatctccatggtctctttgggcggaagacaggtcaggcccctggatactcttacacagccgccaataagaacaaaggtaagagtcacttgttaaataaaacaacacaaaatgcaggaatataacatgtggcaaactatcaggagtgtgaaataaccgatgcattctttcttgtttaggcatcatctggggagaggatacactgatggagtatttggagaatcccaagaagtacatccctggaacaaaaatgatctttgtcggcattaagaagaaggaagaaagggcagacttaatagcttatctcaaaaaagctactaatgagtaataattggccactgccttatttattacaaaacagaaatgtctcatgacttttttatgtgtaccatcctttaatagatctcatacaccagaattcagatcatgaatgactgacagaatattttgttgggcagtcctgatttaaaactaagactggcttgtggttaaatgaatatgttcagtttttgaattttaatagtaactccaattcagtaaatggtatcactgtttaccccttttaaagatatgattagacttcgttagtaatgttcaacttttcacaaagatggtgagtgccatcttaaaacttactggagattggttttatatttagatttatataactggttatgtgaatatatttaaatactggggaaattgcttcactgtcttagaaccaagcaagattcacctgtgttttgtgttcatgttcatttgcctcttaaaggcaagggttgaagataaataaggtagcaatgtctatagttttggccttaactatgccaatctaattataattccctgtatttaaaatggtttcttttacttattgaaaggcattttagtgtggtttatgtgtaatattaaagattattcaacacctctcacatcttacagatctataaggtcacatgcttttaaaatagtagcaagttaaacttcactcttgaattctttacaatctaagtcaaactaagttataatttaggattgtctttaaacagccattcagaaacaaaactgtagaactgtgtatttgattgggaatggtgcttttgccaacttaaaaggattaaagtaacggagatatacacaaattttaaaattatgtgtgatcacaagactaaagataattaaaaagaaaaccacagatcatgactttttgactgtgcttgatttcatgactgatgcacaaattttaatgattaaaaagtgcaggagccctaaatgtcagtgcagcagccctaaatgtcagtgcagcagtgttaaccagtcatggtgctagattgtttacttggttttctaggactgcctcaactagaataacacttcactaattgactcttagtttctttgctcagattgagaactgcagcatttatgccagacatggacagaggaatgcctgtggtcatagttttgtgatgtgtaacagtgtataattacatactgaattatttcatgcatagtctgtgccatacacatttagagtagtccttggagattttatggagatggtgagcacaaggtaagtcataaagaataatgagaaaataaatctatgctggtgcagctgagaactgtatctttgtgggacagtgagaagactgagaagatgtgaatccatggtctcaaaggtgatagggacgattagataggtgttttaaggcctgaaagcaatttataacatatgagtcttatttttatttatagaaatgtggaaagcttgctgtaattcatatttgaagtcctagtctgagttctggtggggaatttaaaaatgcatcctggaaatcctttaaagatttcagactttgaaaggccttgtagcagaggacttggtgactgtataaagttagtggtattcagggacagtgtagcaagtagcttacaaggggacaattctggactaatgagaaagacctgaagtgaaggctagagagttgattttttttttttttggcatcctggaaatgatacaggaaacatattaagatagatacagaaatgtgttcaaccttccatcttggctagttgtggcgtttagtttgttttttgagacatggtcacgctgtgtcgccaaggctggagtgcagtggtgcgatctcggctggctgcaacctctatttcccaggctcaagcgattctctcacttcagcttcccaagtagctgggactacaggtgttcgccaccatgcccagctaatttttttgtagagatggagttttgccatgtggtcccaggctggtctcaaactcctgagctcaagcaatccgtccacttgccttggctccccaaagtgctgggattacaggcgtgagccaccaggccctgcctggttttcaaattcagaaatcttattatttaacccagaagtaatcagcccagtagtaacttaggtttaattttttttcaggtttaaaatttttctcatttattttttctgagacggagtttcgcccttttcgcccaggctgagtacagtggtgcaatctcactgcaacctccgccttccagttgcaagtgattctcctgcctcagcctcctgagtagctgggattacaggcacccgccaccacgcctggctaatttttgtatttttagtggagatggtgtttcaccatgttggccagactggtcttggactcctgacctcgtgatccacccaccttggcctcccaaagttctaggattacaggtgtgagccaccacgtccggccaatttttctcatttctatgcctcctatattaaggtctgtgttggcacagatgagtaactgccatgttctaggtcagttatacccaagcacttctggtggtttaaaatgtgattctgtaacttttttatttttatttttttgagataatttcactcttgttgcccaggctggagtgcaatggcgtgatcgctgctcaccgcaacctccgccttccaggttcaagcgattctcctgactcagcctctcaagtagctgggattacaagcatgcgccaccatgcccagcttattttgtgtttttagtagagacagggtttctccatgctggacaggctggtcttgaactcccgacgtcaggtgatctacctgcctcggcctcccaaagtgctgggattacaggcgtgagccaccacgcctggccaattatgtaattttttaaaaaggacatttctatcagggatatataccttcagaaataaggaaataggggaaaaaaagagcactataaaccacatgttttcatttctagtgcttcgctgtaagtggctaggttggtagaatcaaaaacaagggccagatgtatttaaggggtattcagatgccacctacatgcttattttgtctagaacagtgctgtctaatagaactttctgtgacgatggatattttgtagacttttgctgtccagtgtggtagccactaaccacatgtggctgttaagcccttgaaatatagctagtgtgactagaaagtattttattttaaatttacataggcacaagtggctagtggctactgtattgacattctgggtctaggactagaaccagtggtctgtaacaaaagtactttctctttactctattaaatctagaattagccgggcatggtcgctcatgcctgtaatcccagcactttgggaggccaaggcaggcagatcacttgaggtcaggcgtttgagaccagcctggtcaacatggcgaaaccctgtctctacaaaaaacataaaaattagccaggtgtggtggtgggcacctgtaatctcagctacttgggaggctgaggcacaagaatcacttgaacttgggaggtggaggttgcagtgagccaagattgtgccactgcactcaagcctgggtgacgagtgaaactgtctccaaaaaaaaaaaaaaatctagaattcttggaagtacattatattgcccttcagaatagattccagttcctgttgtgctcacctttataattttaccataagttttacctattcgtaagttggcagttttagatagataacattctggtggtagctagggatttaccttttgtcatccttttcctgcacttctcttgaattcctttatagatgtacagttttgctttaaccactgaagattgctgtaaattataaagggtgtgatagaatccacatggctgtcaagaaggagatcttaccaaggacagttgactgactagtctcagattgtttcatatcatttatacttgggtaagagtaaactagataactgggcgtcgtggtgcacacctgtagtcccagccactctgaggcaggaggactgcttgtgcccagaagttcgaggctgcagtgtagctgtgattgtgctactgcactccagcctgggcaacagataaaggaaactccatctcttttaaaaaaaaaaaaagtggtctgggtgcagtaggtcatgcctgcaatcccagcactttgggaggccaaggcaggcagatcacctgaggtcaggagcttgagaccagcctggccaacatggtgaaaccccatctctaccaaaaatataaaaactagctgggcgtggtggcggcacctgtaattgcagctatttgagaggctgaggcaggagaatcgcttgaacctgggagatgggggttgcagtgagccaagaccgccccatcgcactccagcctgggcaacaatagtgaaactccgtctcaaaaagaaaaaaagtttccttagaatggaaaatattcattcatgagctcttttggcaatccgtcatcagtatattctgaaaaccaataagatgttgccaagttgggggcgagagctatgtaatgcaaggcatatgcctgatgaagtatacaaatacacctgaccagaaactttgtctcccacataagtctcttctaggcactgtcggggtacatactgagctgctgctttggctgtattttctgtgcctcagaataaccattgtcctggtgttcatatccttagagttcagtacaaaatgttggatatccatttaataggttccaggttatcttagttggagtttggggtatttgaaaacgtcatgccttcaggctatcatttccctcagaaagctaagtaaatttactgcattcatttctcaaagagtaaaagtgcaggttgtatgtgtctatgaacatttaaacatgttaaaatgttaaatttaacattttaaatttaaacatttaaatatgtctgtaacttgaacagtgtagtttcagaaaggaccactgggctagtgtaatgcagaaaatgctgggtctaggattaggagaaaattgtgtttagtgtgtatcaataaacagcccgtggaccc

SEQ ID NO: 37097 - DNA, 5948 bp, Homo sapiens
gtcgtcacgcgtcccgcgcctcctcgcgcctgcgccgtggttggaaggtcgtccctgtgaccggcttggcggttggagcggctgtcgccatgttgtcggtagcatcccgctcaggcccgttcgcgcccgtcctgtcggccacgtcccgcggggtggcgggcgcgctgcggcccttggtgcaggccacggtgcccgccaccccggagcagcctgtgttggacctgaagcggcccttcctcagccgggagtcgctgagcggccaggccgtgcgccggcctttggtcgcctccgtgggcctcaatggtgagccggggcgagggccgcgagcagggctgggggtctctcggtgcccgctcctccggcccccagcagggagcggccgcgggcgcgcgagcggagcctgaatcaggtcgggctgggcggcctccgcaactctgggcctggcccccgggctcggggcgtctttctggtggccggcctggactcgcgtccgccggcttcgcctggttcctcctcggccgagttcacgagctctgtagtcccgctgttccagccacctctgaggggttttgttgcttgcaggtcgtttgaccttgggcgagtttctaaacgtacttcctgtgaaatggattcatatctttatcaattttgtaggggtgtcgtgaggcttaggtggaggaattctacgtaaagccgttagcacagtttgggcacttacatgcttaagaaatggaaacttactaatatttgggaagttggtcttctcaccactaccgatcccttcatgtccttccccttcatcacccccccaccaaaaaaaaaacaaaaaaaacatacacaaggtcagttacagtgtagtgtcacaacataatcagtcgtcaaggacgggcagagattgacgacatttacattttacagatgagaaaacagacgaggtagaatgactcgcaccaggatccgtggtgtggacatgtggtagcagggatttgacaagacgaattgtcgtagccactgagctcttcgcaggggctattccacaccctctgtccttagatccccgtttatcttctttgcctcgccttccatctttacttggccctgtatcggagatagagaaatggcagcctgtgggcagtgtgtctgcaggctgtgtagttttcaaaaaaactgggaagactaatggcatctcttaaaatgctggaagccggtaatactgggatctagtttctacttgggaaaattccatagtgtgctgtgtagtggccgcccccgcagttggagcaagtggtcttctccagtttgtcacagtctttaccaggtctgcgtgtttcattctgttaccagcctggctccactgatagctgtttgtgactcttcccctacacgctaaccaaattgcccgccacttttctttttactctgtcttcattcaccctgggctctgcactttcttcatggtccttccactaagttgctacatgtccatatgttttccttacccatcttttcaatctcagttaaggatcaggtgaataaagtttttatttgctgatttgtctgtctctgtagcacatacactttacactctgtattgtgtttattggtaactcctccacccttgggcttaagggcatagagaaggtaatatcttctttatttttctatctttcacaacgtcggattttgtatacagttagtgcaaagtatttgtgaatgaatatttgttaaggagcatcagtgggttttgaagaaactgtccatggcaggtgtagagtaccctagcccatccttgggacctggaggtgagaaggaaggaaggagaacatttcaatagcaaaagaaaagcatctttggaattcgtcgtgttgctaaagtttcttcaaaaaattggaggcttacatttctctgatggccagtgatgctgagcattttttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcaaaaattttctcccaatttttaggttgcctgtaaaccacaatgagataccatctcacaccagttagaatggcagtcattaaaaagtcaggaaacaacaggtgctggagaggatgtggagaaataggaacacttttacactgttggtgggactgtaaactagttcaaccattgtggaagtcagtgtggagattcctcagggatctagaactagaaataccatttgacccagccatcccattactgggtatatacccaaaagactataaatcatgctgctataaagacacatttacatgtatgtttattggggcactattcacaatagcaaagacttggaaccaatccaaatgtccaacaatgatagaccggattaagaaaatgtggcacatatacaccgtggaatactatgcagccataaaaaatgatgagttcatgtcctttgtagggacatggatgaaattggaaatcatcattctaagtaaactgtcgcaaggacaaaaaacaaacactgcatgttctcactcataggtgggaattgaacaatgagaacacatggacacaggaaggggaacatcacactctggggactgttgtggggtggggggagggggagggatagcattgggagatatacctaatgctaaatgatgagtcaatgggtgcagcacaccagcatggcacatgtatacatatgtaactaacctgcacattgtgcacatgtaccctaaaacttaaagtataataaaaaaaaaattggaggtttacctgacttagagaaactatttttagaaacaggcaaataatgtagaaccataaggcaaaaaccttttctgtaatcatttcagcctgtaatttaagttcacattatagtctgtctagatggttcatggcaggatggcttatgggagtggaggggttggatctggagaagattcttgaattggagaggaaggttgtactattttcatgcagatttccaaggcgcattggagctcaaccttaaaataaaacttgttttgttaaaattccttaaattttctcctttaagtatttgattttgctttaggttagaattaaatctagcatcttactgaaagtcagacctaatgcagctcatgtaaatatttggagaatgatttttgcaacagggcagtttaatttccgaaaggattcttggtggtgtagcctactaaagtgtaaccagctagatagagtgggaggagacttttgccaccaaatctctgaatgagaagggcaaagccattttattgagttttcttgtacatttccttgtatactgttaagggttgtggatactgtttttaatgtagaagtatgaactttttattcctttatcttttagggaggaagctcatcttttctgtaatcccaggtagtgctaggagcaagtaatttatgcttaattccaaatgccagtatatactggcaggttagcatttatttgttagagtagtagtataggatgtaatgtcactttgactccacagattctgggatgtgagtctcaagttgccattatctgtgtcctggtcttctccaggaaatgatttagtcagaaaagcacatagagtgattttggtaggtttcattattgtttgaatacttctggcttccataaagttattgaccttgagaatcatgtgaaaagcagttcaggtattccatattgtaatgtttgactactcaaggaagtacagtatattaggatgatatcctagtagagcaaggtagaattgcagtttattacaataaaaatgcatcataaaagatctttattttggatacacattttctaaaagaggaatttttagtgtccccttttttaaaaaggaaactttgtggcaaatttcttaagatgaatatacaatttgcaaagaggtttgcttcctgaaacatacctaaaagtggtactaggtaaaatttttttttggtcagatatttaaaaatagtattggagagagggatgtaactgtgtcttgtttttgttttttaaactaccaaagaaactccttgctcccaaagtactacatagtaattatttgtttaacattcatttgagctcttttatggcctagactagaagtgccccagttgagagaactacagcagtgaaaagggaagataatacccctacttttacagtaactattgccctttactgaagagggggagatatgaaaattttgccctttttttcccttgctaaattgaaataattagttcttttgcagttttcattttattttgagagctctgataaggatgtccttctctgcctattagtggttttaagttaaagtaatactaatttatacactagagtataaaatagaaacgctaatttttctgcagcagagttatacagttcacagaatgtttattatatcattattattttatgaattaacagttttttccgagaacatagattggactataaggggcagacatttgccttaataaggtgatcacacgtcaacttactgtgtggactagatgagttttagggtgtccttctaatccagagagtatgggaggtatttagcatgatttatatagtaagtcttggcagttgaattttcggaaactttgagttattactgtttattttgctgtttaacgtttttagcatgatgcactgaggtgttgtgaatcctgaatcagcaatgttcaaccaactagggggagctcaatttacaaatagtatcttgtgatttcataccagtatgataggtggtggttcacttcatttcatttttaagattttatatgctagcaccgccaatttgactatttctgagacccagtgagtgccatatttcacatttttagaatttgattttttacctgtgaatccataaagggctatttcctgatatatactcccttcgggatactcatctaattgtgttttttaaccttctgtttgtcttgcagtccctgcttctgtttgttattcccacacagacatcaaggtgcctgacttctctgaataccgccgccttgaagttttagatagtacgaagtcttcaagagaaagcagcgaggctaggaaaggtttctcctatttggtaactggagtaactactgtgggtgtcgcatatgctgccaagaatgccgtcacccagttcgtttccagcatgagtgcttctgctgatgtgttggccctggcgaaaatcgaaatcaagttatccgatattccagaaggcaagaacatggctttcaaatggagaggcaaacccctgtttgtgcgtcatagaacccagaaggaaattgagcaggaagctgcagttgaattatcacagttgagggacccacagcatgatctagatcgagtaaagaaacctgaatgggttatcctgataggtgtttgcactcatcttggctgtgtacccattgcaaatgcaggagattttggtggttattactgcccttgccatgggtcacactatgatgcatctggcaggatcagattgggtcctgctcctctcaaccttgaagtccccacgtatgagttcaccagtgacgatatggtgattgttggttaagagacttggactcaagtcataggcttctttcagtctttatgtcacctcaggagacttatttgagaggaagccttctgtacttgaagttgatttgaaatatgtaagaattgatgatgtatttgcaaacattaatgtgaaataaattgaatttaatgttgaatactttcaggcattcacttaataaagacactgttaagcactgttatgctcagtcatacacgcgaaaggtacaatgtcttttagctaattctaattaaaaattacagactggtgtacaagatacttgtg

SEQ ID NO: 37098 - DNA, 6373 bp, Homo sapiens
ccggcggcgcctcaggtcgcggggcgcctaggcctgggttgtcctttgcatctgcacgtgttcgcagtcgtttccgcgatgctgcctctgctgcgctgcgtgccccgtgtgctgggctcctccgtcgccggcctccgcgctgccgcgcccgcctcgcctttccggcagctcctgcagccggcaccccggctgtgcacccggcccttcgggctgctcagcgtgcgcgcaggttccgagcggcggccgggcctcctgcggcctcgcggaccctgcgcctgtggctgtggctgcggctcgctgcacaccgacggtgaggtttagcgggccgggggtgtggtttgcgttcaacagagggaaaacgtagaccaggaatagggcctgcaaccgacctctgaggtctgggacatttttccattgattggcaaccagcgggctaaacccacgtatgatcatatttcccccacctcccctatccagcagtttcgttttcttttggtagggggtgaataaaattaaatactagggtacctttttccttagtcttattctatcgaaagtggacctttgggaaggcccatggtcgtggttgaaaatagcatagttatatcgtttggcaagtggaagaggattggaaattctcctggtttatagcggaaagtggtaatgcgttcattgttggaaatcacttttccagaatcaggctcagcttcctactactattatggtatttttaccgataaggaaacaggcttctagagtaaccgtaatagcagagagattagaaacagtccaggtttctggctgcaataacctgggtaatagttttatgttttagactaactggctttcctttttatgtatctggatttcttttctaggagacaaagcttttgttgatttcctgagtgatgaaattaaggaggaaagaaaaattcagaagcataaaaccctccctaagatgtctggaggttgggagctggaactgaatgggacagaagcgaaattagtgcggaaagttgccggggaaaagtaagtactggtctggggatcccagggcagcaactcccttaaccttgcaggacccatcctgggtcatccccagaagagccttgagttcaggtgtggatactttgataaatgggtttcaagagagtgaaggattcatttggacaacttcgtaagccccaggcagtccattcaccgaacacaaatttgctgtgggctggttactaaggagacaaaaatgtagtgcaaaaaagtactggcagaatcagtttgatctctgatttacagccctgataaaataggacactgctctctaatgtttagtatgggtgaaaatgaaaaatatgtaacttctatgtaacaggatggggttacactgtagtaagggctgccatcagaggtggggagtttgtgacctaagtcagctcccccatcatctcctaaactgttaaagtgtttacacttttctgcattatagtcatccataatctcattacacagataaacatttggcatcttccaggtttttaaattgagcctgggcgcggtggctcacacccataatcccagcactttgggacgggcagatcatgaggtcaggagaaaatcctggctaacactaaaaccctggctctagtaaaaattaaccgggtatggtggcacgtgcctgtagtcccagctactcgggaggctgaggcaggggaatcgcttgaacctgggaggtggaggttgcagtgagtcgagatcgcgccaccgcgctccagcctgggcaacagagcaagacgccatctcaataataaataaataaattgaatttccttcataattgaccttatgatgtgtatgtaatttttttaaatcacagcttttatgagatttaattgagatggcatacgatttacccatttattgaagtttattaaattaagtggttcttagtcctcgcagaattatgcatcagttatcactacctaattctagaacactgttgtcatccccaaacaatacctattagcagtcactcattattcctccctgtagccaccccaggtaatcactaagctactttctctatgggattgcctcttttggacatttcatataaatggagtcatacaatttgtagcttccccccccaaccccacggagtcttgctctgtcacccaggatggagtgcagtggtgcgatcttggctcactgcaacctctgcctcccaggttctgacaattctcctgcctcagcctccttagctgggattacaggcgtgcgtccggttaatttttgtatttttagtagagacagggtttcaccgtgttggccaggctggtctcaaagtcctgacctcgtgatccgcccgccttggcctcccaaagtgctgggatttcaggtgtgagccaccctgcccaccctatttacctttttaattgttgggttgtaaaagttaagtttttctgggtacaactatcttatcaaattaatgatttgtaagtactgtttcccatcttgtgggtttccttttcactttcttggtaatgtcctctgacacaaaagtttttaattttgaggaagttcagtttacctatttttttggtcgcttgtgcttttttatttattttttactttgcttctaattcaccaagtgcaacttgtgcttttttagtgtcacgtctaagaaaccactgcctaacccaaggttgtgaagatgtatgccttaattttttcaaagttttctagttttagctcttagtttaggtctgtgattcattttgaatatggtgtgaagtagggtcctgattctcttgcctgttgcatagtgtgtttttgccctacacaggtcaattgtgtcttctgtaatctcacctaaacaccatttgcgcaaggttttcatagctatttgggggccattaaaaataatgctctgatgaacgtcattcaatttctgtgcccaggagctcagcttagtcagcacagttggaattagacagattttgtcaacctcagactgcctctgttgccatggaaaggtggcttcctggcagagcagctagttagcacaagtggagggcggcacttcatgtactcttttttttttttttttttttctgacagagtcttgctgtgtctccaggctggagagcagtggcgtgatctcggctcactgcaacctccacctcccaggttcaagcaattctcctgcctcagcctcctgagtagctgggattacaggcgcgtaccaccacgcccagctaattttttttttttttttttttttgtattttttagtagagatggagtttcatcgtgttggccaggatggtctcgatctcttgacctcgtgatctgcccacctcggcctcccaaagtgctgggattacaggcgtgagccactgcgcccagccttcatgtactcttgtgtggaatggtgcctgccagagttgcatagcccagcagttttggttctaaaccttatgtcccaagaattttgactcaaactttggaacatgatttgtcaggtgtggattcttgcaccttaaaattgtcactagttggtgtgtctggcctgctttgtgattatgaaacttcccacaagtactctaagggatgagtctctactacagcccttgttctttgtgaggcattcccttccccgttccagggctgctctcggtgtttagcagaggcaccctccatcgcttcttcctttccttgcagggcaaattttctgacggggaaagtctcttaaaggggcttctgttccatctcaccagcctctcaggtccttactttgaccaagggttccctggaaagaccagggtgggcagtgtcagctggctgtggccatgagatgcccagtcagcacatggcagtgagccctggggtactggccctgttgggagtaacccatgcatgacttgtttggctgagataaactgaggccagctttggcttccagcagctggtacatggtaggcacacttcagacctgctgagtcactcaggattggatgtaggcacccagcctagtttgaagttctgcatataattcagccagctaggacagagacattgtttcaatacgcctttttaactgtagcagatttccatgtttatgtgttaacctgctcggttaaaaccatgccttgtctgttttgccttgtctgttttcccttgccgttttagaatcacggtcactttcaacattaacaacagcatcccaccaacatttgatggtgaggaggaaccctcgcaagggcagaaggttgaagaacaggaggtaagctaatactataatcagcttttacctcagttctgacaggctgtgcctggggcttagaggaggagcgtttttctttggtctttcaaaaaaaaaaaattcctctaagtccagtcgcatggctcacgcctataatcccagcactttgggaggccgagacgggcagatcacgaggtcaagagatcgagaccatcctggccaacatggtgaaaccccgtctctactaaaaatacaaaaattagctgggcatggtggcaggtccctgtaatcccagctactcgggaggctgaggcaggagaatcgcttgaacccgggaggcagaggttgcggtgagccaagatcacaccactgcactccagcctggcgacagagcaagactctgtctcaaaaaaaaaaaaaaaaaaaaaagagagagagaatggcaggggcataagagactttaactggatcatgcctactcttcaaacatttcaggaagtgctgtgcccagcctagtaaccagccagtatgagggccacagagtccctagacattctgcccaagagccatcagtacagtgttgggtcatgacctggtgtggacggcgcagctctctggtgtgctgctttcccagccaccccaactagcatctccctgacgttggacccagtctgctcccagagctccgcatcagaggaaaagctgctgctgttattcagccataaggatggccaggttccccagcctttgaccctggtcccttatgaagactcctggaacagtcaagctggaaagagatcttgaaactttaggaaagctttgcagtgtacgggtggaggaaaaggcttggaatgttaagggactgatataaactcagttaattggcacatagctgaggctggtatccacatttcttaactgaaaacccagtgtgttatttaaccaagcagggtgccaacagaagtgagatcaagctcttcatttgggaatagtatggcataagactattcaaatggctacataatatcctaatagtggtggccatcagacactctgaacagagatccttgatccagccatccatctccttccagcagcagcatgtattgacttcttgtttccccagcctgaactgacatcaactcccaatttcgtggttgaagttataaagaatgatgatggcaagaaggcccttgtgttggactgtcattatccagaggatgaggtatgcaggatggagtgctagcctcttggcacccctggggaacagtgtgtcccttgggaacttcctgtccctattttagcagaaatttaaacacttttctagcttagaccagcccagcagggggagagaggtggggagtgagggaagagggttaaaacctgatgagtttcatgctgtcagtggccccctttcttcccctgagtctagcttgtcctggagaacccttcagtttcccaatattgtttcttctcaggttggacaagaagacgaggctgagagtgacatcttctctatcagggaagttagctttcagtccactggcgagtctgaatggaaggatactaattatacactcaacacagattccttggactgggtgagtgcttgataaggtgggggaaccttttgggccttggaaggaagggtcctagttcaaggggagaaaaaagcattttaatgttcattacagatttttttttaactagtaaatattgttctttgcaggccttatatgaccacctaatggatttccttgccgaccgaggggtggacaacacttttgcagatgagctggtggagctcagcacagccctggagcaccaggagtacattacttttcttgaagacctcaagagttttgtcaagagccagtagagcagacagatgctgaaagccatagtttcatggcaggctttggccagtgaacaaatcctactctgaagctagacatgtgctttgaaatgattatcatcctaatatcatgggggaaaaaataccaaatttaaattatatgttttgtgttctcatttattatcatttttttctgtacaaatctattatttctagatttttgtataacatgatagacataaaattggtttatctcctcc

SEQ ID NO: 37099 - DNA, 46171 bp, Homo sapiens
gcagtcagcagaggagagcgccaggacgctacagcggctgaagaggcagtggcgcccgcggccgcagcgtcggggctggagcgatggcggcgaccgcggtggcggcggctgtggcgggaaccgagtcggcccagggtcccccgggcccggcagcgtcgctggagctgtggctcagtgagtagcctggcaggccttcggcgcagccgctgcgccgcacgtgaggcctcgcttcccgcctcccggggccttgcttcggggcgggcggccgcaggggaggccggcggccgggtagggggcctgggcccggcgcggtggggaagatcgcccaggggtcccccgagaggagccccaagcatccgccggggcagcggcccccttctgagctctgcccctccccctccgcccaccccccaacttagcagcagcacaggaccccgacccccaccccaatggctacgtgacctgcgctttcccctgcgccaggcactgtgctcacagcggcttagtcctgcttaatcctcattcccaccccgagctggcttctattattaaccccactacggaagcggggaccttgaggcttaaggagacgcagtcgtgcaagacatgcagtctgtttggggctgagaaagatctctatctggctaccgcgtcaaaaagaaattttttaccttttgtgtttactttggccagacttttttttttaaacacacacacacgtgtgtgtgtgtgtgcgtatatatatatatgtgtgttttttttttcctttaagagacggggtctcattatgttaccctggttgggctcaaaccctttggccagaattcttctgcatgtctcctgtaagcttcacagtcatcttaggggttattattatctccgttttaccaatgagggattgaggttcaaaggggataaagaatattccccttgtacccagctctgctaggtgccaggaacactgagatgcataacacagggtccttgctcaccaaaacattttttagtgggtacaagccggcagtcacatcaccttactaacgggattggcgaggaggaggagggcgttcgtttcacctgtggtggtaggagttggtttacctgggggtcgtcacagccgaccgcattccaggcagaagaaactgcgtgtgcaaaagctggggacaagagaatgtggagcactccgggaacaagtaggtcagtccgctggagtgcaagcctaaagctcaggaatccgggaaaggggctgcacggctaattggggcgagatcttcaagagccttgtgtgctgcagaaaggagtttatgttttatccgagggcggggttgctgtttgggagttttcagccggagaatctgatcaaggaagcctgttaaaggcgtcacttgcagccatatggtgctaaattgggcggagagggtgagacttcaggcagggagagcggctaaaaagctcttttggtggtggttgggggccgcaggaggactaaggcagtggggagagggagaagcaatgagcaggcgtagtcagcagcctcggtgccttggaatgcagacaggggacaaggagaaatctaggctagatcgcgggtttcaggctcgaggaactggtgggttacagatgcctcccctgtgaggaggagctggtttaggcagagaaggttgagatgtggagtttgaggtgcttgtggcatagtcaaaaaagagatgccctctaggcagctggttggcactggagagggcaagtgtgggacgtacggtttgggagtctggttcattggcagtgagcttgcgggagaagcttgcgtatattaagagcagaggtttggaaagagagcgtggggagccccagcattgaagaggcagatgggaagagaagactgaaggctgagcagaaacaggcagggggagacctgcaggggcacccactgatagcaaaggagggatgtggttgtaacgtagttttgctccttaaagatggaggagaatgaggaaggagaagagagaactttgaatttggtaaccaaccagttatttaatgagacatccttgagttaaacagtagagacagaaggtagtagttttaggaggcaatggagaacagaaggcttagactggagttgcaaaaattagaaaaaaaggctgttcatgcctgtaatcgcagcactttgggaggctgaggtgggccaatcctttgaggccaggagtttaagaccagcctggccaacatggtgaaaccccgtctctactaaaatacaaaaaatagccatgtgtggtggcgcacacctgtaattccagctacttgggaggccgaggtgggaggatcacttgaacccttggggcagaggttgtggaggtggagccaagattgcaccgctgcactccagcctaggtgacaaggcgagattctgtctcaaaaaaaaaaaaaaaaagtagccggagtaagagaaagtagctgcctcaggtggaggagataaaaggagtgcctggaactgaggctgcccaaggacacagttcttcaactccagctttttttgaaacagagtctcactgtgtcacccaggctggagtgcagcggcatgatctcagctcactgcagcttacccctctcctgggctcaagcatttttcccacatcagcctccccagttctagctttttttaaatgtatttttatttatttatttatttatttttgagatggagtcttgctctgttgcccaggctggagtgcagtggtgccatctcggctctctgcaacctctgcctccttggttcaagcaattctcctgcctcagcctcccaagtagctgggattacgggcacacgccaccacaaccggctaatttgtgtgtgtgagagagagagagagagatggagtttcattcttgtccaggctggagtacagtggcacgatctcagctcactgcaacgtccgcctcccaggttcaagcaattctcctgcctcagcctcccaagtagctgggattacaggcattagccaccatgtctggctaatttttgtatttttagtagcgatagggtttcaccatgtttgtcaggctggtctcaaactcctgacctcaagttatctgccagtcttggcctcccgaagtgctgggattataggcatgagcctggcctaatttgtgttttattattatggtttttttcatggcatatacattgtattaagctccagcttttgggggcagtgtcccaaagttgctagatcttcctgtttttcaggaacggctagaacctatattcttaagtgaaatatcgtgggttttcagaagttggtgcctactttggcccataatttggggaaggccaggcagaataaatgtgtggggagggtgcagccagtggcctcctcagctgtttttcatgagtcttgaatgtagaaggagggggagagaatagcgagagggaatttaggagtaaaggagattattagaaggagagggggacatgtgagcccctcttcatgttgatgttccattggggaactgcccctcccccattctgggtccagtgtcccatccattgcagaggggcctgaaggtgctgaaggagctcagagccagagcaaaaagggggacctggcctcacagagaggaaggacaccttttgtttttctgactgtctggcgaaggagatcaagatgattgcacatgcaaacaagttcgtcagtgccaccattgccacctgagtattgggtgctcaagtggaacaggggacttgaggaaggtggggaagcgttggggagtggctggtgaggcaaaccgaagtgggcccacccggacggagagctgggtttctcaacctttgcacgagtgacatcttgggcccgataattctgtgttgtgggggctgacctgtgcactgtaggatgtttagtggcatccctgggctaaatccactggataccaaagctcacacccttcctcccagtcataacagccaaaaatgtcaccagatactgccatgtttccccagggttgagtgggatgggatcactcctacccatctccccgctgagttcctgagtgaggactgcagaatgctgactggacatcaggaatgtgggttgcagtcttcatggctgtatttgttgttgttttcttctgggagtaggagcagagaagatgaagtgaacgatgggttaagtcagatttgttggggatggtgggccattggtgctgcaatggagggataagggggtcgtgggattgatagtatggccaagacatgggtgtagttgaaggcaaaagctcatgggtctgagctacatgaagtcaccagggggtggtgtctgaggactggccaagatcaggtccctgcaaacaaggcagctgtatctttaagatgggaagagagtaataaaacctcttcttagggttgttgagagaatcaaaggctttaatacacagaaagcacttaaaatagtgccttactatgcttgtagtaagtgcccaagaagcgctagctattattatcattaggcttttatagctgcaagtaattgaaactaactcatacccatacccgcttaccaaaaaaaggaaagtaaagaaagtcccagagtaggggtaggctcagtccaggagctccacggttcacttctttgattgaattttctctgctttgctcttctccctactgcaatctcagcagaatttcttttccccattgatttgcaagagttattgttcttccgcctgttggcttgggttttatgtccaccttggagtcagcatgacctggggtcatgaaatatgaagatggccagacctggggtggggtggggtgggggacagtacccaacccagagccaaaggtggggagggtgaatgggggacctggaattgaggagaggggttgttcccagaggagtatcaggaagccgttaccagaatctcatgccttaaaagtacaaacggcagcgcctgtgcattctgtcattcagttctgtggtgtttttttccacttcatgtattttggtcattattccacatgactgcagatgtagccgccttgttcttttaaatgaaaagccttagacgccccgttgtatgggtgtcctaggatccatttaaccgggtccctgttggtagacatcttaggtgttgctagccttgcgctattaaaaacagcactcagtcctcttgggctctagaattctagctctggtagcgctaccagggaggccatggcttagtaaaagttgggtgctcagtaaatctgtttcttccttccacttggtcctactcccaggtgatgagtaggacattcccatgctgagtcttggaggttttcacatgtgctgaattgtatgattgccggactcttggggtccacgtgtccctcccagggaaggagtccccctgcagcgtggactgctgaaggattgcattctgctcctcggggtgaccacttcctcacagtcttggggctccccttgctagcacaggcggctgctggtgccagggtcatgaccccggtggttggttggcagctgacgtgggatggtttggcttctgaattagtcactcttggatgagccatttcactcacagccggaggtctcagctgttttcttaacacctctggccctgtagcacgcttgaaatgaatcatacaaacactgcttttagtgaggaaatacatggcagcagtgctatttctcagcacccctctgtcctgctcaagtgccagctataaataaaccaccttggagtctgggatagcccaaaacagagaaggcatcctttgaatttctccctggccgtgccctgtctggcccctagctagtccttggagcagattggtgtcaaacagacctacggcggttgctgtggcctggtcagacccagctgctggccccctgggggtcattttttggagctgctcaagtcttctgaaatagtttgtgcaggctgggattatgtgtttaggggcccagttatttcagaactgagatagccatctctccgtgttatcagtatgtccagccagctggccaaacactgtctagcaaaagaggaatcgttcattcagtagatacctgccagcaactcttctaggtactagagcctgtgagagtgaatgagacaggcctgctttttgccttcaaggagtttatgagcacgaagatcaagctggcttccaagagaggccctaactttgtcaaggaactgaagacctcaccgcaagagtggttagaaacacatccaggctgtggagctgggccagcctatgacttaatttttgtttctgccactcccttgctttgtggttgggtaggtttcttcatctgtaaaatggtgtagatgatcgtgccaacctggattgttctgaggacatctggcatggtatctgacccatagtaggtacttttttttttttttttgagacggagtttcactcttattacccaggctggagtgcaatggcacgatcttggctcaccgcaacctccgtctcccgggttcaagcaattctcctgctttagcctctcaagtagctgggactgcaggcatgcagcaccatacctggctaattttgtatttttagtagagacggggtttctccatgttggtcaggctggtcttgaactcccaacctcaggtgatccgcccaccttggcctcccaaaatgctgggattacaggcatgagccactacacccggccccatattaggtacttttaaaaatgacggttactgttacttttgagccatgataaatcttttttccccccataggaaaatccgttttccttttattcagtatgcagtggagctaaagtgcagggcacgaagtattttacacaacattttaagttcttgtgtataggttttcatggaaatttaaaaatttaacaatgatgggataatagataataaactcatcgtaagtacattatcactaggtttcagcaattcttattttgccatttattttcaactatcaatccaaatatcctagtagtgttttaaatcaaatataagatataatatcattaattttggaaacatttaagtaactatatcttacaagtaaagataaaaaagaaaatatcattattacaactaatacaatttttaatatataaaatagatcaatttgtgtattcaccaaagagtagactctacaaccactgaaggctttgcatgaaatgttttaacatgtttcatctaatatttcatcttcagacacaaaaaatcaatacatgaaaatattcaattacgtataaagggctatagactatggttggaggaggaaatcgcaaatcgacagtgggatattccaaaccactgtattgtgaaagcaaacacaagaaagaaaatagggattcctattgttcccgataaaaggaaaggaaaggtaactcccagagagccactccctcactttgccatattcaaatgttctgaacaaggcacaggtctggccatacccaaggaaagatgaggattcagggtgtaacaaaagacagcagagatcatggggcgtcttaggattctgcccccaatatccacccttccacaaaaacttaatctgacatctcacattggtggggatctggtgttcttgtaagaaaaaaagaaagtctcagaaagtgtttcccttgtagactctggggcagttgatcctcagcactttctattttggaagccagaaaattcctttttgactgagaaggggtgcagtcctgtgcaccataggattcccattgttgactgcatgtcagtgggagccaccagctattacaaccagaaatgtctgggcaaacttcctcaggatgcagaagctgctcccgtgagaaccgctgctcctctccatatgtgaacagactgacagatgcaggcagcaccagcaatctctttaaccactgaggtgcactggaaaatgtgagttgcagtgtgtccctgtgttagaattattaagaggcttttgttgacaattgctgagaccatacaatgcaccacagcaagattagctgggtaaatgatcttctgataaaggtttgaacccagatgttcctcttttgttgttttcctggaagtgggtaaattcagttttcacttcggtagctcccctaacaatcccaagaccaggtcttttactgcttccctaggtggcatgaccattatcggcctggggtaagatgaactgatttcatctcttcctttataatcatgacgtaggggcctcatttcacatgcacagattccctccaaagagtagatgagcaggcctgggccaccctggtgcttggagtaatgacagccttgccccgatgccactctctcttcccaccattgttgagttttgggccatcatgcattcagtgcctcagtgggcagagaaccatacccaggtgctctcacaaatctggagccaattctaaagttttttggactccagctcagctcagaccactgtcacatgctagggactgtgggtgactgtggacatcactggcacctgcttgagactgtgggtgattgtggactctgagcagggatgtgctgtgtccatgtgacactccttctccccaagagttgttcaagaaggtggtgccctaggaatgccatctggacccagtggaacaagaagggcagaaagcacctggcacccactgttcataccaccatcacccagttccttcaagtggctaacttgaagatgtttcctctcgatgaaaatcctaaacaacaaaaaaagaaaatcctaattttgttgtttctttcagcagaagtgatattttctagtctttacagttgagaagtttaggatcttataatgttaatttctctctttaagatggcattagtgcaccgaataccaatgaaattcatgctgacagccctttatagcagcggcatgttgatgcaagtctttgtattcacacggccatgacacagcctccagtttctgtgctttatctttgtgaggaaaactaaatagaaaatacaggtcacggtcatttgccaaggcacacaggtcgaagtaatatcttgcataaacactggcagacacatgaatattaaactcaagtagctccaaaaaacacttctccatcttgctcatgttctcaactgcaatgtccttgggattctggctgtcatccacactccacagaccatgatttctccaaaccttggaggcaagaagcatggctccaaggacaatctttttccaattagtaggacacagagcgatgctaccattagttaaaagtcgttcgatgtacaccaaagctacgattgcacatggagctgtagttttatgacttgaaaaagagtacagaaatgtctgaaagtacagttgtgtttgggatcatgctcgaaggatttccctggaaccttctcttgtgaaagtgggtgtattggcttgtcaaaaatagccagagatctatttgcgtatctgtgctttatgttgtaatatattgcccaagtcacactttctaatgtgtgtcaaagatcaggctggctgactgttctgttatctagcaatatggtgtaacacgaggtgtattttctatcaagatgccatggtatatataatataggtgagagctcctcttttcttgcacactcatttgatattttctcaaaaaaagcgtactttcccttggatggtcagaagcaaaatatttgggcatctcctggtcactgatgtgctgcaggtcatggcccttgcgggctcctaaatccgactgggcaggctccacagcagtggggtgtggcgctactgccacctccgcctgcgtgatgttatagctgcagggcggttccacccgccacaccctgcactggctttgcttggggctggcattggggagcagtatgttccatctgcgacgcctctgctcctctctgccttggcctgcacctttgcttgacgctgcctcatagatgtcagcactgcaggacagctccccaggccccgcacactgccccgcttggggctggcattgggcaacagcgtgttccatctgctgtgcctccactcctctctgccttggcctgcacctctgcttgccaccgcctcatagatgtcagagccacagtacagctccgcagacccccctgggccgaccctacctggggctggcattggtgctcaagcaacagctcagcatgttccccgtgaggcagctcggctcctggctcctctccggtagcttgggccttcccttgcttccaagtctgcagagctcagcacttatacctcttcccagcaaaggcacgctggcagggccagcccttggctgtggggctgctccccactagcagcccgcaccccacctcagctgcctcccctgagctgccttgtctacaagggtcccttgggaacctgtttggtttccttagaatgggtctagatacaacaagcctgagagctgtgattgcggagaagagagcacagagggagctcctcttccttccactgcttcccaccaactgaaggaggttgccctgccaaccaccagagctctctcctggttcccaggaaccaatctggcccagagtcccctccacatgccctgttcccatcgtgatgcgggagcctaggcacgtggttcaccaggccccgccctgccagcggccccacccctacctttcattcattgctggctgctgggagctttcaggtttctacactgtgaggaaggtcttatggtttcaacaaatgaagaggcttatgtaaaagaaaactgagccgggcacagtggctcacatctgtaatcctaacactttggggggccgaggcgggcggatcacgaggtcaggagatcgagaccatcctggctaacatggtgaaaccccgtccctactcgggatcttcccgcctcggcctctcaaagttctgggattaccaataaatcttgattgagtcctcatgatacaagctctagcaaataagaaagaaacctccttacattttgtggattgtattgctgcttggccttggttaagggtttggaacgtaatttaacctcagagaggttttttctttcttaaagaaagctggtgccggccgggtgtggtagctcacacctgtaatcccactactttgggaggctgaggtggacggatcacgaggtcagtagttcgagactagcctggccaatatagtgaaaccccatctctactgaaaatacaaaaaattagccagtcatgttggtgggcacctgtgatcctagctactctagaggctgaggccggagaatcgcttgaacccgggaggcggaggttgcagcgagccgagattgtgccgctgcacaccagcccgggtgacagagcgagactccatatcaaaaaaaaaaaaaaaaaggtggtgcccgtcagtgctgtgtctctttcacttggcagccagggaggagtgagaaggctctggattctgtgaggggagcttgggccatgcctcctgttctctgcctctcctgttctctccctgcctccccctgttctcttcctgcctctgctcttctctccctccaggtccagtcacatgctgaagtcagaattcttttgaggtgtcaaccttgaccttgtagtgaactgaaacagaagcttaaatggtgtagactttaggtgattcagacacataatcgctgagaatcactgctttaaataatttatttgatgagtttctatgttgtacgtatgggtaaggcactgtagggaagatatggcttctgcccttaaggtttcattctctttaggtaggacaagacatgtctacatattacagtaaaagccagagactgtacgtaataataaacaattatcctttgtagacctcttactgcatgctgctgtactaagcattttagacccttcccctttaaatcacatgacagtcccatgaggaaggtactattttccttgttttattttttgtaaacatatttgtagagatggggcctcactatgttgcccaggcttgtcacgaagtcctgggttcaggcgatcctcctaccttggcctccaaagtgctgggattacaggcatgagacactgtgcccagactgtttttattattatttttgagacggggtctcattttgtccccccaggctggagtgcagttgcacaatcatagctcactgtagcctccacctcctgggctcaagtgatgctcctgagtagctaggactgcaggtgtgtgccaccatgcctggctttttttttttttggagacagagtctcaccttgtcacccaggctggagtgcagtgtcacgatctcagctcactgcaacctctgcctcccgggttcaagcgattctcctgcctcaccctactgagtagctgggattatagatgcacgctgccacgcccagctaattatttgtattttggtagagacgggatttcaccgtgttgcccaggctggcctccaactcctgagttcaggcaatccaccctcctcggcctcccaaagtgctaggattaaggcatgagccactgcgcccagccttctgactaattttttttaaaaatttctgtggagattgggtctcgttatgttgctcaggctggtctcaacctcctaggctcaagcggtcctcctgccttggcttcccagagtgctgggatcataggcatgagctgcagcacctggccctattttctttattttatagttgaggaaactgaggctcagcgagtccaagtacatgtgactaatgggtgtagctggagatccctatcggagaaggggcagataaaatatctgttcagaggaggaggagacagcttttgttttatggggacgggagataaaaaggtcagagaagtctttagggtggaatgtgacttgggactcaagggtagataggattttaagatacggaacatgggagagagctttgcgggggtggggaggagaatataggaatcaatcactgatccttccctcgcccttgtgttctctcttcacttagaatggagtcagtgggcaggaagatggtgattacctgtccgttgaccctccctatctagacacatgacttccacgtgacataaatgtgactgcagtcaggaaaaattcaactcggactgtgctgtgttgagtaatcagagggagaagcagtggggttggcgcagcgggaggaagttttctgcaggagctggaaattcagatgggtctggaagaatatggatagggcactgagaggaacagagtggacactcgggccaggaggataataatgtcagaagtactgccccgagaagcaacgcctcatttccagagcctaaaagagctgctctgtcagaaccagtacggtttctcatcagagaggctgggcaggccaggaccagatggccagaggggagttggaagggtggttgttttttttttttgtttttgaggcaggatcttgctctcccacccaggttggagtgcagtggcatgatcttggctcactgcagccgcagtctttccacttcagcttcctgagtagctgtgactacagtcacatgccaccacgcccagctaattttttttttttttttttagatggagtctcgctctgttgcccaggctgagtacagtggtgccatctcagctcactgcaacctccacctcctgggttcaggcaattttcctgccttagccacctgagtagctgggattacaggaacactccaccacgcccagctaattttttgtatttttagtagacacagggtttcaccatgttggcaaggctggtctcaaactcctgaactcaagtgatctacctgcctcggcttcccaaagtgctgggattacaggcgtgagccatcgcgcctggtcttaattttttaaaattttagtaggcatgtgatttccccatgttgcccatgctggtctcaaactcctgggctcaagcgatgcacctcagccccatgaagtgctgggattacaggtgtgagccaccatgctgccactggaagttttatgaacggtcaagatggtattccttctggtggtgtgttcttgtcttcctgtcacacagctgagacacttccaggtggcctctcttctgtctccgcttgtcacaggccaggtgggggcatcccaactcgagtgtgaagccaacacccgggccaacctctgcactaaaagtggagccgctttcaggggaataacttgtcagttaatttttttttttttttttttttttttgagacagagtctccctctgtctcctgggctggagtgcagtggcgcaatcttggctcactgcaacctccacctcccaagttcaagcgattctcctgcctcagcctcccaagtagctgggattacaggcatggatcaccatgcctggctaatttttttgtatttttagtagagatggggtttcatcatgttggtcaggctagtctcaaacttctgacctcaaatgattccccccacctcggcctcccaaaatgccgggattacaggcatgagccactgtgcccagccagcttgttaatttgctggttcattcaatcagcaaatattcagtaagggcataccatgtgcccaatgctgtgctgggtggtggtaggcagcgcaggcacaattcctctccttccagctgtctgcccactggtctgatcctgtagatctgtgataagacagctcttggccaccatgtgtatggggaggggtgtaaatttcttcctattatgtactctctaactttattatttatttgacagacaaagccacagacccaagcatgtcggaacaggattggtcagctatccagaatttctgtgagcaggtgaacactgaccccaatgggtaaggtaacttctcacacacatagttgactctgggggcaccccacactgagtgtaggcctttgtctctcaagactgttttagggttaagctctctaggcaaggatcggtggctcatgcctataatcccaacagtttgggagaccaaggcaggaggattgcttgagcccaggagtttgagacctgcctgggtgacagagtgagagactctgtctcaaaaaaatagaaatgcagtcaggctggcattcattctctcattttcccctataatcctgagaacattatttttctaaaattagcaaattcatgtgggggaaaaaaaacacaggatagctcacttgcaactggcagttattaattttaaatactgttataaaacactaatgctgaggagaactctgaatgttactgatagactatagacacgttacctaattaaaagagatctgtgtattctccaccatttaaatgtaattttaagaaaaaggaaaaggggaaggttttattgaattctgtttccacagcatctggataggacctgaagaatcagaatcaagtgagtcatccagatgttttgtttttgttttgttttcttttcttttctttttttttttttcctgagacagagtgtctcaagactggagtgcaagggcacgatctcagctcactgcaacctccacctcccgggttcaagtggttctcctgcctcagcctcccaagtagctgggattacaggcgcgtgcctccatgcctggctaattttttgtatttttttagtagagatggggcttcaccatgttggccaggctggtctcgaactcctgacctcaggtgatccacctgccctgacctcccaaagtgctgggattacaggcgtgagccactgtgcctggcccatccagatgtttaatctgtgtggtgtcgcatatttggccagtttgaacccagagtttgatcgcactttctgctctagcatttcctaggtatttatcacagccatacagggcctgtgctgctgtggctactcatgggactgggctgggactggcagcttggagtttgggggctgggggttggctgaggggagggcagtgtgccctgggcaggaggaggaccttgggtgctgtaggtgcaaccagggtgggtgcgaggtggccctctccagggcccccgcgtggcctgtttgtcaggcacgctccacctctgcttttggacaccagcccctggaagaaaagtgattttactgagcatgctcagccactcgggttagtttctttttgcccgcccagagtctaggtctttttgtttccctgtagccccacacatgcgccctggctactggcccacaagatccagtctccgcaagagaaggaagctctttatgccttaacggtgagtttggcttgccttgtagcctaacctttcctgtccttgtgctatagagagccgagaggcgctttgcttccacacagatccttttcactggagaagggaggtcccctgagaggtttaccttcacagcaggttggaggagggagatctgggccagggtccccacccttcttcctcctgtttctcgtctgtttcttcagggcagcattgagtctactgtgggagaaggaaaggaaggttttatttcatttgcccttcttagaccagggctggcaagttcatgtgccttttctagagagggcagttctagcacagggcccactagctgttggcaggtatgagtatgggctcagggttgctagtttaggtctttgtatatgtttgagtgtttagatgttggtgactaatttgcagtgttgaaagccacagtatggacgagaggaggggtctgcaggctcagcttgcctcttgagtgccagtgggtgacatccggctggtcttgggcactggataccagatctctgcctctggggaggggttggttctttagccactttctcctctcaaagggtctccttaaaaggtggggtgacctcagggtttgacatacctcactaagctatttcctgggcataaacctcaggcagttatagcaagattgaacaggggacatttttttcttgatctgaaaacgtcctcttcatcaaaacttcagtgtcctcataggcttgaggcagggttagccttggttccagcgcagtctccagcaagtgattaccagcctggaggggagcctgggaccactggctttccaccttctcctgggggtcctgtgtctgtgcaggtgctggagatgtgcatgaaccactgtggggagaagttccacagcgaggtggccaaatttcgtttcctgaacgaactgatcaaagtgttgtccccaaaggtgagtacctgggcttggctctgctgactgtgtcgcacctacgcccactgtcaaactcctggctccctcctcaggccagaggcaggcccacgcatggacaaaacctgctcctgcctgtgaaagaagcgctctcctctccaagctctaggaagaggctctgctcattagctgacccctgcccctcactgttagcattttcacatttcccttttaagaaggcctggggaacgtgtggcctagaggagatgaggaactccagcttggaggcacaggttcctgatagagacagtgagagatcccaggggtggcgtgaaagtttcctatcacctcctgccttgtcctctgtacctgtcctcctggcacctgtcttagctcagccagtctcaggtaaccaacattgagccctgccttgttgtgttcccacaacagtgccgatgctggccatgggtcctacagttcatttcagttctgacactcccctgagttgcatgctacccggaccccacgcagtgagggctcagtgctgcttaggcttcctgtgtttcagctgccagccgtgagtctcatgtgtcctcaagctgctgcacttctgcatccccagctgcagattcaggggttcctatgacccccaccgccccatattccataattccctagaatgattcacgtacacaggaaagcactatactttctatccctgttttattgtaaaggatacaaatggaagcgatacataggcaaggtcttggtggggcaagaggggacagagctgctgtgccctcccctggactctgagcttgccatcctcccaacgtaggttcaactgagaggctctctgagcttccttgtttcagtgttttcatctgaggtttttttgttttgttttgtttttttacacatcattgctggcttgaactagcactaggttttattacctaggcatgatcggtcaaatcattggccacatagttgaactcaatctctagttcacacccccctgcccgccccaccacctccacaggtggggggatgtgggggcaccggtcaggggatggggctgaaagtttcagccctctgatcacaaggttgatctctttggagtggccagcccttgaagctctctaggcactcactgtaagtcattagtgaaaactcaggtgcaccctgcgagtgtgtctcttgaataacaagacactcttgtgactcaggaaattccaaggatttttgaagttctgtgccaggaacggaaacaaagaccaaattttattattatattcttgtccaaggcaaaaaatgactgtccccagtggtgtagaacaggctctgacccaggctcttgcatggtggggtttagtgtgagtattgccgagatgaattccttgaatcccaggaagggctccggggctgggcgccagatggtgtggcctctagtctctcctcacactcataccgcgcctgggagcttgtgtctctgggcctcagcagctacctctttagttaaagtgtcggtctcccaagtcccttccagctctagaattctctttcctttttactttcagtacctggggtcctgggccacaggaaaagttaaaggaagagtcattgaaatactcttcagttggacagtctggtttccggaagacatcaagattcgagacgcttatcagatgctgaagaaacaaggtctgacttgccttactgtgtcttatttcctcttgactaggcctgtatcttcttgctttttcatctgccttataattttttgttgaaagctgtacttcttatgtaggaccatagacactgaggtagagttttttttttttttttttacgcaataaatcttttatctacttacctttaaaagccatagtgcaaacctggaaagatgatgtagggtttgcttttttccctgttgcctggaaatcataggaaaccacagcatgaaaaaggtcaaaatacaagctacctatgtcactaaagcacttatttatcttttaaaagacttgtttgcctaaaaactaaccttttggtttttttttttttttttttttttgagacaaggtgttgccctgttacctaggctggagcacagtggtgcagtcatggctcactgtagcctcgaccttctggactccagccattttcctgcctcagtctcccaagcagctgggactacaggcgtgtgccaccatacccaactaattttttcatttattattattctcccacccacaccccaacacacacacacaaacacacacactctcttcctctctctctgtctctgtctcacttgctgtctcacttacaccaaatatttgtattttttgtagagacagggtcttgcaatgttacccacgctggtctcaaactactgggctcaaatgatcctcccacagcctcccaggcgtgagccaccatgcccatctttaacctcttttcctgaaatagtggaaccttactatgaagtacagataaatgctacctatgagctagagtttgaaaaatactattgtgataaaagtaacaacgtgcagacataaaatattttatagttacaaaagatctttcagtaatcatttagtggatttatttttatttacttcttttttttttttttcttttgagacagagtctcactctgttgcccaggctggagtgcagtggggcgatctctgttcactgcaacctccgcctcctgggttcaagtaattcttgtgcctcagcttctcgagtagctgggattacaggcacctgccaccatgcctggctaatttttgtatttttagtagagatggggtttcaccacattgctcaggctggtctcaaactcccaacctcaaatgatccgcctgcctcagcctcccaaagtgctggaattacaggcgtgagccaccgctcccggctgtggatttatttttaattgacacatacttatacacatttattggagtacaatgtgatattttggtacatgcatacaatgtgtagtgatcaaatcagggtaattggcatatccatcagtgaggtaaggagtttttaatccctggaattgggtagagctttccttttggtagacaggatttgagctgggtgtgagatttgttgttgctgtagttactatatcagacttcagattcctctagtgttagctgatgtttaggttgggggctagctagtttgttagttttcttcagtatctgttctctcagctgtaggtcttcactttcctctgcacctcagagagagcctttctccttgttcttgccactcgtagcagtagacagccatcccttgtcagagggatagggtggcgggcagggccagtctctgttctgattcagcctggttcttaggcaggcactgcatcctgggtcttggtaggatctgtttgtgatcctgcctcaccccagtgtagatctgggcccaggacataattcctgctcctcctccaagggtactagggtttgtttttgttttttctcccctgttttttctctagctgcagtgggttccaccggtgctctaaggctgcagggtttgttactcttctccccctaatcccgccttcaggccttcccgctgttttcgtgagcctctggagaagagcttattttctttttgttgcagcctccagaaattctgtattctcttggtagctcacactggcctgtagacaatttttaaataattctagcttagttgttactattggtattgccttttgtcaatccttggaggttgtttttttccttagatttcaggttacttggttgttgccctgtgatctgggctctctgatgtattcagggaagctgtaggctgggcatggtggctcacgcctgtgatcccagcactttgggagtttgaggtgaggaatcacttgaggccaggagtttgagaccagcctgggcaacatagcgagacccccatctctacaaaaaattttttaaaaaaattacctgggtgtggtggtgcccacctgtagtcccagctacttgggaggccaaggtgagaggactgcttgaccttaggagtttgaggctgcagcgagccatgatcacaccactgcattctagcctgggagacagagcaagaatctgtctcaaaaacaacaaaaatattgtgaatttgcacactttccagtgttttgttgttgtcacgatgggggtgatagttcccacctttgtgtgtcctgtttggaagatgggaatctgaattcctttttatgttgggctcttaaaagaaggaactcaggttcaggatggactgttgttccctgtcacatacactcagcattttcaggagcttcatcagggaccctccagaaacttttgatccctgggaggttatgtagctggataaactgatccatgcttttacagcataaggcccacagactgcaggccttcaggactggctcttctctgacatagttggctctgctgtcccggccaccatggtcccttggattctcctaagagatgatgcaaaacttcgttcatacactgggtgttgtctttgaaggctgttgacagtgctttgctagcatggtattaggaaccaggggtttccagactttatactggattctgactgaagtttctgggtaccatatcggtgtcttaactttgtaaattgcatttttaggaattataaaacaagaccctaaactaccagtggataaaatcttacccccaccatctccctggcccaagagctccatctttgatgctgatgaagaaaagtccaaggtaaggaaacagacctacatggtgtctgatcagaccttttctcttaggcactgtaaatgccctttgatgcttgaatcggagtatggaggggggcaggttacatgggttctcctctccagacaggcccttaggagtgaggtagcagaaggtttgggtgcgttcttcatggataagtcaactaataagggccagtctgttttgattcagcctggttcttaggcagacactgcatcctgggtcttggtaggatctgtttgtgatcctgccttaccccagtgtagatctgggcccaggacataattcctgctcctccttcaagggtactttgtgccctctcccttttgtgcacagccttcctgggggaaagaaggtgcagaaggatagcccgtggggagtgtgggtgatggatgggtcatgtcctgtgtgggtgtggtgttggggtggggacagtggaagaacttgctgctgtgtgttgcttcagctctttctcagtgccagtgagcccggccctatccattttccatccaccatgaactccccaaaccgttattccttggacatcagtatctagagggacaagaagaagaaggtggccaagacccagggataactgtggtgcctgtgagtggggagccctttggcctagtgctggcggtgcttttggtcatgactgttcttggtcagtcacaaggtctagttcatggagtgttggaaggctacacgctgcgtactcgtttctgcgtggtatgctctgcctgtcaactgcaccctctccctgtacccactccttgggcctagatactctgtggccatcaggtccctgttgttagaatgagcaaggctagtctaggttccaggccacctttctccgctttcctcctgcttggtgccttaggtttgcagagggtgggaggagctaggaaggaggtatggtgtgacttctgagaaacaatcctgtgtcaccagccctcattatccccacttttcctgccatccgtcccacaaagattgagtgacttctctgtgccaggcatcctgctgggcgctggaaatgaagggatgaacaagatcaccagggtctgttgtgtcataaagcacatggtccagggcaactgcagacctagtccccttttgggccagagaattctctgttgttggggactgtcctgtgcactgtaggatgttcacagcattcctcactctacccacgagctgccagtagcaccccctctctagttgtgacaaccaaatttctccagacttagccagacatcccctgggagaagtaacccccacatccccctaccccactgaaaaccagtggcaggccaggcacgctggcttacgcctgtaatcccagcattttgggaggccgaggtgggtggatcacgaggtcaagagattgagaccatcctggccaacatggtgaaaccctgtctctactaaaaacacaaaaattagctgggcatggtggcacgcgcctatagtcccagctacttgggaggctggggcaggagaattgcttgaacccgggaggcagaggttgcagtgagtcgagattgcgccactgcactccagcctggcaacagagcaagaccccgtctcaaaaaaaaaaaaaaaacaacagaaaagaaaaccagtggtgtattgggatagtcagagtgcctgcatcgtagtgtccttggaccatttggtgagatggtgcatgtaaaatgtgtgcactgttgttagtgttaactcttctgttgctgctgcttctgctctaggcctgagggagttgtggtctcacctactcttcctgttcactctctgcagcttctgacaaggcttctaaagagcaaccaccccgaggaccttcaggctgcaaaccggttaatcaagaatttggtcaaggaggtgggcattcttccagttggttcagtagaagtagcatttgacagaggctgaaggacagtgcatatgagcctatgcttgaggggtagaggaacggttgcctgggagaaagagtggctcctagccctgaactctggggaacagccatagtctccctcaagggcagcaaggtggtgattggaaccagaaatcccgctgccgtacttctcagctgctttcatccatgctgctcaaagcatttcctagacaccagcttgggtcccagcaacaggtattggtatggacaaagtccaggtttaggaatctgcttttcagaggacttgaggctggtggcacaaaggcagaggtcatggtcaccagtccccaaactgcattttcctccccaggaactctgggcttttgagtattttttcacccactgtgtgagttctcccatgcacttaacatcctggtgatgcccctgagcgagctctctcaatagtgactctttcccatcccttgttcaggcttcagccagggtttctgctccctcactcccatcctcctctttttcccaaaaggaacaagaaaaatcggagaaggtgtccaagagggtcagtgcggtggaggaagtgcgaagccatgtgaaggtgctgcaggagatgctgagcatgtaccgcaggccagggcaggccccgcccgaccaggaggccctgcaggtaatacaggtgtaacacagggggctgcacatgtttactaaagtgggtttgaaatgctttcacctgtttgcacccatgaagccatctcagagtcaagacggtaaacatatctgacacctccccaaatgtcgttgtgctgctttgtcctccctttgtctgtcccttgctccccagtccccaggcagctgctaatttgctttctgttctgattggctgacaactcccagactcttgtataaatggaatgatgcagtacataaccctctatttttgcctggtttctggatctcactcgagatccattcacgttgctgtgtgtagcagtagcttgtttcttattgccgggtactgtcccgtcacctggatgtaccacagcatgtacctgttgatgggccttgcgttgtttccagctttgggtgattgtgaatcatgctactgtaaacaattttgtacgggattttgtgtgaacatcgattttcatttcttatgggtaaatgtctgggattactaggtcatatgctaagtatatatttaacttgttaggaaacaaagtggctaagctatcttcaagggtgattgcaccattttacagtcctaacagcagcatatgcaagttctagctcctccacatcttgagatcttggtttttatatagcatctttatgagataattaacataccataaaagcaaccatcacacctacctagttatagaatatcttaatcacccctaaaagaaaccttgtacccattaacagtcattccccctttcccaaactcccctttccccagtccctggcaaccactaatccactttctgtctctctggatttgcttatttggatgcttcgtccaaatgcggttgcacaatacgtgggctttcgtgtctggcttcctttacgtagcctaatgtttgcaggtgcatccatctggtaatgtgtcactgcttcattccttttcatggctggatagcgttccattgtgtggctatgccacagtttgtttctccatttatcagctgatgggcatttgggttgttcctactttttggctattatgaatgatgcctttgaattattcattacgaataatgactttgaactttgtccaagtttttatgtgaacataggttttaaattctcttgggtatatacctagaaatggaattgctggatcttggggtaactccatatttaacattttgaggaactgccaagctgttttccaaagtggccatgccattttacattcccagcagcaatgtattggctccagttctctgcatcctgccaacatttgctgttatctttttgattggagtcctcctggagggtgtgaagtactgtctcattgcaactttctgtttcttgatggcttatttatttcctatgctcattggcagcttgtgcatcttagaagacatgtctgtgcaaatccattgcccatcttttggattgtcttttttgagttacaagcgttttttatatattctggatacaggttccttatcagacagttttctcccttcctttgggctgtcttttcactattttgatagcatcttttgaagcgggagttttgttttgttttgttttttgagacaaggtctcgctctgtcgcccaggctggagtgcaattgcgtgatctcagctccgcacgacttctgcctcccgggttcgagcgattctcctgcctcagcctcccgaggagctgggattacaggaatgtgccagcacgcctggctaattctgtatttttttttttttttaagtagagacagggtttctctatgttggttaggctggtctcgaactcctgacctcaggtgatccacccgtctcagcctcccaaagtgctgggattacaggtgtgagccactgtgcctggccagtagagacagggtttcaccatgttggccaggctggtcttgaaccctggcctgaggtgatccacctgccttggcctcctgaagtgctgggattacaggcatgagccaccatgcctggcctttttttttttttaatgtcttcctggtgcttttgttatcacatctaagaaaccacagcccagccgggcgcagtggctcatgcctgtaatcccagcactttgggaggccgaggcaggcggatgacctgagttcaggagttcaagaccagcctgaccaacatggagaaaccccatctctactaaaaatacagtatcagccgggcgtggtggcgcatgcctgtaatcccggctactcaggaggctgaggcaggaagaatcatttgaacccaggaggcggaggttgcggtgagctgagatcacaccattgcactccagcctgggcaacaacagtgaaactctgtctcaaaaaaaaaccaaaaaaacaaacaatcaaaaagaaaccacagcctgtctgtgccaggttcgaggcagccatgctgttggtctcccttggaactctgttctccacctccttctgcaggtctgtttcagccatctccctctgcattccagttttttatgtctctctgcacaggaggagagccagcctccacgtaacttctttatttacctgtccttccacttcacaagattagtagaaatgaactactgtctttccaaattcctaagagaaagcctcccgagtagctgggattacaggcacccactaacttttgtatttttagtagagacagggtttcaccatgttggccaggctggtcttgaactcctgacttcaggtgatcagcccaccttggtctcctaaagtgctgggattacagacgtgagccaccctgcccggtcagattattttattttcagaaatcatacacttgtagcctgtagtctttttctgaaactctgtcatgttacttcaaaactgcagtctctaagtcaggaccattgggaggccttctgaagccccagactctgccgtctgcctgatcgaaggctcctggggccctggaggggggcgttatggggtgcctgggcgtgtgtcatgaaccaagctctgctctttcaggtcgtgtatgagaggtgtgaaaagctgcggcccacgctgttccggttggcgagtgacaccactgatgacgatgatgcactcggtaagttttctttccttgggtgtagctagcagcccaggtgcaagacagactcggtccctcctgtcacactgctgtgccaggaacaagacagagtggactttcggttccgtggagcttgggcttggggagggtgtggcctgagttgcctcagaactgacttccagcaggatccaggcttcagtaagaaatcagcagcaggtctaaagcctgaaaagaagtggaaattgaccatggagattggggtgtgagaggtagaagaaagatcccactggaggcttcaggaaaagctgaccaatcgcaggggccagagaaacagctgtgggtggtgtctcaaggggatcacgggcttttgtaccttcaggggccaggtaggtcaactaagagggccaggccgatgggaaatggaaggtacatctgtaaggaagtggagaattgtccacagttactaaaaaagaattttaactctttattgtggaaaatctcgaaacatgagagaggggaatagtaaaacctatatattcttcactcatctttaataattaccagctcatagctgatttttttaatcttacttcatctgtacctctctttgtacacacccattccctagtctgttttgaagcaaattctagacatttctttttcttttaattattttggagatggagtctcgctctgtcgtccaggttagagtgcagttgtgcagtcttggctcactgcaacctctacctccctggttcaagccattctccttcctcagcctcccaagtagctgggattataggcacccaccatcacgcctggctaattttgtatttttgtaagatgacatttcaccattttggccaggctggtttcaaacttctggcctctagtgatccgtctgcctcggcttcccaaagtgctgggattacaggcgtgagccacgatccccggcctctggacatttcagaataatcaaagattcagtcagtgttcagattgccctgataaaatttctccttaatcatctcttgctaacttaaaaaaaaaaaattgttctaaatcagacataaaagaaaagccatataattggtttatatttcttctgtctctcttagtggatagcatgtgcatgccctctgcaatcctttttccttttttttgagacagtctcactctgttgctcaggctggagtccagtggcgtgctcagctcactgtagcctctacagcctttacatcctgtgttcaagcgattctcatgcctcagcctcctgagtagctgggactacagttgcgcaccaccacacctggctaatttttgtacttttagtagagatggagttttgccatgttggccaggctggtctcaaactcctgggctcaagtgatttgcccgccttggcttcccaaagtgctgggattacaggcgtgaaccaccacacacagccttttttccttgcatgaaaataggccctctgaattgacagttctctcggtctcagttttgctcgtggcatcccccatgatgctgctcatgttctgtttctgatatttctttttttcttgagatggagtttcgctcttgctgccccggctggagtgcaatggtgcgatctcagctcgctgcaacctccgtctcctgggtttaagcaattctcccacctcagcctcccgaatagctgggattacaggcacctgccacggctgattttttgtatttttagtagaaactgggtttcaccattttgaccaggatagtctcgaactcctgacctcaggtgatccacccgcctcggcctcccaaaatgctgggattataggcatgagccactgcacagagccagcagcttcagattctgagttaaagttaaaagtttgttattgaaagggccttaatttgagtgcttactgctggccattactctggacagtacaggtgtagaaggtgaacagatttgcttccttctgcattgagaactactaacatgttaggactcaggttaactgactaggcctgatagggtccgatgacacaacctggaggcaggaggtgtggataaactgaacatagtctagccatatgaaggctgttttatggaaaagcttagaaaagactgagattgttggttgccaaaccagggggttctgagtcttccctcattcttcagcggaaattctccaggcaaatgacctcctcacccaaggagttctgctgtacaaacaggtgatggagggccgggtcacctttggaaacagagtgaccagctcattgggagacatccctgtctccagaggtatgtttgaaagcttctccttgccttctctgccttggggcagcctgtaattcccagaaaagaaatgggtcctaaacatattctgggttaaggaatagaaatgagagaactcgccctttgttccccttcctgtgaaagtggatatgttgccacacccagccataggaattgtcatgagctggttgccgggctggaccccagctttgactacacacaaaagcagatggctaagctgtgcctgcgtttgaattctcataaatgcttgcatacaggagctagagacaaaagaaatgatcttccttagtggttcctagtgccaggtcagctgtatcagaatcacctggagcactggttgaaatgcggtccctggcttggaccttctgaatcaagactgcttggagctgggcctggaggtgtgcgtctttcaagcactgtgggtgattctaatcagctgtggtcagaagcctcagaatggcctgagctggagaaggccgaatctgctttcctccagagtgatgggatctttgcaggagggcctatgatccctggggtaggaaggcaggccttggctccctcttgtcttggatgccagctgagcttgtgtgtcaggacactcagctgagtggaaggttcttggaagggcagggagggcgttaccatttgattaggaggtggtctgagggaagctgataggatttatgtggagactttgctctcatgtccaactgacttctcttcctaaccctgggctttctagtctttcagaatccagcaggctgcatgaagacctgccccctgattgacttggaggtggacaatggacctgcgcagatggggactgtggtgccatctttgcttcatcaggacctggcagccttgggtgagggcaggtgcttgtggggagcaggcacaggatgggtgcgagtaggggagtgagctggttcccttcgcggagcacatgcctgctgctgagggagtcgagatggttgtgaataggaagagtgagctggttccctctgggagcacgtgcttgctgctgagggagtcaggatgggtgtgagtaggggagtgagctggtccccttgggaagcacgtgtctgctgctgagcaagtcagggagagtgtgagtaggggagtgagctggaccctcggagaacacgtgtctgctgctgagggagcacatacctgctgctgagggaatcagggtggttgtgagtaggagagtgagctggaccctcagggagcacatgcctgctgctgagggaatcgggatgggtgtgagtaggggagtgagctggttccctctgggagcaagtgcctgctgctgagagaatcagcagggttctgagtaggggagtgagctggtctcctcaggaagcacatgcctgctgctgagggaatcagggtggttttgagtaggggagtgagctggtcccctcaggaagcacatacctgctgctgaggcaatcagggtggttgtgagtaggagagtgagctggttcccttggggagcacatacctgctgccaagggaatcaggtgttctgggcagttcagagggtcccccttgcatattagtcacagattggccatggacgagtcacatgaccttcagtaagttgcttatttgtctagactttctggatgtcctagaaaggatgggtgtggcattactcttcatctggaagcaggtggagttactgttaggcatctcactctactcctttcttacaggaatcagtgatgctcctgttacaggcatggtaaggatgcccttcccagggcccggagagagaatgggagggtctcagacctgcccttgtgaggcagcactgcctggcgagcagagaggtgctcctgcactgtcccggtgggatcatggccttggaggtccaaagcctcttcctcacccatactgtctggctgatacctgggggagacaggttgcaccaggctcctgcttcctggaggtctgcccaggagctgcatgtgatcttgccctttctttcccctcttgccccaagagatgtcaccagtctgggccacagcagcttgggtgggctcaggagagctgtgccttggttttactgtggctgatggtcattcataccctggtcttattttagccattcctgatttgacaggtttctggtcagaattgctgtgaggaaaagaggaatccctcctccagcacgctgccaggcggtggtgttcagaacccttctgcagacaggaatttgctggacctcctctcagcacagccagctccgtgccctctgtgagtcttctgggcaaggggagtgggagagtgtggctcctgagtgcggttccttctcatgggacaagggccagagaatggtgctctaagacagcctctcgccctggagaaacatctttctttctttcttttttttttttttgtctttttttcttttttttttttttttgagacggggtctcactctgttgcccaggctagagtgcagtggcacaatctcggctcactacagcctttacctcctgagttcaagcgattctcctgcctcagcctcccaagtagctgggattacaggcacgcgccaccatgcccagctaattttttttttttaatttttagtagagacggggtttcaccatgttggccaggctggtctcaaactcctgacctcaggtgatccgtctgcctggccaagaaacatctttctattgaaagtttaggccaggtgcagtggctcatgccttgtacttgttttcacactgctgataaagacatacccaagactgtgtaatttaaaaacaaaaagaggtttaatggactcatagttccatgtggctggggaggcctcccagtcatggcggaaggcaaaaggcatgtgtttttgtttgtttgtttgtttttgagatggagtctcgctctgtcgccctgggtggagtgcagtggcgcgatctcagctcactgcaacctctgcctcccaggttcaagcgattcttttgcctcagcctcctgagtagctgggattacaggcgtgtgccaccacacccggttaattttttgtatttttttttagtagagatggggtttcactgtgttagccaggattgtctcgatctcttgacctcatgatccgtctgcctcagcctcccaaagtgctgggattacaggcatgagccaccacactcagccaaaaggcgtgtcttatgtggcagcagacgagagaatgagagccaaacgaaaaagggtttccccttataaaaccatcaggtctcatgagacttactaccgtgagaacagtatggggaaactgcacccatgattcagttatctcttactgggtccctgctacaacatgtgggaattgtgggtgctacaattcaagatgagatttgggtggggacacagccaaaccatatcatacctgtaatcccagaactttgggaggccaaggcaggtggatcgcttgagccctggagttcaagaccagcctgggagatatggcaaaaccccatctctacaaaaaatactaaaattagccaggcgtggtaggtcatgactgtagtcccagctgctcaggaggctgaggtagaaggatcacttgagcccggaaagtcgaggctgcagtgagccattactatgccactgcattccagcctgggcagcagagtgagaccctgtctcaaaaaaagtttaatgtgctgcttcccttttctcattttacttcttttcctaagtcgtaggaaaatacctgctttggccaagacatctgaaaagaggtttatttaaggactaggagtagtagaacatgaggtttttgccgtttgtttttgttttcccttctaataaccatataattgaagttaagcaaaatttgatccatggagaaacatacaacaaagtgcaaagtgccactccctaaaaacaaggttgaacgttccttttttgctttttttgtatacatgtagtggtacattcctgtgtcttgttacacaaacaggattttaatttataaaccgcactccagcatgaccttttcatattatatctgtgatgcatttcatatcagtttctataaatatgcctcagtcttaatagctacattacaatttattgcatggatgtatttgatcatttcccttttttggacatttacataatttctggtttggaggtgcttgggggagtgccttatagtatagatccctgaagggagaggttctctaaggtgtgaatgtaacaacattttcatagatcctgtccctttgcctctggaaaagtgcagcttaccttcacccaaacagcctgaaagtgcccatgttcctgatagaaaccaccaggctcaggcagaagtgggatgtcctgggagttcattcccatttgccacccagaggtcatttcttgcagtcttctttttttcagccactcgggcagggtgggttatttctcctctcaggactttagttttctaaaatgttttcagtttgtgtcccaaatgaacaaaatcatggagtggatagtagctggtataatttgtgtatcatctgcctggctcaagtccctttgtgatcacacctgggaaacaacctgactgagctacttattgtcagggactgcccgacaggtacaacatgaacaaccttcataacaaaggctctaggttattgggttcttattatgtgtggacattttaagtgcttttgtttttttcttttttttttcctgagatggagtctcactctgttgcccaggctggagtgcagtagtgtgatctcggctcaccacaacctccgcctcccaggctctagccattctcctgcctcagcctcctgagtagctggtattacaagcgtgtgccaccaccacctggctaattttttattttttatttttttttaatttttgtatttttagtagagatggggtttcaccatgtcggccgggctggtcttgaactcctgacctcaaatgatccacctgcctcggcctcccaaaatgctgggattacaggcgtgagccaccgtgcccagcctctaagtgcttttcatacatcgtctcatttgattcttacagtagccctaggaggtaaattacttctgttattcccatttaacagatgaggaagctgaggtatgagttcgattacttgacaaaagtcatataacatctggcgcattagctcacgcctgtaatcccagcactttgggaggccgaggcggacggatcacctgaggtcaagagtttgagaccagcgcggccaacgtggtgaaaccctgtctctaataaaaatacaaaaattagtcggacatggtggcaggtgcctgtaatcccagctactcgggaggctgagtcaggagaatcgcttgagcctgggaggcagaggttgcagtgagccgagactgttcgattgcactccagcctgggcaacagagcgagatactgtatcaaaaaaaaaaaaaaaaaaggcatataacatctaactctgtgtgtgtgtgtgtgttattttttccttgttctttaataagcctaacccagattccaggaaatcgctacaatttttgctagtctttgatattttttatttctttgtaggaattatgtttcgcagaaaagtgtccccaaggaagtgccaccaggtactaagtcctctccaggttggtcctgggaggctggcccgttggctccttccccatcttcacagaatacacctctggctcaagtgtttgtccctttggagtctgttaagcccagtaagtacaatttcactccccacctttttttttttttccctgggaatctattagactcccagctttttccactccagtttgatagaggtggcccttaaatttggttgataaatgggagagattttgcatgagggcagaaagtaagaggttgtggccaggtatggtgactcacgcctgtaatcccagcactttgggaggctgaggtgggaggatcacttgaggccaggagtttgagaccagcctgggcgacatagccttgtctctatttgggggggaagaaaaaaattgggaggccaaggcaggtgatcacttgaggccaggagttccagaccagcctggccaacataacgaagccctctctctacaaaaaatacaaacattagctggacatggtggtgcatgcctgtaatcccagctacttgggaggctgaggcaggagaactgcttgaatccaggaggtggaggttgcagtgagccaagatcatgccaccacactctagcctgggtgacaaagtgagactccgtctccaaaaaaaaaaaaagtttgcttctttgtcttttagctgatttcttagccttccttagtattgacactgtcaaggatatgggcaggcagaatttaattaaaaggcttacttaggcacataatgttcgttgatttgggttgggattcaagaagggaatgtttaatgtggcctgaaatgactggcaagaggtagaattcaaacgagtggatgaatttggctagtgatcctccttctctagggatcctccttaaggcagaaaagtggatattatctctgttaaaagggaaggaaatggaaggctcggctaattaaggtgcctaccgtctctacaccagtatgcagagcaggacacaactcaggtcgtctgttccagggcctggactctttagcacagagccctcctatggctctttgtggtgaggttagattgcagagagccctgaaagccaggcagacaaatttataaataaacagagttgataaacaatgggagctctttgcacatttctttattgatttttgatttaagaaataatacatgttcaatgttaattttctgaattcaataactgtattgtagttacgatgttaacatctggggaagctacatgaagggtatatagaaatttttgtattagttttataactttttataagtctgaaattattacaaaacaaactttaaaaaataaaaaagttaaaaacaaaaatacatgttcaaaatgtagagttttattaaagatagaataggccagacgcagtggctcatgcctgtaatcccagcactttgggaggccaaggtgggcagatcacttgaggtcaggagttcgagaccagcctggccaacatggtgaaaccctaaaaatataaaaattagctgggtgtggtaatgtacacctgtaatcccagctactcaggagcctgagcctggagaatcacctgaacccagatggcagaagttgcagtgagctgagatcgtgccactgcgcttcagtctgagcaacagagaagactctgtctaaaaaaaaaaaaaaaaaaaaaaaaaagactagaaaagtaaaatcatctataccattaacagccagagatggaaattctcttcatgtcttgatagattttcttgtcttatcatatacatatatatgtacatacagttcttaataatttgataccacagtgtgtatagaatgttttatactctatttactgttactttataagcctataccatttttatgcccttagttgttctttaaaaacttgatttttaatgaacttatatatatatgcactattaagtagaggtactgtaatctgtttattcagtctttttttttttttttttggagacagagtctcgctgtcacccaggctggagtgtagcagcatgatctcggctcactgcaagcttcacctcctggattcacaccattctcttgcctcagcctcccgagtagctgggacacaggtgcccacaaccacgcccagctacttttttgtatttttagtagagacagggtttcaccgtgttagccaggatggtctcgatctcttgacctcgtgatctgcccacctcggcctcccaaagtgctgggattacaggcgtgagccactgcgcccggccctattcagtctttttttttaaattattttattttattttatttttgagacaaggtctggccctatcacccaggctggagtgcagtggcgccatctcagcttactacaacctccatcctccaggctcaagccatcctcccaccttggcctcccaagtagctgggactacaggcatgcgccactatgtccagcttattaagtccttctctgaaggtcaatttctttctacctgtttgctgttaaaaacagggctacaggctgggtgtggtggctcatgcctgtaatcccagcacgttgggaggccaaggtgggtggagcacctgaggtcaggagtttgagaccaacctggccaacatggtgaaaccctgtctctactaaaaactacaaaaaaaattagccaggcgtggtggtgggcgcctgtagtcccagctacttgggaggctgaggcaagagaatcgcttgaacctgggaggcggaggttgcagtgagctgagattgcgccactgcactccagcctgggtgacacagtgagactgtgtctaaaaaaaaaaaaaaaaaaaaaaaaaaaaccagggctacaaagaacatctttggatgccagggctacaaagaacatctttggatgcctttctttataccttcctgattatgaggagatcataataccagtgaaatgccacatgtagacatttaaaattttgatctgcattaccaatttcccgtctgaaaaggttgctttttttccccatactcttgccaccataccccactggtattttcagtctcttaaatctttggtagtttcattgttaaactatgttttaatttttttttaaatttttttagagatggggcctcgctccatcgcctaggcaggagtgcggtggcacagtcatagctcactgcagcctcatattcttcttgggctcaagcaatcctcctgcctcagacccccaggtagctagaatgacaggcatgcaccaccacacccagcaaatttttattgtctttttgagggtgggaggcagatctcactgtattgcccaggctggttttgaactcctgacctcaagcagttttcccatttcagcctcctgagtagctgggattacaggcatgagacaccatacccagctctaagctatattttagtaatgtatattttgatattaaggttttttttttagctgattaaccagtctgagtgccattcattgagccagccctgatttttgaaggatatgttatgttacagtctcatttagatctgttccacacgttttgtttatgtcactttacttgaattgtaattttatctgagtatttgctatagccctgcccccctttttaaatttattggtcagtcttacatagttttcccccctcaaataaacattagagtcactccttagctaaattaaaagtctctttagaatttccattggaatgttattaaacttattaatttgaggtgatttggtatctacagttttgtacaattaaatataaggtggtatattgtgtgtgtgtgagcatatgtgtgtgtttgtactcatataaaagagaccagaaggaagtaagtgcttatttctgggtagaattaagaatgcattggccgggtgcagtggctcacgcctgtaatcccagcactttgggaggtcaaggtgggcggatcacctgaggtcgggagtttgaggcctgacctcccccagcctgaccaacatggagaaatcccatctctactaaaaacacaaaaattagccaggcgtggtggtgcatgcctgtaatcccagctactagggaggctgaggtgggagaatcgtttgaatccgggaggcagaggttgcggtgagccaagatcatgccattgcattccagcctgggcaacaaaagcgaaagtctgtccaaaaaaaaaaaaaaaaaaaaaagcatttatttcattttttaatgataatcctgtttttgtgtgtgtgtggctttttgttttttgtttgtttgtttgtttgagacagagtctcgctctgtcacttaggctggagtgcagttcattgcaacctccgcctcccgagttcaagtgattttcgtgcctcagcctctcaaatggctgggattacaggtgtgtaccaccatgcccagctaatttttgtatttttagtagagatggggttttgccatgttgtccaggctggtcttgaactcttaacctcaagtgatccacccgccttggcctcctaaagtgctgggattacaggcgtgagcccccacgcctggctgataattctctattttctatagtgttcatgcattattttaataatgatcgtatcttcctcaaaaatgtgatttttaataactggtggtgtgtgtatgatggttggatggtggggaaaggtcagtttggagggtcataggagtccagctagagtcatgaggacttggattatggtagtgcagaggaattcagtcctggacatgttctgcatggagaagcaacagcatctggggataacatgtacatctctttccagcctggctgtccggggggtttgtagtggtgttaaaccttctgcttgtgccctttataccaggcagcctgccgcctctcattgtgtatgaccggaatggattcagaattctgctccacttctcccagacgggagcccctgggcacccagaggtacaggtgctgctcttgaccatgatgagcacggctccccagcctgtctgggatatcatgtttcaagtggctgtgccaaaggtgagtcatctgttggggatttctcagtaatggctgtcgtttttgagtgccaggttcttttctgggacttacctgtcgagtgtcaaggaaagaatcttcactcaaactaactgaagataaagtgggaatgtaatggcttacctgactggggattcctgaatatctgacttcagatatgagtgaatccaaataggttcttaaacaatgccttaagaatctgtatctcttgactctgcttttctttggcaccattctgacagtttctccacaaacaggaaagtggctacccacagctccagggttgcatggtccttaaccctctttatctcagaaactctcaccgggcatgaagcacatatattgattacccaggaaagggctctgattgggcttgttggtgttacttccataccttggaccaggaacttgtatcctgggatatgagacacttggccaatgtgagataacatccatcccttttcaagggaagtggggccctactgattaacaggcaccccacagtcacaggggaaggggcctgtcctgaaaggaaaagattcgagacagacaaaaatatgacctgcagtctctacttcttacggtagtcctatgggcaatgttctgctactacctctgttttataagttaacccaaggctcagaaattaaatattttactcaaggtcacagagctagtgagaagcagttagaattcaacccaagatgtgccctggctgttgatgctgcgtctcagatgccggttattgaccacacaactcccgatccattctgtgtgtggaaggaaaggcctcttagatccttttatcaattagtgggagtctgtctgcttgggctcccataggtgcctcggggtaccacgtttaagagggccatttcctcttggaggggtgttggggaggtccagctccccctcacctgatctccatcctagaagctgtggttaggaatgagttacatgttggttttcttcccctgatagtcaatgagagtgaagctgcagccggcatccagctccaagcttcctgcattcagtcctttgatgcctccagctgtgatatctcagatgctgctgcttgacaatccacacaaagtatgttccagtgtctgtggtagcagggagatgggggcccctgaactgtaaggggaggtaactttgtgggtagagagaggcacattgaggccttgctctaaagtctctggtttgctgggcacagtggttcacccctgtaatcccagcactttgggaggctgaggcaggtggaccacctgaggtcaggagtttgagaccagcctggccaacatggtgaaaccccatctctactaaaaatacaaaaattagctggttgtgggggcacgcacctttagtcctagctgctcaggaggctgaggcaggagaattgcttgaacccaggaggtggaggttgcagtgagccgagatcgcactactgcactccagcctgggcaacagagcaagactccatctcaaaaaaaaataaagtcggccaggtgcagtggctcacgcctgtaatcccagcactttgggaggctgaggcagatggatcacgagatcaagcgatcgagaccatcctggccaacatggtgaaaccccatctctactaaaaatacaaaaattagctgggcatggtggcgtgcgcctgtagtctcagctactcgggagagtgaggcaggagaattgcttgaacccaagaggcggaggttgcagtgagccaagatcgcaccactgcactccagcctggtgacagagcgagactctatcaaatagatagatagatagacagacagacagatagatgaaagagagagagagggagggaaggaggaaaggaaggaaggagaagagaaaaagaaaagaaagtcagtctctggtttggttgggtgttaggggtatatgtggaatatccctcgctggagtctgtctttggggctcactgaaggaagatcagatggattgtcatagctggggaccaagggagggacacatgaactctccctaatcctctggagtcctctgaaaggacaaggtctgtcttccttagctggtctctgaattgcagcccatctcaggatttcaggactgcagaattatcgaagggttcccaggatatgtgcctgtttccccttgtttgtagtcccaaagagagtatcccaggtattttgtgtcagaattgtttgaaacactcacttgacttaacattgacccctgttcctgggttgctctccactgatttgacatcttctgtctcttctgtcccaggaacctatccgcttacggtacaagctgacattcaaccaaggtggacagcctttcagcgaagtaggagaagtgaaagacttcccagacctggctgtcttgggcgcagcctaacttttcacaagatggacccttcatttcaagcttaggctggcgttacttttgctgtctagtcaggactaatcacggtgtttcagtgcggagtgccaagagtcctatcctgacgtcaggctctgggtgtcaacctctgacttattctgcagatgctctgtgtgtgtgtgtgtgtgtgtgtgtgtgtgtgtgtgtgtgtgtgtgttcggggagagggtggtagcacagggcttgggatatcggcagtgtgggaaatgcgaagcatttctcatcatcatcatctctgctacagtcatgtttctgcatgtcagcgagcgacactgtccctgcctcaggttggaggttttatcagccaaagtgtttttttcatgtatcgttcgttccattcatccactctgtgccttgtcagcctttgaaaggcttggttgctcccaggctgctgttctcagggaccttaaaagggacctggttagtcttggggcagagagtatctacttgggcactctcttccaagaaagaccttgtctccattttcattagacaatgcttcttgtgtgtgttctggaagatcttctaaatggaatgcttgttgcactgttcccaggcgagtggctgccatgagacctgaggaccacacttgggggaccaatcatgtccttcaccactgtgccttagaatcgcccctggacagagttcctgggcagaggggaaagcagctcccaggccttactcaggcctcaggtccatgggttgggcagccagtctgggcccttctcaggatcctcatctccatcctcatcctcttccttcacagcatttacttggagctctttgtgacacaccatgtcagtcatgatgaatcggccaacagccagcccttgccagctgacgtcacagtctaagatgggaaactgtggtacagatagacatgaagagagcttagcagtgattgaggtggtgactaaatatacagtcattgaataaataccatgtagcaagtgtactttgtggagtgttgagtaagtggaaaatggaaagccagttgcatttagagatgataggcctaaagggaactgtcttctgtcgagaagtaaaggaaacttcatgaaggatgtagaagcttagctgcctcagagaagagagaacctgaagatctgaggcaagctggacaggagaggtggatatttgttgatggaagaattcaagtttataatcaattcccacttagcacctactgtgtgctaggaacttgaatgtgtatgtttgacaagtcctgcttggcctgatgggtgggagaaggaacctgagcctggctgagatggctaggcggagggctttgaagtccaagcagctgaactggctgggtgggtttctacctttgaaactgcaagacttgtttggagctcttaattacaatatctgatatttttacagtctgatcttttgacttctacatatagtggaaatctgccaatactaattggtggagatgggaactgtaaaagatcaagtatgctaattttaagcaaatgtaaaaactcataaaacaggtaaacagtggggtgatttcatttgccataattcacataagacgaattttaatctaaaagtactttcttgcttgtattctgtgtggcttttttttgttttttgaggccatatctcactctgtcactcaggctggagtgcggtggtataatctcagctcactgcaatctctgcctaccaggttcaagcgattctcgtgcctcagcctctcgagtagctgggactacaggcgtgagccagcacgcccagctaatttttgtatttttagtagagacaggatttcaccatgttggccaggctggtctcgaactcctgacctcaggtgatccgcctgccttggcctcccagagtgctgggattacaggcgtgagccaccgcacccggcctctgtgtagcttttataggctctgttactgttgcgtagtcttgaagaggtacccatcataatgacagcatctccctctgaagggttttggtcaaaatgggtgaatgagacttatacataaagacaggctttctcccctatagttaggaggtgaactcacacatgtgtacctgaacattcttgcttttgaggagacagactcccagtggtactactatgcttaggtgttggacaggataggggtaggaggagaggaggcaggctgctgtcctgaaagtggctgtggtttatggcatcactcccttctaatcagcaagtccagtggccacttagagcccagctcctacctcttcattcacttaacaagtagttattggctgtgcacagtggctcacgcctataatcccagcattttgggaggctgagtgggatgaccgcttgagcccaggatttcaagtccagcctgggctacatagtgagaccgtgtctctgtttttttaaaagctagttgttgaccagctaccctgagccaggcaccaccctgaaggagcttcttttcctctggggagaagcaaattcatgatgtgtgtgctggagatctggcactcatggccagtgctttccagtatcttgaactcttcgggggtcctgttgacccatttcgtgacctacctccgtgactgctctttttcctctgtctcttaagtgtgatggttttccagagtccaatcctcaggactttcccgtccacacacaggcctggtagtcaggtggctctaaaccattaggtgggttgtagacctctctcaagctgccacctccttgctgtcgccagatcgtatttcagtctgtcaggggttatctgtatctggaggttccactgttgcttcagtctcagttacttagaatggaacccagagtcctgcccctttccacctacatgctcttacttgaaagcacctgagacttattgggtccctgattcctgcttcgtctgtatccgcagagtagttgcatgtcatttggcctgttttctaaataatcccacatcatgtcctccctgcacttacattgccactgctctgatttgggcttttttttttttgggacaatgcctctgtcccaattctgagtaacagctctggttcttgccactaccagagttctctagcaaatctgagcatctgacagggtgaaaaattctgaatggcttcctgatgcctgactttatgggatcaaattcaagttgcacgctggcactcagtgcccttctggtatcatctgccaagaccagggcctgcttcaccacagccacaataaagtcctttcaagccct

SEQ ID NO: 37100 - DNA, 28836 bp, Homo sapiens
aaatcccccaagttctcatgatccttgcttccctttccagtcacccttggtgccctgtacttcactgtggtcctgaactgaagagctgtgtttttcaggaagacttggccaggccgtgttccgtgtctctggattcaagtcccaggagtcctgaccagagagcaggtatgcgggtgtggggaagggctgcagaggactcaggtccacaccgaccctgggccaggtgatcacacagaaagtatagacagggactgaacctcagaaaacaatggctgggccaggtgcagtggcttacgcctataatcctagtactttgggaggccgaggcgggtgaagtttgagacccagcctgggcaaaatggtaaaacctcatctctacacacacacacacacacacacacaaatatatatatatatgaatgaagtagtcgagtgtggcgggacctacttgtagtcccaactactagggaagctgaagtggaaggatcgcttgcacctgagaggtcaaggctgcagtgagccgtgagcccgccactggactccggcctgggggacgaatgagacactatctcagaaaaacaaaacaatgtctggcacctgggggaccagcaggttagagcagctggtcgtgcattgccagtttacctgacagtgactcgagagctgagaactgggtatagggcacattattgggatatttgaggcctgaaggcgctgatgagcagccaccagttcagcaagtgcgggctgggtgggacccgcagttccaacaaacactacaaagtccgctcctgtggctttggcctcctcccccaactccccgagtcctccagcctgtggggtgcgcaaaacacggctccctggtccccctagaggtgccccaggccaccgggtcctccctccactgccagccttgggatcccaagcgtagacctctgaggacgttcgtgggcgtgcaaggcgcacctggccgctagaggtgggcgtgaggccgatcgcggttcccccaggcgcagggccgccctcccagccccgacggacagccccgagggagcgcagcgctgccgcagctgctctaagtttcggttcccaaatccggctcggcccacaccgtgtcacagcccggtaattagggaagcggcggcgggcggggccagctctcgcggggcacctgcactcccctgagccggcccacgtggtccgggaggtcccgcccgcggtggcggtgagttgggggcgggacgccgggctgggatcacaatgtcgggggcgcctaggcgtagacgtggcgggcggacccgggggcgccctccggacgcggcaggtgagtggggacgggagccgggggccgccctcctcggggcgccgacccccgcctacccgagtcgcggacgcccgcccctgtccccgctgcccgcctccactccctggtcactgctctccaccgcgattcgcccctcttccccaccgcccgcctctttcccgccacgcccgccgcctcccgcccgcgcggggtgtcccggcgccggtgggacccggcagacgcgcgggacgccccacgtgcgcggcagcgcgcatgcgtggcgggtgcgcctgcgcagtgggcgggcgcggcgcattgctgctcggcggcgccggcgccggggtccgggcggccatggggcaacaggcggccagggcgccaagggccaggtagcgacggctggcggcggcgcggcggcggggcctgcgggctcggtccggcatgtagacgcccccgcaggcgcccgcggcagcgaacggtgagtgagcagacccggcctgccgtccgcctggggtcgcccgctgcctggggtcatcgctgcccgcgagcgcgcggccaggcggggagacaccaggccggccctgcccatctggcctgctgaggaggccgtggaagtgctgacgggccaccgctccgtcccgaatggggcaccagcacggcccagggcgaggctcggccttggggacgggtctgagggaggccgctgtccggcctggctctcccgggcggggaaggtggggccgtccagcccggaccgcgcttgtcagtcgcctctgcttgggcggccaggtcctcggtgtccggccttccgtgggtggtttcagcaagcaggaggggtctttgactcgtgaaagcttagaggggcccaaacctagtgggaaagtatgaataaaagattctatacagcagtattggcatggaattctctaaaaacacatctctgatttagtgcccagtacttgccagaaaattccaatagtctatggtgatgttcctacaggcggctgccatccagtaggtcagatgtcagcaccggccttgagctctaggtcgtcgttttttttcttaattgtgggaacagggcgtgcccagctccgaaggcctggtggagttttccttcccaggccaaggaccacccccaccctcccatccctcctccccaagcaatgagattccttttggcttcgattccgagtaacaagttatttttcctttcttgttttggaacacactaagttttacattcaaaagttcattattcttggctcttgatgggaatacatttcaaaactcttctcttcttgtgttccatgtctctctgacagccttagttggcctgaaactgacatgtttgccttaataagtttttttttcctcctgatgtcatcttgtctaagaagctagttactttaacaccttgttagataattcccttcaagtacttattcccctgaacattgtcctctcaagcctctggaaatttcctgtccccttggaacttctctgtaaggcctgtttgctctcagcagtgacttcactgggacttttgcagccactttatggtgttagcacgctgattccaagctacttgaggaatcacaggtgccaccgcagtacccaacaaaatagcttcatcatttggaggtgtcctctcgagatgtttctgtgtgtatatgtgtgtgtatgttagaaacagggcctcactctgtcctccaggcgtgtttatggtggcatgattatagctcactgtaacctcaaattcctgggctcaattgatcctcccacctcagcctcctgagtagctgggattacaggcctgcaccaccacacctagctgatttataaaattttttgtagagatagagtctcactgtgttgtccaggctagtctcaacctcctggcctcaagagatcctcctgcctccacttcccaaagtgctgatcttacagacgtaagccactttgaccagtcttttttttttttttttttttttaagacagagtctagctctgttgcccaggctggagtgcagtggcacaatctcggctcactgcaacctccacctcccgggttcaagtgattttcctgcctcagcctcctgagtagctgggattacaggcgcccaccaccacgctcagctaatttttgtatttttagtagagacgggtttcactgtgttggccaggcttgtctcgaactcctgacctcgtgatcagcccaccttggcctcccaaagtgctgggattacaggtgtgagccaccacagcttgcctcacttggaccagtctttttgtttgtttgtttcatttgaacttggaggtgggtttatgttgtttcagttggcagcctgctgtttggttccaaaacagcattttcttcttgaaacaactgctgtcagcagttagatttccaggctagcacaaaaacctgtttgactcataaatccttgtagtgagggtgtcccagaaagttggccaagtcaagagcagttcttgtggagtggaggcggtgaacaaatagggggaaagtggcgctcgtgatgaaaacggaaaacaatagttgattttattgagcttcacgcttgaggaaatgtaggtctcacttggaaaattaagaggcaggtgggtgtttgcgggactcgacggccttgcatctggattacctccagtctgcaggtgtggtaggatgacagcaagagggagtgttgagcacacaagcccagcacttggggggaggctgtgtcatggcaggaaggtacagggcctcctccagcagctccactttctagtccgtatatacctgttgacagtcaccgcccagcttcagccgttctggacaagtgggtgtcagtaatgctttagcttgtaaccccaggatttcatttctactctctgtgctggtggcttatcatttgcaatctttcctggcccacaattgcaaaggtcctagcattcatgcatgggaatggggaagtgaataaaatgtgtgtgtgtgcttcagacagatggtgaaaagtgttcagagaaaaagcgaaattgaggcagatgggatgtgaggatgccacgcacactttgtgcaactgaagagggaggtgatgcctggccttcccattcagaactgcccagacccctgttttcttcatctgcccctaagtaggtggagccacatctaaagaaagcccccttcagacctgtaatctgcttaggtttaatgaggtcacagggtgaagccctgtggtcacatggctgtagcactttccagaaagtctttctcagtttgtatactgccagtgtgcatgccagcactgggcattatttaccggggtgagatgagatgggtaatttagtgggcagtaagttttttcccactcagggttgaggttgaatgtttccccatttctgtcactaaataaattttcctttttcatttagtcttgcaacaaatattgattgagttcttacatgggaacgaactcgtgtattatgtttgtatttgtgtgtgtgtgacttttgttcatgttctttgcacatttatttattggcatcttaatgttttccttgctactttgtataagttcgttatgaatattttcttattgtgctctagtatttttttctaataaaacttcctaatacagaggattttttttttttctttgaggcggagtctcactctgtcccccaggctggagggcagtggcgtgatctcagctcactgcaacctctgccgcctgggttcaagcgattctcctgcctcggcctcctgagtagctgggatgacaggcgcctgccaccgcgcccagctaattttttttgtatttttagtagagacggagtttcaccatcttggccaggctggtgttgaactcctgatgtcgtgatctgcccgcctcggcctcccaaaatgctgggattacagtcgtgagccaccatgcccgccctacaaaggttttttaaaattagattcatgctatgaggaatttgaatgcactttggtgcagctagcattgtgtgtccttttaaagcagttaatatatcaaacaaatgaattaagtgtcagtcctgactcacccttgtcaaaaaatacagtggtgaccgcgcacggtggccacgcctgcaatcccagcactgtgggaggccgaggcacaatggtggccgcgcgcagtggccacgcccgtaatcccagcactgtgggaggccgaggcataatggtggccgtgcgcggtggcgacgcctgcaatcccagcactttgggaggccaaggcgggcggatcatctgaggttgagagtttgagaccagcctgaccaacatggagaaacccctccatgttggagaattaagaggcaggtctccactaaaaatacaaaattagctgggcgtggtggcgcacacctgtagtcccagctacttgggaagctgaggcaggagaattgcttgaacctgggaggcagagtttgcggtgagccgagatcgcgccactgcactccagcctggacaacatcagcgaagctccatctcaaaaaaacaaaaaatacactggttgtggtattggagatacttgttaaatatatatatatgtgtgtgtgtgtgtgtatatatatacacacacacacatacataggtgaagataattgtttaaagttggttttaatatttaatattattttataaattagtttactgcttagtcatcaaattgatcttcgcaaataaatatgaacagagcttctaggctgggtgcagtggctcatgcctgtaatcccaatgctttgggaggtcaacacaggagggccaccagagcccaggagttcaaggtcagcccgttcaaggtagcgagaccctgtctctacaaaaaatttaaaaattagctggacatagtggctcatgcctgtagtctcagctacatgggaggatcccttaagcctgggagattgaggctgcagtaagctgtaattgcaccactgcactccagcttaggtgacagagcaagaccctacctctcagtctctcaatatctctatttctctctctctctcacacacacacacacacacacacacacacacacacacacacacacacacacacaaaatagagcttctaggtaatgtagcagtaataatacattttttttaacattttgtgattttgatttgtttattttttattaatgtttttgtagagacggggtcttgctgtgttgcccaggctggtctccaattcctggcttcaggtgattcccctgcttcggcctcccaaagtgctgggattacaagtgtgagccactgtgtctgacctttattaactgtttattttgaaataattggctgggtgcggtggctcacacctgtaatcccagcactttgggaggccgaggcgggcggatcacctgaggtcaggagtttgaggaccaacctggtcaacatggtgaaaccccatctctacttaaaatacaaaaattagccgggtgtggcggcgggcacctgtaatcccagctactcaggaggctgaggcaggagaattgcttgaaccctggaggcagatgttgcagtgagccaagattgcgccattgcactccaacatgggggacaagagcgagacttcgtctggggaaaaaaaaaataatcatagactaattcataggaagttgtaaaaatagtacagagagacccctgtgcccttcaccagctccctctgtgttaacatctttttttttttttttttgagatggagtttggctcttgttgcccaggctggagtgcaatggcgtgatctcagctcaccgcaacctccccctcccaggttcaagtgattctcctgcctcagcctcccgagtggctgggattacaggcatgcgccaccacgccgggctgattttttgtatttttagtagaaacgcggtttctgcatgttggtcaggctggtctcaaactcctgacctcaggtgatccgcccgccttggcctccgaaagtgctgggattacaggcatgagccaccatgcccggcccttgtgttaacatcttacacctccatacacctccatagtacaatatcaaaaccagggaattgaaatactgctaactaaactatagaccttattcaggtttcaccagttttacatgtgtgtatggctctatgcagtgttacctcttaaattaattatataaccactagcaagacacagaactggtcttgaactcctggactcaagcgatcctcccgcctcggcctcccaaagtgctgggattacaggcacaagccaccacacccaactgtattttaattttcttaacagtgttttggctaggcacagtggctcatgcctgtaatccaagcacattatgatgctgaggcagagagattgcttgagcccaggagttcgaggtcagcctgggcaacatggcaaaacctcatctctacaaaaaaatacaaaaattagtcaggcatggtggtgcatgcttgtagtccctggtactcaggaggctgaggtgggaagattgtctgagcacagtaggtagaggctacagtgaaccatgattacatcactgtactccagcctggggacagagtaagaccctgcctaaaacaggaaaaaaaaaaaaaattcagggttccattaagtataaaagattttaaacaccactaagactttttccagctgggtgaggtggctcacgcctgtaatcccaacactttggaaggccaaggtgggaggatcacttgagaccaggagtttgaaaccagcctgtgcaacatagggagaccccatctccaccaaaaaaaaaaaaaaatttccaggtgtggtggtgcatgcctgtaatcccagctacttgggaggctgaagtgggaggattgcttgagcctggaaggttgaggctgcagtgagctgagatcacaccactgtactccagcctgggcaacagtgggagatcctgtctcacaaaaagacaaaaaaaaaaaaatttccagtgctttcttctaaaaagtttcatagttttagtcctcacatttaggtctataatccattctgagttaatatttgtatgtagtatgaggaagtggttgggcttcgttcttttagacgtggctgtccagttgttcagaactattaggtgaaaagatgatcctcctcatgttgaatcacctcagcacctgtcaaaaattcatggactgcatgtgtgtgagggtctgtggcgtctacctttgggctggccgtcctgtttccttgatgtgtatgtccgtcttgatgctgccacgctgtctggttcccgtagtttttcaacaagtcatgaacttagcccttcgcgtttgttcttgttcaaagttttttcagctggtctagatactttacattttcatgtgaattttatcagcttgtcctttcctttagagaagcctgcttggcttttgatggttgtgtttgggtaacatttgcagatcaatttgatgagaactaagatctcaatattgagtcctccaatccatgaacatggtatgtctctccatttatttaggtttcctttcatctctgtcagcaatattttgtagttttcagtgtgcagttctgacatgtcttttgccaaatatatccccacatattttatatttttaatgctattatagatcatatatatgtatatatattttaataagatatatatttttaataatatatgtgtgtgtgtgtgtatatatatatatatatatattttttttttttttataagatgaaatctcactcttgttaccaaggctgcagtgcaatctcggcttactgcaacctccacctctcaggttcaagtgattctcctgcctcagcctcccaaatagctgggattacaggcatgtgctaccatgcctgcctaattttttatatttagtagagacagggtttcaccatgttggtcaggctagtcacaaactcctgacctcaggtgatccccacccacctcggcctcccagtgttgggattacaggcgtgagccaccacacccagctgtaaattatattgttgttattattattattattttgagacagagtctctctctgtcacccaggctggggtgcagtggtgcgatctccgctcactgcaagctctgcctcctgggttcacaccattctcctgcctcagcctcttgagtagctgggactacaggcacccgccaccatgcccggctaattttttgtatttttagtagagacagagtttcaccatgttagccaggatggtctcaatttcctgttgtctattgctagtatatagaaatacaggcgatttttgtgtattgaatttgccttctgaaaccttgctaataaactcacttatttgtttttctacatagaaatgtcatgtcatctgcaagtacaacttcacttgttccttttcttattttgtttaacagacctacatttcatgccaaaccttttctgtcactgtaccttttatttttttcttatgttattgcactggctgtggcctctagtatagtcctcaataggagtagttataccagacatgtttttgtaggttctggttttcattgaatttttcatggtttttttttctttttttcttttttctttttattgaggcagagtctcactctgtcacccaggctggagtgagtggtgcgatctcggctcactgcaccctccacctcataggttccagcaattctcctgttctccttcctcagcctcctgcatagctggagttacaggtgcccaccaccactccaggctaatttttttgtttttgtttttgtttttgtttttgtttttgtttttgttttgagtgctgggattacaggcaagagccactgctcccagccctttttttgtatttttagtagagacagggtttcactgtgttggtcaggctggtctcaaactcctgacctcaaatgatccacccacctcggcttcccaaaatgctgggattacaggtgtgagccaccgtgtctggccgaatttttcatgtatttgaataaaacactggtatgtcttttttctttttttttttttcttttcatttgagatggagtcttgctctgtcgcccaggttagagtgcagtggcacgatctcagctcactgcagcctctgcctcccaggttcaaggaattctcatgcctcaccctctccagcagctggaattacaggcacgcgccaccacacgcggctagtttgttttttgttttttgttttttttttgagacggagtctcgctctgttgcccaagctggagtgccatggcgcgatatcggctcgctgcaagcaccgcctcctgggttcacgccattctcctgcctcagcctcctgagtagctgggagtgtaggcgcccaccaccacgcccggctaattgttttttgtatttttagtagagacggggtttcgccatgttggccaggctggtcacaaacatctgacctcaggtgatctgcccgcttcggccttccaaagtgctgggattactggcgtgaaccaccgcacccagcctgtacttttagtcgagacagggtttcatcatgttggccaggctggtcttgaactcctggcctgaagtgatccgcccaccttggtctcccaaagcactgggattacaggcgtgagccaccacatcccgcctggtatgtcttaagctagggagatattgacccactgggacagtactgtcaattctcgctaaacattagaatcttctggggagctcttttaaagtgccggtgcctgggctgtaccttcaggttctgatcattcagtctggagggcacgtaggaattggtgttgtttgaagctcctaaggtgattgtagaatgcagccagagagagaaccagcttttgggtattcagagaacccgttggctttgaccgtagcatagggcccacagtcttgtgtccatagttcctgaactttccttctgcccaccttgccatcatctcacatattttagttgttttatttaggctgctgtaacaaagtgccacaggcatggggcagggggcgggtaaacaacaaaaatgtttgttctcagagctctggaggccaagagtccaaggtcagggtcccagctaatttggttcatcgtaaagactctctttctcactgtaatggccatcttctctgtgtccccacatggctttacttttgtgcccagtgagggtgggaacagaggtgaggagagagctctctggtgttctgttttgtttttgagacagggtctctattgcctaggctggagtgcaacagcacaatcacagttcactgcaaaacctcaaactcctgggctcattgatcctcttgccggagcctccaagtacctgggactgcaggcatgcaccactgtgtccaactgtttttgttttggttttgtttttgtttttgttttgtagagacagaatcctgctatgttgcccaggctgttcctgaactcctggcctcaagtgatcctcttacctcagcctcccaaagccctgggattacatgagtgagccaccgtgcctagcctggtgtctcttcttacaaggatgctcattctgtctgatcagaccccacacttatgacctcattttttcttttttttttttttttgagacggagttttgctcttgtggcccaggctggagtgcagtggcacaatctcggctcactgcaacctctgcctcctgggttcaagcatttctcctgcctcagcgtcccaagtagctaggattacaggcgcccgccaccacgcccggctaatttttgtattttttagggacagagtttcactatgttggtcaggctggtcttgagctcctgacctcagatgatctgcccgcctcagcctcccacagtgttaggattacagatgtgtgccaccgcgcccatttaactcctttcttagaggcccacctccatattcagccacactggaagttagggcttcaatgtaggaatttggggggattgctgggtggagtggctcacacctatagtccaagcactttgggaagccaaggcaggaggatcacctgagcccaggagtttgagaccagcctaggcaacacagagagaccttgtctctacaaaataaaaataaaaaataaatttggggaggacacattcagtccataatgtcacatttatcctttttaatgccagaatctaccttgtcctcattaagatttatcttctttaatgagaaggtatgtttggctttattttgtgtgtttagcctctgttgagtgatttttattgtttctgtgcacggcccctcttctgttcttctgaagcttgttttattctatttctggctttattggcttgaatgctcagttcatggtttcccatgggctgtgacccagctttgatgggattgaaccgaccctggcagcctgtttatgtcacctccagcttctgggtgttccagatgttgggtctgatcttcactttgatccctgggttgcttaagagaaagttcagaaacttccaagtggctgagggcttttctttgtttctatctcttcctggttttattgtattgtggtcagaagatgaggttctaggctgggcgtggtggcttacgcctgtaatcccagcacttcgggatgctgaggcgggcagatcatttgaggtcaagagttggagaccagcctggccaacatggtgaaaccccatctctactaaaaattcaaaaaaattagctgagcgtggtggcgcacgcctgtagtcccagctgctagggaggctgaagcaggaaaatcacttgaacccgggaagcagacgttgcagtgagctgcgatcacaccactgcactccagcgtgggcgacagagtgagactctgtctcaaaaaaaaaaagatgaggttctaggccaggcatggtggctcatgcctataatcctagcactgtgttgggaggctgagttgggaggatcacttgaggccaggaattgaagaccagcctgggcaacagagcaagacaccctgtctctaccaaaggaaaaaaaattagctggacgtggtgctgtactcctgtagtcccagctacttggaaggctgaggtgggatcctgtctcaaaaaaaaaaaaagaaaaagaaaaaggggaaaaaagggtgaggttttctatcctcaccagttttctttgaggcttaatattggtcagtttggtaaatatttcattggcgctgaattcacgatgcaaggcatggagttcacaacatatctgctggttcaattttatttgacagcttttctggactagggtatttgaaattgcacactttctctctcattaatgtgttgtattgtttacgagaaaagagcctgtcttttttttttttttttttttttttttttttttttttttttgagacggagtttctttcgttcttgttgcccaggctggagtgcagtggcacaatctcagctcaccacaacctccgcttcccgggttcaagcgattctcctgcctcaacctcccaagtagctgggattacagacatgcgcaaccacgcccagctaattttgtaattttaatagagatgggggtttctccatgttggtcaggctggtctcaaactcccgacctcaggtgagccaccgcacctggccagagtctttcttttcttaagacagggtctcgctcatgggctaccatgcccggctaattttttttttgctagagaagagttctttgttgcccagagtggtcttgaacccctggcctcaactgatcctttctctccagcctcccaaagtgctgggattacaggcatgagccaccacacctggccacacagtgtgactttctattttgttcttttttgaaacaattttttttgttaatattattttacagaaaaaattttgagatgaagtttcactctagtcacccaggctggagtgcaatggcatgatctcgacttactgcagcctccacctcctgggttcaagcgattctcctgcctcagtctaccgagtagctaggactacaggcgcccaccacagctaatttttgtatttttagtagagacgggatttcaccatattggtcaggcgaggctggtttcgaactcctggcctcaagtgatctgcccgcctctacctcccaaagtgctgggatgacaggcgtgagccacggcacccagccaaaaacctagagtagttcttaaatatctttgcaatggaaacagtctgttttcaaagtactttggtaaattggacttcagccattttttccccttgatgaaatggaacatatgtatgtgtaaattattattgtttcatacatatttatttactttatttacattatttattttattaaattaaggcatcagtgtttttctgaccgaagttctcatttcctgacaatggaaatggaacaagaaaaaatgaccatgaataaggaattgagtccagacgcggctgcttactgctgctcggcctgccacggcgatgagacctggagttacaaccaccccatccggggccgggccaagtctcgcagcctgtctgcctcgcccgccctggggagcaccaaggagttcaggtacaactgggagggatggttcctcttttttttctcgtctgatttcataatattctttcttaaaacgattatgaagaattctcctgagtagtctgcgtcgatgcatccggaaggtgaggctgggtccttgcccaggtgaagctgtgcccttgaagggggatcctggcccatggacacctgcctggcgcacgttcccaggtgccagcacaggcacagggtgccaccgtgtttctctatctgtctgtatcagcacagaaccatctaactggcgcctacgctgacccttgatgttagactgaagcgcacttggagaggaaacttttttttgagactgagtctcgctctgtcccccaagctggagtgcagtggcgcaatcttggctcactgcaacctccgcctcccaggttcaagtgattctcctgcctcatcctcccaagaagctgggattacaggcgtgcaccaccatgcccggctaatttttgtatttttgtagagacggggtttcaccatgttggccaggctggtcttgaacccctgacgtcaggtgatctgcccgtctcagcctcccaaagtgctgggattaccggtgcaagccactgtgcctggcctggaaacatttgctctacagaagtcactggggtgtgaggggacatccctcttggctctgcttgttttgagaggcgaaggctggggggttctgcactgtgagcagggctggtggaggcagagttatgagcgtggccttgggcgggcccagccctctcacatgttgggcaagtggctccctcctgtgccaagagtgcccacagcgctcacccttgcacaatgctgcttgggcaacagcgccccgggctttgcatgacggtggccgcacaagcacagctgtgatggtgcctggggatggtgctctcggttctggtgatggtaaatgtggtgagttttaggtggaagcttgccagagccggcgctgcctaacaaggatcacgactatcaaatgcaaggggggctttttggtgaaaagtagtcttagaaagcatgttgtcttacccagtgagatgggagagcctgtagcgcctctgacgtggtggcagccgtggagaaacaggctactcccacgttttctgtctacagagtcgctgcctgagccaggaggctacgagcgctggtggctgccttcatcccgcaggcaccacgtcaccactcagcctttctcagatgcctcgttgcctcgttgtcagtgggggtcgttgtcctgtacctccaggccaccccagcgcagtgactgcgtgaacagaattgctttggggttttatttttttttcctgtgggttctttggcataatgcaccatttctgttgcattctgaacctgatgacagcagccctgggtcagaggtcgcctccatagtgagtgacaggcgccttcagggtgaggtgggggaggaggtagccaaatacgcccaagcatagcctgtccttgggaaggaaacattaaatcccaacacccacttcgagaaacattgttttccgcaataatcttttcagttcgtaagtaagtaaaattcttttgtaatgtacttcgttttcttcttctttttttttttttttttgagatggagtcttgctctgtcgcccaggctggagtgcagtggtgtgatctaggctcactgcaagctctgcctcccgagttcaagtgattctcctgcctcagcctcctgagtagctgggattacaggcatatgccaccacgcctgtctaatttttgtatttttagtagagatgggatttcaccatgttggccaggctggtctcgaacacctgacttgaggtgatccgcccacctcagcctcccaaagtgctgggattacaggcgtgagccacaacgcccggctaattttttgtatttttgtgtagagacagggtttcaccgtgttagccaggatggtctcaatctcctgcctcgtgatccgcctgccttggcctcccaaagtgctgggattacaggcgtgagtcactgcacccggcctgtacttaccaatttttaaaaggctgaggtaaacaagtccgtgaccactgatggccacgcctgtgtcacctgtggagcagccctcagggcaccacggctctcctggggttgtctggccctgcgaggcagcggaaggccgttcttctgcattgggacttgaggattttgttgggccgttgcctggccagctgtgtgcaagttttctgagtttgtgaagggactgggaggctcccgggcacctaggacgagggcagcctcagtgctggaccctgaggagcacagcggtcctgacagcattctccccaggacgcgtgcggctgccacagcccctggctgggtgatttaactgtgacctggccatgtttaaatcactaggaaagttgttgagccgttcatctggcgtcttttattcattcattcattcattcattcattcattcattttgagacagagtttcacttttttcagccaggctggagtacagtggctcgatctcggctcactgcaaccaccacctcctgggttcaagcagttctcttgcctcagcctcctgagtagctcggactgcaggcacacgccaccaggcctggctaatttttctttttttagtaaggatgggggtttcaccatgttggccaggctggtctcaaactcctgacctcacgtgatccacccacctcagcctcctgaagtgctgagattacaagtgtgagccactgcgcccggcctacgtcttttttattgacatgagttcagagtgaacatttgtgctagaattttaatctagacgatttagagatgagatgttgtctcaggttttgagtcccaaatgcagatctagagaggggtcctggagacactgaggaattctgatcccaggctggccctggccctggcattttccttgtttgggctgaagctctccccggcttgggtcatgatctgagcggcgcgtgggcatgcgtgctcctcacaggtgccgctccagtgcagccatggacctgggcagaaccttccaagggctattgtgtggctgctgggcagatggagttggcatctttcaaattgcatgtatgccttaccgtgtaacctcctctgtatctgtgtctgtcactgcatgtctggtttcaggccctggtggctctgacactgccctctccccacaggaggacacgctctcttcatgggccatgcccggtgaccacttttggaccaaaggcctgtgtgctgcagaacccccagaccatcatgtgagtgctggggccccaggacggggggttcttggaagggagagaacccctagaccatcatgtgagtgccgggggccatgggatgggggagtcctcgggatgtgtgtggagttgtgggatcgctgtgttgaggaagattctagcacttcatgtgagaagtacatgtttaggtcatttaaacaaaaagccacatgggcgtcctccctgaaccccctgagtgcaggcatccgagcgggggctccccagctgtggcttttccagtggctttgagaaagtggacggcaggcgagccggggcctggagaccgggtcacagcccgtgggtgtggcggcttccacatgagatcctcagggctgcctttttgtttctttaagagtgagtgagaattctggggtgggttgcgtttgctatttgatggttcagtttgtcaacacattctgcctggaggcccgtcatagtgtcatgggaaaaacgcaacagtgatcgatctgatatctgtgttttatgtgtaaagaattataatccaggctgggcgcagtggctcacacctgcagtcccagcactgtgggagtccgaagcaggcagatcacttgggcccaggagtttgagaccagcccgggcaacatggtgaaagcccatccctacaaaaaacacaaaaattggtcagctgcggtggctcacacctgtaatcccagcactttgggaggccaaggggggcggatcacgaggtcaggagttcaagaccagcctggccaatatggtgaaaccccatctctactaaaagtacaaaaattagccaagcatggtggcgcgtgcctataatcccagctacttgggaggctgagacagagaactgcttgaacccgggaggcagatgttgcagtaagccgaagatcgcaccattgcactccagcctgggcgacagagcaagactcagactcagaaaaatacaaaaattagcaggcatcgttgcacacacctgtagtcccagttgccaaggaggctggggcgggaggatcacctgaacctgggaggttgagattgcagggagctgtgattatcaaagtgcattccgcctgggcgacagagcaagactgtctccagagaaaaaagtgagctcccagccagccctgagagtcgtattctgcacctggtagacatcctcattgcctcttccccagagaagcctttgcttctgggactggtgcctcagctctcaggcctctgtgcagaacgggctctcttcctctgtgcagaacgggctctcttcagggcctcctccttcacggagtcatggatgcttcactttctgcaagggaggaccatgcggaagggccgagtgttccagcgcgcaggctgctggggactgttgaccagaaagcgcaatgcggccgtgtgatacgggggcggccactgcatggccctttgctgacaggcaccggtgccatggaggctgggggcgcacagcagggacggaggccccagccctgggctgtcaccgaagttcaggtcccaggagccacgggggagtcatccgaggagctgctctgcaaagtgtgggccccgcggcagcgtgcgtcccaggcaggacgggggttggccttgctgctccagacgctgacggagccccttaggatggaagtgactcgcacttgtgcttttgaggcccagccctttcagtgccactggttcccggagtgtctgtgacctgtcactgctgccaaatgcctgaggcggggggcccgacccctgtttgctttccctcatccagtccatctgcagattctgtcactttgatcccaaaatatccaagcagctcccctgcactattgcccggctgccctccgctgtgtggactcctgaccactcgccgcggcctcaccatcccttccctgcacagcagccacgtgggtgacccagagtgctccactgccctcccggccccgccgtggctctgtcccgccatcctgtgcttgctgtgtccctggcaccccaccgggcctctcccccgctgcctggtgccctccctgcacttcctggtcctggcagagccactcctttgtcactcgcatctcagctgctgccttcaccagccgtcagtcactcgggccagggcggggtcaccggacaggtgcatgttctgcctcagccctcagaccagggcgtactcagtggtccccgagctgcccgaggccagacagccccgcaggaggaagcggtgggtttgtggggcagccttgaggggcatgcagctttctcggcacccccatgggagcacgccccctctgggctctgtgtctctgggatcataacctcccgcttcccatccccgctgtggaggggcagggcttcccatgcatctgaacttccgtcttccctgatagtccagagcaagaccctgtgggggcgcctggtgaggagggcacccgcttcctgttttgttgtccagggaattggtgggcctgtgttgtggaggtgcgtgagtgcccgtgtgtcacagtgtgcgtggccacccatgtgtgagacagtctcagtaggagctggccaggcgggccaggctgtggccatgctggcttcacgccaccccctgccctctccgtgcagtacccacagccgtgtgtgcctgcaagcttcacgccaccccctgccctctccgtgcagtacccacagccgtgcgtgcctgcaagggctggtgtcctgctttgcaggtgacccaggaagaggtcgaggcgctggtttgtggtcacacacagcggtgggtgcctgggccggtgtacgacgccgctgctggtggctctggctgggctcagctgagcctcagggctggaatgggtgtaggccaggccactgggtcagtggtgactgttggcggggagagcagggggagccgtgtgcagggcgggggctttgctggctgaccaggccggaggaccgtgagccacctgcacgcccttgggccggagccaagcagagtgacgcagcgggctaggaggcagggaacgcccttccacctgactgtggcctgagggtgccttccctggggcccagccggttccgcgggccagagcggtggctggcgcagtgctggggcgaggctggaggctgggtacttggccaggtctgaggccacgggaacagagggcttggtcccacccggctcagttaggagcagggagctgaagtgtggcctctttgctgctgaactgaggactttttttcagaagggattaggcaggaggaccatgtgaccaatgaggaaactgttttgttttgtttgatttttataagtgtaggaagctcttttgacttagttgcttttacaacaactttaccaagtctcatcacaattgtgttttgctttgagttttgagtatgaagagcttaggcttctagtgtgggcgcacagtcaggaccataccgatggggcggccgcgtgttcgccaagcgtggcctggatgctgtggacacactggccggctcccagcaggcaggggctacctcgcgagccacatgtgtgacccggcaggtgctgagctcataggggatggcatgagtgaccccacgcctcccagtaatgcctgcacagggtgagtgctgaccagcttccgaaggtcacaagcgatgggctaaggtctgtggccctgtggctgccatcggcgtctgtgttgtggttctgggggtgttagtgggacggtcacactcctggggaagtcactgctgggaagaggcatggcaggcagcagctttctcgattgggcaacttggaactagctggctggcgcggtggtataagaacttgtcctttggggctgaggataggcggtgagcgctgacgacggtggccagccccgctgcgccctcccttggcttctgggaacaggagcaggctccgtggtgtgtgttcccggttctgggctgggatgttttctgtgactaacgtggtaatgggaatcccaccggggtgggccctgcctgtggagaaacaccgggcacagtggtcggggtcagagccagcaaagcgcgggtggctgtgtcagggctgccacggacttttaaacctgtgatttttactgtgagagtgagtgaggttaaagtccgttcatgcagggaggtagtgagctgtgtgcagggggggaagcgggtccttgaggggtcctgggctcccgtggggccagaaactgtgtgcagaggatcctagggacagagtcaccatgtcaactggtttgggttttcgtgggggcctgaggagggcatcaagcaaagagtggcccagccatgggctttcgtggtcatttctgccccaccagcgtcactgaggagccaggcaggcaagtggccgggggctgggaagggctgtggtgcgtgcacttgggtcagcgtggtgcccgggtgggggttgtgggcctgagcctgcgtgtgatgggccaagcaggtgagaggtggtcactccggaccctactgacccctgaccctgtctctgtggcgcgaccctaggccctgtgagcccgtggccaccgagcacgtttccctgggaggtgaaaacacctttttaaagatttttttttttattttctaagtcatacaccttttccgcaagagggagatcgcagctggtgtgaactcttttctcctcccctaaaggcacattcaggaccccgcgagccagcggctgacgtggaacaagtccccaaagagcgtccttgtcatcaagaagatgagagatgccagcctactgcagccgttcaaggagctctgcacgcacctcatggaggcacgcggggcaggggggaagggggcctggggtgcacatggagttgggggggcctccatccacatcaccgccccgtgagaccatgggaaccacctcaagtgctgggcaacggctgcttgtctggaactggggactgagtggggatctgccgggtgtctgggtttgtgtgtgccgccatggcaagcaccagactgggtgaccaacaatgagctggtgggctcgtggccctggaggccgggaagtccgagatcaaggggccacatctgacgtgggccttcctgctgtgtcttctcttcagaagagcaggcgtgggggttgcggcgcccaggaaagccactcctgaaataacagccttagtcaattcctgagagggagccccctccgcccagtcatctcttaaaggtcctgcttcctcctggcgcgttggtgatgaagtttcagcgtgagcgtgggggggcgggcatgcaggccacgatgccaggtctctgaccacagcgcccgtgagtcgggaacctccctgcaggagggtggggtctgcaggtggaatgagcaggttggcactttgcttccaggagaacatgatcgtgtatgtggaaaagaaagtgctagaagaccctgccatcgccagcgatgaaagctttggggcagtgaagaagaaattctgtacctttcgagaaggtgggctgtcagcagctctgtccttggtttctccagcacagttccccgccccattggaagcttctggcactgttgcccttgtcattggtgtctgcgcactgcgccacagaggggccactgtgtgacagcctcttcttggttttgctttgtgtttcctagattatgatgacatttccaatcagatagacttcatcatctgcctggggggagacgggacgctgctgtacgcttcctcgcttttccaggtgaagcgctgacatttccagacccacaccaggttctagtctaggtgctgcgtaacgaggggctcacaagcatggcttccattgcttttcacccctttatacgagagcagtcacctagagcggccagcactgaggcccatggtggcagcccggtggggtgcgacggtggggccaggggcagtgtggacacagtgctacggctgggggtggccagcgcccgcctgggacagcagggagtggcgcagggtggtgggtcctgggaaacgacctcgcctactggcccatcccctctgggcctcccttgagctcctcttcctggtttctcagcagcacagctctcccctggggctgtagggccacgctgtgtgggggaccctggctctgcccttggcccactgcatgttggtgacaccggaaatgcccgcagcccgccctgcttttctccccatctccccattagcacctgtggggcgcgaggctccgaccccaaggctgcctcccacccgccctcgccagctcccccagccctccgtgcccagggggccgctcagccctgccacctttgttcctcaccagctccccacaccaaccttggccctggtggcccggcccaccctggcctgcgacgtccccctccgcttgtccacatggccagtccctcctgcagagggtcggggtgctgtccccacagagctgggtccctcctgaggtgctgctggaaagctgggtggtgcgggggtgcacggcgtgggcactgagtgacctctccgtcggctcacagggcagcgtccctccggtcatggccttccacctgggctccctgggcttcctgaccccattcagctttgagaactttcagtcccaagttactcaggtgatagagggtgagttggaatgttctggagcccacaggagctctgatcatggcgctgctgtctcgcttgcttgcggggggtttattttcatttaatgatgcatggagcaacatttaaaggtttcaagattcagggatttctaaatcttgagtggttcaaaccttttactgacactgagaagtttcagcagatcacaggttgaagctgccatgtgtgttgggcagaagtgagctgattctcactctcagaaggcacagaagtgtcggccgggcgcggtggctcacgcctgtcatcccagcactgtgggaggtcgaggcgggcggatcacgaggtcaagagatgagaccatcctggccaacacggtgaaaccccgtctctactaaaaatacaaaaattagctgggcgtggtggtgcgcacccgtagttccagctacttgggaggctgaggcaggagaatcacttgaacctgggaggcagaggttgcagtgagccaagatcacaccactgcattccagcctgggtgacagagtgagactccatctcaaaataaaaagaaaaaggcacagaagtgtgtcaacttgggagaagaaagagccctctgactcccactggcctccctggggtggggcccctgaccccactgacttccctgatgcatgccctctgactcctgctggacctcagggaacgcagctgttgttctccggagtcggctgaaggtcagggtggtgaaggagctccgggggaagaagacggccgtgcacaatgggctgggtgagaacggctcgcaggctgcaggcctggacatggatgtcgggaagcaggccatgcagtaccaggtgagtggaggcgcctcggcctcggtgaggggcccagggtggggcgacttcggtcccagggatgaggaccttccggagagcccggctgggtgagacggagggtgtctgcgagccgtgcggcatcccccgccctgagtgtgcaatgctgtcgcccctccaggtcctgaatgaggtggtgattgacagaggcccctcctcctacctgtccaatgtggatgtctacctggacggacacctcatcaccacggtgcagggcgacggtaaggcccgcagcactgtcctggggccctgagcgtccctcgggcgggagtgacgcctgcgcctgtccctgtcaggagtgatcgtgtccaccccgacgggcagcacggcgtatgcggccgcggccggggcctccatgatccaccccaacgtgccggccatcatgatcacgcccatctgcccccactcgctgtccttccggcccatcgtggtccccgcaggggtcgagctgaaggtcagagccaacgacactccttttccggtttgtgagtcatttgaccccgtgcaacacaaagccgggacctagcaccccgctctgccatgctggctccagcctcagacgcggcctcgtcatcctagggccatcctgtgccccctcagatgcaagccttcccttgctggtgcccgagttctgtccatcaaggtgcccagggcccgggtctgaggggctttctgccattgttggtctctggcggtgctgagctgggccggtgcctgtaggacgtgcactgcaccgtccgcaaggcagggtcagagctgcccaaccttcgacctctggcgagcactcaggggtgggtgcctagaagcgtcctccccacagctgggggcccacacctctccctgcttgaccctcagatcatgctgtcacctgaagcaaggaacacagcatgggtgtcctttgatggacggaagagacaagagatccgccatggagacaggtgtgggctgcatgccgggctgggcgctgcctgccaacctcctccccgggccaggcagcgcctgccctcttgcggttggcctgtagacacagcttgtcccctagggcaccacagggcctgagtccctgggtcttgcagcatcacagtcggggcacccgtcctgggggcagcgggtcgcatacggtggcacatgcaggcctggccccagcagaggcctgagggtgtcccccctggcactgctgcccacccccacccacctcctgggacctcacccctgagggccctggggcagagtttgtcagttccctgcaccgtcccctccaggacctgggatggctctgtcccagcacccatggggcactgctcaagcctgcctcggggaggggctgcccggccccacaggaaaagagtcccggccattcccagggagggagggaggaagggttcttggccgggggtgggcctttctggaagccctggctcaggctgctgctctcccgtcccagcatcagcatcactacctcatgctacccgctcccctccatctgtgtgcgggaccccgtgagcgactggtttgagagcctcgcccagtgcctgcattggaacgtccggaagaagcaagcccacttcgaggaggaggaggaggaggaggaggagggctaggtcaagcccctatccaggcccgaatccttccgctgccctccaagcgccctctggggacagaccaatctgcgtgtgtctgtgaccgcctgtctcagtggcacggccacttcctttctgtagctgggttagagcctgggtctgccttttgtccagatcagctgtttttttaaaatgtctgactttttttgcatttctaaagaagcgtgagaaatgggctgggagtgcttctgtcctgctgacaccccgcggtgggtccctggagcgcggcctccagctgccgcaatttccatgccaggatatttttccgcaaatcagtcggttgaaattcagaggagtcagaatgactcgacctgtccttcaatgttgataataaatgtctcagccaaaaaccttccttgagctgccatgcttttccccttgacctgcacctcttcccctaaaacttctgcagggaagcccctggcggaggcgccattgaaagcatggtcttgccagtggctggcaaggcggttttgttctgctcagtttctggagagggttggatgcgtcccctgccatccagccctccccgcttgaggccagcactgagtctgggacactcagcgggaagggggctggcatcgccagcgacccacacattcctcacgtagcttctgctcccaggaaggtagtttaaatcctgtatatactttttagagactcttttaaactttctgaagtgctgatgtacatactttctcgtacacacttttgtgaagatttcaaggggaagggagtcgtctgccattcaatgtttacatttatgttctgcaagacgctgtcctcagggaccattaggggaccattctgttcagtgcgatcctgatggtccgggagatgagggtttccggggctagtgatcgtgatcccttttatttgcaactgtaatgagaatttttcacactaacacagcgagggactcaacacgctgattctcctcctgcctctcccgtgagtctccagcctgcccagcaccggcagctgtggagcacgtggatgctgcctaccccggcgcccgcgtcttccacgggcacaggtgtgtggaggccgtggtcggaccctggtgtcctggttactgctgcccgggtgtcttttttttgagtaactgctctctgagttttgcacacgaagttgccctcatctgctggagatcgataaggaaggcacaagacgttctcctctgcccgtgaggagcttcccgcagccgcctggcccagcctgggcacgttctccgaggcatgtgtctccctgctcaccctcgtctgggcacctcagcatctgtggacttgagcgtccaaaaaccctgagtgtgattctgggcagccggcctggcttgaagtccgccatgaccctgggcacaggggaagcccagccgtgggcttaggagagagggaccagcgcccagcgttagggctggaagacggcagtgttcagaattccagccgctcatctgaacacagaaggtgtgaactgacctctaaagcagcgtgagatgggaatgatctagaaaactttggatttttgaagtaaattttaatgtttcatattaatttcttgaaaatgtattaaatgtcattgaaagccttattacgcttttcagatcctttcaataaacaagacttgtagaaaat

SEQ ID NO: 37101 - DNA, 28836 bp, Homo sapiens; identical to SEQ ID NO: 37100

SEQ ID NO: 37102 - DNA, 110870 bp, Homo sapiens
aggaaactcccagggcccgcccaggacccccaagccgccgcggacgcaggtgaggaaccccgctcgcccgcgcctgccctgcggcctccgcggggtccgggtccccctcggaacctgggccggccagggcggcggcggggccgggacggacccccccctcccccccaaccccggcggcgcggcctccccggcggcgcggcctccgggatcgtcctggtccccgcgtcccccaggtcccggccccgggctcccgcgcctcccgggctccaggtccccgcactccctgcactggcttcccggtccctgcgcccccggcctttcggcctcggccccgagctccccgcccccgcgttcaccgcctcgcgcccccggatcccggattccgcgccccggcacatggcacagctccagtggcgaaggaataccttagtgtttgacgtttttgttggaaagtaaggagcaggcagattgttaatgttgcactaaggtcgcgcagcaagatctgaacccgtttttgtttcgtgcccctgtgaggagcggagggagcctggtccgcggagccattccgggcattcttggagagaggagttttgggctttgttaaggaggcgcgatcgttacggaggcagcactgtttcgcacaagcatctgaattgtgtattttaaggctgaaatgcgtgagcttaatttgcagcacattgtgggtgtgacaagaagggtgcaagaataatcgggaaacggggttgatggaacgtgttttaagctgagaggggcgtctggacggtgtcagctccgctattaagtccagtcagggagcggctgctgattgagcccagcgccgcgtggtcgccgctggggactgaggctcgggagcgtttgttttctggcggcggagggcaccgtggctgcgccgggagcggtggtgtttcttgcagtcgtccgtcggactccggaatgaggcgtggtcggagccgcggtgatgcctggtgcagtgcgcacattgctatgcttgacagcttggcggcagagtcccggccaggccgggacccgcgggggccccacgcatgctgccttttccctgcgggtggccagcggttttccaagtgatgtctagatctgcaggcacggagcctggaagaacgagtcacgctgtgagtgggcgcgggccgtagcaggtgtgcactcgtagggccagtagggatatagtgccggtgccctcactgcgaccgaggcgccctggagtcgtggcggaggacgtttcctgcgttaagacaggtgtctgtgctgcgctcaaagaaaatgtaccccctaagtttgtgtgtgtgtttaaatttattttaaacttttagtaagattcactttttggtgttcagttcagtgagctgtagcaggtgcatggactgtagtgacttccaccgcagtcaggatactcaggaaggcagcctctctcctccccgctcttgcagccgcctgtctgttcctcagtcctcctgctttgcccattccagaatgtcacatgtgggcttggagtctggcttgtttcgcttagcataaggcgttggagattcagctatgctctggtttgtccctgaagagtaaagatacaagggtctgaaaagtgtggctctcggatacagcctgagagagagactaaaatgataaagtgatgagaaaaattacaaaactatagttcattaaaaacattaaacagcatagaaccgtgtatactaaaagtgaaattccctcggtacttctaagtagtataatagtcttttctgtgcataagtaattttttaaataacatagtgagatcatattgcatatattatcgtcatacatttttcacttaatgatgtttggttacttaaagatcttagcaatctttacatgttgatatatatagtctgtacacacagatttccctcaatcttttaaataaccgtatagtattccttttttttttttttttttttttttttttttgtgacagagtcttaactctgtggcccagactggagtgcagtgacgcaaactcggctcgccacaacctatgcctcctgggttcaggtggttctcccacctcagccccctgagtagctgggattacaggcacgcaccaccacacccggctaatttttgtctttttagtagagacggggttttgccatgttgcccaggctggtcttgaactcctgacctcaagtgatctgcccgcctcagcctcccaaagtgctggtattacaggcatgagccactgtgcccggccaaatcactatagtattctgtagtgtggatgtttcataattttatcagcctcctgttgattgacattatagttatttactgtttttcaccactacagtcaatgcttgtgtctgtatctttgtgcacatactcaagtttataatgctaaaggtgactttgggtttaaataatagctaacatctccctccctcctttgttttcttttcttttatgttatgttattttattttattttttgtgagacagggttttgctcttgttgcccaggctggagtgcaatggtgtgatctcggctcactgcaacttccacctcctgggttcaagcaattctcctgccccagccttccgagtagctgggattacaggcgcctgccaccacacccagctaatttttgtatttttagtagagacagggttttgccatgttggccaggctggtctcaaactcctgacctcaggtgatccacccacctcggcctcccaacgtgctgggattacaggcgtgaaccaccgcgcccacccaaaacatattttatagtgtgaagttttaactaacatgtccaagctattctcattgtttttcctattaaaatttagccaacccttagaggccattgataaagcatggattaattacactgacataatttaaaaaccttattttagccagtgcaatagtatcagacaaagaaagaaaaggcatacaaattggaaagggaaaattgtccctatttgctgacaacatgattatctacatagaaaatccagggaatctatgaaaaagctactagaactaattaatgaggttagcaaggtcacaagatacaaagtcaacacacagaaggcgaccttatttttcttttttttttttgagacagagtttcattcttgttgcccaggctagagtgcaatggtgcgatctcggcccaccgcaacctctgcctcccgggttcaagcgattctcctgcctcagcctcccgagtagctgggattacaggcatgtgccaccatgtctggctaattttgtgtttttagtagagatggggtttctccgtgttggtcaggctggtctggaactcccaacctcaggtgatccgcctgcctcggcctcccaaagtgctaggattataggcgtgagccaccgggcccggcctggcgaccttatttctgcatacagcagtgccccttatccatggggagatacatgcaaagtcaacactatacaagctgaccttatttctgtttacaacagtccttgttatccatggacgatacgttccaatggaagcctgaaacctgagataagacagaaccctccgtgtactgtggtttttttccctatacatctatgcctatgataaagcttaatttacaaattaggcgcagtaagagattaccaacaataactgttcataatatagaataattatatactgaataaaagttatataaatgtgttctctctttcaaaatatctttttgtatgcactcacctatttttggagggcagttgactgtaggcagctataactggggaaacagaaattgcagataatgaaactacaggtaagtggggactactgtactagcaatgtacaattagaaagttaaatttggctgggcgtggttgctcacgcctgtaatcccagcactttgggaggccgaggcgggcggatcacaagggcaggagttcgagaccagcctggccaacatagtgaaaccctgtctctactaaaaatacaaaaattagttgggcatggtggcgtgcgcctgtagtcccagctactcaggaggctgaagcaggagaatcgcctgaacccgggaggcggaggttgtggtgagccgagatcgcgccactgcagtccagcctgggcaacagagcgagactccgtctcaaaaaaaaaaaaagaaaattaaatttaaaaacacaacatttcgtttgcttcaaaggaatcaaatacttaggtatacattgaataagacttacaggatctgtatgctgaagatgagagaaatcaaagatcatttaagtaaatgggggaacataccatggtcagtggttggaacactcaacatagtaaagacatcagttctcttcatattgatctataaatttaacccaattccaatttaaaaatattagcatgctttaaaaacaaaaattttaaacaaaaattttgtttattgaggtataatatacctactttataaaattcacctacttttaagtatacgtttggctggcctgtgaacgagggggttagggattccaaccccctgtgcagttgaaaatccgagtgtaactttttttgagatggagtttcgctcttattgcccaggatagagtgcaatggcacgatcttggcacactgcaacctctgcctcctgggtttaagccattctcctgcctcagcctcccaagtagcttggattacaggcatgcgccaccactcccactaattttgtatttttagtagagagggggtttcactgtgttggtcaggctgatctcgacctcctgacctcaggtgatctgcccgcctctgcctctgcctcccagagtgctgggattacaggcgttagccaccgagcctggcctttaaccttttttttttttttttttttttttgagacggagtctcgctctgtctcggctcactgcaagctctgcctcccgggttcaagcgattctcctgcctcggcctcctgagtagctgagattacaggcacccgccaccatgcctggctaattttatatttttagtagagatgggatttcaccatgttggccaggctggacaagtataacttttgacttctcaaaagttaaaactacgtgacttcccaaaagttaaaactacgaatagcctgctattgaccagaaaccttactgataacataaacagttgattaacagagattttgtaagttatatgtattacatactgtgttctcataataaagtaagctagagaaaagaaaatgttgttaagaaaatcatgaggaagaggaaataaactgactactcatcacgtggaagtggatcatcagaaaggtctccatcctcaaaaagctcacagtgagcaggccaaggaggaggaagtggatgggttggttttgctgtcttgggggtggcaaaggcagaagtggagggaggtggaaggaggggctagagaggcaggcatacaccgtgtaacttttactggaaaaagtctgcaaataagtggacccgcatggttcaaacacgtgttgtttcagggacaactatacaataatttttagaagatttctggagctgtgcaacaaccatcaccataatccagtttttgtttgtttgttttgagacagggtctcactctgtcacccaggctggagtgcagtggtgtgatctcagcttactgcaacctccgcctcctgggttccagtgattctcatgcctcagcttcccaagtacctgggattacaggaggtgccaccaagcctgactaatttttttgcatttttagtagaggaaggggtttcaccgtgttggccaggctggtctcgaactcctggcctcaagtgattcatctgcctcggcctcccagtactgggattataggcatgagccatcgtgtccggcctgtttttgtttttttaattttaattattttttaaatggagatggggtatcactatgttgcccaggctggtcttgaacttctgggctggagcaatcctcctttcctcctgaaagtgctaggattacagatgtgagccaccaggcccggccttgctcatctgttgatggacagttaggttgattccatgtcttggctgttgtgaaaggtgctgcaataaacatggggtacagcgatctcttggacatacggatttcatttcttttagatatatacccaacagtggtgttgctgggtcatatggtagttctatttttaatattttgaggaacccccggcactgttttctacaatggctatactgatttacatctccaccaacagtgtacaagggtttccctttctccacaccctggacaacacttgttatcttttgcctttttgacaagagccagtctgacaggtgtgaggtgatagctcattgtggttttgatttggattccctgatgattagcgatgttgagcattttttcatacacctgttggccacttgtacaccttcttttgagaaatatccattcagatcttttacaattgagttgtttgaattctttgtatattttcattattaatcccttattagttatatggtttgcagatattttcctgcattctgtagattgtcactttgttgattgattcctttgctgtgcagaacatttttagtttgatgtaatcccatttgtctattttttcttttgtggcctttgcttttgaggctttatttcctcaaaataagccaggcacagaaagacaagtactgcacgatctcactcacatgtggaatctgaaaacgctgatgccacagaagaacagagcagaatggtggttaccagaggctggggtggctggcggaaggggagagaggaagatgttggtcaaaggatacacatttacagttagatacaagggggaaagtccagaataggcaaatatacagagacagagagtagacaggtgattgcctggggccagaaagcaggggagagaggatcagtgaagaacgggtagaaaaagtgagaataactgctaatggttagggagtttcttctcccttttttttttttttttttttttttgacaaggtctcgttctgtcacccaggctggaatgcagtggggcaatcatggcttactgcagccttgcccttttgggcttaagcaattctcccacctcagcctctccagtacctggcactacaggtgtgcaccatcatgcctggctaaattttggttggttgttgttttgtttttttgagacggagtctcactctgtcgcccaggttggagagcagtggcgcgatcttggctcactgcaacctctgtctcccaggttcaaacgattctcctgtctcagcctcctgagtagctgggattacaggtgtgcaccaccatgcccggctaatttttgtatttttagtggaggcagggtttcaccatgttggccaggctagtctcaaactccttacctcaagtgatcctcctgcctcagcctcccaaagtgttgggattacaggtgtgagccaccgcctaatttttgtgtttttttgtagaaataaggtttcaccatgttgctcagactggtctcaaactcctgagctcaggtgatccccctgcctgggcttcgcagggattataggctaagccaccgcacctggccacatttaagtctttaattcatttcgggttgatttttgtctatgttgagaagccaaggtctgatattatttttctgtatgtgtgtatctagttttctcaacaccgtttattgaagaacctatccttttctcattgtgtgttcttggcacctttgttaaaaatcagttggctgcaaatgcatgcatttatttccaggctctattctgttccattggtttatgtgtctgtgtttatgacaatagtgtgctgtttgggttactatatctctgtagttttttttgttttgttttgtttttgagacggagtctcactctgtcacccaggctggagtgcaatggcgcaatcttggatcactgcaacctccgcctcccgggttcaagcgattctcctgcctcagcctcctgagtagctggggattacaggcgtgcgccaccacacccagctaatttttttgtttttagcagagacggtgtttcaccatgttggccaggctggtctcgaactcctgccctcaggtgatccgcccacctcagcctcccaaagtgctgggattacaggcgggagccaccatgcccagcctctgtagtatattctgaagtcaggtagtgtgatgcctccagccttgttcttttgctcaggatagcttttgctattccaagtcttttgtggttccacacaaattttaggatttctttttctatttgcatgaagaatatggtaggtattttgatagagactgcattgaatctgtagattgcattgaatctgtagattgctttgaatctgtagattgcattgaacctgtagattgcattgaatttgtagattgctttgggtactatctattgtttatttattttttgagatgagttacctaggctgttacccaggctggagttcagtggtgcagtcatggctcactgcagctttgatatcctgggctcaagcgatcctcccacttcagcctcctgagtgtctgggactacaggtgtgagccaccacgtgcagctactttttattttatttcttttctttttcttttttctttttttttttgagacagagttttggtcttgttgctcaggctagagtgcaatggcgcaatcttggctcaccgcaacctctgcctcccgtgttcaagcagttctcctgcctcagcctcaagctactcaagctgggattacaggcgcccactaccacgcctggctaattttgtatttttagcagagatagggtttctgcatggtggtcaggctggtctggaactcctgacctcaagcgatctgcctgccttggcctcccaaagtgctgggattacaggcatgagccatcacgcccagccttattttattttttagtagagacaaggtctagctgtgttgcccaggctagtcttgaactcttgagctcaagtgatcctcccacctcatcctcacaaagtgttgggattacagatgtgagcaacagcacctggtctattaattctgttgttgccagtgtttttggtgtcatatccaagaaatcattgccaaatctgatgtcatgaagcatttctcctgttttcttctaagagttttatagttttagatccgatgtttaggcgttgatctgttttgaattaacttttcttttttgtgtgtgtgtttggttttttttcgagacagatccttgctctgtcgcccaggctggagtgcggtggcgcaatctcggctcactgcaagctccgcctcccgggttcaagcgattctcctgcctcagcctctctaggagctgggattacaggcccccgccaccacacccagctaattttttgtatttttagtagagacgggatttcaccgtgttagccaggatggtctcgatctcttgaccttgtgatctgcccgactcggcctcccaaagtgctgggattacaggagtgagccaccacgccaggccaaattaacttttctgtatattatataaggtaatggtccaacataattcatgtatgtgtggatattcagttttcctaacacaatttgttgaaaagactattctttttccattgaatgatcttgacatcattgttgaaaattgtttggccacatatgtgaaggtttatgtctgggttctttgttctgtttaattggccagtatgcctttctttatgccagtgccacactgtttcaattactgtagctttatggtaagttttgaaataaaaaggagtgaagtctccaactttgttcatctttttcaagattgctttggctattctgggtccttggagattcctatgaattttaaaatgggttatttttgcaaaaacaaagtgctgttggaattttcaaagggattgcattgagtctttagaaggctttggattgtattgtcatcttaacaatattatgtcttccaatccattaacaaagatgtctttccatttgtttgtatttaatttctttcagcagtgttttatattttttagtgtgtaagtctttcacctccttgattatatttttttaaattgaaacttgtatttagccattttgagactaatatcttgaataagtaaaattcatttacactacattcttcatcttttggatgctgttgtacatggaattaatttccttttgggattgttcattgctaaaatatagaaatgcaactgatttttacatgttgcttttgtatcctgcaacttccctgaattcgtttattagctctaactaataattattatggaatctttgggatttactacatataaaatcatgtcatccagagtttcatgtgttatgaggcacagagggactacctttttatcataatgtttgtagtaatttttgtccgcaggtctgttttgtctaatacttgtctaatgttagtattgccacttccctctcttttggttactctttgcatggtatgtccttttgcgttcttttagtttcaccgtacttgtatttttatatttaaaatttgtttctagtggatagcatatagttggttcatgttttctgtttactctgtaaatctctgccttttgatttgagtatcttgttcatttacatttaatgcaaatatgtatgtagtgggatttacatctgtcattttgttatttgttctctttatgtcttatatccagagagctgatggccacagcagctccggcctgatttctaataggagggttatctaatagaaggatttcagagcattccagggacaagatttgcatttgtatgaatttttttgtgttaaaagcctcttagaacatggtctcaagaaattagggatgtgtttttcaccatcgtgttggtttaagcctgatgtgcatctgtgctattcagcacaagctcactgggcatttgttttcctggtcgctccccctccaactttattacgactgcatttccttcacgcacagcccatgccgtgggctgtggcttggccctccatgggggcagaggtgatgtctgttgaactgtggctcccaggttttttagatgggaataagacagatgtacagtgatagccgctgtgaccttgtcatgccctgttctttgctttccccttcacattcacatttgcatcacaggggagggggaaaaaagcccaaaacactctgaaagcagtgggtttcatcttgaaacctgattccatagccaaaatttgatgctcagagcctgtgtggtcactccttgcagtcatgttttcctggccaggacagtggggatgagtgttgatttgtccttgaagatactcacagaaggagatgtgcttgctctgaagaaccacatagccccacagctgaagtggtgaagttctgcattacatttgaatccctgtccaaagctcaacttctcaagctgttcctagaaggaccagtctccacgaaaccagtgagccttaacaccacctggactcatggctcagtggggccagctgcccccagagatcattgaataactgtatgtgttaaattgagtagacttgtgcatatgaacaaaaacttcactgactcttgagaggtagccttgttcctgtcaaggagaccacagggataaggttttcatatgcacaagttgtgttttcttgtttgtcgtgatgacagggtgtggaggtggtagaggtgatgtattagtcagggttctccagagaaacagaagcagcaggatacgtgtggatgtgcgtctagagagatttattttaaggatctgactcacaattgtagaggctggcaagtccagcgtttgcaaggcaggcccataggctaaagacccggggaaaagctgatgttgaaggcagcctgaaggcaagattccctctttcttaggagaggtcagtcttttttctttcaaggcctgcactggttggatgaggcccacccaaattatggagggtaatttgtttcattcagagtctactggtatagatgttaatctcatctaaaaagtactttcatagcaatgtttagattggagttggaccaaaaactgggtaccatggcctggccaagttgacacataaaagcaaccatcacagggattgatttttattttgtatttaaataatttgcgttttatttttatttatttatttattttttgagatggagtctcgctgtgtcgcccaagctggagtgcagtggcgctatcttggctcactgcaacctccacctccctggttcaagcgattctcctgcctcagcctcttgagtagctgggattacaggcgtgtgccaccacgcctggctaatttttgtgtttttagtagagacggggtttcaccatattggtcaggctgttctcaaactcctgacctcaagtgatctgcctgtgtcagcctcccagagtgctgacttcttttctttttgagatggggtctcactgtgtagcccaggctggtcatgaactcctgggctcaagtgatcctcccacctcaacctcccaaagtgctgggattacaggagccaccatgcccggccttcttgtatttcagtcacacatttcaggctgacctcactggtcacatggaattgactgtgacctgtgatgggcacctgagaagcctctggagctcttggttgccctgattctatcccaggcccaggtggagggcagatgtgctgtgttgtagctgcgggctgtggtggggtgctatgttgtagctgcgggctgtggtggggccgggccctggaagtgtgtgtgaagacacaggccggcacatgtcttcccacacactgtgagcaggaaaggttcaggtgccccgagttcttcctcttcacatatgtcggccgcactcctgtagacttagccaagactacatggtggaaagtgcgattggaactctgtgcttcaggaactttgtgatttcatttagtgagatctgggagcgtgctctgaagtcacctgtcctgagcccctcagccagcagggcttagtcgggccccgtccaggccattgtcacttttgaggaagactctccaagatttataaacaggtggtgggtgacctgcccattgtagtccataacctgttgctgccagcagctcctgggaaggggcgataggagagcactgcctccttgtcccgtgtcccaaccgatgctagagccagtgcttcaggtattcaggtacctcaggttgcttggaaaagtttaaataaattatgcttacttattaagtattctcttttcatcttttatcagctttttttattggctcccctgcagaaaaaaaaaaaggcagaggtgattttgggaactgcggcgtcccctcggcatctctgaacatgcgccaccgtctgtgtgttcatcaacgtaaagctgtctgttctggctgttgctgtctcatacagtgtgtgcaccagatgctagcgagtcttacacagatgctgtcgagatgtaggaggcagcgttgctgtgtctgctgctcatcgtggggtctttccacatgctgccaagcgggttccctttctccacaaacttggagcgagggtctcggtgggctgtcatgggtgcagactcttagttgagaaatcttcaggatggcattgcctttctgcagcctgttgttggccacaactcaggtccttcttcatccccggcaggaacaaacccctcctaagcttttgtgtatttatctgctaaggctgccaaaacacagtaccagcgactgggtggcctcaccacagacatagtatttgctcacagttctggaggctggacatccaagatcacagtgtgggcaggttggttccctctgtggcctgtctccttggcttgcagatggccgtcctctccctgcgtccttgcgtggtcttctctctgtgtgcatctgtgtcctaatcttgtcttttttttttttttttgagacggagttttgcttttgttgcccaggctggagtgcagtggcgtgatctgggcccaccgcaacctctgcctcccgggttcgagcgattctcctgcctcagccttctgagtagctgggatttcagtgtgtagctgggattacaggcccacgccaccacgcctggctaattttgtatttttttttttagtagagacggggtttctccatgttggtcaggctggtctcgaactcctgacctcaggtgatccacccgcctcggcctcccaaagtgttgggattacaggtgtgatccactgcacccgacctaatctccttgtcttataaggacccagtcctattggatgagggcccaccctgatggattcattttaacttaattatctctgtaaagaacggaagcattctgaggtcctgggggttaaggcttcaacacacgaattttgagagcacacagttcagcccataacagtttgttttgttaaaacgtgggctcttcattatcgcctttgatcccctgggccaagcccttgttgatggggcgcccctgaactctcagagccatggactcctgctgctctggggacaccagggcagcgggaaggggctggggcctggtgtgtccgctactagggaagcctaattcgttatccctgttagataaaaatacaggtgctctagtatttgcttctgtcattccaaggaatcacagtcatgcatcacttaccaacagggatatgttctgagaaatgcattgttaggcacttttgtcattgtgtgggcatcataaagggcacttacacacacccagatggtactgcctgctgcacgcctaggctccacgctagagcctgttgctcccaggccacacgcctgtgcagtgtgttactgcagtgaacactgtggttaagagtatttgtgtatccaagtttacgtaaacatagaaatggtacagtgacaccatctcagctcaccacaacctctgccttccaggttcaagcaattctcctgcctcagcctcccaagtagctgggattacaggcgtacgccaccacacctggctaatttttgtatttttagtagagacgaggtttcaccacgttggctgggctggtctcgaactcctgacctcaggtgatccgcctgccttggcctctcaaagtgttgggactataggcgtgagccaccacacccagacagtaatttaggatgtttttaagtaattttaagtttagagtatttttacgtaaaatctagcactttttggttacctgtatgttgatatgtttattaatatatgtgtacacacacacacacacacacacacacacacacacaatggaatactattcagcctttaaaaagaaggaaatcctgtcatttgtgacaaggataaacctggaagacattacgcttagtaaaataagccaggcccagaaagacagatactgcatgacctgatttctatgtggaatctagaaaatttgagctcatagaagcagagagtagaatgagggtcgctgcaaataacccatctgggcaggcagacggggctggggttggcatccatctcctgccgtttctcggctctgtgaatttggacaaatcactttctctggccctcaatttcgccgtctctaaagaaggggttgaatgagctcagacagcccaaggcttcacgaagtgcaagcggctgagatgtgctggtgttgaaggtgattgaggacagggtggggtccctttttcccagagggaacatggagccctgtgtctcaggtgcccgtggcatcttcgccggctgcacttggttcccgactccccggggagctgccgggcaggggaaactgccctgctggcctggggcaccgtggccgaggtcagccaaaggccaagacctgccttcttgctggggctggaggctgcttcctgccttccaggctgcggagtctgctggcagggctgccgggtgtgtgtgtgtgtgtgtgtgtgtgtgtgtgtgtgtgtgtgtgtgtgtgtgtgtgagtgatgaggttgcggagtctgctggtggggccgccagttgtgtgtgtgtgtgtgtgtgtgtgtgtgtgtgtgtgtgtggtgaggaggagtggactcactctgcatgggggtggggtagggttcacatattttaagctcatcatctggctgggaaagtagctgctcttgctccagaaagggaaaaaaaaaaaaaaagtatgtgaagtgatacatatgcgtaatagctcgatttaaccattccacaaggtacacatatatgtaaacctctgattgtatgcagtaaatatatacaatttttatttgtcaacaataccttaatttatataaaaacatgtgaatccatagtttctgtctcataataaattagtttggcccatccacaaaaaacaaaacccagctcttttgcaatgatctgaagcattctgattataacactgatgtttattcccggggctgactgggcctggaaggtcctttctacaagccgtcctcatgaaggcatggtgtccaggcatctctcacaactgggggttaaaagctttctgcccaggagtgcgtgactctgggcaaaaccttcctctaggcagacgcgggcatgttgtggccgtgctctggctggtgagatgggttcagcctgcgatacgtgccagcgtccagcctgcccggggccataggagtgaggggcgaccaaaacacacttccgcttgaagagtcggggcaagtctgtttgagacatttcccattcctttcccttatgttcacaaaaagttttcagggggatatttcattctttcttatgttatgttatgttatgttatgttatgttatgttatgttatgttatgttatgttatgttatttttgaaacagagttttgctcttgttgcccaggctggagtgcaatggcacagtcttggctcactgcaacctccacctcctggattgaagcgattctcctgcctcagcctcttgagtagctgggactacaggcatctgccaccacgcccatctaattctgtatttttagtagggacggggtttctccatattggtcaggctgacctcaggtgatcgcccgcctctgcctcccaaagtgctgagattacaggtgtgagccaccgcgtctggcctttcttactcattttaaataacttcaaacttatacaaaacattgcaaaaataaaaataggacaaagaacacaattcaaacacttctctctccacttgaggccctttacctctagacacatcagtgtctatttcctaagaatgaggatgttctcttgtgtgccacaggacacttgtccactactggccctgtttagaaaatgcttgccgagccctgtgctggagcatgtgttgcccaggtattcatgtgtaagaatgttcctcagaggtcatgacagccaagtgtctgcaaatggcattggttctgagcagcaggagacaggacatgtagcctggtttgttggttgggtggaatagcacgcacacgtcaacatggtgcttcaggagcaccgcctggcagcgtgcatgcgtctcgtaatagcagtgggcacagtatgaataggtcaggtgactatatatagatgatatcccttttataacaactcaactgaaaggtgctttttaagaatatagatgagctatggccgggcgtggtggctcacgtctgtaatctcagcactttgggaggccgaggctggtggatcacctgaggtcgggagttcgagaccagcttgaccaacatggagaaatcctgtctctactaaaaaaaaataacaaaatttagccgggcatggtggcgcacacctgtaatcccagctactcgggaggcttaggcacgagaatagcttgaaccagggaggcggaggtggtggtgagctgagattgtaccattgtattccagcgtgggcaacaagagcaaaactccgtctcaagaaaaaaaaaaagaaaaaaaagaagaatatagatgagatacagtttatgcagaagaaagcaggggatcgatgcctgggggtgcagagcaggggctcactgtggatcacaagcaggactctgcctttcggtgtgggcagtgagttcgcacgtctttgacatcattaaacattactaattatggtgagagcaggtcagagtccaagaattattatgtatctgagtcccagttttaaaaatcctactaccaatcagtttgctgaaatttttattgatctcaagattacttttaaatgaattatctgagattacctatagtagtgctgccttgacactgtttctcacctgagcagctgtttggcttcccatagtggccacagcaatttgcagaaactggggctatgattagaaactgcttccttccctgggcctgggctggcagacttcttcctccttggtaaatttagaagtgaaacaggaaattccaaagggaaaagctaatatgataaaaagttaaaacttagtttcaaagaaaatagtaagtgaaatgaaaaagaaagtagcttgacctggaaaaagttttgtagcaattctcacaaagctttaatatctttaacgttgttagtatagtaagtccatctgtcagttgctgaggaaaataccaagattccaaggattttaaaaaaacaaacaggcaaacaacccaagctggcaagttacaaatgaagaaaaacaggcagggggaagtggctcgttcctgtaatttcagcatctttgggaggctgaggctggaggatctcttgagcttaggagttcaagaccagcctgtgcaacaaggcaagactctgtctctacaaaaaatcaaaaaaattagccagacgtggtggtgcacacctgtagtcccagctacctggggggctgaggtgggaggatcacttgagcctgagaagttgaggctgcagtaagctgttatcacaccactgcacttcagcctggttgacagtgagaccctgtctcaaaaaagaagaaaaacaaactggttaatgcatagaaatatgtttcatctcagtgataatacaagaaatgaaaattaaggccaggcacagtggctcatgcctgcaatctcagcgctttggaaggccaaagccggcggatcacttgaggtcaggagttcgagaccagcctggccaacatggtgaaaccccgtctctactaaaaatacaaacattagcccggcatggtggcgagcccctgtaatcccagcttctcgggaggctgaggcaggagaatcacttgaagacaggaggcggaggttgcagtgagtcgagatcatgccacttgcactccagcctgggtgacagtgagactccatcttaaaaataaataaaatataaataaataaataaataaataaatgaaatacaaattaaaagaacattcagattaaattataaaaacagaagtgacccctggattctgttgggaagcgccatgctactgtccggctccaccttgttcgtgggcccccgtaggagggcacctggcccaaagccacctgcagctttagagacattgtgtgacctaagaaacctcctgggatgtgctgctaggaaagtcatctgcaaacacactccaggcttttccgcccagatgtggtattgtcaggcttgtctcatgcctaagcaggaggagggcgggccgccctgaagcaggctgcggttcatgcatgggccagtggtgtttccttcacatgttctggatgtgcaggtgttgctgtaatggtggaaaagatttatatgacctcagtgaaagagctgctttctgcttttgttcctttgatggacagctaaatggcctggatacctttcccacagttttcgtgaagacccggagctttaagatcaggattctggtttacctgagaagctccccgttaggtccctgctcggttcacagtcactggggatgttctgtggcaccgcctgcttatggagctcctgtctctgcaggacgtctccggcaaggtgcctgggacatcccagagcacgagcccgctgaaatggggcacccgaaggcacagaccaccccactgcgtgggacctgtgaggtgtcttggtgcatgtggaggaagctggtgaggttgatgctggtgtttccagcccaagtgtcttgacagcaggacccttgatagagattggcgagtgaggtgtagtgtaggtggtagctaaggtcatgggcttgacctcaggctggaggcagtaggggatcccaggagacactctgcccacgggctgggcacagtggtggagcccgggagacactcggcccacaggccaggcgcagtaggggagcctgcagctcctcgtgggtgcacttggtgcaggagaagggctgggctgctactgggctatgccagaccctggcagggccaggccacatccaggccagccacgtggggattcggggattcaggtccttacaggggagggagagacaggaaaagaacaggcacatcaggaggtgtggatgctgggtgaagatgatctggtggctgccgtgtagcctttggtcatcaacctgcaccctcctgggccctgagaggagaacctgagaggctggtggggagggggagcacggggctcgatcgcccgtggcgcctgttcctcagccgggcgccgcaggacccagcagatacacggtctgttgggcacagtgataaggtgggggacaaggtgggtggcagccagttccctttccttcaagccgcaggaatcagagcaggctgagagcccccagccagaatggccagcggtggaattgctttgtcaagcgcccgaggtcatgcttggtgcccagccgagcccatggcctcctgagcaggcgggactgcccggccatgcgggccacgccactgaggcacgtgaggcaagccacggggctgcggcagctccctgtccctctgggctcagtgtcggcatctgtgaatggggacccccactcttctcctgagcgtgggagcgccccctctgtggtgtgactgtcctcccggagaccgccatggtgggtctgccctaacagaaagagtaggtggagcgggaaacgctgtcttcttccctttgtgccttttaaacatgcactggattcgggtgaaagatgaaggaatggccgtcgtcgaggagcactccttaattgtttatgctgtctgtgtgttgcccaggtgcacacaggtgggaaagaaacagcccctcccaccagcctgatccctacccaacccaggcatctgccaggtgggctgatggagcttccccgagctcatctgtgtgcctggtagcccagccctgggctgaggtgcatgttctcattgtcctgagggccccacctggggcagtgggactggtggatggcacagcgggtcctccatggcccaggggtgtgggagatggagggaggcccttgggtgttctatgagcgattgagactttattctgtggaatactgggccccatctctgccttttattaattattttagcatccgaatagtttttttcatacaaatttgacagataaagacagaactgctctcccttgccctcctggggcactctggggtttcatggcgcatggtttgaaaaccacagctgtaggcagagagagccagtgaaagcgtgagcaggagagtgacaggaagagaagcagaggtgagtgcaggtttggcggtgcctgggggatcagagggaagcctgggggagggcgatgttaggaggttgtgagaccacttggtcttgggagacccctcccagaggcagcctgaccctggccgaaggggctgcagccccaaggtggggggcggaggccatgtggcgtggagacgtgctctctttcagggttccttggcacactgttttagatgtcagcacctcattgtgattttcaaacttgatttctgtttctctgttgatgaggctgttcttttgagctggttttgagtggccgcttttgaggatggaatttgaagtttttgtgcattaaagaaagcagattacctcacacctgtaatcccagcacttggagaggccgaggcaggcagatcacctgaggtcaggagttcaaaaccagcctgaccaacatggtgaaaccccgtctctattagaaatacaaaaattagccaggtgtggtggcgggtgcctgtaatcccagctacttgagaggctgaggcaggaaaattgcttgaacctgggaggcagaggttgcagtgagccgagattgcgccagcccgggtgacaagaacgagactccatttcaaaaaaaaaaaaaaagcaaattacttcagtaataaagctagtctagaagatgttatattggtttttaactatgcactgtttgccttgctggtcatgacagcctgtttctgtgctgcagccgtgcggtcaggccgtttaacctggggaaaaccagctgcagccatgctggcgcggtcccctgcttccaaatacagaagagcacattctttctacacctgggagagaaagggacagcaaagtatgcttttcttcttcagatgatttattttatgcctattttacatgaacagcttgcacaaaaatattggaagtttctacttttctgggaagtgccatcattttgcatatagaagaggaagaaaatcagctcatgccttgtgcacgtttgcagaaacatttcatagtttgtctttgtttgattatgctgtttagctggacaagtggaatgcttacaagttgtaacattttttgttttttgagatggagtcttgctctgtcgcccaggctggagtgcagtgacacgatctcggctcactgcaagctccgcctcctgggttcacgccattctcctgcctcagcctccctagtagctggcactacaggcgcccgccaccatgcctggctaattttttgtatttttagtagaggtggggtttcaccgtgttagctaggatggtcttgatctcctgacctcgtgatccacctgcctcggcctcccaaagtgctgggattacaggtgtgagccactgcgcccggccaattttttgtatttttagtagagatgaggtttcaccgtgttagccaggattgtctagatctcctgacctcgtgatccgcctgcctcggcctcccagagtgctgggattacaggcgtgagccaccgtgcccggccacaagttgtaaaatttttaaatgactggtttagaaatgctgggaagaccctctttctagcaaagcatctctccacctgtctcagtgcgggctgcagtggcgggagttagcgtcggcgtgccgcctgccacagcactgccgcctgcgtggcaccgacgccttcgcttctgcattttctggattgtggcttctccacattttgcaaccttggtgttgagctgtcttggcagtttctattttaacacctaaagagatgactgttcggtccctgtgaaaagctccctcttgacctagggtggaaagagaagtaaatacatctcaaaagtttatcctctaatgtggtaaaatacaaggtccctccgtggccaggggctggctggagcgggcagtgcacgttgtccctgtgtgtgcagccaccattctgctgtgtgctcgctggcatcttgggagcctgggcccggccagagtggccgcatgcacactgctgtctcggggcggcagtggggccgtggggccatctggatggtgtggccacccgttccccctttaccagcccccacccttcctggccacctgccccgagcctcccctgagatgccccgtctccagagcccctgacttgtttgactcctttgttttgtctggtgtccaaggccggtttcccacggggcctgtgttctcccagggatgctggcttattgaagacacacacactcacacacatacacactcacacatacaaactttttttttccttttcccttttaatctcttggcaccacctctgcttccaggttaaagttagtcttggctgctttaatttccatttgtttttgcagcctagtagtgtcttttttcattttcaagactgttgagttatgccaggactcagggttatgacctactgactgagctgcctgctgagcacgagagacatctctttcttcccagccacctgccctcatgctgctcagacacagggaaaaggaccaaatcatatttatttattttttttgagacagagtctcactctgtcgcccaggctggagtgcagtggcgcgatctcagctcactacaacctccgcctcctgggttcaagtgattctcatgcctcagtttcccaagtagctgggattacaggcacctaccaccatgcccagctgatttttgtatttttagtagaggaagtatttcgccatgttagccaggctggtctcaaactcctgacctcaagcctcggtctcccaaagtgctgggattagagaagtgagccactgtgcccagccccaaatcacatttaaaaaaaattctgttgattcactgttctttgttttgaagcatgtgatgattgtgaggttttacaaaaatcaccctcccatctcctgggatgtctgctgtgtggagaagtgaggtccagggtctctctgggaactgggttccccaagggcagcatggggaggcactggctgatgccctgagcccgtgagcttgcagggggagtgtggcgagggctggccacatctagatgggttaaagaccaggagcctgggcggatctgcccgttttctagttggtggaagcactggtgcatgcctcctttgcctttgccccttggcctgctgtctccaactttctccagcatcttcagggctctgctggggccagcagggtccttgaccctgctcccctgcctccccagcccctgctgcctgcccacgccggggcaactctgtctgtggctccagctccatgctgcctctgtcctgcccctcaggcctaaatcggtctccagcacctcactcgcacttggaaagtggccatctgtacctctgtgcctctggccttgaccccctgggtgggcacccggcactgggtcagggcggttctcaaccttgctctgtggctgtgggccctggggcagctggcgaccccatccagcctccctccactcatttgccaatgtgtcagggtggcctccaccttaaggcagctgtgaggaccacttcttgagactgcatctgtgtggatctgaggctgaggggcagccagtgacatgtggaagaaaggaggtggacccatggagcccccagcatgccctgtaggcactgcccttcaagtgggtggcactgggaacctttgcctcctgcccaccgtgggtcccttgaagcccatctggggttccacgatccagcaggtgagtgaggtgtgcagcatgatgtgagctcagacacggagccagtctgccaccgcccggtggatgttgctcactctgtaaactgccctgcagctgcctagagcagaggtgcatcccgacccatgagacactcagagattgacccgggactctgaggacatcactggaagagcagccaagtatgatgatgtcctcctttgaaatctttatttttaaaaactcttaaatttacaaaataaacgaactgatggcttattaaaacagcagttcccctaccatatttaaattcatttttatatcttgacaagctataggatttggaatcaaacatgagggttgagaactgctgctgatagaaaatcagtcagggaaggaaaaaacatctctttatgttgttcaatgacataaaccgagggtgggcatgttatttttgggtcggttcgccgcctggggaggccgggggcacaggcagctggaactgtggcatggtagcgccttgtgaccgagctcatgcaggtctggctggcttgttttgttcccagcagtgtgctctttctgcatggagcacgtattattttcatgatcagcaaaataccagctcgtgtgggttcttacctggcagacagcgcagggaatctgcgtcccacctgggtgactccgtcctacctgttcttggctctgtgttcatttgccagggctaccattaacaaaacaccacagatcaggcaggaatttctttctctcagttctggagctgggagtctgagatcagggggccagcagggttggcctctcttgtgaatggccaccttctctctgtgtcctctcgtggtcttccctctgtgcctggtcacgcattgccctgctctgatcaggccccaagcagtggacatcaatgtacctgtccacacgagctgaaggagcagagacagaaatgcgatcctattgtttttgtttttgtttttgtttttttgagacagtcttcgctctgtcacccaggctggagtgcagtggcgcgatcttggctcactgcaagctccgcctcccgggttcacgccattttcctgcctcagcctcccgagtagctgggactacaggcgcccgccaccacgcctggctaatttttttgtatttttaatagagacggagtttcactgtattagccaggatggtctcgatctcctgacttcgtgatccacccgcctcggcctcccaaagtgctgggattacaggcgtgagccactgcaccaggccctgatcctattgttaaactctaaagtgctggctagtagcaccggcagaacagtttgtatgccgttccaaatacgtgactttaattatgctgttggatatttgcactgtggcagccacttataaaggctggtcagatacaactgaggctccattccaagggcagtggacactggctttgcagtgaccaggccagacctggtgctgctgcctgggaatgggggcttcttagacacagaaggagactagaggctgtgctggatgctggtgctgggggaaaatccctgtgggacgtggcattcatgggaggacaaaaggagggccggaaaaaatcccagggtgcaggcggctggagtcacgcattgcctttgttctctagcagtggggtgcagggtccgctggtggcagttagagacggagcaaagtaaatgcacttgaaagagctttgggaggtggaactgtgaggagtcagagaacaagatgggatgagacatgagctctgatgtgcctgtgtggagtggacaccgccagggcccccacgctggctctgtaggtggcacccaggccagaccctgcacccacgctgccagggctgagaccttggagacttggatttagagctgattactccaagtccgcctaacagggtgaggcagaagctgtgcagattcgcatctatggaagatgcacggacggagagcccttggaagcgggccgggcccaggccgtgtgcgtgcggtgacagctgcttggcatcacacaccaaggcggatgtgggagggctgcctatgatcatgaaaaacctgaaatatgaaaatgtgaagaataggagagaacagcagtttgccacagcagggccctggccagcactccgcacggtgctctgatgacttgagaaattttgtggaagctgggagaaagaaagagcttacaaagcagtttgtatgacagtatcttgtttttgtaagggacagtgggatgattgatgataggttttctttttccttttccatgttttctgattaatcagcatcaaacattgctatttttgattgtagtaaaatatgcatgcataacataaactttacccccatgtttaccttttttttttttttttgagatggagtctcacctcactctgtcgctggggttggagtgcagtggtgcgatctcagctcactgcaacctccgcctcctgggttcaagtgattctcctgcctcagcctcctgagtagctgggattacaggcacctgtcactatgcccagctaattttttgtatttttagtagagatggcgtttcaccatattgtccaggctggtctcgaactcctgacctcgtgattcgcccgcctcggcctcctgaagtgccaggattataggctggagccaccgcgtcctcccccatcttcaccattttaagtgtacagctcagtggcgttaagtacatttcaccttattctgcaaccaccaccactgtccagctagagcgtttcatctttccaagccgaaactctgtatccactaaacaccaactccccagcccagcacgcagcccctgtcaccactgttctcctttctgtctctgagtttgaccactttaggtaatttatatgagtggaatcatgcggcgttttttcttttgtgactggcgtatttcacttagcctaaggtcgttaaggttcaaccatgttgtaacttgtcagaatttcctttcttttaaggctaacattccactgaccacataaatactgttatttttatacaaagaaagaagtctgcaagcactggcttggaacaagctgcgcatctggcgtttttccatgggttcaacaagctgcgttatctggtgtttttccgtgggttcaacaagctgcgcatctggcgtttttccgtgggttcgacatcagtggtccctgctgtggatcacagctgacgcacgagcagttctcccccgagcctgtctgtggcgcccctccccaccttcctccaccatggggtcatcttggcctctcctgggcagaggccggggaggaaggcgagtccctgtgggtgctgcgcggggtcaggggctgttgccatgtgggatctgtggcttcccagggtgctcggtccgacctgtcttcttgttgacccgcgtggggcccgggcatgactggacacgcccccaggcctctcctggcactatctgggttcaggccgcagaaagggcagactgcgggactctgggctggagtcgcaggacacgggcagcccctatggggccgaagcacgtcctcaggcagcctggcccctccgagcggcatcaccctgaggtgcctgcgtggacaccaagggcaggccccccatgctggctctgcaggcagcgctggggctggaccctgcacccacccggccggggctgccctgcactgctcctttctgaggtgtgtggaacaggaagctgtgatgtggagggaagtggacgagagtttctgctacatgtagatttctagtgaggaacatgcagcagtgaccggctgcggtcgggggcgttcccttacgtgtcggggaggtccaggtggctggcggtgcggccggtgcctctgttctccctcatttccagtcagttcctgagaaaatgggtggcgtctccagccgccattggggattggcctgcaattgtttccatgtatctgtggaaccggcccaacaccccgcgtggatgcctgagcctggagactgtactgaaccctgcgtagtctatgtttttccgtacttgcataccagtgacgaactttaattggtaaattaggcacggtaagagattacaataataatagaacagttgtaacaatatactgtcataaaagttatgtgaacgtggtctctctctctctctcttgccctttggtgcccgccgtgagatggcggtgagatgggcggcgcaggcattgcaatgcagccttaggccgctgctgaccttgaccagcctggccataccgctgcagtcccatgctggcgacccagccggctactgtgtggctcacaggcgggtcgcacatacagcttggacacgctggacaaggggatggtttgtgtcctgggtgggaggagcaggacggtctgagagtttatcatcctactcagaacagcgcacagtttaaaacttacggagtgtttgtgaatggagttttccgtttaatatttttggagtgcagttgacctctggtcattgaaatcgtggaaagtgaaactgagattcgggggtggctatggcatttcttcttccagctctgtcagcttttgcctagtgtaacgtgaaggaagctttttggccgggtgcattcacattgagggttgttctggctccttggggagctgaccccttccttctctctctctgatgagttccttgctcggaggctggctgggtctggtgctgacaaagccaccccagcttccttttggccagcgcttgcctggttcacctttttccccttttgctttcgacttacctacctgtatcagtatatttgaagtaagtttcttgtagatggcatatggttgggttaggattttatttatctgttctgacaacctcttctaattggtgtttttagattattatgatagtgtaattatcaatgtgtttcgattcaggtctaccattttattatctgacttctgttagatcactatctttatcattgctctatttccttttaggtttttaaaaacatagtattctgttttaatttattctaaattatatgttatctattttgctttggatagcttttttaaaaagtatgttaatttttctttttttaaaagaggcaggatttcactgtgttgcccagacaggccttgaactcctggactcaagtgatcctcccttctcagcctcccaagtagctgggactgcagcgcctggctgtacagctttcttcggtggttgctctaaggatttcgaagtccatgcttattaacatttcatattctgctgaggatctgaaaagtctgctttttactacttctagtgggacatagaaatcttaccccatccaggtttcccctcccccttttagattacagttgtcttgtttatatgatttatacaattatatacctagaaatattttataatttacttgttatgtatttgtgtaatttacatttatgtacactgaaaggcccattagacagtactttgatttttgcttttaaccgccaagcactttggaagagctgtggggtcgttgtgtgtcctgcgccctcgccgcttagcctgcctactgcctctgctttgtggttcgtagcccatgcctccttccacctcccttcctgtcagcctgtaccgctggccagcatgctctttgttttcctcctctgcccacgtcctggcttcaccttccttcctggaagacacgttcccatcttgagggaggatcccaagttggcacctccccgctttaggcttaggcgcattgtgcccgccttccggcccgcctggtccccgctttaggcttaggcacattgtgcccgccctccggcctgcctggtccccggggggaatccgcggccctcccactgttgctctgtgctctgctgagcgtcatttctcctgctgttttcaagatctgttttcctttatctttagtgttcagcagtttgaccgtgatgtgtctgggtgtggatttcttgtttgtcttgtttgggatccatagagcttcttgaatctgtagacaaaagactttctccaaatttagggtgttttctgtcatttttttcagctgtttttcatcactgcttggtttccccttttccttttgcactctcatggcacagatgttagaccttctctcttgtcctgaagatccccaaaattttttcaatctttttttctctctggtattcagattagaaaacttaacattgctctatcttcaagttcactgaatctttcctgaggtttttttttttttttacatttcagtagtgtgtcttttagttttgaaatttccatttggttcttctttatatcttgttttgtttgccttttgctgatttccattttttcattcagtttgggagtgttacaatcgttagagcatttcatagcacagtagttgctttaaagtcgggtggataattgcagcacctgtgttattttggcatctgttgattctcttttcctgtaggagcccatacgttcctcgttctttgtgtgctgagtaatctgggctgtaagtggatggttggatgttatgatatgagatctgggtcttgttaaaatcctaggaggatgttgatatttttattttagaaagcaaacaccctgaggagacttgggctgtggttctgacttgccttcagtgggtggcagctccatgtcaattctggcttcacagcctcctgcactgccacttggacctgccccctgtgtgccgctggtggctgtctggctgtggtctcagggtttggggtgtgaagaggatcagatccacacccctgcagcttgaggatgggcttgaagctcatgagcaattttgtcggctggctcttctgagctgcttcctctccacactgccactggggcttcctgggtccctggagagcttcccttctccaccctcagccagtgcagtgggactgactacccgttccactgtgcacctccatgcctgcgccagtgctggaggagggatttggggctccttctgttcagtgtctcctccaggccacctgctgctctttccttcatagaatgtggctcagctgcccctggtcccatcccagggcagagctcctcctgagtacccttgagactggagcagattcagcagaaggcagattgccccctctccctggagctggctctgaaggtgtgtttagacgatgtctgccttcatttctgcacctctgctccagctgcggtgtggcactttctgtcccctgcggcagccccatactccttgcaatctcagcctgtctgtgcagctagacagctggtgttgggcggcagggcgctcgtcttttccatgtcaggccctagtgtgtttggaggcaccacctgggaggtggctgcatttagggaggctctgctgggcagatgtggcattggagaggtgctgcccctccagcactttgagggggtcgtcagaccctcgagagagtcctcagcaccagcaactcaggacggcggcccccatggtgggaaggatggcaggaaccatgtgccccatactgtgaccctcctggaggccaggagagcctgttctcagcgagtgtggaaggataagctgcacagggcctcccagcctgctggcccacgtgccctgagagagacacgcaactcccaaggactgatcatgcccctgtcagccatgtccggtgccctcgggagagcgggaaggggttagaggcctgggtacccaacctcgaagcttgttgggtgtcccctccttctcctcacagaacaggggtccttatgtgttgttccagcccaggatggcggcccaggtgactctggaggacgcgctgtccaacgtggacctcctggaggagctgcccctgcccgaccagcagccctgcatcgagcccccgccatcctcgctgctctaccaggtgggtgcccagcagctgcagggcgtacagcctgtgctccgaccccacatgatgtttttctcttcctttccttcagccaaatttcaacactaactttgaagacagaaatgcatttgttactggcatcgcaagatacattgaacaagccaccgtccactctagcatggtaatgttgcggtgtgtctttgtttctctctgcagagaagggcgtgtttgaaggacagatgtatactttttggtattatcccaatagactatgcagtgaggaaaaagagaagaaaatgaatgaaatgccttatatttttaagacagtctttgcttttcttagtgtaaaaacaatacatgctggttctgaaaattcaatgtctctggcccagagaaaacctttgtcagcgtttcaagggtgcacctgccctgttaatgctcattccctctccagatctgcacccacacacaccaggtatgtgcccatatgagatttagatttataaatgaattgcattgttattatagttctgctttttttttgagacagagtcttgctctgccacccaggctggagtacagtggcgcgatcttggttcactgcaacctccgcctcccaggttcaagcagttcttgtgcctcagcctcccgagtagctgggactactggcgcccaccactacgcccagctaatttgtgcatttttagtagagacagggtttcaccatgttggtcgggctggtctcgaattcctgacctcaagtgatctgcccaccttagcctcccaaagtgctgggattacaggcatgagccaccacacctagctagttctgcattttaatggtctcatcaacaggttttctttctttcttttttttttttgagatggtctcactcaggttgcccaggctagagtgcagtggtgtgattagggctcactgcagcctcaacctcccgggttcaagcaatcctcccacctctgcctcctgagtagctgggactacaggcacacaccaccatgcccatctacttttttgtgttttttgtagaggcgaggtctcaccatgttgcccaggttggtcttgaattcctggactcaaggaatccgcctgcccagcctcccaaagtactgggattacagcctgagccactgcacctggacaagaatattttcatgccatgaaaatgtgctagagaaagcaatccttaatggctacgtaaaccattttgtaaatgtccacaattcaactatttttgcgcattgacttcctcttttatgtcgtgtaataaaaaaatgctgtaggctgggcgcagtggcccacgcctgtaatcccagcattttgggaggccaaagtgggcggatcacctagggtcaggagttcgagaccagcctggccaacatggtgaaaccctgtctctacaaaaaaaaaaaaatacaaaaattaaccaggcatggtggtgcgcacacctgtaatcccagctactcaggaggctgaggcaagagaattgcttgaacccgggaggcagaggttgcagtgagctgagatcgtgccactgcactccagcctgggggacagagcaagactcgtctcaaaaaaaaaaaaaaatactgtgatgaacgtctcactaaataaaggctagatttaagagcatctatttgattttttccaaaggaaacgatgttaaagagtggaaagcaaaagcagttttacagcagtgatgacagtcctcttcccatggactctctacctagattttaagtgctgtgggcgtgctcctaacttttcctcctgcacacccggggctggcagccctgcctctagtcctctctgggaccgggaggccctgtgagccagtgaggaggccatggggatcctgtgtgtgctcacaccgggcagggcgtctgccctgagcccttcctctgtgttcctaactgcaggtctcatggccagcaggttgttgagggctgggtggagccaaggtgtaacgcctgtggcacccctcagagatgcctgcgtgtcactgacacccctctcgcctgcagaagccatggggtgttttgggtggtcattgtggcccccagcgccgcacctcagtgtcactagcttctggcagccgtctcttggcacacaggccacagtgcttaggatagtttgtggcgctttgtctggattttagcaactggcatctgcttttcatgctagttcccccgcctgcctttgatttgccctgtgttccattgcagaacgagatgctggaggagggccaagaatatgctgtcatgctgtacacctggaggagctgctcccgggccatcccacaggtgccacgctcgcctggctcttcccctccagccacaccctgccaggcccctgccacaccacacccctgcccctgccatgcctggcccactctcctcccagttctcaccccacagcagggcgggatcactagctctagaagcccagcggctgcttctggctggatcaaagcctcttatgtcatccttgttcctttattcccaggtgaaatgtaacgagcagcctaacagagtggaaatctacgagaaaaccgtggaggttctggagcctgaggtcacaaaactgatgaatttcatgtacttccaggtaaaatggcaaataatctggggggggtgtaacaccgaggggtgggttgctgaccccttcctacccatcactgtcactgtgaacaccctgaacagagtgcctgcaaattaaagcaaccagtttctgagacaaaagggaccaagcctttgacagtctaaagttcctcatgccctttcggaatcaacgctccttttgtggttcacttctcttctctgagagtgattttatgtttccttcatggagcctgctttctgtcagtttcaagtacaatgctttgactttttgccagtttgtactttttttttttttttttttttttgagacagagtcttgctttgtcgccctggctagagtgcaatggcatgatctcggctcactgcaacctctgcctcccaggttcaagcgattctcctgcctcagcttcctgagtagctgggattacaggtgcccgccaccacgcccagctaatttttgtatttttagtggagacagggtttcaccatgttggccaagctggttttgaactcctgacctcagatgatctgcccatcttggcctcccaaaatgctgagattacaggtgtgagccaccacgcctggccaatttgtacttttgttttcgtctgctctttcaggtattttcttgctgttagcctcaccctgactgtccattcctggtggtcctcgccctggccttggttaggcaagaagtagccacatggaaggggcttgctgctttttaaagaagtattttggaaacatccagattttttatgatgatgtccttcagcaaagggaggagatggaactaactgggagatgaatttttgttttaccttgaaagttaccaagaggaaaaaaatctctcccagttttcacttctgaaagttagaacatctgaattttacaggcgttttattggagcattttgctcagtaattttgctggaataatcagcaagattttgttactttagtgatgtagttggtaaagtgcaagtcaagtaatgatggtgcagagcaggcagtgggagctgctttcaggaaggggtctggttgcccacattgtaaacacttcggcctggagcctcactgggcagatcgtttctcatcgaggagcagtgactgcaggtgcttgaaggagggacatgggcttggctcctcactgacctgcagctttctgccctcctgcttcctctgcacagagaaatgccattgagcgtttctgcggggaagtgaggcgcctgtgccatgccgagaggaggaaggacttcgtgtcagaagcctacctgatcacactgggcaaattcatcaacatgttcgctgtgctggacgagctgaagaacatgaagtgcagtgtgaagaacgaccactcagcgtacaagaggtgagcacccacctcgcgcactgcgggccctcccgagagcacccagctcagtggcctgccttgtgcacagcaggtgtgcgtctttgtttgctgaagtcgtcacttctggtaggcagcagctacgtctcagtgtcagggctgtgtgagcacctgcttcgagggataaggtgaggggagccagcagataagtgcatatcgtggctttgcacagctagagcaggctcttcgtgccctggctgtcctcagatgtcacagaggaccttcgagcccctgggaagacagacatgcacaagatgtaggcctagctcacagagcacaggcatctggctcagggagcatcttggcaagggggcaggtggcctctgcagcctaccttgggcgttggggctgcagtcctcggtgccggtcactcgccagcgggggtccccagcacatgagcaccatcccagcaatgtgcagacgtggcccgtgcacagtcacagggtgtctcgtggtcacactgcgcttccagatcctctccctggtggttttctttctggatgtagagagcttctggagaagctagcctctggagaggctggcaagacgagcggaagaggcaggcatggcccagtgtgtgcttctggagcagtgtggggcagtgggtggccgatgggcatttggtgacactcggcgcgctgccgaccggcgttcggtgacacttggcacgctgccgaccggcgtttggtgacacttggcacgctgtctcctgatgctcttgctctgcttcatctgtgctcagtgcttttgaagacatgttttgctggaatgagatgctaatttcaatttcctctgctaagtaaggcatcttagctctaaaattaaattcgaagagaccttactttgcatctgaatatgctctagttatgttgcattttaaatcatacaactgttgctatgtctttattttaaaaacccacttgggacaaaatgaggcagcagtaggagtcaagctaggtcaggcagaattttaagcctcattcatgtgaaataatgcagtgttccatttatcacctaaaatcatcagctctgcacagaagtctagatcttcagaactagagaaaggtctctggagttgacctgtgagcccctcttggggcagaagtctgaagggtccctgtttgataacagcatctgtgggaatctagcatcgagactcactggtcggagtgggctcctggtcccagccgcccaatccagtagctgtgtgattttaagcagccttctcagccgccgttttggctttgtcagggaaatgggggaggtggttttcaatatttaaaagtatttaaaagttgtgtgtgtgtgttgttgttttttttttccttttagcactagcacctttattctaaagcctagtctgtaaaacagtttacagatggggctgctgtgtgcaaagctgggggaaggagggtttcccctctagcgtcttcaccacctccaggttcccctgagcaccaaagagtgggcctggggcagttccgtagctcttactgctgcctcttcctctgacctctatctgggacccctgttggttaaccttcccagaccatcacccccacccctcccaagacccccaccacacacacacgcatctagctcttttggcacctgctcgtggctactagtataacctcttttaagtgtcaatgccaagataactcatatggttatggtgaggcttgaggaaaatagaaaacagtatccttgaccctttccttagtctccccacccgccacctcagcagctactcaaatcaataaagcaaacatggccaggtgcgatggctcacacctgtaatcccagcaccttgagaggctgaggcagaaggatcacttgagcccaggaatttgagaccagtctgggtaacatagcaagaccccatctctaaaaaaacaagagcaaaaaaaactagctgggtgtggtggcatgcacctgtggtcccagctacttgggacgctgaggttggagaatcacttgagcccaggaggtagaggctgcagtgagctgtgattgtaccactgtattccagcctgggtgacagagtgagaccctgtgtctatttaaaaaaaaaggaaacatggttttttctttttgagacagagtctcactggcccaggctggagtgcggtggcacgatcttggctcactgcaacctctgcgtctcctggattcaagcaattctcctgtctcagcctcccgagtagttgggattacaggtgtgagccaccacaccgggctaatttttatatttttagtagagatggggtttcaccatgttggccaggctggtgttgaacgcctgactcaagtgatttgcctgcctccttctcccaaaatgctgggattactggcatgagccaccatgccccgccctggaaacatgtttaaaaaggcaaggaatgttactgtatcagttaatattacgtttaactgtatgcaattatttaaagcccagataaataacagtggctttaaaaagattgcagtttatttctctgtctcctgaaaagtcctgaattgggtggtctgcagctgatcgaggctctacgggacccagggctcctgtggtcctgcggctccgcttcaggtgttgcctcctggtcctaaatggttgcttaagctccagctgtcatttctccattccagtcagcaggcagaaagtggggaaagatgggctccatgcttcctcatgagtaaactttgagtgcttgtcagtatcttgcattatatctcatggcctagtccttggtcacttggccacagctagctgcagggtgggcgaggcacacggaatgtgtggggctccctggaatgtgtgttccacagaaatgcagggctcgttcctaaggaggaaggggaggaagtgaatgttggtgtaggttatcagcctttgccttggtaactcttaaaactaaacccccaaggttctgggttgcacagacctatccttatgtgggccgtttccactgaactttcttgcgggacagtcctagatgatcagaatcctcacacccccaccttcaccctgccctgccagacctcgcaggcttagcatggccttgcagtattgtattgttgggcctcacgtacgggtgtagctacaaattggtggcaggccagggctctgtctcaggaccttggacaccagtggtccctgaggtggcctggggaggtgtggtccagagggttcccagcagagaacctcagcagtgctggccggcttcatggcagggcttgtgggagtcacggagatggcagtggcccttctcagactcggggtccaggagccctgtgccccctagatgaggtgggcgtccaccagtatagggcagagaccagtgtgcagggaccctgcagggagccgtcagctgtgaccagccgggtggagagctgtcccagcctgtgcaagacacgtctaagttggcagaagactgacctggagtgcagggccagagacgcctgaaaaggctgaaatcataggtggcttctgagattgacccacatttctgcagatgactgtaggggaaagggatcccactcgaaccaggcttttttttttttttttttttttttaaatgtggcacgttggtgcattttgggatgaattctttttgttttcaaagggccgctcagtttttacgtaaaatggcagatccacagtccatccaggaatcgcagaatctgtccatgttcctggccaatcataacaagatcacacaggtaaggctggtgtttgcacactcaggttgatgggccaagcagccggccgggcgccgggcccatgcatgagtctcttgctctgtgtttcagtctctgcagcagcagctcgaagtgatttctggctacgaagagctcctggcagatattgtgaatctgtgtgtggattactacgagaacaggatgtatttgacgcccagtgagaaacacatgcttctcaaagtacgtgtgtggggacgctagcccgtggcactgccgagggacagccttactcttgtcaataggctgtgctttatctagaatccttttgacagctgtgtcttatttgcatgctgtcatgtgtgaacagcgtcctgcccttgcacacagcctgcacaacaggctctcaacacaccccatgagtgtgtcacacactgaccctgggagaaggtgctggccaggaggtccgggtcaaggattctcagctttttttttttttttttttttttttaagctgcttttcgttttattctcaaggcagggtgttgctcttgcccaggctggagtgcagtggcacaatcacagcccaatatagcctcaacctcctgggctcaagtgatcctcccacctcagcctcctaagtagctgggactacaggtgcacgccaccatgcctcgctaatttttaaattttttgtagagagagaatcttgccatgttgtacaggctgttctcaaactcctgggctcaagggaccctcctgcctcagcctcccaaagctctgtgaatacaagcttgagccactgccctttttattttttttttatttttgagacagggctttgctctttcacccaggctccagtgcaatggtgcggacacagctcactatagccttgacctccttggctcaagtgatctttctgcctcaggctcctgagtaactgggaccacaggcacttgcaccaatgcccagctaagtttttgaatttttgtagatatgagatctcactttgttgccctggctgaccttgaactcctgggctcaagcaatcttcttgccttgtcccccgcaaagtgctaggattacaggcataagccaccatgccccgccagctttgtgacagaagttatccaagattctacttgtcaagcatgtgattcctaggactttgataccttgtgtcacataattaaagtagccttttgttggttcaccatattctttattattctgttcaaattaggaagctttccatctgtgtttctcatgggaaagatgggcggcagttcggctgttccctttgctctcttctccacctctgcagggtggccttgggggaccctttgctgggtgtcccaccagcccagcccccagactcctcctgagcaggggagcactgtccacggagtgctttgtgacagcagaaacgttgtgtctgcaccggctggtgtgggagccctggccatgagcccctgcggagcactggagcatgcaggtggctagtccacgttaagaatttttagtttgtgactgggcacggtggctcatgcctgtaatcccagcactttgggagttgaggtgggtggatcacttgaggtcaggagttttacaccagcctgaccaacatggtgaaaccccatctctactaaaaatacaaaaaaaattagccaggcgtggtggtcatgggcgcctgtaatcccagctacttgggaggctgaggcaggagaatcgcttgaacctgggaggcagaggttgcagtgagctgagatggcaccactgcactccagcccgggtgacagagccagactccatctcaaaaaaaaaaaacaaaaaaagaatttttagtttgcatacaccgaaacttaactggttacatgtggctgcatattggacattacttttaatggcaaaaaaaacgcaattacttttgcaccagcttagtagctctagaatatccctaccgcttgggttaggctaggggagaggatttgttttttccgcttttagcgactgacctggaagcccagccccgctttgtatcccagtttcactgaggataaaatgatgcatttcaagcaccagacaagcagcctaaagatagatctttgtgatctatttcaaattgtgccttcaaagtcatcagctgtaacagtgtaagtccttatgggtagtgaaattctcagttctgagctttgtcgcatcattcattttgtggcttttcaggtcatgggatttggtctgtacctgatggatgggagtgtcagtaacatctataagttggatgccaagaaaagaataaacttatccaaaatcgacaagtacttcaaggtgagttacatgtttttagatcaatgtttttattgatttgtgtgcactttgaattttggggaagtgagcccctgtgtgactgtgatctatatcaggaaacgctggggctgggtggagtctggggcatgcacgttctcccgtctgcagaggtgaccgcgctttctctttccttttgccctgtgctggttttgcctgggtggagctttatacagatggaattgtgctatttgtactcttctgcgtccagctgctgtcaccagcctcttgtttgtgaggtgcatcctggaggaagcccgtagctacagcttgtagctttcggttgtggtgtagttttctatctgatgactacaccgtaacttatccgttccaatgttggcgggctctcggatgttcccaagttttggcgcgtccaaacagtgcagctctggtcgactgtcctctgttgggtgcatacccaggagagggaccgggggtcacaggcctgatctgttttcagtgtcagtagttacctgcagcctgatgacgctccagcacagctgtcctgatctccgttcccatcagcagtgagagaatgcgccgctggtgccacatcagtacttagcactgcctttttggggtggggggatatcctgaggatgcgtacagcattgagattgtattggctagtgtttcattgtattggctagtgtttcgttcatgtttccctaatggctttccatgttattagcgtgttcccttcgtgatgtgccacttcaagtgttttgctcttttttccctattgatttacagttctttatatattctggatacatgtcctttgttggacacaagtgagtttttttgtttgtttgttttgttttgtttttgagacaggccctcgctctgtcatccaggctggagtgtagcaggccttggtgatttctcccaccccagcctctcaagtagctgggactacaggtgcttaccatcatgcttggctagtttttaaacttttagtagcaacgagatctccctatgttgcccaggctggtctcgaactcctggcctcaagcagtcctccagccctggcctctcaaagtgccaagattacaggcctgagccactgcacctggccttacattttaatatacatgtattctcccctaagaggcctaccctttcactttttcccagctttatcaaggtgtaattgacaagtaaaaattgtatgtttatggtatatgatgtgatgttttgatacacatacacattgtgaaatgatgaattcaagctaatttaacatgtccattacctaacacaccattttttttattttgtgatgagaacacttaagatctactcttttagcatattttaagcattcaatgcattgttattaaccatagctactgtgccatagatgaggtcttcagaacttaactatgctgcggaattgaaactttatacgctttgaccagtatattcccttcctcctcctgcctccagtagccttttcgcgttctcgatggtgtcatttgctgaacagaagtttgtcattttcatgtagtctcatatatgaatcttttcattaatgtccacctaaataaatctttgcagccatccagctcatgagacgtttctgctgtgttagcttctagaagcattctgtctcctttttcacctagatctaatccccctggagctgacttctgcgcgtggtaggaggtaggggtttcgtgtccttggatctttcccagtatggcttcccagttgggcctgcccatttattgcaaagcccattgttctgcagtgctgctaaggtcatgaatctgtctgtggctctgtccaggttctctgtcctgtccacaagcctccatccctgctccagggccacactgccttaattgttggagctttctaacaagactcctaatctggaagggtgtgtcttccagttttgtccttcaggatagtctcagatatcatcccttcacctttggagatgcacgttagaattgatttcctgatttatacacactatccccccaaaaccattttttttcttctggaatattgactgggattgattatagatctattttgagagaatggacatttaaaaaatttgaagccttcctaggcacaaacatgatcatttctccatttactgagaactttttctagaattttcggggtagtacttttgtttagaggtcttgcacattttttgttagatttactgatgcatttttttttggatgctgttgcaaagtatttctctttaagtttttgtattctgattgttgctagtatatagaaatgcagttggctgggcacggtggcttatgcctgtaatcccagcactttgggaggccgaggcgggtggatcacgaggtcaggagatcgagaccatcctggctaacacggtgaaaacccgtctctactaaaaatacaaaaaaattagctgggcatggtggcagttgcctgtagtcccagctcctcgggaggctgaggcaggagaatctcttgaaccctggaggtagaggttgcagtgacccaagatcacgccactgcactgcagcgcagcctagtaacagagtgagactgtctcaaaaaaaaaaaaaaaaaaaaaaaaaaaagggctgggtgcggtggttcacgcctgtaatcccagcactttgggaggctgaggtgggtagatcacgaggtcaggagattgagaccatcctggctaacacagtgaatcccatctctactaaaaatacaaaaaattagctgggtgtggtggcgggcgcctgtagtcccagctactcgggagcctgaggcaggagaatgatgtgaacctgggaggtggagcttgcagtgagccgagatcacgccactgcactccagcctgggcgacagagcgagactctgtctcaaaaaaaaaaaaaaaaaaaaaaaaaaagaaagaaatgcagtgatttttttttttttatgactgtggatctagcaacatggtaggttaattttaacatttgaatagtttttatagatgttggtttttaaattgtattttgttcctctcaaagcgaatgtagaagttacttatagttttttttttgtaatgaatcatttgcagaggtagcattcaagccgaagtaattattagcattagtcagtttccttgtgcttatgtatttggtgactaaatatacataatgactctatttttttgttctttgaatacagcaactccaggtggttccgctatttggggacatgcaaatagaactggcaagatatatcaagaccagcgcccactacgaggaaaataaatctcggtaggaggagaggaaagctgcctggtttgagctttcggcagtgtcctcattgtgcggttttcaaacatcctgcttatttgtctagagataacactgttaacattctcagcctggaattaaatgtccagtattgcagcctttgccacatgcggctatttacatttaagtttattgaaaaatacaattgaggccgggcgcggtggctcacgcctgtaatcccagcactttgggaggccgaggcgggcggatcacgaggtcaggagatcgagaccatcctagctaacacggtgaaaccccgtctctactaaaaatagaaaaaattagccgggcgtggtggtgggcgcctgtagtcccagctacttgggaggctgaggtaggagaatggcatgaacctgggaggcggagcttgcagtgagcagagatcgcgccactgcactccaacctgggcgacagagcaagactccgtctcaaaaaaaaaaaaagaaagaaaaatacaattgaaattttaatttccttacgacagccacgtttgaaatgttcaatagttagtggctactgtgttggacagcacagatacagaacactttcatcatcctagggattcctattggacagtgctgggtgatagtctttatgtttaaaaaggttgtcttaaaaaaaaagaagagggtggggcgcggtggctcatgcctgtaatcccagcactttgggaggccgaggtggatggatctcttgaactcaggagtttgagaccagcctgggcaacacagtgagaccttgactgtatgaaaaaatacaaaaattagccgggcatggtggcacacgcctgtagtcccagctactcaggaggctgaggtgggaggatcacttgagtagtctaggaggtggaggttgcagtgaaccaagattgcaccactgcagtccagcctgggcaagagagcaagaccctacctcaaagaaaaaaagaagagactgacagtgtgtcagatgtgacatctgcagacaatgtggccctaaatcctaaactgtgtaccatcttactctgtgaagaactataaagatcctcagcacagttccagatgctggcaggcactcctccccactgcagactctacagagccatctgagcctcaggggaggctttcattgacttttgccaagcactgtgcccgtagccaacctgcagtcaccattcagccatgattttgacaaacgaagttgcatctcagtctcaggggtcaagaaaccttttcagtaaaggacacataacaagtattttaggctttacaggccacaggtggtctccttcggatatgcttctgtgttgtttttttaaacaaccctttaaaaacataaaagccatttgtgtggctctggtgccaaacaggcgtcctgagctgccccagtgctgtggcctgccggcgcctccgcaggtaacgcgggtgctttctctctgcacagatggacgtgcacatcctccggcagcagccctcagtacaacatctgcgagcagatgatccagatccgcgaggaccacatgcgcttcatttcggagctggcgcgctacagcaacagcgaggtgcgccccgcgacctggagctgcacaggcacccgagggtcgcctgtgtgtgtttgcacccaaatcttaggtttaattgctttgaaaaacagtttactaccagatacgatcatatgtcacataatgacagggacaggttctgacaaatgtgtcattaggcagtttcatcattgtgggaacgtcatcgtgtcctcatgctagcctggatggtacagcctgtggcacagctaggctgcagggtacagcggatggctcctaggccacacacctatggagcacgttgctgtgctgaagactctggatagttgtaacacaatggtatgtatttgtgtatctaaacatatctaaacatagaaaaggtacagtgaaaagatggtattataatcttatgggaccaccgttgtatatgctgtcattgaccaaatgtggtgcatgactgtacttcaaaagcacccattataattgacaaggcagtgaaactagtgttctctctgttcagctgtacaaaaagcttttttttttttttttttttttttcagaaaaacattatagggatcccaagagaaaggacagagatgagataattaattgattaagtggcatttcctagtctagtactgtgattccaagcaactcgaaagatggttggagagaagggaggacactgggaaaggaaagggtgattctgacctggggcccctgtaagcctagaagggaagaagtcctgaggccagaggtgagcaggagcctctgggtggctgtcagaagacgtcccaggggcattgggtccatgtgtccaggaggtgggcctggagttgggtgcagagaacaggtgctttctctttagttccttccagctttgcagctgggtttgccatgttgtcattttggccactcccattctcctcactcacccaggttgactccgagccagcactgctggcatgtctgtgctgcaaattgctggcagggactgcgggttttagggcatatacgcaggctgctttgctgaactggttagtccctcaagggtctcaggaggaccattaaccttagcggggacaactctgtggatgttggccccacccactgcaggacgatgagcaccctgtcccccaccccccatggttaccagtcatcatcatgtaaccaaactgactgacaacccagtagtccaggtatgttggggcacctgctgcttctaacacagacccctggcaagcgtttgggcatgtcagacaaggaggctgtcctgggtgagtcagtgagtgagtggcgagcgagtgggaggcctaggacagtactgtgcactgctgtggcctttatgaacactgtgtgcttaggctgtgctaaattttttaaaaggctttttctttctttaataacgaattagccttagcttactgtaacttttttactttataaactttttacttttaaaaagagctttttggcttttgtaacaacactttgcttaaaacacaaacacactctatacctgtgcaaaaatattttttctttatctccttattctgtaaattatttttctaccaaaaagtttttgtttttttccttttgagctttttcgttaaaaatgaagacccaaacacacacattagcctaggcctacacggggtcaggatcatcaggacatcactaggcagtaggaatttttccactacgttaagattttatgggagcaccatcatgtgtgtggtcttgttgactggagcatccttaggtggcatctgactgtaattgtttctctggcattgtctaaggtaacaaatcagtttttttcggagtacagtttttttttttttttttttttttgggtgagacggagtcttgctgtgtcgcccaggctggagtgcagtggtgcaatctcggctcactgcaagccaaggttcacaccattctccttcctcagcctcccgagtagctgggactacaggcacccaccactacgcccggctaatttttgtgtgtgtgtttttttgtgtttttttttgtgtgtgttttttgtgtgtttttttagtagagacactgttctagccaggatggtctcaatctcctgacctggtgatccacccgtctcggcctcccaaagtgctgggattacaggcatgagccaccgcacccggcctctgagtacaattttaaagtgattcgactttaggtttgttgattttcttttttctgaaagctgaacatcctggtgaatgacgccagcataatttgatttatgtcattatgtcataatctagtcttttttttgtttgtttttgaggtggagtcttgctctgttgcccaggctggagtgcagtggcgcgatctcggctcactgcaagctccgcctcccaggttcacgccattctcctgcctcagccttctgagtagctgggactacaggcgcccgccaccacgcccggctaatttttttgtatttttagtagagatggggtttcactgtgttagccaggatggtcttgatctcctgacctcgtgatccgcccgtctcggcctcccaaagtgctgggattacaggcgtgagccaccgtgcctggccttttttttttttttttttttttgagacagagtctctctctgttgcccaggctggagtgcaatggtgtgatcttggctcattgcaacttccacctcccggattcaagcaattctcctgcctcagcctcccaagtagctgggactacaggcgcacgccaccatgcttagctaatttttgtatttttagtagagacggggtttcaccatgttggccaggatgatctccatctcttgaccttgtgattcgcccacctcagcctcccagagttttgggattacaggcatgagccattgcacccggtcataatctagtcttaaaagagcaatgccagcactactaattacagtgactagaaattgttttatgatttgttttgcaggtgattttgcccttgagcttcttactcagggtacttttttttttttttttgagatggagtttcgctcttgttgcccaggctggatggcgtgtgatggcgggatcttggctcactgcaatcttcgcctcctgggttctagcaattctcctgcctcagcttcccgagtagctgagattacaggcatgcagcaccacgcccagctacttttttatatttttggtagagatggggtttcactatgttggccaggctgatctcgaactcctgacctcaggcaatccacctgccccggcctcccaaagtgctgggattacagcatgagccatcgcaccgggcccctcactcagaggattttaagtcacaccgtggtgtttagagctgctcagggtcctctcagtggtcatgctgtgagctccatgcaggttcccgccattgtttcattttgcttttgacttctaggcattgcatttccgatctcatttaattctgtgtcctaaatatataaaatatttgtgtggttctaatatcacatctataaaaaggtatattcaaagaagcctgccttctccacggtgccccttcctccccataggtcacatgtttaaatttagggggtggttatttgatagaagcaaacccacgtgacttgtgtgttgcccttccccggcctagtggaagtgcgccaagcccacgcgtgtaacagccccgcgcccagcccgcggtcccccaggcggtggctgtggcagcggcctgtcccttgctctgtgctctgcagcacgcccttggccgccattttcccgggaggagggtccagcacccacagcatttcttattttctttttatttatttatttatttatttatttatttatttatttatttattattttttgagacggagtctcgctctgtcgcccaggctggagtgcagtggcgcagtgtcggctcactgcaagctccgcctcccgggctcacgccattctcctgcctcagcctctgaagtagctgggactacaggtgcccgccaccatgcccagctaatttttttgtatttttcagtagagacggggtttcaccgttttaggatggtctggatctcccgaccttgtgatccgcccgccttggcctcctgcatttcttattttcacacgtgtgactttggggtggattctcatggtggatcccgggatggggggagctgggtgggggcgctggtttctcacggggccgtgcccgccttgtgcaggtggtcacgggctcgggccgccaggaggcccagaagacggacgcggagtaccgcaagctcttcgacctggcgctgcagggcctgcagctgttgtcgcagtggagcgcgcacgtgatggaagtggtaggccccgtccccgaccccagccccgctccaaagctgcctcgggcactttattcacattaacttttggtctttgggctttttatctttggccctagaaagacgagaatatctatcagtagatatgtttccaaggtgattttaagtacatctcatttatgtgtgtaataaatgaagggcctcctttttaaaaaaaatcttgatagaattaaatttgtaccattgtgattttctttaagtcgttctttttttgagatagtctcaccctgtcgcttaggctggagtgcggtggtgcaaacataagtccctacagccttgactccccaccccaagcgatccttctgcctcagcctcccaagttgctgggaccacaggtgtgcaccacggctcccggctaattttttttttttttttttttttttgagacggagtttcgctcttgttgcccaggctggagtgcaatggcgtgatctcggctcactgcaacctctgcctcctgggttcaagcgattctcctgcctcagcctcctgagttagctgggattacaggcgcccaccaccacttctggctaatttttttgtgtttttagtagagatggtatttcaccatgttggccacactggtcttgaactcctgacctcaggtgaactacccgcctcagtctcccaaagtgctaggattacaggcttgagccaccgcacctggcctagttttttgttttttggttttttttgtacagacagtctcgccgtgtgggccaggctggtctcaaactcctggcctcaagccatctgcctgcctgggccttccaaagtgctgggattacaggcgtgagccactgtacctggccaagtctcattttttcatttaaattttattttgctttaaatatttacttgtattgatgcataataggggtacatagtttcaggatacatgtgataatttaatacagtcatacagtttgcaaagatctaattggtgtgcttgggatgtccatcgccataaatatttgtccttatgccagaaaaattcgagttcttccctatctattctgaaatgtaccataaattattttaattaatagtcaccctaactgatctatctaacactgtcttatttctaatatcagactgtacatttgtacccattaatgtcgcttcacgccctgcatttttaagataacattttctctttggagctccagccatcaatgtcttttgttgaacattagtaaattatttctggtgccatataaagatttggatacctgtaagcaatgaaagattttcccttttgtgatttattttgatcacataaaaattatcaaattggaagagtacatggtcatttgaaaggcaaaatctttatttacttacttattattttattttttgtagagatgaggcctcactatattgctcaggctgatcttgaactcttgggctcaagtgatcctcctgcctcaacctcccaagtgctggggtcataggcatgagccactgtgcctggcccagaatcctttttaaaatgatgatgaaatgccagagtcttagatactcagcactcactatccaggccattttgccgggtagattttttaaacgagaggttacagggccagggtcttttgcccatctgtggagatggacggtgtgtgcgccctcatgtgtgactttcagaatgcagcaaaggtttgaaggctggcctggctttggccaccatcgtgtgagtcagaccagaagccaggcgttttgcatgcaatatggaacacctctgctctttcggccaccacagtattcctggaagcttgtgcaccccaccgacaagtactccaacaaggactgccccgacagcgctgaagagtacgagcgtgccacgcgctacaactacaccagcgaggagaagtttgccctagtggaggtgaggatgctcggccgctcgctcttcctcatgtcgctctagcttcacaccatcttctctgtcaaaagcaaaaacatgaacaaaactgcctgtttactcattgcttctgtgtgggcacccctttccatctggcagagtagtcagagtagaacgcattagagaaacagtggttgtcggtcctgggtctgcactgaagctccctgggtgcgaatctggactcctggacctgcgtctggatggagagcagtgtcgggtgcggggaagggaggtgaaagagatgtggcccctgctgagagagaagagctgtcttgctctcctgtgaggcaggcgctgcactcccctcgtgagcctttccatgggcagctcttcattccagcatcaactggtatcttttctttcatagctgtgcttttcctgtgctgtttgagaaatctttgcatactctcaggtcgtgaaggtattctgcattgctttctggatacttcactctgctttcacactgagatgcgaaattcacctgaaattcatttttgaaacaattccgtccaaccctcacgctgccacctttgtagctggtcacgtgacaatgcatgtgtggctgtgtttctgctctgctctaacccagtgtcagttgctgtcggtatcccagcaccactctgtagctttgtagtcatctaccgtgtatgagaaagcacgtctttctgtctcctagacttccttggctattcttccccactgtagtttcatattcattttagaatcagcttttcccatcccacagtgaggattttaatcaggatatgaacaatcctatggatcatgacaggagaattgacagaagtctcatacagttggccctcagtgttcttgggttccacctccatgaaccaaccttgggtcaaaaatgttcagaaagaaaaaataacactacaacagtgaaaagtaataaaaatgttaaaaaccactgttttggcctcagcctcctggactcaagcaatcctcccacctcagcctccccattagctgaaactataggtgcatgccaccacacctggctaatttttatatttttggtagagatggggtgtcaccaagttgcccgggttcgtctcaaactcctgagctcaagcaatccacccgcctcagcctccgaaagtgctgggattgcaggtgtgagccactgcgcccagccaaaattttctgattttttgacataaggtttttcatagtaaattctcatcttattttggtagaagcttttttttcacataaccatacagttcacccatttgaagtgtaaaagtcaatgctttcagcacattcacagagttgtacagtcacaatcaaatttagaacaaatataaatgccagcccattatcagccacccttcattcttccctccctcaaccgtatgcagccaccactctgctttctgaccctgtagatttgcctgctctgggcatttcatatgagtagatcataccatatgtggccctttgtgactggctttcacaaagcataattttcacttagcataattttccttttatttttcttaagatggagccttgctctgtcacccaggctagagggcagtggcgtgatctcagcttactgcaacttctccctcccgggttcaagcaattcttgtgcctcagtctccagagtagctgggattacaggcacccaccaccacgcccggctaatttttgtatttatagtagagacaaggtttcaccatgttggccgggctggtctcaaactcctgacctcaggtaatccgcctgccttgggcttccaaagtgccaggattacaggcgtgagctaccgtgccaggccacttagcataattttcaagattcacacaggtatcactgttttgttctgtttattgctgaataatattgcattacatggatatgttacattgtatttatccatccatcagatgatagacatttgggttatttctaccttttcactactatgaagttgctgagaacttctttttcttgtttttttttttttttttttttttggagacaaggtctcactctgtcacccaactggagtgcagtggcaggattatggcttattgcagcctcaatcttctgggctcagacaatcctccctccccagcctcccaagtagctaggaccacaggcacaaaccaccatgcctgactaatttttaaattttttgtagagatggggtctcactgtgttgcctagtctggtcttgaactcctgagctcaagtgatcctcctgctttgacttcccaaagcactgggattagaggtgagccaccatgcccagcctctatgagctttcatgtgcgggtttttgtgtagatgctggttttcatttcttttgattgtatagctagaaatgcaattactggatcataacagcacatttagcttttgaggaactaccagatagtggcagcaccatttctccttcttaccagcagtaagtgagggctccagtttccccacatccacaccaaacttgttattgtatgtctttttgattctagctatcctagtgggtgtgaggtggtatctcatttcattgcgcttttgatttgcggttttctaacaactaaggatgttaaacgtcttcttatgtgcttgttggccatttgtgtgcattatttggagaaatgtctcttcagatcctttgcccatttttaattaggttatcttttttattattgagttgtaacagttccttatacattctaaatatcagttccttacagccataggattttcagtatcttctcccattctatgattgtccttttagtttcttaatggagtcttttgagacacaaagtgtttgaattttgattatgtttgatttatctgtttttctttcgttgcttatgcttttggtgtcatatataagaaatcattgtgtaacccaggtcatgatgatttactcctgtgtttccttctaaaagtcttttttttttttcttttttgagacagagtcttgctctgtcacccaggctggagtgcagtggcatgatctcagctcactgcaacttctgcctcccaggttcaagcaattctcctgcttcagcctcccaagtagctgggattacaggtgtgcgccaccacacccagctaatttttgcatttttagtagagacagggtttcaccatgttggccaggctggtcctgaacccctcacctcaggtgatctacccgcctttgcctcccaaagtggtaggattacaggcatgagccgccacgcccagcctcttctaaaagttttatagttttagctcctaacttaaacctaatttaaatatatgatccattttgagtggatttttatacagcgtttgacaaggttgtgtgaggggccctccagaccaccctccatccccctgactggctgggaggactcacagggcttggtagttgttgcactgaaggttatgactccttgcagccaaaagacagagtcagatcagcaaagggaaaaggcacaggagtggagtccagagaagacaggtgtaaacttccagctgtgcctgctagtggaattgcacgggacgtgcttatttctcccagcgatgatgtgtgacagcacacacaaattgtggctcaccagggcagctccccagagccttggggtcctgggtttttactgggggccagtcacgtggctgaccttggctactcagactctaggtcctcaaaacacacacaggaggtcactattagtcaccttgttagcagagactgatcagactggtacagcagtaggcccggggccccaggcacacaaaaacataatctctaggcaggacactcccaaggttcagagctggttcctgggatgacttcagccagtcctgaagatgggcctttcttggggatgtgcggagtttcattctccccagcctgctgagttaaccctttcctgcacaagggtccaccttgattctctcgcatgtgcagatacagttgtcagtactatttgttgaaaagatgatctttccccatcaaattgttttggtaccctgttgaaaatcaattgtaagttaacttctggactcttaatcctatcccattgacctctgtctatcctatgacagtattttttcataatctcttaatctgtctataaactgctaatgtcccctttttcattcttaatgctggtaactcgtgcttctttttttttttttttttttttgagacagagtctcgcgtgttgcccaggctagagtgcagtggcacaatctcagcttactgcaaccttcacctcccgggttcaagctacttctggccaatttttgtatttttagtagatacagggtttcaccaatgttggcctggctggtcttgaactcctgacctcaagtgatccaccctccttgacctcccaaagtgctgggattacaggcgtgagctactgtgcctggcctgcttctctgtcttttttttctttgttattcttgctaagcatttgtcagttttactgtttatttactgaacagctttgtctttgttgatcacccttgattatacacttgttttctgtttcattgttacatttatttatttatttatttatttatttatttatttttgagacagagtctcgctgtgtcacctaggctggagtgtagtgacgccatctcagctcactgcaacctccacctcccagtttcaagcagttctcctgccttagcctcccaagtagctgggactacaggtgtgcaccaccacaccaggctaatttttgtatttttagtagagacggggtttcaccatattggccaggctggtctcgaactcctgaccttgtgatccgcctgcctcggcctcccaaaatactgggattacaggcatgagccactgcgcccgggtgcttttagttatttttcttcgattttgggggggtttattttgctgttttctataaattagtgatgaatgtttgataagtattatgatttttatcctttttagttttctaatgcgtgcatctaaagctctcagtttgctgttaacttgccttttccttcttcctgtaagtgtgaatatgtaggattgttatgttcacttaaatgggtttttcctcgtttggttttttaaatagaacttttcttttttgttgattggaaaaacaatataaaatcatcagttttccaaagtaagcatgctgaaaacacaagcatggcattaggaaggcacagtgcctgcggcgccatcacagagatggcgctgagcagctgggtgcgttttcttccagactttttcctttctaaaattttcattattttaattgcatatagaccatgagtcttacatgaaagcagtctatttggaaattctttacgttatagaaggatgaattaaaagcagactgtcaacttttccacctgaaaatttcatgaaaaagaaaagcaccaaaatcatataagccatgtttcaagtacttgtcagacacgtcttcatttacccatgaatcaggctgtttataaagccataatgaggaactcaaaaggtgtgaataaaaccagaaagtgatagagggagactgtgtgaagccttggggaaacacatttgtgttcttgctaagtgaacttcaaaccaacagatttaataaaagtaggaagatgcctagccaagcatggtagtgcatgcttatagaactagttacccaggaggctgaggcaggaggatcgattgaccctgggagttcaaggctgcagtgagctatgatcatgccactgcactccagtctgggcaacagagtgagaccctgtctcaaaaaaaaaaaaaaaaaaaaaaagctgccttaattttgaatctgtcaaatacttaatttcaaaaggttttttttgtttgtttgttttttgtttttttttattactgtggactgaagaccattttcagatgttgaagtagggtttttgttttgttttgttttgagacagggtctcgctctgtcacccaggctggagagcagtggcatagtcatggctcactgcagcctcgaactcctaggctcaagtgatcctcctggcttagcctcccgagtagctgggactataggctcatgccaccacacctggctaatttttaaattttttgtagagatggggtctggccattttgttcgggctgatcttgaactctggtctcaagtgattctcccgcctcagcctcccaaagtgccaggattatgggtgtgagccactgtgcctggccaaagaagggttgttaagattttcccaaatgtattagtcttaggtacagcgttctagttaaaagataaaaagaagtgaattatgtttcactggtgctattaaatgttccactttggtgtcttatatgtcagacatccacacggcagggtggacttggggtaagtgtgtcttgctctgcctcacttgctgctttcagagagatttctaggcctcacatagctatcatgaagttggctgtagaaatatttataaacggcaaaagccgtaagaaagctcatgcaattgtaaaggtcatacttggtttgtgaccttcaattgtttattcagaaagtaataaagcacactgtcatgacaaaattactgtctggaaacagggaaataatgagccctggcaccatttttctgtcccaggaattcctttggaagctctttgtcatgtaattatgttccatcagagtcttccaggctttttctgtgaatggtagttcactgcgcctttgttgtgaacaatatgggatttggactacaacctcttgtaacttctttttctagtaatatcatgcctgctttcctgagtctttttcttctttcctatttgaattccatcacaggagggtgtgctggggtggatgcatgtgtgtttcgagtcagatgcatccctgtcctccaggtgctcatggtctgatggggagtcagatgcgggcacagttccattgactatggctttggagaagacgttttggggcagggcagctgcagggcacgaacgcgggagggcgtaaggtgctgtgggcgaggaggagcagcccccggcatgtgccaggcagaggaggcttggtgccatccctaagaagggccgtccctgttgctgtgtcccccgcaggtgatcgccatgatcaaaggcctgcaggtgctgatgggcaggatggagagcgtgttcaaccacgccatccggcacaccgtctatgccgcactgcaggacttctcccaggtgacccttagggagccgctgcggcaggccatcaagaagaagaagaacgtcatccagaggtcagccttccccacgccctgtgcccgctgtgcccacacgtcctcggatgaacttggattcaaacaacaggagcgttaaattctcaaaaatgatttcaatatatttatcttcaaccttcagatgccctcttggtgaattacctctaaaagtaatgcatgggtccaattattaacccaaacaatggacagtaagtcagctgccgagtgtctagggagtctgaggaccccgggacaaggtgcatttatcccaggctcgcggtgcctgtggttcatgcatggtgccttatgggggtctctgcacggtggagccctgttggtgatgaggctgtgttccaaaccagtcgagagacatggccaggctctggtcatgtgggtgacttcacattcctgttggttactggggacagccagctgcgggcaggcggggcccagctctgctccgtgcggaggctgtgttctgccctctccctgcccacagcatgactcagagccacctcactgctgccctgggctaacagatgcgaactggagctcagggcagtcttctgggggtagtaatactctccagaaggcagactcctttttaactttcctgttgagctggtccattaccacatccctccatggcccccagagtaatttgtattttcatgggggctgttctgagagccttgtagttgggtgaggagatggtgtgattgtgaggctggaggtctcggcctctgggccttgctgatcacttggtggggtgttcagtgtcctgcaggccatcaggaagaccgtgtgtgactgggagacggggcatgagcccttcaatgacccagccttgcggggcgagaaggaccccaagagcggcttcgacataaaagtaccacgccgcgccgtgggaccctccagcactcaggttctcgtcccttgagccccgcctgcaccctctccctggggggacccaccctgagctgtgagcgggtggggctggtgaggcccgggttaaatgaggtcctcgctgcctgctcaggcagagaaagtggcgcctgtggtttctgctgctcctctgtttcccacccaagtgagttgggagcgtgaggagacgtgccttgattgtcagatgtgtcatgtgcactaaaaaggagtctgactccatttcaactcccatcccaaaaatgtgggcacaagtccacgtgtctgtattcattctgtgtttcttgatgggtgtttgaatgtctgtataatttttacgttgggtctgcaaatgactgtagatggggcgtgggaaactgtgaggtgctgcttgcgtgtgtcatggtcctaagctgcccactgtcctctctcctggtgtgttcaggcctccccgaggtgcttctcacgactttcacacccggtttaatccacaccgctgcgtctgtcctccgtcctggggctggtcttctccctcatctctgccggaggcttttaatctcttctgccactcttctggaaagtcaccagcaatgcacgctgctggctctgcaggagggtcagggggacggccctcggcctgtgcgtggtgccagccaccctccctgcctccctctgcgtgcgtcccgtgtccctgcctggggtgtgtgtgtcgagtgactaacgtctctctcctgcctctccctcctgtctgtccgtgtctagctctacctggtgcgcaccatggccgagtccttgggctctgccgagctgctcaggcagctcaagtctctgggcatggagaggctcttgcatgcggttaacacgtttctgaggcagtcgtgcacctacctaccccttttaacctttggtggtaagacatcatttgtttctcttgacgtttatggcacggaggcgaactgctccgctacaagttgttctttccccaaagcagcagcaacgtggccgcgtagacaggcacccggacccctcggggagctggtgcggggccctcccgaccagggcgtagcggagcagtccttctctcatgggctttttgagtttggcataactaatgtaccatgtatattttctcccccacaaatgtttccttggataatccagctttacatggtgagaaccatgctagagtccctcattgcagacaaaagtggttccaagaaaaccttgagaagtagccttgaggggcccaccatattggacatagaaaaatttcatcgagagtcattcttctacactcacttgataaatttcagtggtaagagatactgctgagcagcatccggcctggcatgtcctaacaccactaacaccgtctagaatgcttccgcccgcctgaccaccccctaccccgtcccttggtgcacccagacggtgactcgtcctgccctctgtggcggtggctgtacgtccctggcctgagctcgctccacagggcgtggtccctacaagggtataaactgaggagcccgggctggccctgagacatgaacagaaaatcttttcaacccatgcggggttggaaacaggcgaatgtaatctggtgcctgagttgagacacaggcattgataaatactagaaatggcccttgcagaccatgacgtggggggaaggtggcgggtgccctgtgccaggcaagcccatcctgggtgacacccggccaccttgaccggccaccggtgggtgcgctctctgccctccgtgtgtctgtcccgtgttctcatcaagtcctccgttgtccacctcttgctcagaacaggatccctgctgtcttggctggggtgctgcgaggtattggaggaaatagtaccacttttgctgttaactccatgaaaggatggagttcgagtgtgggctcttttaatctgtctcatttttgcgttagacagacctccctgagtgtgcctctaatgctgcagcctggacattggtttttatcctaagtgaaagtgaagaagtcctgtttttttgttttgttttttgttgagacgaagtcttgctctgtcacccaggctagagtacagtggggcgatctcagctcactgcaagctccgcctcccaggttcaagagattctcctccctcagcctcccaagtagctgggattataggtgctcaccactgcgcctggctaatttttgtatttttagtagagatggggttttaccatgttggccaggctggtctcaaactcctgaccttgtgatccacccgcctcggcctcccaaagtgctaggattacaggcgtgagccactgtgcccagccagaagtcctgtttttatgtctccttttgagaagaacatttttaggtaagacacagtggctcatacctgttaatcctaacactttgggaagccaaggcaggagaatcacttgaattcgggagtttgagaccagcctgggcaacatggcgagacccccatctctataaaaaatacaaaatcagttggtggcacgtgcctgtgttctcagctacttgggaggctgaggcaggaggatcgcttgagcccaggagttgaaggctgcagtaagctatgatcgcgccactcacctccagcctgggtgacagagtgagatagactctgtctcaaaaaaaaaaaaaagacactttccccctggatcccactgaagggctcacagggttgatgaggtggctttacctgcagctatgcccagctggtcctgtccctagtgcaaggccccggtgacccctccccactcatgtccatgctgcatggcttggggctgagcgaggaggagcaggcacccagcacacagcccttgtgtcatctctgctaaaggtttttttttgcttgcgggagataacatggagttgtttgaaccctcccagaaacgctgcagcagtgctgtgacctttcgcagctgtggttccgagagttcttcctggagctgaccatgggcaggaggatccagttccccattgagatgtcgatgccctggatcctgacggaccacatcctggagaccaaggaggcatcgatgatggagtgcgtgtcctgcgggcctgtctccagcctttgtgtgtggtgaccgggggtcctcagaggaggtggcggagaggccgggactgtttttagtattgtatttgaaatcaagtttctgggcctgggcaaaatagcaagaccccagtctctacaaaaatgagaaaacttagcctggtgtggtggctgatgcgggaggattgctttaccacagaaatttgtggctgcattgagctatggattgcaccactgcattccagcctggccacgtagcaagaccctgtctccaaataaaaaaaaaaaaaagagaaatcatgtttcctggggtaaagctttagagattaatacaagtaactaaccagtttcttggtgtcagactggaattgagagctcaggcactagaaccagtcacgttcctactttgcatgggtgctggctgggacccggggactcagcctggaccagggagatggatgaacctggaccttccccaggccttcgtagtgcaggccctgtgaggtggccatgcccgtgagctgccttgcgggagccctgtggcctggccttttgtgtgacacagcctctgacccagatgaagtggggaaaggaagtattgattgaacagctttgttctggggatcaggactgtggacctagatggaagggcagtctttcaaaatataaagttcatggaagggaaagtgtttggaaaagggtgtgtctcatggtgagcgactggggagccgcccagccggtctgtcttctgagcaccgtgagtgggaagcccctgagttccttgtgcgtcagtcctcacacatcccttgtggtgcccaggagatggtaagggcagtcaccttccactctctgtggctgtggcatggccatgccatttgtgtgggcagagcctctgatggctcgttgcacagcattggggtggcgtgaggagctggaaccagcttggaggcctccttcaggcatgggcctccttgcccctggccatggcctttgtccagatatgaggtagtgggagacgggccttcaaccatgggccatgctggacatgctcctggtgagctgtgggatccaggaccttcacctttgttcttttttttttttttttttttttaatgctgtctatgtacttccgttggtgtaattttttcttttttttctttctttcttttttttttttttttttttttttgagacagagccttgctctgttacccaggctggagtgcagtggcacaatctcagctcattgcaacctatgcctcccgggttcaagcaattctccggcctcagcatcccaagtagctgggactacaggcacccaccaccacgcccggctaatttttgtatttttagtagagatgagtttcatcatgttagccaggctggtctcgaactcctgacctcaagtgatccgcccacctcggcctcccaaagtgctgggattacaggcatgagtcaccgcgcccagtccacctttgttcttttccagtcagttcattctttttttttttccccccaacagagacaaggtcttgctctattgcccaggctggagtgcagtggtgcaaagacagctcactgcagcttcaacctcccaggctcaggtgatcctcctgcctcagcctcctgagtagctgggactacaggcatgcgccaccacacctggctaattgttttgtgtttcatggagacggggtcttgctatgttgtccaacctggtctcaaactcctggcctcatgttatcttcctgcctcatccacctaaagtgctggagttcattctctatcattttttttggacagggtctcactctgtcacacaggctagagtgtagtggcacgatctcagctcactgcagcctcaacctctcaggctcaagtgatccttctacctcagcctcccaagtagctgggactcaggcgtgcgccaccacgcccagatagttttttgtagttttgttagagacagtattgccgtattgcccaggctggtcttgaactcctcacctcaatcaagtgatctgcccacctcagccccacaaagtgctgggattacaggcatgaaccaccaagcctggtccttggagttcattctggaaataagaaaataattttcttttgttaaaaatcctatgtacttgtagtgaaatattttaaagtctgctaagtgagaagatgcaggcaggtggaggcccttgtccgtgtgtggccttcagtgagcgtctgctgtccccaagcatcctcgcagcctggtgggtgtggcggccgcctcaggcgcagccaccacgtgctttcacaggaggactggtgtttgaagtgaaagttgtttttccttacgtgagaggtggaaaatggagttgagtttctgaggtggggcgaggctgtcggagctgcgagtgagtggcagaggctgctggtcacactgctgctgtcctctgcaggtacgtgctctactccctggacctgtacaatgacagcgcccactacgcgctcaccaggttcaacaagcagttcctgtacgacgaaattgaggccgaggtgaggcccctgcagctccatttctgttcatttccttcaattaaatctcctttctctttttgttttctcccaagtattcaactttctttaaaatataagacagtataaaccacgaagcaagcatgtgggagcaagcccttcctctgtggatatgcttccacgatgagtgcaggatgcgctttttcacttgaccgtgtgtcactgcggtgtctgtgtcctcatctatttttggttatgagcatgatctttgatgttcaactgaagcaactcctgttttatttctctatttttttggttttggattttataaatagcactctgctgcactccctggcatgttttttatttgcatcgcatgacttctataggacaaattcccacaggtggaattctcaggttagtgtatgcacatttaaggagatgaaccttattctacacatcatctcctctgccttctcacaaagaccacctgaaaatggtgcttcagggagatgtcacaggtccccggccctgcaggatgggaggagggcagagacgcccttcttggccctgtctgctgggcagatgggtcctgggtcccacttgccacgaagcacaggtattctcctcacagttccaggagatagtgcgaatcccatctgcaagtaagggtcttttgagggtacctcctgaccaatctcacacccagaacagccgctttgctccagggaaggccctcggtggtgcctcctggagtgcacagtaggcggagctgccccagggcaggaacccacctgcaatgcacagtagctcctcgtggtcactgcacacagtgaagagagccttgttgattctctcttgcatttcagagaataggaatatttttctccctcagtaagattggttctagcctagttttctgtggcagtgtggtagtcactcctggccacactgcagtttatttagtgtgctgttgttggacagtaagattattgctagtttctttagtttatttttcttttttgaggtggagtcttgctctgtcgccgaggctggagtgcagtggtgtgagttcaagcgattcttgtgcttagcctcccgagtagccaggaccacgggcacgtgccaccacaccaggctaatggtggtgggcacctataatcccagctactcaggaggctgaggcaggagaatcacttgaggcagagattgcagtgagccaagatcgcactactgcgctccagcctgggcaacagagcaagactccgtctcaaaaaaataaaagagcctcagttagttgccttaacgaaacattttgtttttcaccttgttatttgatcttgctttagggaatcaaactgtaacgtgtgctttctttttcttcaggtgaatctatgttttgaccaatttgtttacaagctagcagaccagatatttgcctattataaggttatggcaggaaggtgagtatctggtgtgtgattttgatacaaaacgtttcataatttgatctgacattcccattacaatttatggcgtatgaaaaactttctgtcttccttctacactagtttgcttcttgataaacggttacgatcagaatgcaagaatcagggagccacgatccacctcccgccgtctaaccgctacgagacgctgctgaagcagaggcatgtgcaggtgagctggggccgggctgtggtggggacgtagagtgtgcattgaaaagactgggttttcggctgggtgcggtggctcacgcctgtaatcccaacactgggaggccaaggtgggcggatcacctgaggttaggagttcaagaccagcctggccaacatagcaaaaccccatctctactaaaaatacaaaaattagctgggcgtgctggtgggttcctgtagtcccagccgctctgggatgctgaggcaagagaatcgcctgaacctgggaagtggagcttgcagtgagctgagattgcaccactgcactccagcctgggtgacagagtgagcaagactccgtctcaaaaaaaagaaaaaaaaaatgattgagatttcttatagctagctaggtttagatatcagcatgccttgtgactgtgaacgtccttataaattgttaggcattgaaagacacaccgtttctattgggtcacctcacacacagggaacacctgcagcattctgtatctgccctgcggctcctgggggcaggcatagcccggaggggtcagcccttctccaggagcccaaaagccagagcttaaaaagaatgaaggtgagaagcactcatcagctcagagtatcagagaaaactttctcctggccagcaggaagaatttaaagatatacagtgcttattttttacagcttttaaaaaaagattcacattgcatgcctgtattaaaacatctcatgtaccccataaatatgtacacttactgcgtacccacaaacattaaaaaaagaaaaaaaattaaaaattaaaagtgatgttacattacacacacaaaactagttagtaaaatatggaaaactaaaaaaaattgcatttaattctactctctatacacgaataatcatcatgcacatttttggacattttcaccagggctttgtcatatttttatgtagttagaacaacactgaagtatggatatgttcctagtaggccaaaatagagatggagtaattttatttatcgtcataacacctgtaaaaagacacacacaggctgccatgtatgtggggagatgggtcttgaacgtggttgtaaagggtgtcgttattgacagaccagcttctccagggtctctggtgaggcgtttgttgttttcgagctgctcatgtccactctttacctgccatccttccctgtgtacgccagctcctcggcagatcaatagacctcaatcgtctgatcacccagcgcgtctcagcagccatgtataagtccctagaactggcgattggacgatttgaaagtgaagatttgacctccatagttgtaagtaatttcactttgccctattgataaattggactaagggtaggtccagttcttgtatagatgataaaagagatgcactcatcgggcgtggcctataccaagcctcttgtatagataataaaagagatgcactcactgggcgtggcctataccaagcctcttgtatagataataaaagagatgcactcatcgggcgtggcctataccaagcctacactcagtgttcacaatgctaaattgacttaacaaacacataaccccaatcttgaaaaaatcgccaactatggcaaaaggtagcacaccacttaataacgtgtttacattttagtatgaacgagctaggagataaaaatgtttaactttggctggcacggtggctcatgcctgtaatcccagcactttgggaggcctgcgggggtggatcatttgaggtcaggagtttgagaccagcctggccaacatagtgaaaccccatctccactaaaactacaaaaattaggcgggcgtggtggcaggcacctgtagtccgagctactccggaagctgaggcaggagaatcgcttgaatccaggaggcagggttgcagtgagcccagatcgcgccactgcactccagcctgggcgacagagcaagactctgtctcaaaaaaaaaaaaaaaaaaaaaaaaaaaaagaaatatcttctttagggaccaagagagcccacaagggtcttcctgctaattcttctacccctacatttcgcttggctgtctgaattcatctcatctccaggtaaggtctaatccttctcctgttatctggaccttcaggtttcccagtgaggatgtgtgttcggggccaacgttccccgctcaccctctttgggcgctcacccatttttcggctgtctcacggagcctacagaggcaagccgcttccttcagagggtctttggattctctgctttcctggtatgttcctgtggtatttcttgaagcaaaaatttgcagtgtgagtcttcacacactgctgtgttcgtctgaatgggagctgccagttagtcctaccttctgtctgccatttttccctgtgtctctatcacaatttgaacacaggaagaggcaagactaaggaacaggaaaacagaggttaaaaacatctgaactggggaacagagaaaaataaaaatgaatgagacagaaaagagcataagaaatgtagaaaacagtggaaagacctaacgtgtaactggagtgttagaggagatgagagagagagtggtgtcacggaagacttgtctgaagagaagatggcagaaagaccttaacgtggacagaagacaccggcctgccactcaggtgtgccacccaactacacatgctggagccagggccggagccacagggggacctcagtgagcgggcccccgaaccacagctctgtggatcacctgaccaccccccaactctgaccctcggcctgtggtgcctttgaatctttaggatttaatcagagctagtaggcagtaagcctgaatgggctggttgtcttcccttctccagtgcgtggtcattggtgcatggccacacgtccgtttccactgtgggagcagggggagggtttacagtgtgcattttctaacaaaatgcacaaggtcctttctccccttcacccaaggagctctgggtctgagaactggttgaggagccatgaatttcttttatgatgattcaagttaggctggtattggtcggcctagggcttttccctttatccagatcaatgagacttccgaaggccgatcgtttgtgccagccctggggataccacagtcctttagtcaacactggcacccctgtgccaacgctggcacccctgtgagtcaggcaatttgagtacacatgagttgtgctgcccgccacctggcaccattggagtcaaggagcccaggctggtggcctacagagaataatttagacagagctcttcaaagatgcctgagatgagaacaggtttcagggagctaaaacagtaggccctgctgactctggaattgaataaatcaaaattccctcctaagacaaagctgcccatgggagaagctgctgggaatagcatgtaagctggtaagggttaggatcatggcggaggggagcatgagaggcaggtctcagaaggcttgagccagtgctgttactcttggccctgaccaacccctcttcctcttcagaagcatgagagagcttatttcacttccagtcgagccacaggtaaagatcatggtccaatcccctttagacgtattacactaaaaaagaaaatgtaagtgcacagcagtgtccctacagacagtggaggcacgtcagacagacacccacggaccatggaaactgtaacttcatctttcacagtgagctaaaagaaatgaagaaagtagtagttgctggccgggcgctgtggctcacggctgtaatcccagcactttgggaggacgaggcgggcggatcacgaggtcaggagatcgagaccatcctggctaacatggtgaaaccccgtctctactaaaaatacaaaaaattagccaggcttgatggcggacgcctgtagtcccagctactcaggaggctgaggcaggagaatggcgtgaacccgggaggcggaggttgcagtgagccgagattgtgccactgcactccagcctgggcaacagagcgagactccgtctcaaaaaaaaaaaaaaaaaaaaatagtagttgctgtgaaagaataatataaatgagaatttttagaaatccagaaataggctgggcacggtggctcacacctgtaatcccagcacttttggaggctgaggtgggtggattgcctgaggtcaggagttcaagaccaggctggccaacgtggtgaaaccccatctctactaaaaatacaaaaaattagccgggcgtggtggcacatgcctgtaatctcagctacttgggaggctggggcaggagaattgcttgaacccaggaggcagaggttgcagtgagccaagattgtaccattgcactccagcctaggcaacagagcaagactctgtctcaaagaaaaaaaaaaataaatcgagaaataaggttattggaaaaaagaaagttttgaaaagagaaaaggccgggcacagtggctcatgcctgtaatcccagcactttgggagactgaggcaggcagatcacgaggtcaggagatcaagaccatcctggctaacatggtgaaaccccgtctctactaaaaataaaaaaattagccgggtgtggtggcgggcacctgtagtcccagcttactcgggaggctgaggcaggagaatggcaggaacccgggagacagaggttgcagtgagccgagatcgttccactgtactacagcctgggtgacagagcgagactccgtctcaaaacaaaaacaaaaaaaaaaacagaaataagaatgaaggctgggcactcggtggctcgctcctataattccagcactttgggaggccaaggtggatggatcacgaggtcaggagatcgagaccatcctggccaccatggtaaaccccgtctctactaaaaaatacaataaattaaccaggcatggtggcacacgcttgtagtcccagctactcgggatgctgaggcaggggaatcgcttgaacccaggagtttttgaggctctgtctcaaaaaaaaaaaaaaggaatgaaaagagggaacatttttaaaatcaaaaagaaattaaagcagaaaaaggatttgagaggaaatgatgttctcagatgatcatcatcatggatgatgaagattcagtgtacctgtcatacagcttcctcaagaagaaaaccaaagcaacggaacagggccgactggcatctatttcaagaaaatattgataaaatagaagacaccttgaaagtgtctattaaaagcatacatcatgtatttggtaaaaccgacccaagcttgtcaacacttagaaatactgcatcttaggctggttgaagattagaaaaaataataataatacatttaaaaacggtattgcagtgaaagttttggactttccaggtgaggaagaagtccttgggctgtctgagcagggcaggcagggaaggaaaatccgattgtcctcagaccttcaccagagccaaggaaaggaactgtgaatcgagggtttggtcgccagccaaattgatcttctgagaataaaggctgcagacagatggtaatgaacgtgccagggctccagaggattgttcattcctggagaacagaccttggctggcagacactgggcgctggcgggcacagtgcgtgtccctgtgagcatctctgcacttcagagcagggccctgcgtattcatccttagagtcaaacaggctgggactcagagacagacctgtggcggcctttttctacgagcgtaatttggtacaggccatggtgtttctgttggcattggccaaatatgattttgagtaaaatcattggtcgaggctttgatcgaggccattactgtccaatagaaatagaacacaagtcagatccgtaatttgaaattttcccatagtctcattagaaaaggaaataggtgaagttatttttaataacatacttaatccactgtatccccatattaattcaccacgtcattcctatggcagtatagttgaggtgggtatttgctagtctgttttgtcctactcagtctttgaaatctggtgtctcatgtagtgcgcctcaggtgggagcagctgtgctccggccccggctgccacatcggacagtgcagcctgggcgagctccagagcagcgcacgtgagggcttgcaaggcctgtgggaacaagtgcacctgccctgccacccacacgtgcctttcagtgacttcaggcacctcagagaaagctggctcagctccaacgcccagggagatgcagccgccggctgggttatactgcagggcagggccggggctcagcgggcacatggggggaagggtggcagtagcaggccacacgtgcacgctgccccacagggtgctggacagcaggggtaggtggcgtggaggtgactgcagtggagaaaggcatgacccagtgggggtgactgaaaaggtggggtgccaagaagcaagctcatgtcacctgtcagagcctacgctcactgggggctgcctccgtgcagccctgccagggactgtgaggcctgggtgggatcagaggccactcggcgcctccttcctgcctggaccagctctgtcacccacccctgtctttggtgccacaggagctggatggcctgttggaaatcaaccgcatgacccacaagctgctgagccggtacctgacgctggacggcttcgacgccatgttccgggaggccaaccacaacgtgtcagcgccctacgggaggatcaccctgcacgtcttctgggagctcaactatgacttcctgcccaactactgctacaacggctctaccaaccggtgagcgtgcccgccacacaggcgcccacaggcgaggcgctcagggacccatgtccccgcaggcttcctccatgtcaccaggtccctgtctccctgctcttgctgctccccatcacttctcacatgaagagcacgcaggccctccagtgtcttctgtgtgcacaggcagcctcgggtctaccctcgggtggatggtcatggctttgcacgtggggcttgcgtggggctgcatctcctggctttctgtttgcctgatggtggaagtggggtgagtctgcttcttatgcttccgtgctggcatgttggagtgtggggaagccaccctcccacccaccgcccatggacagcatgaagtgatgtgattggtggtgaaacggtggatgctggcagtatcctgaggttcagcctcatagtagggcctgagtcctgggacagccctgccctgggctccgcacaccgggtggcggtcattctggctgaggttccttctctgctcactgagctcagcatctatacagtgtcagcgcgtgccagggacatgtctgtgtcacccaccatgccttcccatagacaccaacagcctggggggatgaccagggcaccaagcaaggtgcctggccactgagctccatccagacgtagaggagtgcaggtgtgtgcacatgcgagtgttaggagcacttttacaaataagtgcttgtgcttgcctctgatctccgcgtcccacccacatgtggctgaattcttactgacttgtaggcccagagttttgtgtctcaggagacaggatgccgagctctgatgagagctctgatgagagagaggagaggcgcagctgccccacggcccagtcctgcctgctgtggctgtcgtctgttcaggacccctgggtgcaggaccgcgtttcctgtggggccgtgggtcaggcccaggtgtgttgcatcactgaggccattctccagggtcatggccacgcgctctgggctgcaggtggcagcacctggcttggcttttcagctcagggggcctccaggccgggctgggagtggtccatggaaaccaaaccgtgaagaccaccgtctctgtttaactcacctttatggtgtccattttcctcaacatttttaaaagatgtttatgcttggaattaattgcaaaaatattcttacacaagtaatatatcaaaattatagaaaaatgggaaatcatggatacataggagagaaaaatgagtgaactccccagaggtttccttggtaaaaatgtatttgtcctctaaagtgaggcatgggcggccctcggcctctccatcccgagtctgcacccctgcagtaccacatacatcacagcagcagggaggggatggccaggcgcctccttccccacaccccgggaggtgacgtgaacacttctgtgtgcagatcagcacggtgcacccagtgccatgcgtgcagctgctcagagccatctgctggggccttacacccaggtagctgcactcgtccccactgtgggcggcaggaggcccctggacccatgggggaccctggacacaggcaggctggttccatcttatctggaaaccaatttcatgtgtgtcacctgtttccccaagagacccagagctgctgcctcgggccatacctgttgggcagaggtcagcatgcagtgacctcagcctcctggtgcctggggacacttgaggtgtgattcacagggaaccctagcttgtcacaggggcattttctgcagaagagctccggtttactcagcaacctccaccttccgtgagtgttggtagaagccattgtgtctgcatttcccacaagtctttggtggaatcaggagagctgtgttatctgggaaaggcattttaaaacaggattttgcgtatccaagttctgtgtcgaatcctgagaagacacataaaccatgctacccggaattttagtcccatgcctgagggttttctgagagctacatggcacaagccaggactttgctcgttgcctggcctaacttccggttagtgagctacgtgtggtggctctaggaggtgacctaggtggtctgcgactggaatttaacctgtacagtgggtaaatgtgtgacagtgctgcagctctggaaagaagctggcagaagggtatttcctcagtccagagttaggcctcttttccagaagaccatagatggagggcgtgtcctcagcggggcgcacctggagcccaaggcggcaactgtcccctcactgctcatggtgacttctgtccctggggtgaggtggtggctgccaggtgttcccactgtcatgttaccatttttctgtttaaaagttataatttgtagggagataatttgagatgatgtaaacaaactccctcattaaaatttgtcccggtcgttttaacatctgtcgacgattcctgtccgaatcagttatcttcacactggtggttgaacagcagtgagttgtttttttggtttttttttttgtttttttgtgacagagtcttactctgttgcccaggctggagtgcagtggtgtgatcttggctcattgcagcctctgccttccgagttcaagcgattctcctgcctcagcctccggagtagctgggattacagatgcatgccaccatgcctggctaatttttataattttaatagagacagggtttcactatgttggccaggctgatctcaaactcctgacctgagatgatctgcccgcctcggctacccaaagtgctgggattacaggtatgagccaccgtgcccagctgagttttaactccttcattccctctgcaggtactagctggaattctgctgtacgtggtagcatttgtttattatttgcttatttgtactaaggattatccattactgtggagttttgaggctggggtgggtgcggtttgggcagtgggagctgcctgcttggtttcagtctcctggggccgtctccaccattctttctgcaccacaagatgttccaggctcggccaggcacggtggctcatgcctgtaatcccagcactttgggaggccgaggcgggcagatcctgaggtaggagaccaagaccattctggctaacacggtgaaaccctgtctctactaaaacaatacaaaaaaattagctgggtgtggtggcgggcgcctgcagtcccagctacttgggaggctgaggcaggagaatggcgtgaacccgggcagcggaggttgcagtgagccgagattgcaccactgcactccaccctgggcgacagagtgagactccgtctcaaaaaaaaaaaaaaaaagaacagaaatttattctcttacggttctggagtccagaagtctggaatcaaggtgtcagcaggaccacgccccctctgagacactgggtagagctgttacttctggcggtgacctcagttctgggtgttcttggcttgcagtggcatcactccagtctcctctctgtcttcacttgccactgtccctgtgtgtctctgtctcttctcttctcgcaaggacttcagtcatattgggtcaaggacctaccctgctactccagtatgaccttgtcttagccagacacatatgtggtgaccctctttccagcagacttcacattctgaggtactaggagtgaggattgaacatatctttttcgacggagtctcgttctgccacccaggctggagtgcagttgtacagtctcggctcactgcaacctccagtaggttcaagcgattctcctgccacagcctcctgagcagctgggattacaggtgcctgccaccatgcccggctaatttttgtatttttagtagaaatggggtttcaccatgttagccaggctggtcttgaattcccaacctcaggtgatccacctgcctcagccttccaaagtgctgggattacacgcatgagccactgcacctggacgaacatactgttttcagagacagtacaacccatagcccacatgtgcatgtgtattagtccattttcacactgccgataaagacatacctgaggctgggcgatttacaaaagaaagaggtttaatggacttatggttctacatagctggcgaggcctcacaatcatggcggaaggtgagagggatgtctcacatggcagcagacgagagagagcttgtgcagggaaactcaccttttaaaaccatgagatgtcatgagactcactcacaatcatgaaaaaagcatgggaaagacctgcccccattattcagttacctcctaacgagtcccactcatgagacgtgggaattatgggagttataattcaagatgagatttgggtggggacacagccaaaccatatcaatgtgcatgtttatttctatatagttacctacgtattaaaactataagtttatactgatatttccaattccatttcagcactgcagagttcattctagtcttctctctttccctttttctgacttcattaaacactgaggatccttgcttcattattcttagtatattactcatttgctcatttccaaaaaaacacagaaagtagtttcagaattgctaatcctggctgggtgcagtggctcacacctgtaatcctagcactttgagaggccaaggcaggaagatctcttgagtccaggagttcaagaccagcctaggcaacataaggagacctcgtctctacaaatttttttttttttttagacagagtctcatgctgtcacccaggctggagtgcagtggcacagtctcggctcactgcaacctctgcctcccggattcaagcaattcccctgccttagcctcccgattagctggactatagtcgcccgccaccacgcccggctaattttttgtatttttagtagagacggggtttcaccattttagccaggatggtcttgatctcctgacctcataatccgcccacctcagcctcccaaagtgctgggattacaggcatgagccaccgtgcctggtctacaaaaaggtttttaaaattagctgggtatggtagcacacccctgtagtctcagctacttggaaggctgacatgggaggatcacttgagcctggggaggtctaggctgtagtgagctgtgatcatgccgctgcacgcccgcctgagtgacaaagcaagaccttgtctcaaaataagaaagaattgctcatttttaccaccgtaaaacacaaacctgccaactctagttcaatatttgttatcaaatttttatctttagattgagaatatatagtaaaatattatgtttaaaattcattagccgagcatggtggcacacatctgtagtcccagctactcaggaggcccaggcaggagaattgcttgaacccaggacatggaggttgcagtgagctgagattgtgccactgcactcccctgggtgacagagtgagactctgtctcaaaataaataaataaataaaattaaattaaattatttggaatgatagagtaacagggtttagatttattcttactccttaagtgaaaaactggacaggacgtatggatcagctgttttcagactcggaccttttgctgaggggacggaagcaagtgaggtgagccctgtgatctccctgacttccatctgaaagcactttctggaccaagttcagagaggaacagtccaagtacagcttggaagttcctgattggtagaggggacaaactggaacttggggaagctgaggcagctggaatttgcagggtggcatatgagagagcagggaccttaacagaaacagctcctgaaaccacatgggcatcccatagcctttgcttgaatactaaactgtgcgtgtgccagggagctgctagctgaatgattctcagcgttcacacaaggccaggaggcttctgagttcctactagcaagaagaatggaactctgttgaggctgggcacagtggctcacgcctgtaatcccagcactttgggaggccaagacaggcaaatcacttgaggtcaggagttcgagaccagcctggccaacatggtgaaactccacctctactaaaaatacaaaaattagccaggcgtggtggcaggcgactgtagtcccagctactcaggaggctgaggcgggaggatcacttgaacccgggacgtcaaggctgcagtgagccaagaatgcgcgactgcactccagcctgggtgacagagactatctttaaaaaacaacacaaacaaaaaaaaaaaacaaccctgttgaacacccagatgttcactagaggtgccagaggtactgaattatgcccatccctacaagtgccaaaaattcatcatgacaagatccagcagattgacaagtaagtcaactgcctgccccccaagacattcaacactctctcttttttttttctccctattcttgccattctggatttcagttagatatatgttagttagaccttctcattttattctccacgtccctttgttgtactagttttcctttttttgcggggacagagttttgctcttgttgcccaggctagagtgtaacagtgtgatctcggctcactgcaacttctgcctcctgggttcaagtgattctcctgcctcagcctcccgagtacctgagattacaggcatgtgccaccacgcctggctaacttttgtatttttagtagacatggggtttcaccatgttggccaggctggtctcaaactcctgacctcaggttcaggtgatccacctgcctcggcctcccaaagtgctgggattacagccgtgagccacctcgcccggccaacactctttaaaagacagtaacaaagtcaagacatgcaacatggcactgaaatgcccagtgcccaatcaagaattactagatatgccaagaaccaggaaaatgtgacccatagcccagagaaaaatcactctgtacaaaacagacgcagaaatgacagagatgatggaattcgcagacaaggatgttaaggcagcgactatgcatgtgctcaaggattcagggaaaacaatgcagagataaatgggtgttatataaataatccagtgaattaaagctgaaatgcagtatctagaatgaaaaattacttgttgggccgaatatcagagtagactttgcgggagttgagtgagtttgagattataacagtggaaactagctgaactgaagcaccaaaagaaaaaaatgatgaaaaaaacgagaagggcctcagcaaactgagacaaacatcagcgattctaatatgcctgtgattggaatcctagtaagaggttgtcggggggcagaaaagatttcaaaattaatgcccttgaatttcccagatttgatgaaaacgataaacccacagatacaagaagctcaataaacctcaagcaggatcgacacaaaggaaaagagccactgttgggcctagcactgaccaggtcaaaataaggctggagctgaacctcagtgtacccgaggcaacgtgcagtgggggcttaggatattggtgctgaaacttagttttcctcttaggggattgcagtgacattgtcaaactgcagagtctgagggcacagtcctccacaagactgcctttgctgcagacaccagccacacatttggggtccctggggccaccctcacttctaaccagcaggttacagttcaggatccaccctccccagctcttcaggtgacacattcgcagtactcactgggcgtgccctaatacgattatagtcaattggaggaaaggatgcttgttggaaggatgtgcagggcaaagtctgggaggtttccatgtgcaaagctttccctgtcctcagggacgcatcaccctccgagctctgaggtgggacgctcctcagggtactgccagccaggggcgctcacttgggctgtggtgttcagtttttattggggcttcgttgcatgggcacagttgactgaatcactggccacgtagctgagctcagcctccagcccttcacctcccaggaagtcagctgagttcaccaggcacacagccccaggcctctaaccccatgctgtctttctggtgtggccagccccatgttgagtcatcttgctagcataaagtcaggtgtggccccgtgataccagtcattcctgtcactcagaaatgagggtgtagagactgcctcctagaactgggccagaggccaccaaatcctacccaggagtcaatcagtatctaaacttgataaatcaagaagaagttgtagaaatgtattatttagaaatatagaggccgagcgtagtggctcacacctgtaataccggcactttgggaggccaaggcaggcagattgtttgagcccaggagttcgagaccagcctggccaacgtggcaagaccctgtctctacaaaaaatacaaaaattaaggccaagcacaatggcttacgcctgtaatcccagcactttgggaggccgaggcagacagatcacgaggtcaggagatcgagaccatcctggctaacacagtgaaaccccatctctactaaaaatacaaaaagttagctgggcttggtggcgggcgcctgtagtcccagctacttgggaggctgaggcaggagaatggcctgaacctgggaggcggagcttacagtgagccaagatcacgccactgcactccagcctgggcgacagagcaagactctgtctaaaaaaaaaaaaaaaaattagccaggcatggtgacctgtagtcccagatactcatgaggctgaggtgggaggatgacttgagtccaggaggttgaggctgcagttagtcaagatcacaccactgcactccagtgtgggtgacaaaaaaaaaaaaaatatatatatatataaaatatataatatatacatatagactataaatgtatatatataattatatagaataaatacatgtattatgttatgtatcatatatatgtattttgattaaaattttaaataatattataaagagtaattgcattacttcaacagttctgtatctgagttatatcatagacaaaataaattaaggcctgctttctaaatttaaccatcattttaaacattctaagcagggaaaacattgtgttctaagcagacatagtagtaaagcctcctctaggccgggcgtggtggctcatgcctgtaatcccagcacttcgggaggccaaggtgggcggatcacttgaagtcaggagttcaagaccagcctgaccaaaatggagaaaccctgtctctactaaaaatacaaaattagccaagcgttggtggcacatgcctgtaatcccagctactcgggaggctgaggcaggagaatcgtttgaatccggaaggcggaggttgtggtgagccaagatcacaccacagcactccagcctgggcatcaagagcaaaactccatctcagaaaaaaaaaaaaaaaaaaaaaaaaaagaaaagtctgctgtaatataagtggcatcatatcctggcgcttggctccctgcatggatttttactctgattttccatttgttgtcttctcccgcaccccgccgtcaccattgtaggtggacggaggctgacgtgtgtgccgtagctttgcaggtgtgtcaccatcggaggtggacagaggttgatgagtgtgccgtggctttgcaggtgtgctgctgtcaagggtgtgagcagtgcccaggaatctctgggaaatggggttcccttttctgagcatcaccctgaccgtagcgcctcctgatggaatgtacttcctggaacgggtgttaagaacacaggcgcagggacacacagacatgcacacatcctgttgcagacacatctgcagataacacatctccatacatggactcacgcagatgcaggtgcacagagacatgcagacagacatgcatgccaagcactgaggactgtggcacccagggatattggcatactgacagcacagggatttaggatccgtttggaaaggcatacccagaagtactgcggtaggtggtcagggggcctagtggctgctcctctgtgcagcacgtcctctcagatgcacacattgtgtgggacagcagtattttcacaattacatctgtttccatttcctgaagtggaatatgagttaatcaagtgcttggaattacataattagcaaatccacaaaattgtctttcttatacttctttgcaaaagttttatgtgtttaaacgaacccttccaatttgaaaggcttagctgagtttgatgtttctgcatgaaaatggacacattcgattttaagtgtcccctaatccattatcaagacacaatctcttgactaattgagtgggttacaaatacctaagtgtccctgtccttccctgctggtgtgtaacttgtgatctgaaccaccggggcgtcgccgttctcgtcacaggcagctgccccaccgtcctcgccgtgtctggaagcgcagcagagcccacgagctacctgaggattgcgttgggctcgaggcggctctggtacagcagaccagaccccgggtgttcctgctgtggcccctgagctttgggtgcatttattatatttgagtattgagatctcattcgttctatggttttcgattcactagaattttcctatttgatgattgtatcagttgactgggaggaagatttagtagatggattatggaggacttctgaattttaaagaactattgttaaatttggtttctttttcttttttaaatctttcttgtttaggtttgttcggacagtgttaccattttctcaggaatttcaaagagataagcagcctaatgcacagcctcagtatctgcatggatccaaggtaggctccaatgtgttcgtgttacgagcttgaagctcataatgaagcatgttttgaagtgtagtttaattggtttggttgcagtgacctaaatgtatcacgctgtgtataaaatgttattttttttttccattctgttaacatcttcctgaaaagtagcagtaatttaaaacaaaaactagccaaccaacccaaaacagtgcttatctagaactagcgcgtacgtagtgttgggacagctctggccttgtgataggtgtcaggctgggcctggtctctttcccagcacaaacacaagtgagattgttggaagattacaggtttaaaaacatcaagctgagaagacaagtggaagaggctcaggtgcattcctgagataaggaggcccagggtggctgtaaggcctgaccggaggagcggagctggaaaggtgagcccagggaaggtctgacatccagaaacaaggatgtccgcctgtgcctggagggtggaaacccggagcacccgggtctaccatgtgtgagataggatgatgtccacgctgggggtggcttggcttgtcacaagtctgagtattattaagggctagtttcttcacgtttcaagcacccgtgtgatttagtaaggaaaatataaacattgtagcaacgaagagagatgaaatgagcagataccccacaaaaatagagcagagcaaatacaagcagatccccagcctcagcggagctggggaaggaacaatgatggcggcaagagccagcaggcccccaggatgaggccagaggatccggctcgcctgtgaagagcgaaagcgtcttccctctgcgagctgcggtgtccccgggctctgcggtgggggcaggctgccagcactcatcagtatttaagtgtcctcgcttgtaggaagcggggacaatcacaggacattgtctgccccatctgcccaatgcctggagctgggatggagagggcccaggccctgccgctcacacgctgcctgcacctggacgctttctaacgcaccagctggctctgagtggcggaaacaatgttttccactcattcctttctaaccctctgttcttcagagcgagatcttctcactccagtcctttgggcgtcttccttctccttacagggcagtgccttggacctggcaggagcgcaagtgtttgcacctgggaaacggcaaacacccaaatcagggcattggtttttggagggcccaagcctcggcatacgctgcccgtctctcccgcccctgaaaagagcgagtgtgggccgggggcggcctttttacggcactcagagcatctctgagcaggagagacaggtcgtctgaactgtgtgcagtgatgaaggggatgtgagattcctcttcgggaaacggggcccacgtggaccaagggtgactgtgtaaacattatgtccttgaaaatatgttctttttattttttatttttttgagatggagtctcactttgtcgcccaggctggagggcagtggcatgatctcggctcactgcagcctccgcctcctgggttcaagtgatcctcctgcctcaacctcccgagtagctgggattacaggtgtgcaacaccatgcctggctaatttttgtatttttggtagagacggggtttcaccatgttggccaggctggtctccaactcctgacctcaggtgatctgcccgcatcggcctcccaaagtgctcggattacaggtgtgagccactgcgcctggccatctttagtgttttaggggttattttttttagcaatgttatgatggcaattgaaaaaaatacaattcagatcctctctagggtgcagatgtttgaaggaagtgggttcttgcctttcacaaagacaaggttaaaggtgggggtgggaggtggcattgcctgccttggggagaaaaatgtcagggctgggagcctcgctgacacatgagggccagggtcgccaatgcctggagaacatgggacaggctcattccatcattccacactccgcgttctcgaggctgttggcaggtgcggcctccgctgtgcccctccaccctgtctctgttcgtgttctcgaggctgttggcaggtgcggcctccgctgtgcccctccaccctgtctctgttcgtgttctcgaggctgttggcaggtgcggcctccgctgtgcccctccaccctgtctctgttcgtgttctcgaggctgttggcaggtgcggcctccgctgtgcccctccaccctgtctctgttcttagcaactcctaatggctgtggaactgtgagtggacacacagttcgtgtgattctgggcttcatgtggctgtgttggtgccccaggagggcatccagacaggtacccaggcgccaagaatgcagtgaccgggcctctcctctgtggggcagggtggggtgcacgcctgggcaggggtgcgccacagctgttacggggctccccctcacttcccgaagccctgtgagtggttaagaattcacctccattctgctccatgtgatactcccatgttctttctagcaaggattgaagttgacttttctttttttttttttttttgagatggagtctcctctatcacctaggatggagtgcagggcacaatctcggcttactgcaacctccacctcctgggttcaaacaattctcctgcctcagcctcccaaatagctgggattaaaggcgcctgccaccatgcccggacaattttttgtattttttttttttttagtagagatggggtttcaccatgttggccaggttggttttgaactcctgacctcaaatgatccgcccaccttggcctcccgaagtgttggaattacaggcatgagccaatggtggtgcccagttgaagctgacttttatgcaataattagttatactcaaaaggatgtttctttaaaggattagagtaagtgttctgaggcttctgcttctgaaagtaaaatgtagtgttttacctttagaactgaaggaaatgttattttagaagataggactagaaagtttggcgagtgagaataatttcttgggtctctgtgaactaaaagatttgctctgggcttctcttgactttgaaatttttaatccctgttttaggcataacaataaagtaggtttttgtcactccctgatagagaggcatttgtgcgcagagggcactgggcagagaggctcctctgtcacccccatctggagaggatggctgtggaagcgagggaggcaggcggggggtaggcaggcgacccgactgcgtggggccgtgcacctgcggttctgatggatcgagtcctggaaggggcctcgtggggttggtttttgagatcccaggatagcactgtggtgacatctttgctgcccagtgtgtctgtgtgccctttgtggtgttaaaggctcttgacacacgtttttattctccaggattttctcccaggagtgcagggaggcactgttgcttccattaagatgccaacatgagcgcgctgttccagggtggtggtgcggggtgcacatttgccttgagtcagcccctacactgccagagcaccctgctgccctgtgtgcatgggcaccacctcagggatggctccagggaatgggcacttggaggcatttgcaaagctgatgctcttttggagagaaagaaagatttgatgatgtgaatttgatttttttttaaattcaactatttgcaactgaacttgaacctcactgtaagagatttctgcctccgtttcagaaactgtttgtgtcgtttttgttaaaacctaagctagtacatggtttttctttttgttttttgttttttttgtgtgttttttttttttgagacagagtctgtcccctaggctggagtacagtggtgtgatcttgcctcactgcaacctccagtgattattgtgattccagtgattcgtgtgcctcagcctcccgagtagctgggattacaggagtgtgccaccacgcctggccaatttttgtatttttagtcgagacagggtttcaccatgttagccaggctggtctcgaactcctgacctcaaatgatccacctgcttcagcctcccaaagtgctgggataaaggcgtgagccactgtgcctggccataaaccagtaattttttttttttttgagacagggtttttgctttgtcacccattgctggattgcagtggcgcaatcacagttcactgaaacctccgcctcccaggctcaagcaatcctcctgcctcagcctcccaagtggctgggactacaggcatgcaccaccacatctggctaatttttgtgttttttgtagagatgggatttcaccatgttgcacaggctggtcgcgaactcctgagctcaatcagatctcctgcctgggcctcccaaagtgctgggatgtagccgtgagccaccgtgcctagtcctaaaccagtaattttctattagattatttagacatatacaagtgacactgatgttgaccaccacccactcaagaagaggctggatactaaaagagatgatgtctgagctgagtcatgtgctcacagcagacagcccttgtactcacaagcactcacatatgccacgtgcacttgcttctgctgcagtatgagtcacagtgtatatctgtgtgattatggaatacacaggaatccactcaaaaaacagattagtgctttttttatgaatagtgaactagggctggtatcttgcaggaataaaataaacttagatgagggacccatttatgcaatgttatctttttcgttcttggtcatgtcaccacttacagcatgcctgcttctcagtaagacacccttttgagcacattaactagtattctttatctcataagtaagattgtccccatttcacagatgaaggctcagagtgtcgtgaaagttagagcacccaagttgcacgactggcgagtccagagccggctctgtgtgctgtgacccaccttctctgcttgtcgaacaaggctggagactgtatcaggcacgggcagcagagtctgtcttgaactgagctgtgtgactggacatccagagtgcttcctcttctgagcttaagtcttttacagcacagtgtttgtgacggtgcccttccccagaagtagtgcctcctcccactcccctgagtagttaagtcacatctgctgtttgttaccctagctgtgttgtctctcggatgtgtcatctttggggtgagcttagtctactgggaaaccggacactgggcagggggccagaggcctgggaccatgtgttcattgagtgatgcctcctctgacagctgtcatcctgagccagtcagggcgggtctgagaatgaattctctcacttgtaacatgaggtcattagatttcactgatgactttcgtgttcttcttttcaaacattgaacctgttatcaaccaaaaatattacacagaatcccagcacataaagcccagggtgctgctctgaggagaggctgggaggagggggtgtgggcgaagatgtgtagatggtttcttcaaggttgcagcgggccgcagggcttgggcctgggacagacactgggtggggtttctgtccttcagtgttgtctaatctcgtcactgtaatcagttttggctctttgttttggggggtctcatgaccctctacacatctgataattcactagaaggactcacataactcagagtcttacagctgcagtttattccagcaaaggggtacaaagcaggatcagtaatggaagcagacagatcaggcggaggctgaagaaagcaggagtggctgtattaatataagataaaatcaacttcagagcaaagaatattgccagggagattacataataataagtcaaaccaccacgaagaaaacatagcaatgctagatgtttatgcgtcaaacaacaaggcttctgtacttgaaggaaagactaatagaagtaaaggagaagtgaacaatcccacagttacagttggggacttcaactctcattttagtaattgacagaacaagtagacacaaaatcagcaacagtagaaaagaactgaacaccaccatcgaccaacaggatctaactgacgtgtgtaggttcctctaccccacaacagcagaatatatacgtttttcagattcccatgaaacattcaccaagatagaccatacgctgggccataaaactcacctcaacaaaatttaaagaactgaaatcctatggagagtgttctccaactacaatgaactcaaaccagaaaccaataataaaaagataaccagaaaatctctatatgctcggaaattagcacacttttaaataatccttgggttgaagaggaaatctcaagagaaatttaaaaatacattgaattgaatgaaatgtaaatatatcaagatttgatatatacagctaaagaagtgatttatttgatttgattattcgatttatttatttgatttatttggtatacagctaaagtgctgagagggaaatttatagcactgaatactcacagtaggggtctcctgctatctgcacccgtgtccttagacaagctgaggggtgtccttctgcaggaaccaccttgatatgttttggctctatgtccacacccaaatctcatctgaaattgtaatcctcataacccccatgagtcaagggagggacctggtgggaggtgattggatcatgggggtgacgatgttctcatgatagtgagttctcacgagatctgatggttttataaggggttcttcccccttgctctctcttctcattcctgccaccttgtgaagaaggtgcctgctcccccttcaccttccgccatgattgaagttttctgaggcctccccagccatgtggaactatgagtcagttaaacctctttcctttataaattatccagtctcaggtatttatttttagcagggtgaaaatggactaatacagtaaattggtactggtagagtggagtactgctataaagatacctgaaaatgtggaagtgactttggaactgggtaacaggcagaggttggaacagttcggagggctccaaagaaggcgggaagatgtgggaaagtttggaactctctagagacttgttgaatgttttttgtttgtttgtttgttttttgaaatggagtctcaccctgttgcccaggctggagtgcaatggcgcaatctcagctcactgcaacctccgcctcccaggttcaaataattctcctgcctcagcctcccaagtagctgggattacaggtgcccaccaccatgcccagttaatttttttgtatttttagtagagacagagtttcaccgtgttggccaggctgttctcaaactcctgaccttgtgatccacccacctcggcctcccaacgtgctaggattacaggcgtgagccaccacgccctgcctgttgaatggttttgaccaaaatgctgatggtgctatggacaataaagtgcaggctaactaaggtggtctcagatggaattgaggagcttgttgggaactggagcaaaggtcacttttactacactttagccaagagactagcagcattttgccccgccctagagatacgtggtacattgaacttgagagagatctgaaattggagtttgtttaaaagggaagcagagtataaaagtttggaaaatttgcagcctgaggatgtgatggaaaagaaaaacccattttctggagaggaattcaagctggctgcagaaattttgaatgtcaatcaccaagacaatggggaaaatgtctccaggacatgtacgaggcagcccctcccatcataaacccagaggcctaggagggaaaaatggttttcttggctgggcccagggcctgccctgcccctatggttccccctcccccacctccccaccccaccccccatccccgtgcagcttcaggacttggtgccctgcatccctgcttcctggtcgctaaaaggggccaacatacagctcaggctgttgcttcagagggtgcaagccccaagccttggtggcttccgcgtggtgttggaccacctagatttcaaaggacatgtggaaatgcctgaatgtccatgcagaggtttgctgtgggggtggagccatcatggagaacctctgctagggcagtgaggaagggaaatggggggttggagccccacacacagagtccccactggaatactgcctagtggagctgtaaaaagagggccaccctcctccagaccccagtcagcttgtactgtgtacctggaaaagccacagacactcaatgccagcctgtgaaaacagccaggagggggactgtaccctgcaaagccacagggtggagctgcccaagactgtgggagcccacatcttacatcagtgtgacctggatgagagacacggagtcaaaggagattattttaaagctttaagatttaatgactgccccactggactttgggcttccatggggcctggagcccctttgttttggccagtctctcccatttgcaatgggagcatttatccaatgcctgtacccctattgtatctaggaagtaactaacttgttttttattatataggctcataggtggaagggacttgacttgtctcagatgagactttggacttggacttttgaattaatgctggaatgagttaagactttggggcactgttgggaaagcatgattgagatttgggaggggccaggggcagaatgataaggtttggctgtgtcccccacccaaatctcatctccacttgtaatccccattatgcccacatgtcaagggtgggagctggtgggagttgactggttcatgggggcagttttccacatgctgttcttgtgatagtgagtgagttctcacgagatctgatggttttataaggggcttcgccttttgttctctcttatctttcctgccttcttgtgaagaaggtgcttgcttcccctttaccttctgcataactgtaagttttctgaggcctccccagccatgtggaactgtgagtcagttaaacctgcctttttttttttttttttttttgagatgaagtctcgttctgtcacccgggctggagtgcagtggcgcgatctcggctcactgcaagctccacatcccaggttcatgccattctcctgcctcagcctcccgagtagctgggactacaggcacctgccaccacgcccggctaattttttgtatatttagtagagacggggtttcaccgtgttagccaggatggtctccatctcctgaccttgtgatctgcccacctcggcctcccaaagggctgggattacaggtgtgagtcgccgcgcctggcctaaacctgcttttttttaaaataaattatgcagtcttgggtatttctctatagcagtgtgaaaacggactaatacacaccctaactaccttcctcgccttcccactccacaggggtctctctcccggctccgggggtgccctgtgcatcctgagaaggcagctcccccggccccttcagggtccgaccttgggcatcctgctgggagactgggaggcagggggaaactctgggtcgtattcatttctcattctagacttcaaaatggcttctagcgagtcggctattcaacaaatgttgaaacaccaaatggttttcttttcttttctattttagcaggtttctttttggtggcaggctaagtaggttttgtaactgtaccagttaagggcagtagattttacaagtcagtagactcagacccgctcacctgagcctgtgtgtgttgagtgatcttctcacacagttcttcatctgcacatgtgtgcggggaccatgctgagagctctgtgccctgttttccaggctttgaacttggcctactccagcatttacggcagctaccggaacttcgtgggacctccacactttcaagtcatctgccggcttctcggctaccagggtatcgccgtggtcatggaggagctgctgaaggtcgtcaagagcctggtgagtgttccctggacatgcttctttcacacagcctggattccctggggcacccatgccagagggtcttctctgcctggactgtgattctccaacagctggattcgttcaattaggcttcaaacatttctgaccatatatagtttgatacttccctcatcttttcaaactcaagagaatgggtccaggttattttaactgatacgcagagtttttatttgtatgtgtagagagggggtcttgctatgttgctcaggctgtccttgaactcctgggctccagagatctgcccatcttggcctcccaaagtgctggggttacaggcgtgagccaccttggccagcctggatttagttttctagacataacttactttttataatttttcatcctttttattattttaatcttctgtgacttgagaccatgtaagagtttggtcacttggcacagccatcagcccgtgacccaaacaggtccttccaggacccgctggggactctgtcccaaaacatgtggcagcttggagggtgttaggattgctgacctcaccacagctgagcctggggccgcacccaggagcacagacagcgtcctgggggaccctggagctggcagtgctcacgatgctggggtgcatccccataggagacacctggcgacaaagctctcccctcattgtggcaccccgggaccactttcatcttgaaagaggagtccagtttcagaacatgaattcagtcatgggaagccacctggtgatggttgctctctctcccggggtggattttattccccagccagacgatcctgcagccttgctggttaccgagctctttgctaacagacttgtttcagggtatgcgccggccacaggcgttagcagagcggagtggggtggctgacgcagcccgtctcatctccccggcagctgcaaggcacaatcctgcagtacgtgaagacgctgatggaggtgatgcccaagatctgccgcctgccccggcacgagtacggctctcctggtgagtgcgggcgtgtggagctcacagtgctgtctgtggagaggtcagaaaggaattcaagtcagaaattcttgagaaggattagatttgccatgtgggaagaggcagtagacagacaaatgcaccttacaaccaggaagaggtgtgttggggtcactgtctgcaggcgaggaagcagaggtcagcctgcaagagttgagacaagagacccctgaacaccacgctctcgggcacccctacgaaagaattgccacccaatgaggcgagagagccgactgctgggtcctgctgccctgctgggcctatagggacttgaggctcagagacaggcccaccgagatggtgcaaggcctgcccctgcccccaggccgtcccatccatctgcaggtccagctgcagggccctcaggcaggtgtgctcttagggacaggcccacgtgacttgctgtgggttggtttggggcaatgcaaataaatagctttagtgatctcagaaagcattgtctcataaaattgtatgacagggacctttgtcacgtaacaaaactgcttttagtctcttacctggccgagttttcttgaaagctggacagttgaacactagccttgtgttgtaaagcgacttgagcctgcacgtgggtgaccgacgaggcactgtcctgatgggcagtcagtcagcgtggctgagctcttgaacacgtggctcaggactttttgctttttggcaactccccagggctgttgctggtgtttgaggagacgataaggtgtccccctcagccaccatggggaagtagccatcagcacggccctggctcaagagaatctgttttcagtttattgtcagaaagtagaggaggaatgctgggatgattaaaaccaatgcttatgtcgtgactagagatggaaatttcagatgttgaggagggagccatttcccagtgtggtacagggaaagcttgctgggaatgacacaggtgcatgagcgtccccgcccccacccccgccaagtggggctgagtccctgcagcggtgctgagagctgggaggagcagaggggccgtgtcgggccgctggtccttggggaaggggcactcgggcaagacctgctgggacaagggtttaaggtctgctgagcctcccgctttgctcttcccagggtagtttaggcccctcctgatgccacgttcattgtgcggtcagctgccggtttctgtctgggctggagttgaagctgtagattggctgggaaacgttggccttctgtcccatatttgcaccttgcgtctttttgtgccttattccgctgtccgggatgccgttgagacgcctgccttgctctggagctggcctggtgtgcggcctcccgttgggcgtgctgttagttagctgcaggcttcctagatgccctttctcagattaggtgcggccccttccatgcctgcgaagagagattgcattttgtcaaataccttgtctgcccccactggggatgtggtgcagtctttgttcttgtcatgtggtgacgtttcctatcatcatagccttccctaaagatatgaggttgagttgaaaagaggcttcagagccaaggcccggggtcacatggtgtgtggagaacgtgcccaggtggcgaataaaccaccgctgcagggaagatgctggggatgggacgttgtggctgtccttatagccaggcttgatggcggtgtcagaacggcaggtgctcctggctgtggacccaggctgctagggcccggccccctccagtcccccaaccccacctcactcccgccaccgtaggtatcctggagttcttccaccaccagctgaaggacatcgtggagtacgcagagctgaagacggtgtgcttccagaacctgcgggaggtggggaacgccatcctcttctgcctgctcatcgagcagagcctggtgagtggccccccaacgccgcccctccccgccccagcccaccccaccccaccccaccggccaggggagggctttctttggcgggttctttagtgggggtgtggcaacagctgtgcatcatttttttttttttgtggctgttgagactttagtttgaatttgttcccttcaattgaaaaacaaaaatgtactgtagttcactgtctcaagaatgtttttctgtgttaacgtcataaaactgttatattatgtgatgttttcaacatctaaatgaacatatttggtgtgcctgtaaggtataaggcattgctgcgcaggagggccctctgtatgcctgaggccgctgagcagttgaagtgtggctcagtgtgactgaggaactgagtgctaaatgttactgaattatcactgatttaaatctgaatggctgcacgtgccccatggtggacagcacgagtggccagcatgaaaggggagcccccgggagcccaccccctcttaggacgtggcacagtggacgcctcgtgttttcgactggccgcctttttgtggtgctgtctggctgtccctctgtcctgtacatcacagcagctcagtttataacctcctgggctgggaaagccagtgggaaatggaatctcaggtagccctctcctgccttccatcgtgactaacgaggtgggcatctcttcgttcgttgcgtcttcttgtttcttttcctgtgaaatgccccattgagttcttcggcctattttctttttctttttttttttttttgagacggagtcttgctctgtcaccccggctggagtgcagtggcgtgatgttggctcactgcaagctccgcctcccgggttcacgccattctcctgcctccgcctcagaagtagctgggactacaggcgcccaccaccacgcccagctaattttttgtatttttagtagagacggggtttcaccgtgttagccaggctggtctccaactcctgactttgtgatccacccgccttggtctcccaaagtgctgggattacaggcgtgagccactgcgcccggcctcttttgcctatttttctacagctcattctgtgtagactctttatgtgctgcacatatcgtaaattcttctcccatttgtggcttaccttttcactctgatagtggtgatttttgataaaatgctcttaatttggatgtagcctttttttttttaatgattagcacttttttttttttttaatctaccatctgcacatggaactttcagtatctttttgaagatgttttccctgccttggggtcatgaagacattcctttacattgtcatctaaagatttgaagctttgccttctgcatggaagtttgtaatccttctggagttggtctttgtgtataatgtgagaggcagaggaagcttctttctctctgtggagacccatttgtccctcctctagtggctgaagggctcctcctcccgttgctgaccagtggtgtcccctgccatctgccagcttttcatgggcacaccggcctgtctcctggctttctgccacatctcgctggtccaggcatctgtctctgacatcatagcacattgtcttgctcatcgttgctctaacatgactctcgagtccccacttgccgcgttccctgccttgctccttcttcttcagcatgttccctccccagggctctctgctctgccctgtttggggattggttcaccacataccctggcgaagcgtattggcttgtgcatgggaatggcacttcgtctccagagctgcctggggaggcctttcctatgttgtttcccaaagcagtctcttgtctttaggtctctggtagctttgcaaaggcagagttgtgtttgggaagaacagggagagggtggtctgtacacagctcagggcattgctgtcagactgccaggcctctggggactgagcctctggaccagccgcctcacaccagcctgtgcggtgaaagagaatgtgttggctcacatgtcaggggagtccgaggtcaggcgtgacacgcctgggagctgacagcctccatcagacctgcatcttcggctccctctatgcctgcacgcctaggcagaccctctcctggtggtttcaaagagggactgcagcagccccaggccttcattgtcctggccacccacaggctcggtggggaccccaagtagcatctcctcccatgctcccctcaccactgtgagtgtgaggggtacaagatggagaacccaccagtgtctcagaccagcaagaagccagtgtccagggtggccctgctctaaggacatgttccccaaataattgtgaattgttaaaaaccagatgttaggaagcatctctttaagtataatctctcattatgaattttaaatatttaatacaggaatattcctttcatgggtgacttttcctgaacttacagcataaggcgcgccctatctcatctgctatcttagtccattttgtgttgctgtggcagtgcctgagactgagtaatttataaagaaaaggagtttatttggctcatgactctggaggctgggaagtccaagatcaggcagcccatctgtcagggtctcatgctgcttcagctctgggggaacagagaaggggaagcgggtgttgccaagagaacaaacatgagaggcagccttgcttacaacaacctgctctcgcaggagcttatccattcccacaaaaactaacccaattgtgggagaactgacccagccctgtaagaaatccatcacctctcggaccaccttccaacactgctacattggcaattaaatttcaccatgagttttggcagggacaaaccacatccaaaccatagcctctgtgtatgtccaagcctgaggatgcctgtctggtcattggcctcaggtcagggaggtgagacccgagctttcttaatggggagacagccttgtggaattgatagagatagtgtcagagaccccttagggctggtttctcttctgtccagctgccctttttggaaataagataaagtgtcaaaagcttttctttacatcatttctttttttttttagactggagtttcacgcttgttgcccaggctggagtgcagtggcacaatcttgactcaccacaacttctacctcctgggttcaagtgattctcctgcctcagtctcccgagtagctgggattacaggcatgtgccaccacacccggctaattttgtgtttttagtagagatggggtttctccatgttggtcaggctggtcttgaactcccgacctcccgcctcgccctcccaaagtgctgggattacaggcgtgagccactgcacctggcctgacattcttcacataaacaaactcttgtggttctataattatttatgtccatcccaggactcatggacataaataattatagaaccacaagagtttgaagcaggcagaatggaatttactaggataatctcttagcttaaaggcacggtttctgtgcattgtcatggcaacagttggccctctgttggcttctggatggagtgtgatgctgcattagaaacagggaaagagaagcggagcagatggtgtctggccggcgtctggcactggattgacgttgatgagtacggaaaagtctgcctttcttcctcttggtcttagttttgccatcatctctgggaggtcctcagaagttaaaatctcattgtcggtatttcttgattttctgatagctgtttctttgtttaatcatttcttttactcctatgggactttaagatttcagcatggctgtggggtcggaggcactgaaggctccatcaccttctgcctgctccgtgggggtggtgagcgcactgtggtctgaagaggcccttcctggtggcctaagagccctcacctctaaagatgaacagcagttgctcaatttttgaccatctttgggttcttggtggatttggggtgttctgctgtcctcatgatcctggaggtacattttctttatatatatatatgttattctggagaacggaccttgtgtggtttttattacctctgtaaaggagcttgtgacccaagagcagttcggcatgatggcctagaactttgttttgggctctgtagggaatgagtggatgtggacaccagggtaggccacccctactccttccatctcctgtgttgtttgcaggagacgccccttccttctgtcagtgtggtgggatcttgtcataaactgtggttcttaagagcctggtggcaaattagcagggaaggatggggcgagagcttttagacaggtaaatcctggaaaacagagcacacattcaacactgggtcttacctgtgtctatatttacattaattaaatgtaactaaaaataaaattcagttcctcaagtgccaagccacattccaagtacttactaggcatgcatggctggcggctgccggaatggacaggacagacggaagcatttccatcatcccagaaatctcttgacagagataaaataaacttacagagtttattttatgctaaaaggcaaagaagttcttggttttcagcaccagattgctctctggcgagatacccttcctagcttgaccctctctttctctgctctagtctttagaagaagtgtgtgacctgctgcacgcggctcctttccagaacatcttgccgcgagtccatgtgaaaggtgagcctgctgacccccaccagggagtccagactgccctctgtgggggtggtgcccactgtatgcaaccggagagctaaggaccagtgcagattgtgggtttggcgcctgttcagtcatacccaggggtaatgaggagtgtacagaacctagttaaatgaagattgagaaatagagctgcaatgatatgatgtcttagaattgcttccaaatatcaatagcatgggagcagggggagttgggtatataagaagcagagtggccatgagttgataattatagcagatgatgggtacaggctcattgtgccattttctgctttcgattacatttggaatattcaataaatgaaaagtgaatattgagcagaaaattggttctgccggtttgaattaaaatattaaatgagccagttctgtaaaataattttcaaagagaatctgtatccataatgttaacttaaaaatcttttgttttttaaacaaatgtaaacctttgcaattaccgtttcatacaaaggagcagaatatagtaaaatattttttctactgcagagggggagagacttgatgccaaaatgaaaagactagaatcaaagtacgccccgctgcatcttgtcccactgattgaaagactggggacccctcaggtaacgtgtaccgtgatggctgtggctgttgcaagctgggcatccatgccaggccaggtggcctggttgggagccagactggaaggcatcgtgaagtccagcggctgcgtggctgctcaggcctcaagtgttgcaagtggggtgtgcaccaggactgcttccctgggtggtgggaggattcagatgagctaacacctggaaagagcttagcacatcacctggcacgtaaggcttacacagaagacatcactttcactgtccagcccttcatgaagaaggctttcccataggtgtttaagaacagaagaaattaggccaggaggcaaggtgtcagggtagagttctacagtgatccagctgcttatgctaagtcagggtttctcagccattttggaccagataactctatggtgggggctggggcgccctgtgcatcgtaggatggttagcagcatccctggcctccacactagctgccagtagacccgctccacccaaaacatttttccagggccgggcaccggggttcattcctgtcatcccagcactttgggaggccaagacaggagtttgagaccagcctgggcaacatggcgaaaccccatctctacaaaaaatacaaaaattatccgggtgtggtggcatgcacctggtcgcttgagcctgggaagtcaaggctgcagcgagctgtgattgtgccactgcactccagcctaggcagcagagcaagaccctgtctcaagagaaaagagacatagaggatgtggagtagctggatgcctggaggcccacggcattccacggcttgtcctttctgcagcaaattgccatcgcaagagagggggacctgctgacaaaggagcgcctctgctgcggcctgtccatgtttgaggtcatcctgacacggatccggagctttctggatgaccccatctggcgcgggcctctgcccagcaatggggtcatgcatgtggacgagtgtgtggagtttcacagactgtggagtgccatgcagtttgtctactgcattcccgtggggacacacgagttcacagtcgagtaagtgtgtgctgagagcaggacaaagccccagaggaggggaggagctgtgggggaggggaggcgtgttaggctaacaagcagccagccatgctcaggaagtggaccagaaactcactgagcggcttttaagcctcctgtagtggggattcttacttgatgccaaagagctgactcaggactctagtattcagggagtctctgaacccacggcaattgtatgcacgttgggcgtgcatttttctaggtgggaggtccatagagtcattcatcacagaggggatatgatctaaaaagggacaggaagcagcacaccagaagagcccaaaaaagttatttatcaaaaccagggaacagccacctggctgcccggcattctcttcctggctgtggaaggtgactgtgtaggcacagacagtaatgcagatggcttggtcactgacatctggagacagactgagaaaagacttcataacgtatcactcatctcccattctgtttctgcttcttgttcctaggcagtgctttggtgatgggctacactgggctggctgtatgatcatcgtacttcttgggcagcagcggcgttttgctgtgctggatttctgctaccatctacttaaagtccagaaacatgatggcaaagatgagattattaaaaatgtggtatgtggatgaaaatctcgcaccatctatggaccttttgcaaaagcatactttctttgtgttataagttcttgtttctggcaatgtttttcatcctagtacgtaaggtgccaccaacagaaactttcttttcgttcccaaaatgaatctaaatataattggccagtaaagcagtctggcagagaaaatactcattgttccgttttccttctcaaggtacttagatttacttccagtcttacaggatctgcattgtcagaatattggcaactatagtcttcgggcccctggaagtctgtgctttcttggctgctttaaaggccttttgtctttgttgctttatggatccctcatagttgaattctggaaaatactcagccattatctttgaaatatttcagcctcctttccattctccctattcttgccattcaggacttcagttaaacatatgttagaccttctcattctattctccacatctctttgttgtatcagttttcttttttctttctttttttttttttttttgagacagtttcgctcttgttgctcaggctggggtgcaatgccacgatcttggctcactgcaatctctgctgcccaggttcaagtgattctcctgcctcagcctcccgagtagctgggattataggcacctgccaccacgcccggctgatttttgtattttgtaattttgtatttttagtagagactaggtttcaccatgttggccaggctgatcttgaactcctgacataaggtgatccgcccacctcccaaagtgctaggattacaggcgcgcccagccctgttgtattagttttctattgcttccatgacaacaaatcaccacaggcttggcagtttaaataccactgattatctcacaattctctaagtcagatgcctgagttcagccaggcccagctgggtcctctgctcagtctcatggggccagtgtctgaggtgctgggttcaccctggaggccttcaagcttatgcacagttggctcaattattccttgcagctgtaggactgggtcccccttccttctcatgctttccaagtggccccctccagcaatggtgggttgggcagtctcagcctctagtcttctgccatgtctctcctgcctccggccagagaacattccctgactgtgactatattgagcccactggacaaccccagatactctccctgttctacagtccagtcttagccacacctgcccaggccccgtggagtggaggcaatgcagtcacaggctccaggtcatgggcctctctcaggggcccttctgcctcccactcctccatttccggggctcccagagctgtgtccagatactgtattcatgtgtcttagttaacttgtttacttcagctctaatctgctgagcttttactctgaaaatattattagttcactttttaaagttcaattaggttcttcaaatcttcttggtaactgacagttttattgtcttaactgaactttttccatctcttatttctttatccaattcatgtattctatattctgtgtgttttccttctagtatctgaaggccttggaggtatttaaaactttgctgtttccttgtgtgttgggttatttgggagtctttatttaactggagttaatttagattgctttcccccaagatgtgcatttgtatctgcccatctctatggggtgctaccaactcagggccgctttagccgaattggaggtcctggcttcactggggagtcttcggtgtggtcccgcttgcttacgcccgggctgctcctcaccccaccgccgctgttggcatctgcccctgaggaggccctggcttcccccttaccacctgcataggtagaaccagcttttcaaagcgttttgtttgcgtgtatgttcttaattcgtgttctttattcctgtggtagcaggagggtctgtcagagtatcccgtcacagtatttccaaactggaagtctaaaacttgtgttagttgactggcctttctccactgaccacatcatcttcatctggagatccccagctttgagcagacagtaggttcttaattgccaatgtggaaggaataggcctatcaattgtgcgcatgaatgaatctacagcagcatgaagccaacagagggattctaaattcaaaatatattcatccttccaactgttgcattaaagagatggtatgtggctgggagtgctggctcatacctgtaatcccaacagtttgggaggctgaggcagaggaggattgcttgagctcaggagttcaagaccatcctggacagcataataagaccttgtctttacaaaattaaatttaaaaattagctgcgtgtggtggtacacgcctgtggtcccagctactcaggaggctgaggtgggaggatgtcttgaggctacagtgagccgtgatcatgccactgcactccagcctgggcgtcagagtgagaccctatcttacaaaaaaaaacccaaaaagaacagtatgtgtgtcaattccgtttgctattatttttctgagaaaatataagaatcctgacattttgaaacatgaagaataaatgttgaagtgttaatagtaaaacatcctcactttgatggttgtagcctttgaagaagatggtggagagaattcgcaagttccagattctcaatgatgagatcatcaccatcctggataagtacctgaagtcaggcgacggggagggcacgccagtggagcatgtgcgctgcttccagccgcccatccaccagtccctcgccagcagctgagggcacgcgctgcactccgtaactcaacatggcatgcctttctctccgtaaactatttagtgagatttttagggactatttttcagtatctctgtacctgttaaagggggtgcttttcgatctaaaaacttaattttataaaattgacttatttttctagactaaaattgtatatgcttttggtaattaggaactcttgagaatattggctgctgattgttgccatcacgttcctacaaaattgtttttctatgggatgttctggcagctgtgtcataaaatgctgctgggttcattcattcattccataagaaacttaataccagcaaatgcattaaatcccttgccagttaccattaactgtaactatttagcttttgtttagggatctttctgatggtcttttatgagcaatcttagttctaagtcattgttcccatcccttttttgtgtgtttcagaaaatagtgaacttgattcccctgcttccactaaatccagttgtgacaaaatctaacgtgacatcagatcgaaaggttatagaaataaaactaatgagatct

SEQ ID NO: 37103 - DNA, 3731 bp, Homo sapiens
cgggaagcgcggcggggcctccagaccggggcgggcttaagggtgacatctgcgctttaaagggtccgggtcagctgactcccgactctgtggagtctagctgccagggtcgcggcagctgcggggagagatgactggggagcgacccagcacggcgctcccggacagacgctgggggccgcggattctgggcttctggggaggctgtagggtttgggtgtttgccgcgatcttcctgctgctgtctctggcagcctcctggtccaaggctgagaacgacttcggtctggtgagtcaccctttgcatagccccatccccgacccgcgcaggtgatcgacacctagtgtcccccggaacgcgggcggctgagccgactttccgcgacaggacccttttctttctcccagaccccgtttcctcctaccgctcccagcccctctccctctccgggtccccgtccttctcctcattcgagccccttcctcttttggggtccccttccctccctgaaggcgccttctcctttcgtagaccctcccctgctccgagcctccagcttcgctccaaactccccttcgtgttcctctttcttgttctgggaccccatcccctactcgggatccccattagatcctccctctcccatcggaacgtgggttcctaaaacccccaagacaagtttgtctttgttgacccttcctcctcccatgacaggtgcagccgctggtgaccatggagcaactgctgtgggtgagcgggagacagatcggctcagtggacaccttccgcatcccgctcatcacagccactccgcggggcactcttctcgcctttgctgaggcgaggaaaatgtcctcatccgatgagggggccaagttcatcgccctgcggaggtccatggaccagggtataaagatgtctgggtgaaagagccggtgctaggttggatgggtgggcagcccaatgagcccaagggccctgaggataggggaacttagagggttggttgcctgagtccctgaggggtagagggaacccgagaagggcaagtgtctaggacagtgatctggaaattgggatcaccaaggagttggacattcacttagcaaacatttattgggtactatatacctataccaggcactattttaggtttcatgaatatagccacgaacaaaacagatcaaaaatctctgccctcaggatttaaattgtactggaaggagacagacaagcataataaacaagtaaacttttttgtctgttgcaaggtgataaatgcaatggagaaaaataaaacaggacaagaggtatagatagtgcaagtgttggattgcaccctgggaccatcggaaggcctgaggtccctagcagaaggtgggaaattaacgggaagtggtagaaagggtacctgcagagtgctcactctgggtttcttcctccaatttttttcaggcagcacatggtctcctacagcgttcattgtcaatgatggggatgtccccgatgggctgaaccttggggcagtagtgagcgatgttgagacaggagtagtatttcttttctactccctttgtgctcacaaggccggctgccaggtggcctctaccatgttggtatggagcaaggatgatggtgtttcctggagcacaccccggaatctctccctggatattggcactgaagtgtttgcccctggaccgggctctggtattcaggtctctgtcctaggagataggtggagggggctgccttgtggagagtctgagggatacccccaaatggactcctttccaaggggaagattctctgaagtcagattttctggcttgggtgggattccttgaaagacagggcatcctggtaggaacacattatcaggagaagagggaactctgccattggcttcccatttggcattgtcaacaggactgcgttagtccatgcaataccctcatgcaaagtagaaaaaggcactgcctctttggacagacacaagcctgtgccagggtgcacagcttggcgagtgagcacaggttgggtttaagctctcatgcaccctgtggctgggcccctggtgcacatgtccagctgtacaccctgggagagcttcttaattcaaacagggtgtgtatttatgggatctgactggaaccctcagtgagcaagggctgaactcaaggggaccatacatgtgattgcatttgggaagtggtgggttctctgtccctgcctctgagcccctagagtctccttctgtgacacccagttccctttcccacagaaacagcgggagccacggaagggccgcctcatcgtgtgtggccatgggacgctggagcgggacggagtcttctgtctcctcagcgatgatcatggtgcctcctggcgctacggaagtggggtcagcggcatcccctacggtcagcccaagcaggaaaatgatttcaatcctgatgaatgccaggtcaggagtccatgagatgttccctacccatttgaccctccctgccctccagaacatcatttcacgcacagacccagggtctgactgctccactcagtgccacacacccttgctcccctcggggacagggcattttccctgttccctccctgaggtcctgtcctctcccctcagccctatgagctcccagatggctcagtcgtcatcaatgcccgaaaccagaacaactaccactgccactgccgaattgtcctccgcagctatgatgcctgtgatacactaaggccccgtgatgtgaccttcgaccctgagctcgtggaccctgtggtagctgcaggagctgtagtcaccagctccggcattgtcttcttctccaacccagcacatccagagttccgtgagtgcctcatgggtggggtcagcagggagagccctgtgtctagacaaggcctgggcagagaccctctctccctgactctcctgctctccccaggagtgaacctgaccctgcgatggagcttcagcaatggtacctcatggcggaaagagacagtccagctatggccaggccccagtggctattcatccctggcaaccctggagggcagcatggatggagaggagcaggccccccagctctacgtcctgtatgagaaaggccggaaccactacacagagagcatctccgtggccaaaatcagtgtctatgggacactctgagctgtgccactgccacaggggtattctgccttcaggactctgccttcaggaacacgggtctgtagagggtctgctggagacgcctgaaagacagttccatcttcctttagactccagccttggcaaaatcaccttccctttaccagggaaatcacttcctttaggactgaaagctaggcgtcctctcccacaaaaaagtcctgccctcatctgagaatactgtctttccatatggctaagtgtggccccaccaccctctctgccctcccgggacattgattggtcctgtcttgggcaggtctagtgagctgtagaattgaatcaatgtgaactcagggaactggggaaggctgagcctcctctttggtgttgcggtaagataaccgacagggctggtgaaagtccccagatggcaggatatttggtttcagagtaaggactaggtgcaccaccatgactgactatcaatcaaaatgtttgtaacttaaaatttttaatgaaggataatgaatatttgtagagtctctatggttctgtcaatgc

SEQ ID NO: 37104 - DNA, 71700 bp, Homo sapiens
gcagagagcagccgggctgccagcggtgagtgctatctttcgcggcgacggcggggtgggtgaggtcgggccccaagactcggggtttgccgggcgcctcagttcaccgcggccgcctggctctctgcgtcggggtgggccctcgggcctgggcactgcgcgtctggcccgacgctcgggcggaaggcatggctcccaccccggccctcctccgcgtcgcccttcccctagagctgatctcccgcggcggcctgagggtcgacttttccacagcttgggccgagagagcccggcaggccctcggctgagggttagggctcggtatctcagggctcggggtccagtccccgcgccgccgccccccacgggctaagccactttaactctccgagcctcagtttccccatctgtacgatgaatgggcctcgggaggcagcgaattctgggggtacctaacgtgagaggcgctcgatgcatgctcatgggacccgaatctaaccctgcagcatcaggtgggctgagtcgatggatcacgggagccccccagcccggcctgcatccctgagggcagtgcccctcgcagtcaggtgtctcggcggcccccacaacacaggtacccggatctcctgggggagccgggacacccttagatcgggggagcaattgggtaagagttcaaggtctcttgggcgccagggggaggagagtagaggtttcagtgagcttgattgacttcgactttctgcgtattgtttttcaaaacgagttacccttgtgtaaactggtgaccactaataaggagtttggggctgtttcaatgaaagtggctgtctcctctcttaaacccttaaagctgcagccttgccttgccttgcctctgagcttggccaagctggagaatgatgccagcacaaaaggagacaggactggactgggtggccctggtttgattcttggcaagcaagatacctcctggagcctccgttttctgatcagtgggtctggtagtaagacagccaccctgctctccccacagggttgagattctgaggatcaagacagggtcccagagagtggcatcgagaactttaatcctccttgtaagcagaacgtttatggaaccctctgggggatccagtatccccaccgttgttcactgctgtaattccttgggtcttgctttatggagaaggcattgattcattaaccatttgcaagttctacctacggaaatcccttttgagtggttatggggttggcttggtcaggagaacagctccaaaggcccagttagtaaaccagggaacccagaaaggtccacttccttttttttgggaggagggctgttttaggagttcttattttccttttaagagagtggtttttgagctacttatgaccttcatgccatctaatgttggaaactttcgctgagcagatagcttattataaaaagtatttgtacaacatccgcatttcagagaatgggatgctagctgccagttgcgtggtggtgtggaaacttaggagtgatcttaattttccaaaattcttcaggtctagcacttgaagaaataataggtagatttgaaatgaaacaacccagggatattcctgaaaacagcagcattgaccgcagccaatgtaaatcaggtgtggatcgtcctgggtagtaggagtttataaatgccacagaggatgtttgctgccagacatacctgaattttaggacctgctgttggttaactctgggttgatccacccttaaccccttgaaaatcagaatctgtgttaggtaagtctgtgtatgattaggagacaggccaattgaaatcaaaactgcttggcaaatccagaacatttactcgtgaagtccatggaacatttcaagttaaaaataatttagcttttaagtaacttttttttttttgtgagacaggtctcactctgtcgtgcaggctggagtgcagtggcgcaatcatagctcactgcagcctcaacctccaggattcaagcaatcctccctcctcagcctcccaagtagttgggagtacaggcacgcaccaccacacccagctaattttttaaatgttttttagagatttggtttgccatgttgcccaggctggtctcgaattctggggttcaagtggtcctcctgctttgacctcctaaagtgctgagattacaggtgtgagccaccgttcctggctttcttatttcttcttcttttttttttttttttttctgatggaagctcttgaagttataggacctttcatggttccagagaggctggccgcccctacaagagcttcgatgtccttgtgctttagggaggagccagagaaacagaggtcaagctctggcactagcaccgtgtgtggcctcaattgagcatgttgggatttaactttctgttatatgtcagactcacttaaaaattaaagttagaaaaaggtgaaatggagaaatgacaattttcttttcttttcttttctttttttgagatggagtctcgctctgtcgcccaggctggagcgcagtgggctcagtgcagcctccacctcccccaggttcaagcaattttccttgcttgaattctgcctcagcctcctgagtagctggaatttcgagtacccaccacctggccaaagattctgtgctcattagcacacagcctcccaggtggctacagccttaaaagactttcaaatgccaattctaggctgggaacagtggctcacgcctgtaattccggcactttgggagaccaaggtgggtgaattgcttgagtccaggagtttgagaccagcctgggcaacacggcgaatccctgtctctataaaaaaaatacaaatacaaaaattgactgggcatggtggctcacgcctgtaatcccagcactttgggaggccgaggcaggcagatcacttgaggtcaggagttcgagaccagcctggccaacgtggtgaaaccccgtctctactaaaaatacaaaaattagccggtgtggtggtgtgcacctgtaatcccaactactcaggaggctgaggcagaagaatcacttgaacctgggaagcggaggttgcagtgagccgagatcgtgctgctgcactccagcctgggtgacagagtgagactctgtctcagaaaaaaaaacccaaaaaacaacaacttgttttgctgtgcagttttgtcatctggcattgggcagaaatttggacccgccgggcaggtgggagaagcatctgagtcagaggtcacttacctgcttgcataggccgctgacctataccaagccttagtttcttcatcactaaagtcagagaaagaacccactccacctgcctctgggacagctcagaacatgttaaccctttcagcagtgggtccttcttcatcttcttggcgctgtttggatccctgtagcgtgacacataaaaaagcacacatccggccttaggatatgtgtaggctctggtttgggcacttgagaactctcacagggagggaagcaagcatacaattcaacaagaatggcacggtgtgttgcattcattctcaagatgatggggtgaggcttttattagtgctgagcctgctgtttgtttccacagcagggctccaggggagaggtgatgtttgagttgggtcttggaggattgctaggagttctctgagcccacccaggcacaccagctctggggggcatgtagggtgtagattgcatgaggctgaggtcgcgtggtggcacttgtctgaaatggtcctaggaaccatgggaagagatggggaggtgttttaaaaggtcagggctatgtgactagctcagatcagtgttgtgtgttttttttttttttagacagagtctcactctgtcacccaggctggagtgcagtggtgtgatcttggctcactgcaacctctgtctcctgggttcaagcaattcttgtgcctcagcctcccgagtagctaggattacaggcaccggccaccatgtctggctcaggacagtgttttcttgtactgaatattctcttactgcctaatatcctctctgggtgaatgaacaaccatttgggaaatttttactgtgtctaaatttgtaatcatactgttttagagctctacatcttaaaagtttttcctccccaagcgagatgtttacatcagttgtgttcttgttgggattagtgtgcacacgcctgtctgcatctgtgcgtgcgtgtgtgtgtgtgtgtgtgtgtgtgtatgcatataagagggagagaagatggaggaattccatgggggcagaccatggttctttgcagattggtggctccagttggttgggttcactggagccacgttcatcagtttgtttctttctttccttttctctctctgtatgtttatttatttatttattatttgtagaagtggggtctggctatgttgcccaggctagtttcaaactcctggcctcaagtgagcctcctatctcagcctcccaaaacgctgggattacaggcatgagccaccgcgcccagcccagtaactgttactcctgacgctggtcggtgtggcaactcagttgatgcttggacgtgttgtgaacaaagccccggggaacctgatccttctggtggcttgtgcagcaaactgttgatgtgggaagcttatttatttcacttgttaaagaggtgacttggatagggggatatctaagaattgtcctttcattggagtgctggagggtgtggcattcggatctcctttgtgcagcatctgtacctagctgagagaattgtacacataatttcccgaaatgcgtcagtttcaaggctaacttagaatatgttggtggccagactgtggtgctgtcagctgtggactgttctccaagagttgaatttctttttttttttttttttttttttttttgagacagagtctgactctctcgcctaggctggagtgcagtggtgtgatcttggctcactgcaacctctgccttccaggttcaagcaattcttctgcctcagcctcccaagtagctgggattacaggcgcgtgccatcacgcccggctaatttttttttgtatttttagtagagatgaggtttcactgtgttggccaggctggtttcaaactcctgacctcaagtgatccacccgcctcagcctcccaaagtgctaggattaccaggcgtgagccaccatgtccagcttataagaattgaattctttaggagacatttggtaggagaatagaagggggaaagttgccttttgtctacttggatgtagtaatgaggaggaagatggggcattgtggggcgtgtcctctaacttggaacagatgtaatttatttctaggtgaaagttaagaacagtgcttactcattctatttatctgccctccttttatcttcggcactttttcctacagccctgtttctgagctcacgtcacatcacctctgcggtggtgatgccggtgttcttagagcactgtgtcctagtgatactttgatcttcgtgggcatgcatcatcagtgcattgggtaagccgggcctgtacaaaggtttgcaggtttggttaggaacacgtgaactacggtcacctttctgaactttctgaactcatatgtagtgaccataggtcacctgggttgagttttcaacactgcaaacagggatggcagttcttgaatacacaggagagtgcattagccagtggtgcccggcatcattcagagtgcagtttggcatcaggaatgttccgtcaggtatttgtggtcttgtggagaaaagccactgttggttttggtgaagggcttcagaccctttgactgctcatgaaaccacacagtcttaacatggacacgttggacgcgttccttacgtaacgtgatttgcaaactcaggagtcattcagcgtcacagcagtgatcaaaagctcccagcccatctacccgaaacctccacaacaagagctctatctgtcagtggcctcaccgacttcctgggccctgaagctccaaggacaaaagactcctgtcccttttcccttcctctccattctgggtctcccaccaccaccaagtcctgtaagtttttagtctttttttttttttttttttgagacagattcttgctctgttgttcagagtgcagtgacacaatctcagctcactgcaacctctgcctcccaggttcaagtgattctcctgcctcagcttcccgagtagctgggattataggtgcgcggcaccgcgcccagctaatttttgtatttttagtagagacagggtttcactgtgttggccaggctggtctcgaactcctgacctcaggcgatctgcctgcctcggcctcccaaagtgctgggattacagcaggcgtgagccaccacgcccggccctttaaatctctttccactgctgtggtcttactgtagccccttgtcacttcctgctgcgctgacccgtaattgacccataattctccctctcttcccctccctaccacgttccaagatctgtccatggtaccattgctggttgatcttggaaccctgcttcggtcacccctcctttctcttcgcccagactggagtgcagtggcacgatttggctcactgcaacctccacctgtcaggttcaagtgattctcctgcctcagcctcccgagtagctggcactacaggcacgtgcctccacacctagctaatttttgtatttctagtagagacagggtttcaccatgttggccaggccagtctcgaactcctggccttaagtggtccacccagctcagcctcccaaagtgctgggataataggcaggagccactgtgcccggtcactgtcactgtcttattgcatgttttcttcttcatctgctttcataaaggataaacagtgacttaataaaaggtgtctaattctcccctccctagtggcaatacggttggactagaaggtgaattcagttgagaacagggaacctatcatttctgcgagtgtaagctggggcatagaacaatgccaggcataaggtaggcacttggatgaatggatgaatgaataaatatggcttctgtcccccaagtttactgctgagctttctcctgcatattgactgagctcagatgtcaaaattgggtctgatctgtagttttttttttttttttttttgagacagagcctgtcactctgtcgcccaggctggagtgcagtggcgcaatcttggctcactgcaacctctgcctcctgggttcaagcaattctcgtgcctcaacctcctgagtagctggaattataggtgtgtgccatcatgcctggctaattttttgtaattttagtacagatggggtttcaccatgttgcccagctggtctcgaatgcctgacctgaagcagtctgcccgcctcggccttccgaagtgctgggattacaggcgtgagccactgcgcctggcctggtctgtacttctgaagattattccaaagtacagtaggaacttttggtaggactttagttttccatccaggtataaaattttgtgtcagtggtggggttgcgcatgttcagtagctgcaacactagaaagatggcaaagcaggagcaaagaaaaatccctttggctccagaaaatctcctgaaagcagaaggcttatcaaggcctcaaagccacccagtcaaagtaggcacttttggcaaaggaggagcagagggaaggaaaagagctcaggtttaaacgactggaatcattcctacatgattcctggcggcagaaacatgacaaggtgtgtctcagacgactagaagtaaaacctcacaccttggaatcgccagataaacattccttggcctttgttgtacgcgtcgaaaggattgatggtgtgagtttactggtgcggagagccattgcaagacttaaacctaaaaatgcagcgtatagtatgtaaccttatgtgacctggggatttccaaatctgaagtctgtccagaaactcattttgaaacgtagacaagccaaggtcaagaataagaccatccctctgacaacacagtgattgaggagcacctgggaaagcttggtgtcttttgcttggaagacctcattcatgaaattgccttcccaaggaagcatttccaggagatctcatggttcttgtcccctttccacctctcagtggactgtcatgctaccaaaaatagtggactttctgaaggagattggcacacctccatcttcttgggggtgtgtgcatcaatcagctcatccgccagctgaactagagccaggtgccaaactacagtaaatttttatcaatgaactggaagcttgtgttatttttgggggcggggtggaatttttatcaagtatcttcagagaagattatttcctgctttatcttcaaaaactgtaaaggaagggtcaaaggaaagacagtggctggccgggcccggtggctcacgcctataatcctagcactttgggaggctgaggcgggcagatcacctgaggtcgggagttcgaaaccagcctgaccaacatggagaaaccccgtctctactaaaaatacaaaaattagctgagcgtggtggcacacgcctgtaatcccagctactggggaggctgaggcaggagaatcgcttgaacccgggaggcggaggttgtggtgagccaagatcagacctttgtcctccagcctgggcaacaagagcgaaactccatctcaaaaaaaaaaaaaaagaaaagaaaagacagtagcttacgttcatggcggcacctctcatcacagtccagttccaaggaaaaattccagcgttttctacgttggctgctgccttgtctgaaatcacattttgtggagaaaggagtcttgctttgttgcatcttctatcctagggtttaatgttggtgaatgagtaactctagcatttgtacaaggctccctaagagtcctgcagcagtcgaccaagcccggggacataattgaatccggagattcctggggccttgaaaaaggcttgaaatatacataggaagaaaggcacaaaaataaatgctcacttgtctctgcaaaaaaaaagaaaagaaaaattgtgtctcaagttccttctgtagttgataatttattcagtaatcattttataattgaagaagaatattctgactctaaatctttctagatcagttacctggatgctgaagacatgaataaatttgtttattttaaaaatcctagggcctggcacagtggctcatgcttataatcttagcactgtgggaggccgaggtggacggatcactagagcccaggaattcaagaccatcctgggccacatggcaaaacaccatctctatttaaaaattagtgtttttaaacatcagtgtttaaaaattagctgggtgtggtggtgtgtacctgtcatcccaactacttgggaggctgaggtgggaggatcacctgagcccagggaggttgaggctgcagtgagccatgatcagaccactgcacaccaacctgggtgatagagtgagacccccatctcaaaatatacagtaataaatgaaaaatagaaaattccccaaataaataaataatagaaaattctaatgaaaataaaaggagttgagtgtaaccgttgagtgtctgcgctgggtgtttatgtctcatgtaaccaacgtagcactgtgagcatggtcatcccggagacggactgtgataaatcgtgtgcccaggatcccagagtgcataggtggcatatctaggttttgaaccaaggtctgttggtcttttatagctcaactgggttgtgagtttgttgaatttcactttccatgctttccccaaccaaaccaaaaaccagagggggaactgaaagctgagagcctagtaattgagaaaaggactctgggaggtgatggtgtcaaaaagcagtccagggaagctcttgtggttgagcacacagctctgcccagagcttcctagatgccaaggcaaagaaggatggggttacatagcagttattggaaaaaggaagctgaccagtttctcattagtatttttcagctgggcgcgatggctcatgtctgtagtcccagcactctgggaggctgaggcaggaggatcacttgtggccaggagtttgagaccagcctgggcaagagagagagagagagaccctgtcccttcaacaagaaaatacacatttaaaatattagccaggcatggtggtgtgcacctgtagtcccagctactcaagaggctgaagcaggacgatcgcttgagcctgagagttcaaggctgtagtaagctatgattgcaccacgacactgcagcctgggtgatggagcaagaccccatctcttaaattttttttaaaaagtgcttttccctgggcctttacacgaggatcattgaataaagcagtggtcagcagcccatgtactcagcaagtatttgtagagcaccacgtatgtgccaagctctcttcgaggtgctgggactacttttgtgtgtggaaaagaccaacaagatgaaagatgatgttggcctaggccagggtggaggcactgttttcaagaacaggagtgttcccacaggtgaccctttctgggtcccatctaggtaagaggctgagaggttcaggctcggttgtaaattctgtaagggcagttctttgggaggtgtgagcaagagaatggaatcagagcgattattttagcaggcaggagtgaagcttgagaatctggcagagtgaggagcgatcttgtgccagagtgagaggcagccagtccaaagtgaaggttctgaagctcttagtacctcccacgtacagtgtcctgcttttttttctttctcttttctctctctttttttttttttttttttttaaggcaggacacttgctctgtcacccaggatcattgctcactgcagtctcaaactccttaagcccttccaagtagctgggactacaggcacacaccaccatgcttggcgagtttttctttctttttgcagagatggggtcttgctatgttgcccaggccgatctcaaactcctgggctcaaacgatcctcctgttgacctcccaaagtgctggaattacaggcatgagccactgtacctggacccctgctatttttcctgtgatatttgaaaagcttggcttggtttcttgccctttagtaggtgattgcaggcagagccacgaggtcttagaaagcagcacggctctgttccgatactcctggctgaagggccagtgtgctgtgccattgagggagaagcattgactctggtctgggagattctgttcatttagtcattcagcaaacaaatattgagtgctggccaggtgtggtggctcacacctgtaatcccagcactttgggaggccgaggcgggcagatcacctgaggtcgcgagttcgagaccggcctgaccaacatggagaaacctgtctctactaaaaatacaaaattagccgggcgtggtggtgcatgcctgtaatcccagctacttgggaggctgaggcaggagaatcgcttgaacccggggggcagaggttgcagtgagctgaggttgcgccattgcattccatccagcctgggcaacaagagcgaaactctgtctcaaaaaaacaaaaacaaatattgagcactcatgttatgcaaagtctgatgagcaccagggttacagaggtgcaggatagctccacccagacacgagaccaatcctgtgtccttctgcagggattatttcatcttgggtaatgctgtcatctgatgatgtggccaggatgtcagctgcaaaatgaaccccaggtcattcagtgaggctgcgtctacctgtaactttgccatgtcctaaaaaggtcttgaagggcagacagatggttgatagaatagctctggagacagttggtctgggtttgaatcctggttccaccatttatcgattccctgatgttggacaaggtcctttaacctttgtgataattacagctcctgtatgtcagagcagtgttaaaacactgttcattagttaaaaacaaatcagggccgggcttggtggctcacacctgtaatcccagcactttgggagattgaggtgggctaatggcttgagcccaggagtttgagaccaacctgggcaacatggcgaaaccccgtatcttaacaaaaaattaatggggcttggtggtgggtgcctgtagtcccagcaacgcaggaggctgggctgtcatcacgccactgtacagcagcctggctgacagagtgagaccctgtctcaaaaaaaaaacaacaacaaaaaaaaccccaaaaaacaaaaaccaggtcaggagtggggagtgactgctgatgagtgtgggatttccttttgagggtatgaagatgctctggaatctggtagtggtgatgcttgcacaatgggtgaatatagtgaaaaccactgaattttatactttaaaatgatgaattttatggtgtgtgaattctgtctcaattttttttttttttttttgagactgactctcgctctgtggtccaggctggagtgcagtggcccaatctcagcccactgcaacctctgcctcccgggttccagtgattctcttgcctcagcctcctgagtagctgggattacaggtgcccaccaccacacccagctaatttttgtatttttagtagagacggggtttcaccatgttggctagactggtctcgaactcctgacctcaagtgatcttgccctcctcggcctgaggcatgagccactgctcccagtctctatctcaggtttctttttttttttttttttttttgagacggagtcttgctgtgttgcccaggctggagtacagtggaacaatcttcacttaccacaacctccacctcctgggttcaagtgattctcctgcctcagcctcccaagtagctgggattacaggcacacactgccataccagctaatttttgtatttttagtagagatagggtttcactatgttggccaggctggtctcgaactcctgaccttgtgatccacccgcctcggcctctcaaagtactgggattacaggtgtgagccaccacacccggcttctatctcagtttttaaaaatcaggtttataggtcatgagttcttgagcaactagactcccaccagttgtgcctccagttccctgtcatcttgagctagtcgtggacacctgcagcagacgtatgttcactgcgtgtttctgggctcccacacatttctaagccctcttgaagttaacttcgggtaatggcctgtgagaggaagtcacgtatgtcacttctggatggaagcatttaagagccagggccaggccctccagcaatcttcttcccatcaggacggcccggaagttgaacattgagatggtggaatgacaagagaaaaagctgcttgaaccactgagtcaccttatggaggccaagggcctagcggagtcaccctgcccacactagacgttgcttagagttcagcttgaagccatgtgatgtgggtcactgcccaggaggacttttttctagtgctgtggcctggaggactttccctctagcctctcatgcaggtgtactgtgtgatgtggtgggtctcttttctaacaggaagccccagtgggtgcagcagagctgtggctctcccaactcaagcacatctccacagctagctgccggcaagtacgcagctctcttggtggtgtctgagaaatggagcattaagccctcagtctaaaggagcatcttgggtaacctagtgtacctgtctcgagcagcaggcatagtacaatgtcaggccagcaccaaaggattttgtcttccttgtaagacaacatggggcaatagaaagctctgtatgggcaatcttgtaaatggtataataattatgatgcttttatagacaccgcatgaccgtccttagtcaccatagcgatgggatctaattattactgacttgttcatgttgtgggtttttagtaaccctactgcccacattctagaatttaaacacatgctgtgaatatccaagcacaggtcacagagatgacctagagttggtgctcagtacactttttttgtttttttgagaccgagtctggctctatcgcccaggctggagtgcagtggtgcgatctcagctcagcgcaacctccgcctcctgggttcaagtgattttcctgcctcagcctcctgagtagctgggattacagagcatgcaccaccatgcccagctactttttgtatttttagtttcaccatgttggccaggctggtcttgaactcctgacctcaggtgatcttcccactttggcctcccaaagtgctgggataacaggtgtgagccaccgcgcccggcctcaatacacatgtgattgccttgaatgcatagcaatgaccgaacatcaaggtgaaacgcaagcaacgctggggaaggaatgaccaatacggtgccctctgaggcctcagcccaggggccatctggcttgtctgtctcattagtaccattgttccctgtcagcttgtggaagagctgatttgaaaccacctgttggaccgaaggaagccactgaccaatacctgttctgtgggtgaagctgtcgcccagagcaccccctgtgactccgtggtcctctatgcactagtagaaactctgtttttgctgaatggcacagcccactactagctgaatgtggggtgacagtagccagcatgagaaccatcaagaccattatgggccaggagttgggtcaccccttccttgtctagggttgcaacaagaagtgacagagagggtcccacaaggtctttaaatctccctctgtaagttgtgggaatttcagtaacttgcttggtccttagggctttgaatctgagtctgtaaaatgggtgaaataatatttctctaaacaggtttatcatatgaatcaaaagaaattgtagaaggtgcctagccagggtgcttggcacgtagtaggtgttgagtgaacgttggttgcattgcttggctcctccttagtgagcctgtagtaaacacagtgctgtgtagactaggcaggcctttctctcttctgcaattctgagtgctttttcttaagaaccaaggggtactaacccttgttttagagacattcagaaactagccaggcgtagtggtgtgcacctgtagtcccagctcctcgggaggctgaggtgggaggatcacttgatcctgggaggtagaggttgtggtgacctatgattgcaccactgcactccagcctggacaacagagcaagaccctgtctaaaaataaataaaataaaataaataaataaatgtaaacaaggaaatagaaaacgtttatactgatggagtctcgctgtgtcgcccaggctggagtgcagtggcacgatcttggctcactgcagcctccacctcccgggttcaagtgattctcctgcctcagcctcccaagtagctggaattacaagcatgtgccaccacgcccgtctaattttgtatttttagtaaagacagggtttctccatgttggttaggctggtctccaactcctgacctcaggtgatccgcccacctcgacctcccagagtgctgggattacaggcatgagccaccttgcccggcccttatgtatttattttttaaagacagggtcttgctctgtcacccaggctggagtgcagtgttgggatcatatctcactgtaacccccaattcctgggctcaagtgatcctctaacctcagcctcctgagtagcggggactacaggtgtgcaccaccacacctcactaattttttaattttctgtagagatggcgtttcactatgttacccaggctggtctcaaactcctggcctcaatccatcctcccgcctcagcctctcaatgtgctgggattacaggcatgagccactgtgcctgtccagcaacaatatttataacagcccccaaaaggaaacaatccaagtatccatcacccattgaatggataaacaaaatgtggtatatccatacgatgaaatgttactcaggcatgaagaggaatgaagggcttttatgcatgccacaacgtggatggaccttgaagacattattctaagtgaaagaaaccagttacaaagggccacttattgtgtgattttatttatttatttatttatttatttatttatttatttatttatttgagacacagtctccctctctcacgcaggctataatgcagtggtgcagtcttggctcactgcaacctccacctcccaggttcaagcgattctcctgccttagcctcccgagtagctgggattacaggcgcctgtcatcacacccgactaatttttttgtatttttagtagagacggggtttcaccacgttggacaggttggtctcgaactcctgtcctcaagtgatcctcccgccttggtctcccaaagtgctgggattacaggtgtgagcctccgcacctggcctgtttttccttttaaagccgtgactctattttcccttctggccttggtgtgtgctcttccccactctgtctccttcccttttgagtcctttccatcaggaagccctccttaaccactaccagactcacccacacatgaaccggctcccaccatctgttctgtttattttggcaaggaaataaagatgtgtcttccaccagaaaagctgaggccactactcgattcagtttgccctccctgctggggcacaggtgtcatggcctcccttaagtgcttattaattcctgtgtttcagctttcatccttccacctgctgctaggcctctgtgcacacagtgctttgtggaattgctcccgtctcttcagcttagcagcgtgccttgaagaggaagagctgcagagaaattttgaaaataaattgctttttgaaaaataatttgacagtaagtcagggaccttgaaaatatttgttccctttgattcagaaatatttctaagacaaattcagaaattctttttttttttttttgagacaaattctgtctctgtctgcccaggctggagtgcagtggtgcagtcttggctcactgcaacctccgcctcccaggttcaagtgattctcatgcctcagccccccgagtagctagaactgcaggtgtgcaccaacacgcccagctaattgttgtattgttttatagaaacagggatttgttgtgttgcccaggctagtcttgaactcctgagcttaagcaatctgcctgcctcggcctcccaaagtgctgggactacaggcatgtaccactgcgcctggccagaatttctattttaaggaacttatcagtggcttacaaagacttatgttgaaaatatatcaatcctgtttttcatgacttttttaaaaacagttttaatttttttttctgtactagaaaatgcactgtaacttgacattgtaatagtgaaaatataatgacatttgagaatttataacaagaaaatgttcacaatttaatatatgaaaagtagaacaaaattatatgtagtataagaccgatcatgttaaaaacatgggcgggcacggtggctcacacctgtaatcccagcactttgggaggccgaggtgggtggatcacgaggtcaggagtttgagaccagcctggccaacatagtgaaaccccatctctactacaaatacaaagattagccgagcatggtggcaggcacctgtaatcccagctactccagaggccgaggcaggaaaatcccttgaactcgggaggtggaggttgcagtgagctgagcgagatggcaccactgcattccagcctgggcaacaacagagcgagactccatctgaaaaaaaaaaaaaaaggaaaagtatgtcctgtaatatgcatgtaaaaaactggtagaatgaaaccaaataagagtttggattatgttttccttaattttatgttttaaaatatagcacattttcttcactaaacatgcttttaaattttttaattgacaaagttgtatatatttatagtgtatggcatattgttttgaagtctggtagaatggctaaattgagttaattaacatatgcattacctcacacctttttttgtggtgagaacacttaaaatctactcttagcagtcttcaagagtacaacacattgctactaactatagtcaccatgttatacaataggtctttgttttttttttttttttttttttttttttttgagcggagtttcactcttgttgcccaggctggagtgcaatggcgcgatctcggctcactgcaacctctgcctcccaggttcaagcgattctcctgcctcagcctctggagcagccaggattacaggcacctgccaccacgcctggctaattttttgtatttttagtagagatgggggtttcaccatgttgcccaggctggtttctaactcctgacctcaggtgatccacctgcctgggcctcccaaagtgttgggattacaggcgtgagccaccgcacccagcctcagtaggtctcttgaactgtatttaattttaactttttgttttgaaatagtttcagatttgcaaaaaagttgcaacagcagtgctaacaattcttgagcgccctttacccagatttccccattgttaatattttaccatatttgctttatcaatgtgtgtgtgtgtgtgtgtagatatattttttcttgaactatttgagaatgagttgcagatatgaccaagatacttggttacccctaagtacttcagtgtgtattttcttcaaggcaaggacagtttttttttttttggtaagcaaaatacagtgatcaatagcaggaaattaacattgatatcctgtgttgtctaatcatagagtttctttacattttgccgttaatatcttttacatcagaaaaaatatgtttttttcctggtccaagacctcagagtgtgtgtgtgtgtgtgtgtgtgtgtgtgtgtgtgtgtgtgtgtgtgtgtcttagatcactcagtctttgtttatctttcatggccttaacatttttgaaaatgtgaggccgtgtctttgtcaacgtctcacagtttggtttgggtttgtataattcccttataacaagatccagcttccacccgaggcaacagagtgaacaacaacaacaaaaaaagaggtgacctgggtgcttttactaccctacattcagatgtgggagcaaagaaatgacttaaagttggagtttatatttaaaagggaagcggaatgtaagtttggaaaatttgcaggctggccatgtgacagaaagaaaaaactttttcaagagaattcaagcaggctgtggagcaaccgcttgctagagcgatttgtagatttaaaaaggagccaagtgctgatagccaagactgtggggaaaaaaaggccttgaaggcatttcagagaccttcccggcagcccctcccattacagttgtggaggcctcagagggaagaatgctttgtggttcaggcccagtgccagggacagcctcaggacactgctcctcacatccctggccattcagcttccagccttggctcaaaggggcccagatacagctcaggctgccacactagagggtgaaagccatgagccttggccgcttcaatgtggtggtgagcctgtgggtggacagaatgcaagagtgagggaggcttggcagcctccacctagatttcagaggatgtatgggaaagcctgggaaaggggcagaccccttaccgagaacctctggtaggagaggaatgtgggactggaggccccatacagagttctcactggggcactgcctagtggagctgtgggaagggggccactgtcctccagaccccggaatggtagatccaccagcatcttacaacctgtccctggaaaagccacaggctgtgagagcagcctcggattgaaccctgcaaagccaccaggacagagctgcccaggaccttgggagcccacccttcgcaccagcacgccctggatgtgagacatggagtcaaaaggagattatttgggagctttaagatttaatgactgtctgccaggtgcggtggctcacacctgtaatcccagcactatgggaggccgaggtgggagtgcattggcgctatctcagttcactgcaacctccacttcctgggttcaagcgattctcctgccttagcctcccaagtaactgggactacaggcacccaccaccatgcccaggtaatttttgtatttttagtagggacagggtttcatcatgttggccaggttggtctcgaatcctgacctcaggtgatctgcccccgtcggcctcccaaagtgctgggattataggcttgagccactgcgcctggctggagggaccggttttttaattgagagggttggtacttctcccttcctgcctttttccaagggctgctcggggcttgtgtgtgtgtgtgtgtgtgtgtgtgtgtgtgtgtgtgtgtgtgtgtgtgtttcaaagacagagatctgtatttattaactcaggtcagacacttgggatttttcaccaggcatcatcaccaatcagccagctcagattaattaatattaatttggttggtctgttcccaggcccttggtgtgcaggcactttctgtcattaagtccttgtgacccagcctcgtgtgacacatctcccatgatggggagccactcccccaatagcgcattctatgttcagactcctttattagaacgtctttgcttggaggggttgtaaacctctctcctctatgaccactcctatttctgaatgccaggcctctccctttggcagttttctgaccacctaaagaagggatcaagtacctctgaatcttcttttcttaggattaacttttccagtgtctttactgtttctttctttctttttttttttttttttttttttgagagatggtctcgctctgtcacccaggctagagtgcaatgacacaatcatcatggctcactgcagcctctgcagcctctaactcccgggcttaagtaatccttctgcctcagcctcctgagtagttgggactacaggtgcatgctgcgacacctggataatttttttttttttttgagatggagggggtggtctcactttgttgcccaggctggtctcgaacctctggcctcagcacttctccagcctcggcctcccaaagtgctgagattataggcgtgagccactatgcctgtttctcttgtgacaggtgttggggactactgtgccctagagccactttctgagtgttgcagtttgtctttgatgttcaatgtggagctcatttggaattctattaaagaatccttagtgtgccttcccttttggggaagccatgttgacttcggcccatcctattctcatttcggtaaaggaggagggagtagcactgcccatgctgtgggcttgctgccgtggacttgctgtaggaattgtaacacatgcgtgtgtgggcagggggttggggggcaggtggcattctgattgcctccaggtgatctctccagactgttgcccctgcgctggaggcagaagccgacttcagaactgatctgcccagatttgagaaaagtaaagcaagacccctggctctgtttctcttattattattaatttttttttttttttttttttgagaccgagtcctgctctgtcacccaggctggagtgcagtggcgcgatcttggctcactgcaaactccacctcccgggttcatgccattctcctgcctcagcctcccaagtagctgggattacaggcgcccgccaccacacccggctaatttttttgtatttttagtagagacggggtttcaccgtgctagccaggatggtctcgatatcctgacttcgtgatccgcctgcctcggactcccaaagtgctgggattacaggcgtgagccaccgcatccggccgctgtttctgttttctatatttttattcaaaattaattgaggcaatcagctaggcttggtggctcatgcctgcaatcccagcacttgggaggccaaggcaggtggatcagttgagatcgggagtttgacatcagcctggacaacgtggtgaaaccccatctctacaaaaaaaaaaaaaaaacaaaaaaaccaaaaattagccaggcatgttggcgggtgcctgtaattccagctacctgggaggctgaggcaggagaattgcttgaacctgggaggcggaggttgcagtgagcctagattgtgccactgtactccagcctggggacaagagccagaccctgtctcaaaaaaaaaaaaaaaaaaaaaaaaaagaaggccgtgtttggtggctcacgtctgtaatcccagcactttggaaggctgagggggtggatcacctgaggtcaggagtttgagaccagcctggccagcatggcgaaaccccatctctactaaaaatacaaaaattagccaggcgtggtggcaggcacctgtaatcccagctactcgggaggctgaggcaggagaatcgcttgaacctgggaggcagaggttgcagtgagccgagatcgtgccattgcactccagcctgggcgacaagagcaaaactccatctaaaaaaaaaaacaattgaggcaaaagtggggatggtcaggaggatgaaccagcgtgaactcctgtggagagttttgtgcctgtaaatcaccttgtgccaccttttaatgttgacgctggattatatccatgcaatgccctggagcttaggggagctgtggtctcgtccccttggcattcaagccaaggagccaaggccgcagagatgctgctagaagcaggcacggggagctgcagctgcagcatcagcccctgtgggcctggtcagttcgatttgtgctgagtcatgcccactgttcgcctgctgtccctcctgtccccccagtcacgcttgcacagatctgactcagcagctgccttcctcctttcacgtcattgcatcgggcacatgctggtcatgtgtttctaaattaagtcctgttgtgtggggaaaaggccatcagctgggagcgtttggccatggccatcttcagtggagaatgttctccaggataccttggtgaaagccccgtgactgcattgatattaggggtgcaggcatcgttgtacagtagtaccttcctgtagcagcattctgatcacagcacccccttgccctgtcctcaccagcttccccagggccaaacaccttagactggcatacaggcccctaggcccttacgcactcatctgggtgtctcttaaaagtttatctcggccgagtgtggtggctcttacctgttatcccagcactttgggaggccaagatgggaggattgcttgagcctaggagtttgagaccagcctgggcaacttagtgagaccccatctctacaaaaaaatttaaaaaatcagctggtatggtggtgcatgcctatggtctcagctatgcaggaggctgagggaggaggattgcttgagcccaggagttagaggctgcagtgagctgtgatcacaccactgcactgcagccttggtgactccagcctgttccgtgaatgaatgaatgcttatctcttattcgccatctatgcatccccacataaaaacacatcccattgcaccacacttgagttaccccagaccccgagtttctcgtgttctaggctctggtacacgcttcctctatcggtagcttcgctcatccccctaatctgactggtggaccctgatcattcttcacaatccagcccagatgttggcctctgggagccccttccttgactgtttcagactgtcatgcctgctttttccttccagctctatttcccctgcacctggcctccccatgcagccgtgactgttgggataggtctgccctttctcatagcaggaggacaccttggggcaaggttggcatgtctgctcctgcctgaacccacacagttcctggagtgcagcaggtgctcctcagctgtttgctgcacgcatggacgtaagagtgacagaagcatgtccttcgacatgacgtttttgtacctgaacattgtctagaggctttccagactgtaagctctgtgggattaggagcctgcctgcctcgcactccctggcatccttagtgctttgggcctcacaggccagcggagccctcgtgcgggttccaggcctgctttggtgggagtgctcagtacttttagccacacagagccgtggcctgcaaggctttcggagtacatctctagcacatctgagaatccggaagcaactcagagtttctggaatggatttcacaaagtctgtgaataagaaggccccacaggccctactcaacagcttttttttttttttttttttttaaatacagaagatgctagtcttcaaagaacctctttactcttttactctttttctttttttttcgagacagagtctcattctatcgcccaggctggagtgcagtggcatgatcttggctcactgcaaccttcacctcctaggtgcaagtgattctcctgcctcagcagcctccagagtagctggaattacaggggtgcgccaccatacttggctaatttttgtatttttagtagagactgggtttcccaatgttggccaggctggtctcgagctcctgacctcaagtgatccacccgcctcagcctcccaaagtgttgggattacaggcgtgagccaccgcacctggccctctttactcttattatatagtgatggggtcttgctttgttgcccaggctggagtgcagggatactcactgcagcctcaacctgcagggctcaagtgatctcctgccttacctcccaaatagctgggactacagacctgagccaacgctccccacctctttactcttattttattttatatttatttatttattgagacggagtctcactgtgttgcccaggctggagtgcaatggtgtcatcttggctcactgcagcctccgcctcctgggttcaagtgattctcctgcctcagcctcccaagtacctgggattacaggcacgcaccaccacgcctggctagttatttttgtatttttagtagagatggggtttcgccatgttggccaggctggtctcaaactcctgacctcaggtgatccacctgcctcagcctcccaaagtgctgggattccaggcgtgagccgctgtgcctggcttactcttatcttagatatcacgctaacaagcagctgatttcccaatttacgcagattcaaagcagccaattagaaatgggtgagagacttttgaaaaaaaacgtaggcactctcgtggccgggtgcagtggctcacacctgtaataccagcactttgggaggctgaggcaggtggatcacgaagtcaggagatcgagaccatcctggctaatatggtgaaaccccatctctactaaaaacacaaaaaattagccgggtgtggtggcaggcgcctgtagtcccagctactcaggaggctaaggaaggagaatggcgtgaacccaggaggcggagcttgctgtcagctgagattgcgccactgtactccagcctggacgacagagcaagactccatctcaaaaaagaaaaaagaaaaaacgtaggcactctcataatggtgagggtcatcctgcctcaagaaaagacaaacactatcaacaacaaagatgcaggggccgggtgtgctggcttacacctggaatcccaggactttgggaggccaaggtgcgaggatcgcttgagcccaggagtttgagaccagcctgggcaaccaagcgagaccccatctctacagaaataaaagtttttaaaaaattagctcggtgaggtggtgcatacctatagtctcagctacttgggaggctaaggtgggaggatggcttgaggccaggagtatgagggtgcagtgaactatgctactgctttccaccctgggtaacagagtgagactgtgtctctcaaaacaagcaaacagaccaaaaagatgcaggaacctgagatcccacagcctgggttccctctgtgtgcaagcaacctctcctgcctctttaggccctaagtatgttgtacaatgacacgatggccgagtagtctacaaaaggaaccgtgcgtggactcgagacagcatggacatggttcacgtattccggaagtatttctctagctgtgtagaattttagagctgaggatgatccttggtgaccagctccatattgctttgtggagaagaaacctgagtcctgggaggtcaagtaacccgttcagactcccacaaccagagcctccggcatctgtactgcccagtcagtacagagctccggtaactaggtgcacttcagttatctagagtaggcgctaataacttatttcttgtcagaggccaggtaataaatattttttaggctttgcatgccaagaagtaaaatctaggatgttatatataatgagaggcaacaagtttccatgttttttgttgatgaaattcaaataaggctggttgcggtggttcacacctgtaatcccagcactttgggaggccaaggcgggagaattgcttgagcccaggtgtttgagaccagcctgggcaacttagccagaccctgtctctataatttgaaatatatatttttaaaagaaattcgagtaataactaataacagttgagtgcaagtttttaatacaggtttgttaataagaagaatggaatgatttttgtagggataacaattttgggccaggtgccatgactcacgcctctaatcccagcactcttggaggctgaggtgggaggatcgcttgagtccaggagtttgagaccagcctgggcaacatggctaacccctgtctctacaaaaaaatatttaaaaagttagctgggcatggtgggtagtatacacctgtagtcccaactactgtggagactgaggtgggaggatcacttgagcccagaaggctgaggctggagtgagctgcgattgtgccactgcactgcagtctgggtgacaaagcaagacccagtctcaaaaaaacaaaaaacagaaaacaattttgtttcattggggttctgaattagtgttcccaaacatcaaaatctgttgcaaatatccccgtgtcagtgctcatctgtaatgagattgtataggtgacatctttgaaaatatcttttcacacaaataggtactgccaagttatattggtcagggagcataaattttgatggggcattttaatcattggaagacagcatttatagatttttttttttagattcccctcttgatatttgcctttttgcattattgcattgcagatcagccacttccaattgaaggttagatgagagctgctcaattgtacagttaaatggattttaaaatatgggaatttccttcatacttagatcaagatctgaaaaacgctgctagggctagaactagcagctcaaagtttttgttttttttgagctcaaggtttgagctcaaaaaaatgtgcaaaggtttttcacttgttctaaccttgacagtctaggaattgtatggcgcaggttgacattacttgtgattcatacaatgttaatttcattgaaatgactttaccgcaatataagttttgcatataactgctgttttgccttataattttagattggcctcattaagaaacatcaagtctgcagcaaaagctaatttccaaagcgatttagtatttggtaatagtggttgagggcagttctttcttttttctttttctttttttttttttattgagatggagtcttgctctgtcacccaggctggagtgcagtggcatgatctcggctcattacaacctccacctcccaggttcaagtgtttcttctgcctcagcctcctgagtagctgggactacaggcacgtggcaccacacccagctaattttttgtatttttagtagagatggggtttcaccgtgttagccaggatggtctcgatctcctcaccttgtgatccgcctgcctcggcttcccaaaatgctgggtttacaggcatgagccaccgtgcccggccctctctttttttattttttatttttatttttagactaagagggcagtacttttcagttattcttgttcagaaaagatttaatattcactctgagctcaaaatagtcacaccagactttaccactgctaagctgctgaactgctgtatggtaggccagttaggatattcagcttctatttttgacaaaaatccttaagaccaacttaggttaagtccatgagagcagatactgttgacattcccttgttcgatcacatataatagattcaaattttttgcataatatctgctggtgaataatatagtgaacaaccataggctccaactaagcctttttctgccccccacattcattataacacatcttagtggattccatttcagattgtactaaacttttctcaacttctttgaaaatgctcttatttgtagttgtttcatgctaattcttcaaacttggtattgactccccaagtaaacaacaactgaaaagtattggtaacgtctttagattcatcaagagccaaggaattgcattcttaaaccctcttggtggcttccctgtaaatgcttccaagatatgagcgaatgctatagaaattgcaggaaagtccaaagggctgcgcgtctcctgtggctcagtcttatttcatacctgcaacatcttttaagggaaatttgcaaaagggagaattatcaacttaaaaaaaaaatagccaaggaaacctcgactcttcaaggaagcaaggaaacgtgctctccttgggagtgacattagaggaggcccagtgtgagtcaggacttcatcaccacctggcggaaccagggagccccaccccatgtgtcagtggagatcatgtgctgtcttccctctccaagctagggtttgtcagcagaggcccaggagggagactgaatctcgcctgacagcaatgaactgataccttccttccctataagcaggtgacagacaatatttaataaaatcaaaaaaggctgggtgcaatggcttacacctgtaatcccaacactttgggaggccaaggtgggtggatcacttgaggccaggagtttgagaccagccccagcaacatggtgagaccctgtctttactaaaaatacaaaaaaataaattagccaggcgtggtggcacacgcctgtaatcacagctactctggtggctgaggcatgagaatcagttgaacctgggaggcagagattgcagtgcactgagatcacacaattgcactccagcctgggcaatagagacagactctgtctcaaaaataaaataggcttaaataagattcaggatcttaaagtacccagaatgcccagaatacaataaaaatcaatcactataccaagaaccacaaaactctcaacttgaatgagaaaagagagtcaacagacaccagcatcaggatgacacagatgttggaattaagatatagagaagaatgaaacagatgtcttagaaccgaaatatacaatagtcaaaataggaaactgaatggatgactccacagcaaaatggaggagacagaagagagaatccatgaacttgaagttagagcagtagaaatcacctaacctaaacaacagaaaatagactgaaaaccaaaacaaaacaaatgaacagagcctcaggattttgtgggactaataacaaaagatctgactttcatgtcacccaagtcccaggagaagaagagaaagagagtgaggctgaaaagttatttaaaaaataatggcggccgggcacggtggctcactcctataatcccagcactttgggagacagaggtgggcagaatctcaggagttcattaccagactgggcaatgtggcaaaaccctgtctctactaaaaatacaaaaattagccaggtgtggtgaggcacacctgtagtcccacctactcaggaggcctgaggcaggaggatcccttgagcccggaggatccctcaagcccagaaagttgaggcttcagtgaacagtgattgcaccactatgcctccagcctgggtgatagagcaagaccttgtctcctaaaacaaaaaagaaaagaaaagaaaagttgctatattttgcaaaagacataaatctacagattcaagaaactgagtgaaccccacagaaggtaaacacaaagaaatctgcaccaacatctcagtacagataataaacttcctgggtactctggctattgtggctgtggagcgatctgtctgagtcactcttggacactgctttttaacaggtcaccttggagagtgtagtgttccccgagtacctctcagtccctgtgggttgcgctgtcaggcaacagtagggtatggttccatgagggttttccctcatcttgaagccactaaaccttggcagaggggcttgtgaacctgaatgaccccgctccccctgcagccagaaggtgcagcccctggtgccagagccttgtctaggtggccctgacatgacagtgacagctaaagggttgactaaattacaagttttattctttcctttcttgttactgctttgattggggtgtctgactcaccccaatatcagtgctgagttggttgctcaatcttttttacggaccagaagttgcaaacagtaaatgcaaaactgcaaatacttcctggaagataacctgttccagtgttgcaaatggttggcctcagagagcccttgtgttcttgcgtcattctccctttcagaagctggtgaggctcctgccagtgccccccagcctgtgtgctccctgatttatttgtccatcttgctcagtggtgtgtgggagggactggagctgttgcccttgattgctaccttggtgggaaccagccagctaccgaaattgacagggaatcgtggtcaagctatacatgcatagtttttacccttctctgtatgttgtattttataataatgaaaacatgtagagacctaatttataataaaagtcaggtctgctctatttagagttggggagatctagttggctggtattctgacatgtgcctttttctgtgcctaattttttcttgagacaggacctcactctgttgcctagactacagtgtagtggtgtgattatggctcaccgcaacctcaacctcctgggctcaggtgatcctcctacctcggcctgccacatagctgggactacaggtgcgcaccgtcacacctggctaacttttgtattttgtggtagaagtggggttttgccatgttacccaggttggtctcaaactcctgagctcaagtaatctgcccgccttggcctcccaaagtgctgagattaaaggcatgagccactgcacccagctctgtacctaattttacagatgagaacatgaaagccttctgttggtaaggggtgtgtctggggtcccagccagctggtgtggcggggctgtggcaagagcctggtctagttcttgtttgctgtttggattgatactgtgtttggccccatgagctctgccttgtctcttgttccttttgctgaaggtataaagaagaaactcagagattaaagactctttcagggcagaaggctcacacaggcttccagaacctcctcggagcgattgtagggactgcctgacccggaagagagttgtcagtcaagaccgccagagttttcccatcagagtatttggcatagcagaggtggctcccaaactgtgccagggcactgcagcaaactcacaagtgatcattctcaatgcggcggacgctcaagtctgttgaactccatgcgaagtgctagcttgggacagttcacggttccaacgtgagatccttgctgcattccttcttaggattttacatctttgcgaagctgggtttgcagtggttgttcagacctaactatacgtggaactgttaggcatttttttttggcctacggataccattaaaaatttgctgagataccagggactccacaaacgaaggacatttgggatctgtccagacaggtacactggaagcccaatgtgtgttttatttgttaattgattgattgattgagacagtcttgctctgttgcccaggctggagtgcaagtggcacgatcttggctcactgcaacctccgcctcccgggttcaagcgattctcctgcctcagcctcccaaatagctgggattacaggtgtctgccaccatgacctgctcgcagcaccacgcccagctaatttttgtatttttagtagagacggggtttcaccatgttggccaggctggcctcaaactcctgacctcaagtgatatgcctgcctcagcctcccaaagtgctgtgattacaggcgttagccaccacggccggccccaatgtgtgttttaaatctttgcgcttaaatgtttttgatttctgcacattttgtgttgcacgtgtcataatgcattcaccgattcccttcattcccttgagtagttattgcgccctggattctgcgccaaggaagtgtgtgctggggaggggatggtggagctgaggtctgaagaatgagtacgaagcttcgagaggaggagcatctcagacacctgtcaggctctggggcaggaccgcagaggtgcaagctggagagtggctcagggtggggctggagagatgggtgtgtgtctgtgtgcgcgtcaaggggaaaacggttaagtttcttaacccaggggctcatttgtggcctcagcccccaggcacactgcttggatcctgggattcctccaagcttaacctccttgagaggccttcctttcgcaccgcatgccagacacagaggtgcctgagatgctgttcttccctcaaggagctcacaccgagtgagagagagacccatgtcctaagtagagggcggtgagcacagcccggtgggaagctgggcctgtttctcgttttgcccgagtgaggtgcttaccccgtgtggcctcatctgtagctcagggccttggataaagtgatggctgggtccttcccaccgcacctgtcttctctcagaagtagtttgatatttcagagtcaaagctgctgggaacattcttgttctgtggagcctccaggctgagcgctgggagtgcccagtgtgctggtcggggctggggggcactcagggccaagccccacccctgttggctgcaggaagtcagtcacagcctcaaggagcagctcctgttcgtttccttcgttttgcgtgttagtttccttacaggcgtgagactgtgtggtcctgactgtgaactccgggaagaggctgaaagaagctgtgagtgcaggtgttagagacaggcagcatgaagaggagggaatagagtcagcctcacagactgtcctgatggagttgcagtgtggttttcagattataaaggcattccatagtctgtatgccaagcactgccaatccaggtacccgaaaatcggaaggttcttgccttctattcacatgtttatttattcaacaaatcgacataaatgctcattatatgccagtctgtgaactaagccaagtccctgcccttgtggggtgaccctctagtcagggagagagccagtggtggggtaatgtataatataatgtgaggtggggataagctcagttgtgaggggtcagagggtggggattgtggccagggggcagttgtagattctgttctcaggcaaagtttctctgagatggtgacatctgagcagaaacttaaatgagggagtgaattttgcaaataatgagatggccatgtgcaaagtccctgaaacagaaggaggccagcgtgacctgcaaggtgtgaggaaggggagcgtagtaagaaatgtgggtggtgggagtgggttctgagggccggatcgtatgggccttatgagctgtgtaaggacttcagggctttgttgttgttgttgttgttgttgttgttgtttttgagacggagtctcactctgtcacccaggctggagtgcagtggcgtgatctcagctcactacaacctctgcctcccaggttcaagcgattctcctgcctcagcctccccaagtagctgggactacaggcacgcgtcaccatgcctggctaatttctgtatttttagtagagatggagtttcgctgtgttggccaggctggtcttgaactcctgacctcgtgatccacccgcctcggcctcccaaagtgatgggattacaggcgtgagccactgtgcctggccactttaggtttttgtacgaagtatgatgtgaagacatctcagggtttgttgttgttgttgttgttgtttgagatggagtctcactctgttctccagcactccaggctggagtctggagtgcagtggtgtgatctcagctcactgcaacctccgcttcctgggttcaaatgattctccagcctcagcctcctgagtagctgggattacaggcatgcgccactgcatccggctgatttttgtatttttagtagagacagggtttcaccatgttggccaggctggtctcaaacgcctgacctcaggtgatccacctgcctcggcctcccaaagtgctgggattacaggtgtgagccaccgtgcccagcccatctcagggttttgatcagggaggggacatgacctgacttacttttttttttttttgagatggaatctcgctctgtcgcccaggctggagtgcagtggcacaatgtcagctcactgcaagctctgccttccgggttcacaccattctcccacctcacctccctcctcctgtttctgggactacaggtgcctgccaccacgcctggctaatttcttgtattttttttttttaagtagagacggggtttcactgtgttagccaggatggtctcgatctcctgacctcgtgatccacccgccttggcctcccaaagtgctgggattacaggcatgggccaccgtgcccggacgatctgacttactttttaaagcatccccctgtctgctgtgtggggaatggcccgtccatcagaattctcttgcggtgattacgtaggtgcagatgtaccgctaacctcactcccagcgtcgtcgatttattaatagaaactgccatgagttatgcaatcagcttgagtctgcgttgagaaggacttcacatcatgggcattagatctcttctggaaaatgaggggaccggtcacttggggagttagaagggaggagggtgagggacagggagcgcgagtttcttggctgctgccttgtgatggataacagctagacagctaggggagctcctgtgtcaccatggcactcctgactggttccagtggggccctgactgtctgctgcctcatgactctgtgggacaagtccttccagaatctgtcagagcagatcctaaatgcctctctgtctggttctatgaaaatgtgacaggtggctcataagcttgacagagatcctgatatgactagcattaagtaaatattaaatgtgtttataagattaaatataaatagttttctctggggacaacagaattcactttgtcctttaatgtcatatcaaaaaagctggccaggtgcagtggctcacgcctgtcatcccagcactttgggaggccgaggcaggatcacgaggtcaggagtttgagaccagcctgaccaacatggtgaaactccatctctactaaaaatacagaaaattagccgggtgtggtggcacatgcctgtaatcccagctgctcaggagactgaggcaggagaattgcttgaatccgggaggcagaggttgcagtgagccgagatcgcaccactgcactccagcctgggtgacagagcgaggctctgtcccccggccccccccccccccgaaaaaaaaaaagtcatatcaaaaaagccaagttgaggccaggcacagtggctcacgcctgtaatcccagcactttgggaagccgaagcaggcagatcacctgaggtcaggagttcgagaccagcctggctgacatggtgaaaccccgtctctactaaaaatacaaaattagccaggtgtcgtggcgggcacccgtagtcccaggtaccctggaggctgaggcaagagaatcgcttgaacccaggaggcggaggttgcagtgagtcgagatggtgccattgcactctagccagggtgacagagagagactctatctcaaaaaaataaaataaaaaagaaagaaaaaagctaaattgagatgaactcaagccattggaaaagcagctcagattagtgagaaagcaaagacccaagcttgcgggcctgttctgaatggcctgttcccagcaggttgtgtagcagtagaccgatgcccacaaccctcggatgccctggcttcccagaccagccccatggtttcctggtgacagtgacagccatcagcagtcagctagaacatagtctctcattgcctaattgctgacacatgactaaggctttcctgattgagtctgggtgctctggttgtggtgaaaaacccagtcggtcatatccatgattgcaaaatggaatagtgtgaatttcagggctgagcccagcctccttggtaagcagcagaagctgctgtttcagggactctcacttggacctttgttgactcatgtcacgtctgcctaccaggtgtcgttggtggaaggaccagttgagcatcttatgagggaactaggctggtgacatgggggttcccccacctccctcccggacggggcggctggccgggcggggggctgacccccccacctccctcccggacggggcggctggcggggcagaggggctcctcactgcccagtaggggcggccgggcagaggtgcccctcacctcccggatggggtggctggccgggcggggggctgacccccccacctccctcccggacggggcagctggccgggcggggggctgacccccccacctccctcccggacggggcagctggccgggcggggggctgacccccccacctccctcccggacggggcggctggccgggcggggggctgacccccccacctccctcccggacggggcggctggccgggcggggggctgacccccccacctccctcccggatggggcggctggccgggcaaaggggctcctcacttcccagtaggggcggctgggcagaggcgcccctcacctcccggacggggcagctggccgggcggggggctgacccccccacctccctcccggacggagcggctggccgggcgggggctgacccccacctccctcccggacggggtggctgctgggcggagacgctcctcacttcccagatggggtggctgctggacggaggggctcctcacttctcagacggggcggttgccaggcagagggtctcctcacttctcagacggggcggccgggcagagacgctcctcacctcccagatggggtcgcggccgggcagaggcgctcctcacatcccagacggggcggcggggcagaggcgctccccacatctcagacgatgggcggccaggcagagacgctcctcacttcctagatgggatggcggtggagaagaggcgctcctcacttcctagatgggatggcggccgggcagagacgctcctcactttccagactgggcagccaggcagaggggctcctaacatcccagacgatgggcagccaggcagagacgctcctcacttcccagacggggtggcggccgggcagaggctgcaatctcggctctttgggaggccaaggcaggcggctgggaggtggttgtagcgagccgagatcaagccactgcactccagcctgggcaccattgagcactgagggaacgagactccgtctgcaatcccggcacctcgggaggccgaggctggaggatcactcgcggttaggagctggagaccagcccggccaacacagcgaaaccccgtttccaccaaaaaaatacgagaaccagtcaggcgtggcggcgcgcgcctgcaatcgcaggcactcggcaggctgaggcaggagaatcaggcagggaggttgcagtgagccgagatggcagcagtacagtccagcttcggctgggcatcagagggagaccgtggaaagagggagggggagggggagggggagggaccagactttgtctcttaaaaaaaaaaaaaaaagactcccaggcataggaaagcaggcattcaccataaatctcattgttaacaggaactaccttcatagcccaaggttttaggaatacagagacactcttgccagtcaggatagtccaaggctcgtgaatatcaggagccactcaagggccaggcctggagacttggaacatgcagggtttagggcaacccccgccagccacacagctggggaaagggtttgctgcgaaatggtccactcttgcgtgcacttcctcccgcctgccccccgtgcggtgtccttgtgggattagaggatgttccagcacactgagagtcagtggctgtcattttctctgtcttccagggacccagtcccagctgctgccttagcttgcaccccaggaccaccctgggctggtgctgacaccactgggggctgtctgttatgtcagccccagtccaagactgtggctgtcttggcaggaacctggctgagtgagccccttctcctaccccgtgcagtgaccatttcctgcagccccaggggcaaggcccagcatttaggtgggcaccccagccagcctcaggggcaccctgctaccctctgctgacatctgctgtttctgtctcctaacagtttcatgatcaacatgggagactcccacgtggacaccagctccaccgtgtccgaggcggtggccgaagaagtatctcttttcagcatgacggacatgattctgttttcgctcatcgtgggtctcctaacctactggttcctcttcagaaagaaaaaagaagaagtccccgagttcaccaaaattcagacattgtaagtgccgcctctcagcctcctctctctgtccctcttctgtcaccactccaagcagtgtcctgcatgcgggcctcaggctgaaagaagcaaggctccttgtagcattttggggtgactcttgggttttgccttcttgctagattgtgcttgagctctcccttaatcatctcttatgtggggtttataaggcccttttctatctgctgtttatatgaccttcacaggaagcactgcgaaaatgacaccagtttacagattaagaaccgggggctcaagaatgttaacgggcctgccagggtcattagccagcaatagcagcgctagagctggaacccttttttccatttatttatttatttatttatttggagacatggtctcactgtattgcccaggctggagtgcaatggcggtggcacgatcaaggttcactgtaatctccacctcccaggctcaggcagtcttcccacctcagcctcccgagtagctgggactaaaggtgtgcaccactatgcccagctaatttttttttttttttttttgaagcagaatcttgttctttcaaccagtctggagtacagcggtgcgatctcggctcactgcaacctctgcctcccaggctcaagcaattcttctgcctcagcctcctgagtagcttggattacaggtgcccgccaccacgcctggctattttttgtatttttagtagagacagggtctcaccatgttggccaggctggtctcaaactcctgacctcaagtgatccgcccacctcggcctcccaaagtgctgggattacaggtgtgagccgttgcgcccagtcaatttttgtatttttttatagagacagggatttgccatgtcccgggctggtctcgaacacctggactcaagcaatccgcacaccttggtctcccagagtgtcgggattacaggcgtgagccactgtacccagcctagaattggcattttaaagtctttttaaggctgtagccacctggaaggctatgtgctaatgagcacaaaatctttggacaggccttattttgttgctcttttaaacttttcatgaagcttccttttaagaataagtgaaaaagatggattagttaaaagaaaaacgttaaggaaataatagtatagatggtatgtagacagaaaaaaatgataccgaaggtctgcctaagtgactgcatccctgtctctccaagattgatttccataagccacacggaaaagtcattctccagattttagggtcctgcggccagaattacttcctgcggttacgcttggctgtgtttaacaccagtctcagactccaggggcccgcagccaggtttgagtggggacctgccaggtcaggtctgagccgagggaactccaggggcacgggcctgctgccttcagggactccctggatttggcaaggggcaggtctcaggggcaggattgggagccattctcagaccagaacccctttcattctgtctgtcttcaggggacccagtcccagctgcagccttagcttgcaccccagggccaccctgggctggtgctgacaccagtgggggccatctgtcatgtcagttccagtccaaggctgtggctgtcttggcaggaacaagccacacagaaaagtcattctccaaggctgggcatggtgaagcatgccgctcacatcaaatcccgattccctattccaatctgggtatcagccttccccgccagaacacttacagccttcacaccgtaaagcagatattcacacaacacagttcttataccatggacagggaattagttttacatttttaaaaactgggttcagggccaggcacagcggctcacgtctgtaattccaccactttgggaggccgaggcgggagaaatcacttgaggtcaggagttcgagaccagcctggccaacatggcgaaaccccgtctctaccgaaaatacaaaaactagctgggcgtggtggtgcatgcctgtaatttcagctactagggaagctgaggcagaagaatcgcttgaacccaggaggcagaggttgcagtgagccaagaatgcgccactgcattccagcctgggagacagagtccgtctcaaaaacaaaacaaaacaaaacaaaactgggttcaatcttatctccatcattgactcactgagcaaacatttcctgaggccctacctacagtgtcccagacactatgctaaggtgtgtggctgcagcagtgaagaaaatagatgaatgctgtcttcatcaagcttacgctctagtggtgagtgaaccctgggcgagaccttaacctcattctgcctcagtttcctcacctgctaaatggaggcagtattcccaatcttgtggggcttttgtcttaaatgaggaagagtctataaactcacctagcactgcccctgagggataggagctgtgtagtgtttgcgttgatcgtatttcgtgccaggcactatgacgggcacgatcaggaccacagagccagcatttatgttaagctggaaaatgagggtgttgcaacatagtttttttttttttgagacagacttttgctcttgtcactcaggctggagtgcagtggtgcaatctcggctcactgcaacctccgcctcccgggttcaggcgattctcgtgcctcagtctcccgagtgcctgggactacaggcacatgctaccacgcctggctaatttttgtatttttagtagagacggggtttcaccatgttggccaggctggtctcaaactcccgacctcaggtgagctgcctgcctctgcctcccatagtgctgggattataggcgtgagccaccacacccggccacagcgtactttttagaaatgctttgtgaactgctttaacctacattgtctaatcagggcctccttgcaacagcgccgtgcgttaggtagcgtgggttgcctcatttctgctctcagagaggttatgggatgtgcccagggcacaggctggagagacaggctccgccagctctaagagagaaggaattggtgtggggatcagaccaagtcctgcaggaggggtgttgggcaggttcttaaaggtagagccacaccctgaagctgaaaggactttagagcagagggcccgatataggaagggcagatcagctggaatccagcccatcctgtccagggctggtacacggggcattgctggtgtggaatagtacttttgataaaaaagcgtagtagtactcaagataaagagaccagggtccaggacccagctcctgaactggcccttgttccctcatctgtaaaatggaagttccgccccaccgccgtgagtgaggacgtgggttggccctgggagcctgcggagcttgccaccaagggaggcagcattcctctcatagctcatctgttctcgctgtcacctccctggccttacaagaggaagttgacataaaacctgtagactgtgggagctgtagggtcccaaagcacttgtatttttttgttgattctcactgttcctctttgccaggatgctgaaattctgttccctccacctaatcatgatcttctaaccttatgtgtgtggagatatgcagtttccagagtcttgtctcttccctcattaaatcacactggatgcctgctgcagccagggcttttacctgtacgctgtacaagacaaatatttctagtaccatggctacattctggaccctgaagttgggtgctcaaggttgagtactgactctcccacattagccatctgacatcagccaggtgacttgatctttccaagtctgtgtccccaactgtaagctggaggtagtagtagtacttacctcataaggctgtgaaaactgagttaatccatcatagagctctttgctcagttcctggtgcatagtaggctctcaggtgttatggattgttactatttatttatttattttgaggcagggtctcactctgtcgttcaggctggaatacgctggcacgatctcggctcactgcaacctccgcctcccaggctcaagagatcctcccactttggcctcccaagtagctgggactacaggcgtgcaccaccacccttggctaatttttatattttttgtacaaatggacatctaacaatgttgcccaggctggtctgaaactcctgggctcaagcagtctgcctgcctcggcctcccaaagtgctgggattacaggcgtgagccaccatgcctggagtgtgttattatttttatcctttttattaataccatctccagtcttacaagagcccttccacgaagacatgagcagcccattttgcggatgaagaaaccgaggtgccagggattgcagagtttgcccaaggccacctaacttctaaatagcagcagagttggcttttgaatgaagtctgcaagctccacaagccatgttttctctactttgccatgctgctcctaatttagtgttaataggcctcctacgatagtgttagtctcctaagatagtgttaataggcctggcatggtggctcacgcctgtaatcccagtgcttagggaggctgaggcacaaagattgcttgagccaggagttcaagaccagcctgagcaacatagggagacccccacccccccgccatctctacaataaacaaaaaagagtggtgttaatttgttaatttaccgacaaggagagtattccttatctgaagtgcttgccagaagtgtttcagatcttggactttggaatgtttgcattatactcaccagatgagcatttcttatctgaaaatctgaaatgctccaatgattcttccctttgaggatcatgttgacgctcaaaaagtttcagatttcagattttagattagggacattcagcctgtagatgttattttacagagcaggaagttgggtgtagtggttcacacttgtgatcccagctctttgggaggccaaggcaggaggattgcttaagcccaggagttggagaccagcctgggcaacgtagcaaggccctgtctctataaaaaataggagaaaactgaggctcagaaaggtcacctagctgatacaaccaggcctcaagcctagatctcctattctaaatcccacatcagtgtccctggctaccggtatttcagtgagcacaggtgatttctgttatagccacagagcagtagggagtaatagggcttagtgtgaggaaggtatgtggcccagggctatatcaggaactctcaccatgatttctggtggcttctagaattggcatttatttattttgttttagagacacggtctcgccctgtcacccaggctggagtgctatggcgcgatatcagttcactgcaacctctgcctctggggctcaagcgattctcttgcttcagcctcccaagttgctgggattacaggcacccaccatgatgcccggctaatttttgtatttttagtagagatggagtttcaccacgttggccaggctggtcttaaactcctgaccccaagtgatccatccgcctgggcgtcccaaaatactgggattacaggtgtgagccactgtacggggccaaacacatttttaaaacaaaaaacccagtgggatttttgttggaattggattgaatctgtatattaatatgggaagagttgacatcctacaatattgagctttctattccatgaacattgttttatccctcccggggaggtcttttggactgtttgtaatagcaattaatgacttgttagagaggagtggtaatgagcaacaagttctttttcataataatagtagcagtaatgataataaatggctcttcctgccaggtgtggtggctcacgcctggaatcccacacttcaggaggccgaggcaggtggattgctttgagcccaggagttcaagatcagcctggcaacatgacgaaaccctgtctctacggaaaaaatacaaaaattagccaggcacggtagcatacgcttgtagtcccagctactcaggaggctgaggtgagaggatcacctgagcctgggatgccaaggctgccgagcgccgagctcacaccgctgcactccagcctgggcgacagagcaagaccccctctcaaaataataataataataataataataatatataataatgactctttcacgtccactcccactcactcaggttgcacctctgaacagagcatttcgcactggggcagctcatgccctaagggagccccagggaatgctcagcctcttgagtagctggggtgacgggcacatgccaccatgcctggcttatttatttttttttaaagacatggtctcgctctgttgcccaggctgggtcttaacctcctggcctcaagcagtctccctgcctcagccttgcaaagttctgagatcactcactgtgtaggatccaaagtcccacaggatccagggctcctgtgggctctctctcctgtgggcctggcagctttgctcacccttatggaacaacaccgcatggcgtgccctcttggtgatggaatttgtatttttgcctcccatggtgcagagagcgtcccatttccatctgggtccctaccttagtgcggggccgcctgtcggagggaagcttctcagagaatggccgttgaattaaccaaggctaaatctgtatgtgtggctgcctctagggaaacctgtggcctccaggctgggtttggcttacacagtatttttttaaaaaatattttaattagaacattaaaaagtgtggcagtatcaggcccagcgtggtggctgacacctgtaatcccagcactctgggaggccaaagcaggtggatcacatgaggccaggagttcaagaccagcctggccaacatggcaaaaccctgtctctacaaaaagtacaaaaattagctgggcatggtggtgcgtgcctgtaatcccagctactcgggaggctgaggcaggagaattgcttgaatccaggaggtggaagttgcagtgagctgagatcacgctactgcattccagcctgggcgatgaagtgagaccaaaaaaaaaaaggcagtatcaaataaaaacttagacttacagcttctttaaaaaaaaaaaaaaaaatagaggatctggtcatactggacccacagtgatgcccaccagctgtggagcagctgagcagcggccccattctgcacgaggcctgtgcgctgcattcactctgaccctccagcccgctcaggctgctgtgctcatgttgcctctactggccctgagaagctctgcagtgccccctgcacctgtgctttgctcctggaatgctagagtgctttaaagaaaaataaagcttcttatggaacatttcaaacaccagagtgtagggcacaggagagtggaccccatacgcctccagcccccagttttcataactactcactcctcgccggtcttatttctttccgctgccccccaccgccgcaccagtcctggattattttaatgcaatccccagatgtcatatttcatcaggaaatgtttcagtcctctaaaattcaaggactcgccaggcatggcggctcatgcctgtaatcccagcacttcgggaggctgaggcaggagaatcacttgaagccaagtgttcgagatcagcctgggtagcatagcaagaccccgtctctacaaaaaacacaaacattagtcaagtgtggtggcacatgcctgtggtcccagttactcagaaggctgaggtgggaggatcacttgagcccaggaggttgaggctgcagtgagccatggttgtgccactgcactccaacctgggtgacagaacgagaccctgtctcaaaaaaaaaaaaaagtaaacttcaagtattctcctttctgaacataacacaacgccatcttcacaccttggaagtcaacagtaattcttcagcatcgttagatacccagacaacatttattcatagttccctgattgactgatgtttgattttgtttaacagtttttgtttgtttaattcaggatctaaacaagacccatacactgcagttgattaataaatctttcgtttgggagaggtcaggtatattcaggtataatttgcatacagtaaaatgcccccctcctcccttttttttgagacagggtcttgctctgtcacccaggctggagtgcaggggtgtgatcagggctcactacagcctctacctcccaggcttaaggggatcgtcccatctcagccccctgagtagctggggctacgggcatgtgccaccatactcggctaatttttatttttaattttagtagagacaaagtctcactatgttgcccaggctggtcttgttcgaacgtctgagttcaagtgatcctcttgcctcagcctcccaaagtgctaggattaggattacaggcatgagccactgcactgggccaacattttcctctttaagtgcaccagttcatgagtcttgacagatgtatgtgattctgtaatcagtatcataatcgaaatctagaacatttcatcactccgaaacagtcctgtcctacctctttgcaatcatcctcctccatcgggtaatcagcctctggcaactgccaatcttatttctgtccctgtagtttaacattttccaaagcgtcacataaatggaatgatagcaccgtgggctgctgtgccagcggtttttccttagcgacacgtcagctccctttccattcctaagcttcccttccatcccgtttcttccttgaaacatcatttgtatcacagtttcccacagtctggattttcctgattacgtccccctggagattgcttttgaaaagccacaaaagatctcattttcctgagtgaccttccttttggggcctgttcttgacagaaagcccgggaggccaggggtcagggctgccagcatcacgtgtctgttttttatctcctgagtgccaacagatgggaagtggatctgggggtcttgccacatccagttcagggtcactttctctgtagtgaggtccttggctccatcgagcatgaaaagagaaatacaaatgagactgacaaagaggaaagcattaggggaagcctgtggccacgagagtagacggtgcagggggcccactgcctcccgctgctgtgggaacggcgaggacatgggccagggtgtttctgccacttctgcaagcacagctctgggttttctgctgccatctgacctccaaagggacctcgcctcctctccttcctttcctggtccctgatgagatgggggaggtttctgtcactctgacaagtgcttgaaactccagacatgggctgtcgggaactgtcgggtactgccgtgcagagcgcatgttgtctgacctcctgacttcactgggccctgtcgggtgcaggagagggagctgtggatggcacagtgggacatgtgctctactggcctgggggtggtgggaatgcagaggaggggtatcccccattgggggtgtgtcagggatgagatgcccccacaggagcctaggaggccaagtgtggaggctgggaggtgaggacacgcggggctgttccaagggagccacatgctggtagagcccaggcacaggtcaccaagggagtcaggggtcgtggggggtcagaggtcataaaaggagttggggtcaccaaggaagtcaggtcatggagggagctgacacaggagagcatcttagagggccttgggaccttccaaggggtatggatttttttccccagctttattgaggtataaatgacaaaaattatatatatttatcagagcatctaagtttttttctttttctttctttcttttttttttttgagatggagtcttactctgtggcccaggctggagttcagtggcacaatcttggctcactgcaacctctgcctcctgggtccaagtgattctcctgcctcagcttcctgagtagctgggactacaggtgcctgccaccacgcccagctaatttttgtattttgagtagagatggggtttcaccatgttgaccgggctggtcttgaactcctgacctcaagtgatccacccacctcagcctcccaaagtgttgggattacaggcgtgagccaccatgcccagcctaagcatttttctttttttctttttgagactaagtctcgctcctgtcccccaggctgaagtgcaatggcgcaatctcggctcactgccacctccgcctcccggcttcaggcgattctcctgcttcagcctcccgagtagctgggattacaggcgcctgccaccacacccggctaatttttgtatttttagtagagacggggtttcaccatattggccaggctgatctcgaactgctgacctcaggtgatccgcctgcctcagccttccaaagtgttgggattacaggtgtgagccaccgcaccaggccagcatttttctttctttgtaaattttatttttcccagctttaaaatgacataattgacaaataaaaattttatacatatatttaaaattatgtaagttcaaagtatacagtgtgatgttctgatatacgtatcttagctgagcatggtggcttacacctgtaataccagctacttgggaggctgaggcgagaggatcacttgaagccaggaggtcaaggccagcttgggcaacatagcaagacatcgactctacaaaaacttaaaaataaattcaaaaattagctgggcatggtggtgtggacctgtcatcgcagcactttgggaggctgaggcaggagttggaggctgcagtgagctgtggtcacgccactgcactccagcctgggcaacggagcgaaccccgtctctagaaaaactaaaaaatcaatttaaaaaaatgacatatgtggatgacgctaacagggagctggggaagcctgtgtaggatggcggtgtctggagagcggtggccccatgaagcgccatttggagctggagtggagggagctgacttggaagcaggaagatgggccaggaggctgctggcctcagcctagcagaaattgaccagggccgctcggcacagatggagagccgagtgcaaatgcaggtgtcagtggatcagagaaagggctccaagccagtgcttttgaaaacataattctgggaccctcatcacccaccagaggtgatgttcttatctccattttacaaatggcagtgctgatcccaggagagggtgagtgacctggtcaaggctgacgttagcacatgagagctgggattccagcctggggcttcctgcaccacgcttttgctccctcggacccctagctcttgtcatggccaccccagcccacccctcctttccatcccctttgattgcacacaatagcagagccactttgtgccagatcagatgatcttactgtctgagggtatggccttttctttctgtcaccgatgggctgaataaccctgagtttctcttctctgtctccggaaaattagccctagtcctggccaccccctggctcagggtcactgctgaggtcgtcagaagagcatcaaggcttttgcgtgtgtggaacagcacagcaggctttctgagcttcacagacttgctcacggagtcctgatgtgaacacgtgctggaggacatggtcggggggaatgagggagcggcagcccaccagagccttagagcatcctgaggacacggccccaggatccttgggaagggctgtgagatgtgctgcctgaacgtgcccggggcgcactgcagacagggtaaagccgggggaggtgcaccttgcttggggagcagacaggaaccccgggtgctgggccactgggccctggagctttcacaggcctggagttgaattaccgcttcacccaccctgagcctcactgccttgtcaaggtggatagaaacccttgcgcactgcacagggtggtgaggattaaacaaaataaaatagaaagcttcttgaatgctagccagcatgcagtaggcactcagtaagaagtcattcccttcgcctgttttgtctctgacctgtggccactcacacctgctttcacctccccctgcctgtagccagctgtctccagcagctgccctccccacgtgttcatcagagtccctgtccgcagagacagctgctggcttctgtctgagctccagcaaaccactttctgttttcaccaaagactggcgtttccaaccattagccccatgccacaaggctctgaaggtcaagaaatctgggtccgcctagcagagcccactctccgtcctgccagagcaggctgcccccagctctgctgccatcgtgcctctgtgcctcagccgccaccccttctctcgccgtgggcacccatgaccctggagcctggagaacttggcagtagacgctaggttctgaaagggagctggtccaaagcagcttccccatgtgttgctaagggcaggggacagtctcaggagaaatcgagtccgctgcagaaaatccaaccggatttgcagtttccagaaatgttcctcagcgtcgcctgtgacgggaacaaaatgaaccgcacatctcggttcatctcggtccaagtgactcagtgcttttcccgccctccctcatcttccccacgcagtggactacagctgacttctgatcctgaacccagaaagactcctgctcccaatttaggcgtggagagccttaattggaacctttcatgctccgttctggagccacgtggtctgtgtgctccaggcctgggacagctgccacctctgtacggctggagccttgggctttctggttttgtttgttttttcttgagacagggtctcactctgtcaaccaggttggagtgcagtggcacaatcttggctcactgcaaccttcacctcagccttcaggctcaagtgatcctcctacctcagcctcccaagtagctgggatcacagacgcacacctctacacccggctaatttttgtatttttggtagagacaggctgtttcgccatgttgcccaggctggcctcaaactcctgagctatggcgtccacccacctcggcctcccaaagtgctgtactggtgtgagccactgcactccgccgagccttgggctttcggatgggctgtttgcactcgggaacctcagaagggtgctccccaagacagaacatcaccactgcaaacggagcccaccttgccaggcatttccccaactgccctgatgggaggggaaggtgtgtctttcatggcacacaggatgcttcccgctgacatggacccagtgtcttaagctctgtttgcccgcaattcttttgtgtgggggaagacagggaccagacttaatttaatgtgattgtgtggcgccctggcagtgggatcagtgtggcttcctttatggagtgcagccctgccatagcaacctgcaggctgtcttctagagcctagaagagctttgttccgcagacatgacttcctttttttttttaatgggaaacggggagggcgtggggagaagggctctgatataaacagttaccaaggagacccgagtcggggttggaaaggttttctccttccctcggtccatacagagggaggaggggtgtgtgcccggtgcagggactcatgggaggcttcactctggaatcctgagtcctgcctgctggggctccagatgttgcagagttcttgggctcatgggggcagacgcaggcaggagctcagggaaattccgagaggactttggggtgtccaggagcactttgaggccacgggcccaggcaacttcctcaccagtacggaacaggggatgcacagggccgaactttccatctgctggcccctgctggtgtccaggagagagctgtgaccctcctttttccttaagtcctggagctgagagtgagaagccatggggtgcacgtactcgtctccacctgaggagcccgctctgagaaggtcagttcctgacactgtccctggcggcagactgccctcatgccccttggccaggggacgcctgcaccctcactcgagtgtgggagacttcctcctggcggggacctgctggaggcctgaagatgcggctgcctggagttaacagcaaggtcagccattcccagggttgctgcccctgtctctggcgagggactcagccaggcctaggcactggtggcccctctggtccaggacttgcacgctgcatttccctgcttccaaaggaaggaatttggactggagaccaggaaggcctcatgcaccctcttctctgcctataaataatcaggtcccccatgcaaatccaggtctgaggtcctccgatggaatggagcccattcagagcagtccagtgtgggccctctcgggctaagcccgtgaactttgcttcttggagcccccagcagggccttgggttgggaagggagtttcctggcaccctccccggcaggatgggtttaaccagcaggaacttgaaggaattgttctgtgttgcgccggtgacctagaggcacaggtccgcctccagctccttgggttcccttttcccccctggaccactcacacttcctgggtgaaccctagccttggggcagagcaggctggcacaccttgtccactctgacgttccagcccagaggctcccctgtccactcccagggccagccagcctggcattctgctttgtccaactgcgtcaggaggtcacatggaagccctcctcccccgccacttgccgggcttctgggatgggagccgagcttggaagttgccatcccttggcaccccgcttcccgtggggctgtctctccagggggccgttttctattcctgagaagacagcccagctcgtccaagaggcctttcccggtttcttcagccataagcgtctgctccctttgaagccctgtggcgtgaacctgtcctgtcccatccgtccctgtggcgtgaactgtgccatccatctatgtggtcttagcacatgccaccttgtgccatggatgtctttgaaatcacaggctgaccgccttccagggaatgcccttttttctactgggtgttaaccaagttccccagtcaggcactggggaggctgcaataaccagatgcagctctttaataatagtgtgggcacgagaggggcggggcctgtgcagtcccgtgcctgtctagtgtcagagccaggatttaaagccaggtccgccctgccacgtggctcttcccatcttgctgggatcctcctcggaggctgtcttcccctggctggaggattgggcctgtgaagtcacaggttgtctcgttctagtctcatgccctcggtgcctggcgcagtgcctcccgtgcccccacctggctggcctgtgttacccgccaggcactcacggggcactggagtttgctcttgtccttttcttcagcaaatcttcagatccactttgttggagatggaacttccctggaagcatctgtcctttgagtagagataggggttggcttttcagctgatgccaggtcagacctcagaggtggctagggagtgagaagtgccctcaacagcctcttagtccgcccctgccagcctcgtgctggacagagaactcagggctggccaccctaggaggagacacggcgtcctgtgccgtgtgctaggcgtcgcgctcatggcagggatacacagacagcccccaaggttattcaacccaggcttccagttaagccacaggaatgtgcagagtaaagtgccttggccgaccagtgtgtgtgccacagcgaagacggcgacagtagcgttgctgcgtgaggggcagggacggcctctgggagaggaaagttaagttctgtggtaaaggatgagtagaaggtgggaaggggtcacaggaagggccttgtaggcccagggagccgcgtggaaatgtgagtagcttagcgtagcccagagaggtgggaaatggggccgggccactgcgggaggggtgttcagaatcggccacttttctcttgtttaaaatatctgctctgctggggtccccttactcagggtgtagctattctaattatccttattgttggaggcttcaaaatcaatcagtcgggccccacatgtaccacttctgtttatttatatcggttggttggttgatttacagggtctccctctgtctcccgggctggaacccgggtgtttgaagctgcagtgagctatgatcgcaccgcacggtcatgtgatcgcacagtggtgagatcatcgcccactgcagcttcaaacacccaggttcaagggatcctcccacctcagcctcctgagtagctgggaccacaggcacagaccaccacaccgggctaattaaaaaaaatttttttttttagaggtagagtattgctgttttacccaggctggtctcaaactggcctcaagtgatcctcccaccttggtttcccaaagtgctggcattacaagtgtcggccactgagctaggttcttggatactctctttaagaaaatgcctcttcttggaagttgcagtgagccaagatcgtgccactgcactccagcctgggcgacaaagcgagactccatctcaaaaaaaaaaaagaaaaagaaaatgcctcttcaagtcttttgatagtttttctgatggaggatttgtctttttcctgttgatttgtagggctttcttacattctcgatcaaagtcttttgcccacatataagtacattacaaatatcctctcccacactgcagcttgcctttccttcctttaatggcgttttttattttattttattttattttattttattttattttttgagacagattctcactctgttgcccaggctggagtacagtggcgtgatctcggctcactgcaacctccgcctccctagttcaagtgattctcctgcctcagcctcccgagtaggtgagattacaggtgcgcgtcaccaggcccggctaatttttgtatttttagtagagacggggttttgccatgttggtcaggctgggctcaaactcctgactcaagtgatcctcccgcctcaacctcccaaagtgctggaattacgtgcatgagccactatgcccgaccaaaaatgtcattttaaatacaaaaatgtattttcatcttcaggtttgtcacttgattcagaatggccatatttcaaatctccaccacccagaggaaggtgtttcccaccttgctgtattcagccagcgtttttcacctccttcagcttgaaagtcctgggcaaggggcactgggcttgttcctctggccctgcaggcttggggcaagggtcagaaggaaacagaagaacggaaaatggggcggggtgaggggtggtgcgggggtagaaggccagaagtggacagtggacagaagattgtgtcaccccagcctgatcctgaggctggcgggcaccaggctgccctctggaggggatggaccaaggtgagggctgtagtcccaggaacgcagagaagggaaaaatgaaatgtggcccagtgcaggggaagcagagggggtctttgaatcccaggggagctgacccttgcgcaggaccttgagggcagagcgggggtcagccaggtgaggggactgtggcaggaaggctctgggtggaagcgatggcgtgcacaggattctgaggccaccatgcagggagggggtgtgaattaggcatcaagcttggtttgtggaggggagtggcaggtgacgctggagacagactctgaggggactcatgtgcccggatcccatgggtcgtgggagctgttgaagagcggagcagggaagtggcagatgtgagaggcaggggctggagaaggaagaggtgaagaggtggaaggtcaggctgaggtcaggccgtggggacctgggctgtgggtggggaggaagagggaagtggaaaccttggctcttccttgagggaaacaagcccatatctatctgggtgcaggagaggtcttggctttgcaaagcactggtgtcgcaagaggctttactgtaggggaaatgggaagggtgagctggtgcgggaggcctgggagccctggtgttggattagaggccagctgctggcttagcccctggggagtggcacgggacaaagctggaatgtcccctccctgtgctgccacagcatcccatgaaacctgcatctaaggacacccacgtcccgtgacacctgtgtcccatgacacctgcctcccacgctcattgcacacttttgtcttgcaggacctcctctgtcagagagagcagctttgtggaaaagatgaagaaaacggtgagtttcctgcatgtctttactcttctcaggaagcctcggccccgatgggcatgtaatcaagtctagcagacggctggcgtcaccgcatagaggatgtcccggtggccaggagagggaacgcagcccggctcgcttgggagtcattcttgcctaaccaaagccctgaagcagctctgctgttgctgggacagtttgtttccttgaatctttactttttgaacaaaccaaagtctaagaacagaccctccctctaactcacgaagcttctcccgtctggccctggcctgtccaggagcagaggtaaatctcacagagctgcggtcgtggcaccactgccattttctctccgctttgtttttgttacttttttttttttgagatggaatctcgctctgtcacccaggctggagtgcagtggcgcaatctcggttcactgcaagctccacctcccgggttcaagccattctcgtgcctcagcctcccgagtagctgggattacaggtgcgtgccaccacgcccagctaatttttgtatttttaatagagatgggatttcaccatgttggccagactggtcttgaactcctgacctcaggtgatccgcccgcctcagcctcccaaagtgctgggattacaggcgtgaaccaccgcacccagccaatttaactatttaattgtaggcatcagtactacatttacatagttaaaataaaaacatccactattcagtggaaagctcccctctgccacccactcatccccactgttcttattatttatggatccttctagagttcctgtatgaacatacaagtaaaacaaacagagactcttatttttaatttaaaaaaacctttattttattttagagacagggtctcactgtgttgcccaggctggagtgcagcggcgccatcatagctcactgcagcctcaaactcctagactcaagccatcctcctaccacagcctcccaagtagctgggactacaggtgcacaccaccacgcctggctaattttttaatttattcttcataggaacaggttctcgctatgttgcccaggctggtcttgaactcctggcctcaagcaatccttctgcctccgcctcccaaagtgctgggactgtaggtgcgagccattgcatccagcctacacttttcttaaaacacaaaacgtggcatactatgtgcactgttccagaccttgctttttttttttttttttttttttttgagacagagtctcgctctgtcgcccaggctggagtgcaatggcacggtcttggctcactgcaaccttcacctcctcggttcaagtgattctcccgcatcagcctccggagtagttggggttagacgcctgccaccgtgcctggctaatttttgtatttttagtagagacggggtttcaccatgttgaccaggctggtctcaaactgctgacctcgtgatccatctgcctcggtctcccaaagtgctgggattacaggcgtgagccactgcgcccggctgaccttgctttaaaaaaaaaagaacacaaaacaacttgatatgtctcaaagatccttccatatcaatacaaagatactgccatcatcttagctgtaccatgattccattatatggccatctggattcactgtaacgcacttaaccctgtcctattaaagatgggcactggggctgttgctactctttggctcttaccaacaatgtcactgtgaatatgtagctcggtttgcacatttcaaatacaaagcagtcccagaagtggaattgctggattggaaggtagatgtgtttgcaatcgtgatagaagctacaaatcgtccccgtaggagtcacaccgtggcacgcgctcaagaatagcgacgtgtgagaaaactgttccccacagccttgccaacagtttgttattaaagtttagatttttgtcagttttctaggcttaaaaaaaaaactcagtatagttgtaatttacatttttatgaatgagattcagtagattttcacccacctaggtctagatggcttcgtttctttttcttttttcttttcttttttttttttttttttttgagacagggtctcgctttgttgcccaggctggagtgcagtggtgtgatctcagctcactgcaatctccacctcccgggttcaagcaattctcatgcctcattctcctgagtagctgggattacaggtgcgtgctaccatgcctggctaacttttgtattttcagtagagacagggttttgccatgttggccaggctggtctcgaactcctgacctcaggtcatccactcaacttggcctcccaaagttctggaattacaggcctgaaccaccgcacccagcctcttttttctttttttaatagattctctcttcacatcttttgcctgcttttctgttgggattgatctttctccttgaaattattagggagatgaatctcttgtctgtgatataagttgaaaatatcttgcccgttaaagagtttgtcttttagtgagattccatctcttaaaaaaaagtttgtctttcaacctagctgatcgcatttttatttgttttgctgtgtaaaagttacagagtcacctatatgattctttcttttcgtgacttctggtcttagagtcataatttgaaggtcttccccatgctaaagagataaagatattcctgtattttttttttctagtacttttagggttttgtttttcatattcaaaatttaaaatctgatctattgggaatttatcctgatgtaagatgtgaggtatgaatccaactctacattttacatagctgtctaaacaccatgtattagagtccatctttcccccactggtttgaaatgccacctttatcatatacttaattcctgggctgggcgcagtggctcatgcctgtaatcccaacactttgggaggccgagatgggcaggtcgcttgagcccaggagtttgagaccagcctgggcaacatggcgaaaccccatctccacaaaaaatagaaaaattagtgggacacagtggtgcgcacctatagtccccgctacctgagaggctgaagtgggaggatagcttgagcttgggaggcacagattgcagtgaccactggactcaaacctgggcaacagctacaccctgtgtcaaataataataataatagctgggtctctgggttcttttcactgggcgcaacgtgttcaaggttcacccacactgtagcatatgttagtacttcctttttattgccaaataatgttttaatatatggattcttacttatttttccgtgacttttaggatcaatttgttgaggaaaaaaaagctgttcagatttttttttttttttttggtagagactgggtctcactctgttgcccaggctgttctcaaactcctgggcttaagcagtcctcctggtgtggcctcccagggtactgggattacaggtgtgagccactgcacccagctggttcagatttctattacatcatgccacatttctctagtgacataaatagagctgccatttttgtgggtcgagactccctgtccataatcggggtgcttttccattggcgtgagtcctttgtgtgtagttcagtagcttctgacacatctcttacaaagtttatttctaggtattttatatattttgatgctcctgtaaatatttagctgctatcttaggtcatcttttgttctcttaacctgataatcatgagcactttctcttctattaagtatttttacggtgattattttaaaatatccttttgggcgaaaaccctgtctctactaaaaatacaaaaattagccgggcgtggtggcatgcacctgtagtcccaggtactcgggaggctgatgcaggagaatcacttgaacccgggaggcggaggttgcattgagccaagatcgcaccactgcactccagcctggccaacagagcaagattccatctaaaaaaaaaaaaaatccttttggccgggtgcagtggctcatgtctgtaatcccagcactttgggaggctgagacgggcggatcacctgaggtcaggagctttgagaccagctggaccaacatggtgaaaccctgtctctactaaaaacacaaaaaattagccaggcatggtgacggacacctgtaatcccagctattcaggaggctgaggcaggaaaatcgcttgaacccaggaggcagaggtttcagtgagccgagatcgcaccactgcactccagcctaggcgacaagagcaaaactctgtctcaagaaaaaaaaaaacaatttttaatgatttaacaatgatttgtggaaaattcaggaactttaaaaagtataagaacatttattgtaatccctaagttttttttggtggtggttttgttttgagactcagtctcactcctgtcacccaggctggagtgcagtggctcaatcacagctcacttcagcctcaacctcccaggctcaagtgatcctcccacctcagcctcccaagtagctagaaccataggcatgcgccaccacacccagataaattttttgtatttttagtagagacagggttttgccatgttgcccaggctggtctcaaactcctgggctcaagtcatcctcttacctcggcctcccaaagtactaggattacagaagtgagccacggcacccggccgcgtaagttttattttgtatgaggtgggattcagtgtgaaaactagagactactttaggcattttaatctggaagggatttcacacagggaagggggtacttccaggttactggaggggctgaaggagcaggttggtctctaagatatcacagaagcaacctgcaaggtagctgctctgttcgaatgcagcctgaaactgttgagttcaggacacaccacgtgtagctgtgatccaggataagaagctacttctacagctgcctctgaacatcacataagccagtagccaggactaggaacttgcagtctggctaccaaaactattagaaatacctcaggtggctgggtgcggtggctcacgcccgtaatcccagcactttgggaggccaaggtgggcagatcacctgaggtcaggagttcgagaccagcctggccaacgtgttgaaacccagtctctactaaaaattcaaaaaaattagcctagcatagtggtgggtgcctgtaatcccagctactcaggaggctgaggcacgagaattgcttgaacccaggaggcagaggttgcagtgaactgagatcgtgccattacactccaatctgggcgtcagagcgagactccgtctcacacacaaaaataaaaaaaagaaaagaaaaaaagaaaaatgccttaggcactgaagaccaggcactgcagagaacctcacatgtgcatgaggggccaggaagccttggcctcccttccacccttcagatcttgcaaagcacgttcaattggctgaaccgaattggctgcaactccagccccaacgggctctggggaataggatttcaggcttttcaacagctgctggaggaggagggtggactgacgagtatgtgagccagcccctaggacctttccctgttgtaaaattttataatgaatatgtatttaaccagcaaaacacatccagaatgccccatttagggaccctcggtatatttcttgccagtctgttttctttgtgcctgtgggtatagaaagaaaatacatatgtatgttttgatatacatatctattatttatataacacaattggattgtatagccagccctgcatatccgtgagttcggagttcaagaattcaactgcagactgaaaatatttggagaaaaaatggattgttgtgtctgtcctgaacacatactgtcatcttactgttccctaaacaatacagcatagcaactatttacagagaatttacattacattaagtattacattaataagtaatctagagatgatttaaagtatgttggaggatgtgtgtaggctacacacaaataccacatcattttatagcagggacttgagcatccttggatttttgttttttgggtttttttgtgatggagttttgctcttgtagcccaggctggagtgcaatggcgcgatctcggctcaccacaacctctgcctcccaggtccaagcgattctcctgcctcagcctcccaagtagctgggattacaggcatgtgccaccatgcccggctaattttgtatttttagtagagacagggttttctccatattggtcaggctggtcttgaactctcgacctcaagtcatccacccgccttggcctcccaaagtgctgggattataggcgtgagccactggaggtggagtcttgctctgtcacccaggctggagtgcagtggcgtgttctcagttcactgcaacctccacctcctgggttcaagctgttttcctgcctcagcctccctagtaactgggattacaggtgcacgccaccatgcccggctaatttttgtagttttagtagagatggagtttcaccatgttggtcaggctggtcttgaactcctgacctcaggtaatctgccagcctcagcctcccaaagtgctgggatcacaggtgtgagccaccacgcccggctgcatccttggatgtaagtatctatgggaggtcctggaaccattcccccacggataggggctatacatttggttactttttttaactttgttttttccccgtgtcatgaaaatgtcagaagtgtgatcttgagcagccgcgtgtgtgagattgccttggtgacctttgccctcctttgccacagtggctgtgacagtgagaagcaagtcccagaggaacttagaagggactcaaagccaggaaggaaagggggcggcctggagggcccccgcctgccaggcctgcccagtgggtgttcaccggagccgtggctgaggtctgtggccctcaccaaccctgtgtctgccttccttaggggaggaacatcatcgtgttctacggctcccagacggggactgcagaggagtttgccaaccgcctgtccaaggacgcccaccgctacgggatgcgaggcatgtcagcggaccctgaggagtatgacctggtaagctgccaccgcgtgctggccccagatggaggcagtgggtaggacagggagcaggtctgtagggcgcccctcagcagggggaggccggcagggagtggggtcctgggaagacgtcctcggaagttgccttcccgtgagggtcattgccatccctgcccgggctgactgacggaagggccattcctgcagttgcagccacgtgccaggcatcgtttccccaggactggccctcccctgagtgccggctgccctcctggcggccgccacatctcccaaaccaaacccaccctccccagctgctccactcccctctccttcgaggtcttggtgacgggcactaccccacagccctctccaggctgcatttgcagttgatgaacagtttagttagatatcagtgtgcaccggggctgtgcggtgcctgggagctttggaatgaggttcccagggtggccccagacctgcatcagctcaggaggctgcattctgatggctcttttgtgccaagcttcactttcctctagaaacacatcctctccgctccagcctaacacgggtgaccttgtcctgcccacctggcacaaatgcccatgccccagcccctccgtgttgttacttctctctgatcccacgacactcagacatccctggcctggtgccaccctgggcaggacctggccttccccatctggtgcgggttgaaccttgaacaggctcagtcatggccggggcgcggtcctgtccctgtttctgcaggccgacctgagcagcctgccagagatcgacaacgccctggtggttttctgcatggccacctacggtgagggagaccccaccgacaatgcccaggacttctacgactggctgcaggagacagacgtggatctctctggggtcaagttcgcggtgagtcacccagagactgctatgggctcccggtggcctgcggtgcctccctggggactccagatccatgtatctgaaaggcagccctccagacccccaccctgtcctcagcagccagggcaggccacttgtgagaccctctcctctgccccagaccccagcactacgagaatgtcccctccctgtccccagccccagtcggctccagggggcattgggtgctggagactaaaggcaagaaaggtctggctggacgactgagacctgcctggcctcggagagctggagccccagcccggtggggagggtgggctggccccgcttccctgtgggttgaggctggcagtggacggggcaggctgtgggctgcaggtcaaccagatgaagcctcttcagtggcccagtgttccttgcagtgcgaggcgcctggtggaacggaggcctgcaggtgttgccagcagctcagccagtgctgtggggcctcccgccctgcccccatggcccctcccactggtcaggtcgagggccaggcctcagagcggcccctgtgtccacgcaggtgtttggtcttgggaacaagacctacgagcacttcaatgccatgggcaagtacgtggacaagcggctggagcagctcggcgcccagcgcatctttgagctggggttgggcgacgacgatgggaagtgagtgcccaccctgccaccatgatcagcgcggcgggcttaggcaggggccgtggaacgtgaggggcgcgcacaccattgtgtcagctgagactcagcgacacgcacctccaacacagagggaaggggctctcctgcctctgccctgcccctgccagttttgcttttcggcttgcccaactccctggagccttcctgatgctctgggtttatgtcgctgggtgccccagggtgcacagtcctgagctttggggatggggtggggtcggggcgtgcctggcaccaggtaccgttgccacatgggcctcccctgagccgctccccctctcctctcctcggcccagcttggaggaggacttcatcacctggcgagagcagttctggccggccgtgtgtgaacactttggggtggaagccactggcgaggagtccaggtgagcaagtgcccgcaggtgcggtgggtggcctgggcgggtcctgtgccgagggcagccaccctggaacaagggctggcagtgggtcgcagcaaggttagaagacactccgtcatagggtcgaggagggaccttggtcccagccaaggactcactctgccacgttgctctgcactgccctggggcagcggggtgcatcccacctctcgacaaggacacatcgcgtcgggctctgtggctaggttcaactttggcaaaagggctcatttccttaaaatctgcctccacagacttggccaaaaacataacgttcctctctgtgcccttgatggcccctgggtgctgcccgggcttccttaccttctcccagatggaagcctgcccagccctgccccggcttctgggcgtctggcccccggcagctccacgccgcctccctccttgctccctcgcctgccctccttgtgcatctgcagcaggggctcccctgcttcttgtcgtatgtacctgggacctcaccccaaaggccatgcacggtctcccctgtagtccaacccctccctctcgggactgacccctgccgcttcccggcctcacccttggtctcccctttccagcattcgccagtacgagcttgtggtccacaccgacatagatgcggccaaggtgtacatgggggagatgggccggctgaagagctacgagaaccagaagccgtgagtggagggagcgtggcttggggcagacggctctatggccactggtgcaccccaggctcagtctgccgtgtatccccatatccccacagggcccttctcaccagaccccgtgccccgagtgggtgtgagtgtccacgacctgtccacggcccggccccaggagactggcactcgcccagtttgtactgagctcacttagccaccttactctgcactgcccagggcagcggggcacatcccacttctcgactaggacagtgcattggcctctgtggctaggatcctctttggcagaagggctcattttcttagaatctatctccatagatagacttgggggagaaacctggcgttcctctctgtgcccttgatggcccctggttgctgcccagattcctgcccgagccacccagggaagtcctcgtgccactgcatccaagaccagctgccctgctttctgtaggcctgccccagcctggctggagcgagaagccctgcatgtcggtggctttccggagtgcaagtttctctcttgtccacggtgtagtccaggacgtgtgggggtgggggagctgtgctcctcatttggggaccagccaccttccagcctgtggcaccgtcagcttgggcctcacagttcttttaggggccagcctcagtttccacatctgtaaacagacactgatgacccagctctgcccatgtggtgggactatagagagaactgcattagggctgggcgaggtggctcacagctctaatcccagcactctgggaggccgaggtgggtgaatcacctgaggtcaggagttcaagaccagcctggccaacatggtgaaaccccgtctctagtaaaaatataaaagttaaccaggcatggtggcgaatgcctgtaattccagctgctcaggaggctgaggcaggagaattgcttgaacctgggaggcagaggttgcagtgagccgagatcgcgccgctgcactccagcctgggtggcagagcgaaactctgtctcaaaaaaaaaaaagagaactgcattggaccaggctgggagagcccttgatgtaaccggtgagatttcctcatggagatctctgagattccctgtgctttgtgcaaccagaagcgtccttggagacggagactcagatcaaagccccggccgctcactgtgcttctctcctccccacccagcccctttgatgccaagaatccgttcctggctgcagtcaccaccaaccggaagctgaaccagggaaccgagcgccacctcatgcacctggaattggacatctcggactccaaaatcaggtaccagctgccactgtcaccccctgaaccctcactctgggcctcctgacctggggcagggccagccttccgcccctcccgagcctcacatctccctccaggtatgaatctggggaccacgtggctgtgtacccagccaacgactctgctctcgtcaaccagctgggcaaaatcctgggtgccgacctggacgtcgtcatgtccctgaacaacctggatggtgagtgccacagtcagggcgccctgccgggctcaggcagccgcgggattgggcctgtaggaaggccctgggttgagcttctgcttaggcctgaagccccggtgcctgggaggcccttgcaccgagactccacggttacaggatcccaagcaaacgggaggcggggtggccctaggggtctagccctctctgtcggggttccccctaccccgtcactgtcatagtcctttaagggagtgaggtgctgaggcctggtggcagaggcagccctggctcccccatggccactgtgtcctgctgggaaggagggcctggctccacgacccacctctgccggcctggggctgcccccacctcctcactgaagtcaggagtcagcagccctcccaggcccccaagggtgcacagtggtgccgagtggcagtagccattacgcggggctgcctgggcctggtggggctgcccagcctgagcctcccgctgtgaagccctcggaccccactggtcaccaacctgggccgagcccacctcgccccacccctgcttgccggtcctcagctgccatgccagggctgcccttactgtcggcttccacagcccgcctgtagggaagcctgggcggggctgtgtcagaccgtgtagtgtgcggtgaaagcacagcgggtgcgttagtgtgcaggggctcccccgcacctcccctagcagggtcctgcctctgatgaggacttcctgtctggttggaggccccagacttggccccagggccagggaggcatcagagagcataggccttgtttccagcaccagctggggcacctgttgccgcagagctggcccaaggtgtcaccccctcctgccgcagccacccatccccaggaggcggccgcctaccccaagtcctgcctgtctcttccctgcagaggagtccaacaagaagcacccattcccgtgccctacgtcctaccgcacggccctcacctactacctggacatcaccaacccgccgcgtaccaacgtgctgtacgagctggcgcagtacgcctcggagccctcggagcaggagctgctgcgcaagatggcctcctcctccggcgagggcaaggtgcgccccctcagcccccgcaacctccgccccgtcaccccgccgttttccgagctccgtgggccccaatcagccccatctcacccccgtgtctcttaggagctgtacctgagctgggtggtggaggcccggaggcacatcctggccatcctgcaggactgcccgtccctgcggccccccatcgaccacctgtgtgagctgctgccgcgcctgcaggcccgctactactccatcgcctcatcctccaaggtgagggccggcactgccctgccagccacacgctggaggcccagccctgctcacagcaggcagagtgcaaggcggcacaggagctccgagatctgagccctgagctccagttccagccccagcgcagctccaaatgcctccccaggctgtggactcagtcgggctggcttgtgagattctcagcatctgtccagccccggtccccagaaccagtccgggaagccgctggggagggggcctctgaggtttgggtgccaggtgggctggaagaggccctgggtgagtggggctggcctgcagaacgggacttggggccggggctgggcaagggcctcggtgtggcggtggagctcacacggccctccccacaggtccaccccaactctgtgcacatctgtgcggtggttgtggagtacgagaccaaggctggccgcatcaacaagggcgtggccaccaactggctgcgggccaaggagcctgccggggagaacggcggccgtgcgctggtgcccatgttcgtgcgcaagtcccagttccgcctgcccttcaaggccaccacgcctgtcatcatggtgggccccggcaccggggtggcacccttcataggcttcatccaggagcgggcctggctgcgacagcagggtgagtggggtcccatgggggagagggggtgacgactgggagccccgcgctcaccccggcccctgccacgcaggcaaggaggtgggggagacgctgctgtactacggctgccgccgctcggatgaggactacctgtaccgggaggagctggcgcagttccacagggacggtgcgctcacccagctcaacgtggccttctcccgggagcagtcccacaaggtgagacgggcgggcacccacgaaggtgggcatgaggctggcagggccacagccacagtgcccccctcacagcaccacccttggccccaggtctacgtccagcacctgctaaagcaagaccgagagcacctgtggaagttgatcgaaggcggtgcccacatctacgtctgtgggtgagtgagtggggtcactggaatagggggcagggaggacaaggccctgcctgccacagttggcccagcccccagcaccccctcttcctgcccagggatgcacggaacatggccagggatgtgcagaacaccttctacgacatcgtggctgagctcggggccatggagcacgcgcaggcggtggactacatcaagaaactgatgaccaagggccgctactccctggacgtgtggagctaggggcctgcctgccccacccaccccacagactccggcctgtaatcagctctcctggctccctcccgtagtctcctgggtgtgtttggcttggccttggcatgggcgcaggcccagtgacaaagactcctctgggcctggggtgcatcctcctcagcccccaggccaggtgaggtccaccggcccctggcagcacagcccagggcctgcatgggggcaccgggctccatgcctctggaggcctctggccctcggtggctgcacagaagggctctttctctctgctgagctgggcccagcccctccacgtgatttccagtgagtgtaaataattttaaataacctctggcccttggaataaagttctgttttctgt

SEQ ID NO: 37105 - DNA, 3860 bp, Homo sapiens
ctttccgctcggctgttttcctgcgcaggaggtgagggagactgggtcctggcctttgggcatcatccagcgccatcggcctggcgcttcagccaacgcgggagtggatgggccccttcttcttcgcagacagcgttcggccgctgcccgggctctaggcgcggccggacggcccagtctggagggttcggggcggaggcccgggggggtgcgcgcgcccggggtccggcctctcactcgctcccctctcgtccgcagccgcagggccgtaggcagccatggcgcccagccggaatggcatggtcttgaagccccacttccacaaggactggcagcggcgcgtggccacgtggttcaaccagccggcccgtaagatccgcaggtgagccctgcgctcggggctgcccctggggctcgtgcccgcggctgcgccttggcttgcgggtggccgatgccagggcggggggcgctgtctgcaaccgtcgcggagcgctggcctggcggccttaggcaagggtgaccgccgctgcgcttctctccaccagacgtaaggcccggcaagccaaggcgcgccgcatcgccccgcgccccgcgtcgggtcccatccggcccatcgtgcgctgccccacggttcggtaccacacgaaggtgcgcgccggccgcggcttcagcctggaggagctcagggtgagtactggcagcgctgcggtgtcaggaaggccccgaagtcccctctgttggcctcagtcgcgtgatgacattctccggaatcgctgtacggccttgatgaaagcacatttgaacccttttccatctgattgctgaggcttttcatccaggcctcggggctggagaaagcccgggcctgtctccatctctctctggttctggggcaggtggccggcattcacaagaaggtggcccggaccatcggcatttctgtggatccgaggaggcggaacaagtccacggagtccctgcaggccaacgtgcagcggctgaaggagtaccgctccaaactcatcctcttccccaggaagccctcggcccccaagaagggagacagttctgtgagtacacggctctctggccgtcctggtgcgcggggacagtgaggcttggctcctttatcagtgacaccggtccctgggtcttgctggggtgagaagaaccaaaacattgtgggtgatgagctaagcgggactgctaaggttcacctgtgcgtttccgcagagataaccttaatggacatggcaaggctgtgtgacttggaggcagctttttccattgacgttgctctccctaaaatgcttcgtattccaaaatatttctagaaagaccttgtaggataaggttgataaagagtccattgtatacgtttccgggtagttaaattagggaacagttttctctgccccgcccgtggttcacaggtagataactgtctcgtgcgtgttgcgtcaactcagtaagatatagtcacctaactaataaggactgttcttaacattggggccacaaagtgtgttgtagaaaaggctcagacactggtcctgaacacggaatccccaggggaaagtttggggccaggtgagggtggagtccttgcagcagtgcggccaaccccacttaactcttctcattcaccaacaggctgaagaactgaaactggccacccagctgaccggaccggtcatgcccgtccggaacgtaagtgaacacttactcaaatccaggcttcagacgagatcagtgggtgaacacgtgggtatctgagatgcgggtgatgggggtcaggcttaagaacgttaatagtggcagttgtgggtgtggaggtttgcggaaaggaacatttcttcttagtttttacttcttgcaaccatgaagccatacattgggaagtatttttgtttgttttgtgtttttttgttgttgttggaaagagagtttctctatgctgcttacattggttttgaattgctgggtttacaggcttgagccgccatgtccagctcagggagggtttttctttttttttttaaatcccagggaaggtgattgactcagggttgcttttcagcagtacttatggcagcgaacctgacccccaatccccgggaggtcctccaggttctcctgacgcttggttgttcccttgccctttggtgcatgtgggtttaacaacctgtctttctcttctaggtctataagaaggagaaagctcgagtcatcactgaggaagagaagaatttcaaagccttcgctagtctccgtatggcccgtgccaacgcccggctcttcggcatacgggcaaaaagagccaaggaagccgcagaacaggatgttgaaaagaaaaaataaagccctcctggggacttggaatcagtcggcagtcatgctgggtctccacgtggtgtgtttcgtgggaacaactgggcctgggatggggcttcactgctgtgacttcctcctgccaggggatttggggctttcttgaaagacagtccaagccctggataatgctttactttctgtgttgaagcactgttggttgtttggttagtgactgatgtaaaacggttttcttgtggggaggttacagaggctgacttcagagtggacttgtgttttttctttttaaagaggcaaggttgggctggtgctcacagctgtaatcccagcactttgaggttggctgggagttcaagaccagcctggccaacatgtcagaactactaaaaataaagaaatcagccatgcttggtgctgcacacttgtagttgcagctcctgggaggcagaggtgagggatcacttaacccaggaggcagaggctgcactgagccaggatcacgccactgcactctagcctgggcaacagtgagactgtctcaaaaaaaaaaaaagagacagggtcttcggcacccaggctggagtacagtgccacaatcatggctcactgcagtcttgaactcatggcctcaagcagtcctccctcagcctcccaagtagaggggtttataggcacgagaccctgcacccaacctagagttgccttttttaagcaaagcagtttctagttaatgtagcatcttggactttggggcgtcattcttaagcttgttgtgcccggtaaccatggtcctcttgctctgattaacccttccttcaatgggcttcttcacccagacaccaaggtatgagatggccctgccaagtgtcggcctctcctgttaaacaaaaacattctaaagccattgttcttgcttcatggacaagaggcagccagagagagtgccagggtgccctggtctgagctggcatccccatgtcttctgtgtccgagggcagcatggtttctcgtgcagtgctcagacacagcctgccctagtcctaccagctcacagcagcacctgctctccttggcagctatggccatgacaaccccagagaagcagcttcagggaccgagtcagattctgttttgtctacatgcctctgccgggtgccggtattgaggcacccagggagctgttactggcgtggaaataggtgatgctgctacctctgctgctgcactcacagccacacttgatacacgatgacaccttgcttgtttggaaacatctaaacatctagtagatgacttgcaggctgttggctaccagtttcctgtctgaggtgtatatgttaacttcgtgatcagtttgtatgtttgggactcttgtcctatgtaaagttaaggtgggccgggtgcagtggctcacgcctgtaatcctaacactgggaggccgaggcgggtggatcacctgatggtgaaacctcatctctactgaaaatacaaaaattagctgagtggtg

SEQ ID NO: 37106 - DNA, 38108 bp, Homo sapiens
cgcctgcccgcccgcccgctcgcccccggtccggactcctcctcctcctcttctcgccattgcagttggacccagcagcccggcgcgcaccgcgtggcttttgggggcagaccccggcgggctgtggcaggagggcggcggcggcggctgcggtcgaagaaggggacgccgacaaggtaagcgtcaatgtggcggcggccgggcccgctcccgcctctgcccctccccccgcccgccctcagtgagatccccactgagggttcgcggtgacaaggctggagggatcccacgctcgccgcctccgcccggttccctcatcccggcgcctggcccgttcctcccttgccggcctcgctcccgcgctcggccgttaactctcttccattgtgcggaggaaacaaaatggcggctgcggcggcggcgaggactcggtgcgcgcgcagccgctcccccccgcacgcggcccctcggccggcggcggcgccacgcgcgggggggtgcgcgcgcaccgggcccccggctgccgcctccccgcggctgggcttttgtctgttgcgggggtcctggggacgcgcgcacgtgcttggagcacacaccccctcgggtcccgagttccgcggcggggcgaccccccttcctcactccttccctaccccctcctcctctttgtcccggtcccgcccccgattccaggagagtcccaggttcccgaggcgggaaaagtcgcctcctttgtcctcacaggtcgcggagaggcggaccccctccttggaagccccttcccacgcggattgctgaggaagcctttgtgggttcgtcgggtttccaaatctctggtcagccaggcctctctcagatcagggtcaaaacttgagagggtttcagctttttctttagttagtttgttttcattgttgaatgtttttccagattgttagtatttgccttctctagaccggcaatctacttgggtgcaagcctgggccccgaaacgtggatgcttaaaacccatttctacctttattttctcaagtagttgaacgattgagattctcgaggttactcatgaggttctgccccagttaattcaccgcctggatgaattatttggggtgtacggcggtctgcatgctcctcccccagttcagtggccaaatttgaggagaatgagggatctcttctccacatttccaacattgtttgccagttgctgcttaggtgacatggatcagcaacgaagcgtcggtttcagtggtttctttttctggactccggtaattcactgctgctgaatctttttcaagattttgctctctttaaaatgagtggtgtgatggcatatttgtggtccacatggaatcgcgaggtgccatccgaagttaggattcaaatttaggactttaagctctcttttcctcaggtatttgtggatgggaatctccatggattgctcagagtgctgccactgtcccttgtgcgtgatgctttgtgtgtggtctcgtgggatgtagttacagtagccgcccagactgtgaatgaagtgtgggaaccagggcctcattcacagctggaaagcaggaggaggccgcaggacattggcaggtgctcctctccctgttccgtggtgctggggccccttgcttatgtgggtggctcttggtccctgggatttgtgaatggagtctgcaggccccagtgttgtctggaatattctttagttcagattggaggctagcaatgactgccaggcttggccttgccgccactgggcgctatttatcactctccctatcttcctggagcttagccgagtcttcctggagctgagaggtgcctaattgtttgtggtttttctgattgaacttgtttggtgcctctaggcaaaaattcctttggctccttctagtattttcagggtcttgaaggcccatattcctgagcatgaggaatctaagtctgttattttttcctaaattttcatgttaaataccacgttgacaaaggacagctgctaatattttgatcacacagatacagacggtgctccctggttaaggcctccaggtaggggacaggtagagtcagtgatggggaagaagccttctgtaagtccctttcctttgggtagacagtagattaccctttaggctttagcaagatgtgggggttagaagtcttctattcttggaaaagcctttagtcgttttctttgggctggggcctcttctcttagggactgctgtcaccctttctcggtttcttttgattacctttcatggccccagaggagtgatcccttcccttatttatacctcttggacttgtcatcctgctacattttgtcagcaagttaattcaccttgtgcagttttgaaagatgtgtaagtgttaacatttagtattagcatttatggcccaggaaattgtgaccttaatatttgaatcttgcttttattaaacctttacaggaactaggattttgtagggttttttttttttttttttttttgagttagagtttagctcttgttgcccaggctggagtgcaatggcgcgatctcggctcaccgcaacctccacctcccgagttcaagcgattctcctgcctcagcctcccgagtagctggaattacaggcatgctccactacacctagctaattttgcatttttactagagatggggcttctccatgttggtcaggctggtctcgaactccgaacctcaggtgatccaccggcctcggtctcccagagttgtgggattacaggcgtgagccaccatgcccagccttctaggttctgtttattggatgctttttatcttaacaaagtcctggcagagaaagatttgatttgtttccatcaggaagtttggaatctgaggcagatagtggtttgagtgtcatcttcacacaatgaatgagtagagatttggggcctgggaggcacgaggcaaactttagtttcctactgaagcatttgtccgttttatctgaaacaagtagattgccgatctgtattattatacatagtaagctgctgttgaaatggttgtgaaagtagagtaggcaggtaggtggtggttagggggcctcatcggtgctgatttttaagaaatttttatgatatttatgatctgttataaatccttgtgaaacttttccatgagaacacttcacgggtgattccattatgaatagcaattggtggccgggtgcggtggctcacgcctgtaatcccagcactttgggaggctgaggtgggcggatcacgacgtcaggagttcgagaccagcctgaccagcatggtgaaaccccgtatctactaaaaaaaaaaagtacaaaattagccaggtacggtggcacacacctgcagtcccagctattcgggaggctgaggcagcgaatcgcttgtacgtaggaggcggaggttgcagtgagctgaggtcgtgccgctgcactccagcctgtgtgatggagcaagacttcgtatgaaaaaaaaataataacaattggaaattcagatacatttagcatcagctgtatttaggcatcgtgtaaaagtgatgtccagttaaaatttaatttaatttttttttttgagacagggtctcactctgtcacccaggctggagtgcagtcgcgtgatctccgctcactgcagcctctgtctctgaggctcaagaagcaatcctcccacctcagcctcccaagtagctggaaccacaggcacatgtcaccacacccagctaattttttgaattttttgtagagacaggatctttccacgttgcccaggctggcctcagaactcttgggctcaagcaatctgcccaccttggcctcccaaaaagctggaattactggagtgagccctcactcctggccagaatttaccttttttctcttctcattaaatgtttacgtagtgaagacattgaaaatgtagctactagttttttttaaatttttaatctaattttatttttttgtagagatagggtcttaaactatgttgcccaggctggtctcaaattcctaggctcaagtgatcctcctgcagcctctcaaagtgctgggattacagatatgagccgccttgcccagtggcactaattttaagacaaaaatatgtttactgtctgagggccattctcttgtggaatgcgtgatcaccatgtatcatttagtcataaagttgaatgtattacagtatgcaaatttgctccaaattatttttataattttaagtgatagtaagaagttctggccaggcgcggtggctcaggcctgtaatcccagaactttgggaggccgaggcgggcggatcacaaggtcaggagatcgagaccatcctggctaacccggtgaaaccccgtctctcttaaaaaatacaaaaaaattagccgggcgtggtggcgggtgcctgcaatcccagctgctgaggaggctgaggcaggagaatggcgtgaacccgggaagcggagcttacagtgagcagagattgtgccactgtactccagcctgggcgacagcaagattctgtctcaaaaaaaaaaaaaaaagttctactttgcagtgtgaagtacataattttcactgaacatgcccaacagctgtccttatcttttcgaggattttgcttgaagctgaaggttaaggtcttacttagataaagataaaaggtcttggagatgagtaagtcttccaggccactttcttttctgctgcttgcctataaaactagtttctcatatcagagtgttgtttttttttttttttgagatggagtctcacagtgtcacctaggctggagtgcagtggcacggtctcggcttactgcaacctccgcctcctgggttcaagtgtttctcttgcctcatttctcttgcctcagcctcccaagtagctggaattacaggcacctgccgtcacgcccagctaattttttgtatttttagtagagatgaggtttcaccattttgctcgggctagtctcgaatacctgacctcaagtgatctgctgcctcagtctcccaaagtgcaggaattacaggtgtgagtcacaacgccggttctaattttttttttttttttttttttttttgagatgagtctcgctcagtcgcccaggctagagtgcagtggcgcggcttactgcaagctccgcctcccgggttcatgccattctcctgcctctgcctcccaagtagctgggactacaggcacccgccactacgcccggctaatttttttgtatttttagtagagacggggtttcaccatattagccaggatggtctcaatctcttgacctcgtgatccgcctgtctcggcctcccagagtgctgggattacaggcgtgagccgccgtgcccggccaatttttgtatttttatatagagactgagttttcgccgtgttggctagggctatcttgaactggcgtcactcaagtgatttgcctgcctcggcctctcaaagtgttgggattacaggcataagccaccatacctgacctgcagttatttcaaagtaaaaaggttttactaaacagttaacatgtttggatgttagtatttaatgtccatgtgagagatggtctttttaaaaaaaaatcttaactggaaaaatacagttctgggagaagtaaacattgaactgtatactaagtttaaaaaaaataatccaaggcttcgctctgggaatacatggggaaggattgcttctgcctccacccagatatgggaggatctctcaaccatgcttcccttgcccccctgctgcctgagagcatgctggaaagagggtttgataattcccacttgaagtcatgttgaatgtttttctatggtggcagattttaaagcatttctgttggttcatccaagagcagttaatgtttttcttttttttttcctaaggactggctctcactatgttgtccaggccggtcttgaacttctgggctcaacgaatcttcctgcctcggtctcccgagtagctggtactacaggcattcacaactgtacccaatttaatcctcttcatacattgcatttgtagtattgtagttcacaaaacatttccccatagtgccacctttaatccttgctgtctgcagcctgaggcaggtggtattttcatcctcatttttcacccaccaccagaaaggtaagtgatttgctgtaggtcccaaagctgccaggttggagagcccaggggcaaattccaggcttctgactctaggactgtgggcactccacaacactagtgagcctggagtcccgggtctccagaaacatttgaggaacaacttgtatttgccaacttttttttatgagatggagtctcactctgtcgcctaggctagagtgcagtggtgtgctgtcggctcactgcagcctccgcctcctgggttcaagcgattctcccgcctcagcttcctgagtagctgggattacaggcgcccgcccccacacccggctaatttttgcatttttagtggagatagggttttgccatgttggccaggctgatcttgaactcctgacctcgtgatctgcctgccctggcctcccaaagtgctgggattacaggtgtgagccaccatgcccggctgtatttgccaactttttattttgtcaaggaaaatatctttaaattagtgatcattcaccatttccgtttttcataattagcaagattgtctttatcaccaaaactataggaataaaataaaggacagtcctttaagttgaaaatatttactaaaatctttatttctggctgggcgcggtggttcacgcctataatcccagcactttgggaggccgaggctggcggatcacttgaggtcaggagttggagaccatcctggccaacatggtgaaatcccgtctgtactaaaaatacaaaaattagccaggaatggtggtctgtggctgtaatcccagttactcagtagagtgaggcagaagaattgcttgaacccacgaggcggaagttgcagttgagctgagatcacgccactgcactccagcctgggtgacagagcaagactctgtctcaaagagaaaaaaaaaaaaagctctttgatataataatactgttgcagtctgaactatgaaccattgcactggacttcacatttttaaatatttcagaatggcattgatagcaagattttagactggcattgcctcgctcggttgcttgctttttttttttttttgagacggagttttgctcttgttgcccaggctggagtgcaatggcgcgatctcggctcactgcaacctccatctcgcgggttcaagcgattctcctgcctcagcctcccgaggagctgggattacaggcatgcaccaccacaccgggctaattttgtatttttagtagagatggagtttctccaagttggtcaggccggtctggaactcccaacctcaggtgatccacccgcctcagcctcccaaagtggtgggattacaggtgggagccactgtgcccggccggttgctttctaagaataattttcaatgtgcccttgatggcgtgactctgtcaaagttcaaggagtcaccaagactcctagctcaagtgtatcatttcagctcacagcccaggatgggccagctccagaggtcaggaaaccaggaggtgggttgagtctctgaatttcagagcctaatttggtctctctcaagtgaatatccacttcaggaccattccctagagttgctgggaaggctgtaagacttatgaaataccccgaagacaggtggggccatacctgtgagggtgttgccactgtacctgtccattccacaaacatctgttcatccactcatgctgaactaacttgggcatgtttcttttccaacaagtgccatgaacctcatagtgtaattagtgagaggtcagaaagatggccattgcaccacaaacataatgttttgtggttgaagcttctgtaactgcatgttgtgggtgggctggattcaggaacaaaagaaaaatgaatccctgtgtgttaaaccatcccaaaccaccaagaagtcatgtttaaaatcccaatacttcatttaccacttgatcctgccttgggtttgttttcagagaagctgcatgttgctggtgcccaggattgaatcataaaaattgtaagaataggctttgctggtgccaggtttgaataaatgtggttgcaagaacagcattgttcatcgtttcgcagctttcgtttaaagttagattagtaggggcagcggagtgttgcgtgtgggtgggtgctgtaggcttattgccagcagtgtgcctcactaaatatcctcttgaaagggaagtttctgctcaccctgaagactgctggatcagttagtgagacaaattccaagaagctggcttggatgtcaaattggtcttgggctcatagagaggaatggatttgttgccctgaaaaggagcgataactctagtttttaaacatttgttttagttcagataattactgcccttattcattgtgtccacctgagtcagaaagcattgctgctgttgcctggtctaagggaggaggacccaggcatgtaacggactgcatgctggccagttgtggtggtcagagcaagctggaggccagcgaggcccttcaggggtcttttcaagggtctgccttggggagcagaggaagatgaagtgaggcagtcgttatagcaagggcacacccacgtttctcattttgaacagtgaagaaagcagatggaaagccacatgtagggcatttgctgaagacaggtgtgttgggggcgtgtgtgtgtcctctgaggcattttgggtggggcgatattttgaccgaatgataccttgttcttcagtgcttcaatggttgatggggtggctttttttcgagatggagtctctctctgtcatccagactgcagtgcagtggcgcgatctcggcttactgcaggctccgcctcttgggttcacgccattctcctgcctcagcctccctgagtagctgggactacaggcacctgccaccacgcctggctaatttttttgcattttttttgagatggagtctcgctctgtcgcccgggctggagtgcagtggcgcgatctcggctcactgtaacctccgcctcccgggttcaagcaattctcctgcctcagcctcctgagtagctgggattacagacgcctgccaccacgcccagctaatttttgtatttttggtagaggtggggtttcaccatgtgggtaggctggtctcgaacccctgacctcgtgatccacccgcctcagcctcccaaagtgctgggatcacaggcgtgagccactgctcccgtccaatttttttgtatttttagtagagaggggtttcaacgtgttagccaggatgctatcgatctcctgacctcatgatccaccagcctcagcctcccaaagtgctgggattacaggtgtgtgccactgtgcctgatagtggggtgattttctacttctaactctctaatgtgtcacatggctttttttaatagattgtctgtatcaactgggggtgaactttagtcttttaacaattttcagactatgaagtttggatgtaaacacctctaatgtgggaagttagttttttttaaagtatctgtatggagttatggatatatataaatttaatgtgttgaatctgttttattttagtaacatcttttgaaaatgttcaaacatagaaaaaagggtgatacaattttagtgaacacttaggccgggggcagtggctcactgcctgtaatcccagcactttgggaggccgaggtgggcagatcatttgaggtcaggagtttgagaccagcctggccaacatgttgaaacccccgtctctactaaaaatacaaaagttagcctggcatggtggtaggtgcctgtaatcccagctatccgggaagctgaggcaggagaatcacttgaacctgggaggcggaggttgcagtgagccgagatcgcgccactccgctccagcctgggcaacacagtgagagtccgtttcaaaaataataataataaaaaatttaagctgggcgcagtggctcaacgcctttgtaattccagcactttgggaggccgaggcaggcagatcacttgaggtcaggagttcgagaccagcctgacaaatgtgatgaaaccccgtctctactaaaaatacaaaaaaaaattagccaggtgtggtggtgcatgtctgtaatcccagctacttgggaggctgaggcaggacagtctcttgaacctgggaggcagaggttgcagtgaaccgagatcgtgctgttgcactccagcctgggcaacaagagttaaactgcacttcaaaatataataataataaaataaaaaatttaatgaacacctacctgtatgcacagcctaggttttgctgtgggcatttaactgcttgtgtttcacatatttgtccatccacttataattcttttcacttttcactttattgattgatcagagacagggttacacttttgttgcccaggctggagtgcagtggtacagtcatagctcagtgccatctcaaactcctgtgcttaagcagtcctcgcgtctcagcctcccaaagtgttggggttataggcgtgaaccactatgcctggccaaatatatgtatatatatttttgtatatatttttttaaattttatttttgttttttattttatttttatattttgagacagagtcttgctctgtcgcccaggctggagtgcaatggcgcgatctcagctcactgcagcctcagcctccctggttccaacgattcttctgccttagcctcctgggtagctgggattacaggtgcactccactacgcccagctaatttttgtatttttagtagagacagggtttcaccatgttggtcaggctggtctcgaactcctgacctcaggtgatccacccacctttggcctcccaaagtgttggtattacaggtgtgagccactgcgcctggccactttattttgatgatgcatttcaaactaagtagcaggaagttgcaagtcttccctctacatattattaactagaatttaatatttatttacagttcttttttggggtggcgggggtcagggtctcacacactttttttgcccaggctggagtgcagtagcacagtcttggcttactgcagcctccatctcctgggctcaagtgatcctcctccctcagcctcctgagtagctgaaattaacggcaggtgccaccatacctggctaattttttttttctttttttttaagaaggagtttcgctcttgttgcccaggctggagtgcaatggtgtgatctcggctcactgcaacctccgcctcctgggttcaagcgattctcctgcctcagcctcccgagtagctgggactacaggcacgtgccaccaatgcccagctaattttgtatttttaatagagacggggttttgccgtgttggttaggctggtctcaaactcccgacctcaggtgatccacctgcctcagcctcccaaagtgctgggattccaggcatgagccaccgcgccctgcctacctggctaatttaaaaaaaaatttttttggagaccaggtctgattatgttgcccaagttggcctcgaactactgtgctcaagtgccttggcctcccaaagtgctgtgataacaggcgtgagccactgctcctgcctcactttatttttatgatgcatttccaactaaataacagaaagttctaatcttccctctacatactaacaagaatttagtatttatttgcagctaggtttttatttttttctttaaaaattttttttgtagattcactcaggctggtcttgaactcctgacaagtgctgctcccaacgtggtgagccaccatgcccagcctcttttttctttttaaataatgcacagatctttagtataccagtcagtgaattctggccactgcatatacccaactcttgtcaggagggagaatgtaaccttcatctcagaaagcttgggagggccccttcccatgtgatccctaccaccgttccccagaggctgtcccatcactgattagtttcgcttattctagaactttatgtaggtggaagcatgattctttttgaatttgttccaaatgtagccagtgggacacctcacaagtcagctccgatgtcctcaggacaagactgctatagtcaccagtgctttgttgctttctggcgctccggtaggatccaggctcacttggtatatcccctgctgcagattacggtccacttctcccgggagctgctttcagtaggtttttgttgttgttatatttttgtttatttatttatttcgagacattctcttgctgtgtcaggtaggctggagttcagtggtgcaatctcggctcatggcagtctcctccccagttcaaggaggtcaaggagttcaagaccagcctggtgaacatagtgaaaccctgtccctactaaaaatacaaaaattcgccgggtgtggcgacacacacctgtagtcccagctactagggaggctgagacaggagaattgcctgaaactggcaggcagagattacagtgagccgagatcacaccactgcattccagcctgggcgacagagcaagactctctcaaaaaaacaaaaagtgttggctttgcatcgtggctcacacctgtaatcccagcactttgggagactgaactgggaggatcacttgagcccaggagtttgagaccagcccacgcaacatggcagcaacccatctctacaaataattaagaacaaaaaatctattatggaatttttaaaacatgcacaaaagaattacagtatccatcacccagcttcaacagctgtcagtgttctacagtcttgtttcatccttctctactttcctttttttttttttttggagacggagtcttgctctgtcgcccaggctggagtgcagtggcacgatctcggctcactcactgcaagctctgcctcccgggatcatgccattctcctgcctcagcctccctatagctgggactacaggcacccaccaccatgcctggctaattttttgtatttttagtagagacgaggtttcaccgtgttagccaggatggtctcgatctcctgacttcgtgatccgcccgccttggcctcccaaagtgctgggattacaggcgtgagccaccacgcccggcctcatccttctctactttctgctccctggtatatttcagagcaaataccaggtatataattttagccataaatttgtcttaaatatgtgtggaacagttaaagttggttctttccagcacaaccacagtattattcccctaactgaagtaactataattccttcataaggattcacttcatgaacaagattcccagtgtcgttgcgactatccagggaaaccatagccaagggaacaggcttggcagaatcagtggcgaaagaaggccctgtggagcttgactctggctcggtgaagagacatgggtgatggaggagaggatgccctttgcacacacatcactcacgcctggccctcattgcagcctgggaaggcagatttttttcaacagtaggatctagtaccaattgttaggtctatgggatatgtgctgcatgcttcaagtaggttgacttgtttcattttcctagtcctgccgagagtagaggggcctcttccgtgttgctaatgcaagaaggaagctagtggctgggcaagtggggtttcaggtccaagtctgtgcagaagctttccttgggcgatcgatcgagtggcttgccccatggtgtgagtctcaggcatgttgagccactgagcccagggactggctttctgcccttttcatcccatgccccctcacactccttccctcctgcatccctaccctgacatgaagcctttgacctcaccatgtcctgttgctgggctttgcaggggcatcatttgactcctaggggttttttgttttgttttgttttaaatgagacagagttttgctcttgtcacccaggctggagtgcaatggtgtgatctcgactcaccgtaacctccgcctcccaggttcaagcaattctcaggcctcagcctcctgaatagctaggattacaagcatgtgctaccacacccgactcattttttgtatatttaatagagacagggtttcaccatgttggccaggctgatcttgaactcgcgacctcaggtgatgcctctgcctcggcctccctaaagtgttgggattacaggcgtgagccaccgcgcctggtgacccctaggttttatttatttatttattgagacggagtctcgctctgtcacccagggtggagtgcagtggcgcgatctcagctcactgcaacctctgcctcccgggttcaagtgattcttctgcctcagcctcctgagtagctgagacaacaggcatgtgccaccacacccggctaattttttgtatttttagtaaagatggggtttcacagtgttagccaggatggtctcgatttcttgacctcgtgatctgcctgccttggcctcccaaagtgctgggattacaggcatgagccaccgcacctggccggttttatttatttattcatttattttttttgaggtggagactctatttgccacgcaggagtgcagtggcgcaatctcagctcactgcaacctctgcctcccggtttcacgctgttctgcctcagcctccctagtagctgggatgacaggtgcacgccaccacatctgtctaatttttgtatttttaggagagatgtggtttctccatgttagcccagctagtctctaactcctgacctcaagtgatccacccaccttggcctcccaaagtgctgggattacaggcgtgagccacctcgctcaagcacccttaggttttaaagtttaaccttggggtgtttaaattttgcagttagatttgctaggtagtcctgggtattttgggaagttcttgttttggcagcatgtcagactttatccttgatgcttgggcctttcaggtttgagcctgctctgctggctcggaactagtttagtcggaaggggctggcagttgcctgtagggggtagattcatctggtgtgtattatgctgatggggttttttggttgtttactcatttggaagatttcagtatggaccagactgtttgtgtagagtgggaattgagtaggttggagtcggcatgattctgagaccgaaatagtaattatggcttcgtttgtcctgaaggattctgtcgtgcacttcagttgtctcagcctcttcagagttgaacgtgatgtggttgtcatcgtccacctgatatttcaaatgttcacttttcgggaggttctttctttttcattttacagaagccttttgggaccctttgtcatatgtctttcttccttccacctcttcattaccatcagaggtcagagctccttccctctcttttccttccccaagcaccaagattttgatgtgaacatctttttttttttgttttttttttttgagatgaagtcttgctctgtcacccatgctggagtgcagtggtgtgatctctgctcactgcagcctccgcctcctgggctcaagcgatacttgtgcctcagcctcccgagtagccgggactacaggtgcccaccacgcccggctaatttttgtatttttagtagagatggggttttacagcgttggccaggctggtcttgaactcctgacctcaagtgatccacccatctcagcctcccgaagtggcaggattacaggcgtgagccactgtgcctagcatgatgtgaacatttctacctgtagtgttttttggagagctgttaatattttcatacttgtaaaaatgggcatatttatgtaaaggaagataaaagaagtaaaataccatctgagtggcttgtgggcctgaagtcagttctggcttctagaaaccatctgttttcatttttagggtgttacgtagttaatgccttggcttagcagtggttacttggaaataaagatgtgtcctgctgtgttgacaggcccttcatgaggcagcacacatgtcattcttgctactgtgtacctagctgctgaaatgaatcctataaattatatgaaactaaaaagattttctgatcttatagagttgaagtattgataacaccaaggaactctatcacaatttgaaaagataagcaaaagtttgatttccagacactacagaagaagtaaaaatggtaagtttgtttttgatcacagatactgtttcttcactcatgtacagagatgtttgtagccttttccaaagcatttgcttccattaccatttttattagcccttttggattataaagcaatattatctattctgtattccattctgatagtgtaggaacgaagtcagtgccccattactcccactgcccagagacaacagcttttcagtttgcttgtccctccttggttcttcagttgtgctcctgcaggctttgcttttacacacgagcgatatagcatcattctgaattgtgcagcttaaaagatgaacgttgggctgcttgctctctttacatcatttttaacttaattctcacatccctagcgtccaatgcgaatttttgtgaatgatgaccgccatgtgatggcaaagcattcttccgtttatccaacacaagaggagctggaggcagtccagaacatggtgtcccacacggagcgggcgctcaaagctgtgtccgactggatagacgagcaggaaaagggtagcagcgagcaggcagagtccgataacatggatgtgcccccagaggacgacagtaaagaaggggctgggtaagtgaggttttccgttgtccttttcttttttgtagggtagccagggtagaggttggcacctgttttctaagaaactccagcctctctggggacctctgggttgtggtcagactgaattcctcactgagctgggtgttggtctgtccctcagggaacagaagacggagcacatgaccagaaccctgcggggagtgatgcgggtgggcctggtggcaaagggcctcctactcaagggggacttggatctggagctggtgctgctgtgtaaggagaagcccacaaccgccctcctggacaaggtggccgacaacctggccatccagcttgctgtaagtgtggccaccactgccgggtaggtgggtgggggggtggtaggcatgctgattgaggatgtggggcccaggaagaagtgtcctgctaggctgtgctccaagaagcacatgccacacttgccctggcacttgctgtgcgtgtgccttctcagtaggtgacaaccaggacaccaccaagccacagagattctgtggaacctgactgcaggggtcataaggaccccgtgcctattgtgtgccaggctgcaccagcccgaggtcattgggcataaacttcacgtctaggctccattggatggatggctagatagatagcagagttgttatctcttccattggatccaaagctgaatgtaaagaattttttttttcttttgggacggagtctcgctctgttgcccaggcctagagtgcagtggctcgatctcagctcactgcaacctctgcctctgaggtagacaattttcctacctcagactcccaagtagctaggattacaggcatgcaccactacacccagctaatttttatatttttagtatagacagggtttcactatgttggtcaggctgtcctcttaactcctgacctcaggtgattcatccacctcagcctcccaaagtgctgggatcacaggcatgagccacctcgcccagctgaaaatcttttctatatgtttattttttattttataaatagagatgggttcttgctatattgccctggctggattcaaactcttgccctcaagcagtcctcctgtccccagcctcccacagtgctgggattagaagtgtgagccaccacaaacaatttttttttttttttttttttttgagatggagtcttactctgttgcccaggctggagtgcagtggtgcagtctcggctcactgcaacctctgcctcctgagttcaagcgattctcctgccttagcctcccgagtagctggtattacaggcacatgccactacgtccagctaatttttgtatttttagtagagatggggtttcgccacgttggccagagtggtcttgaactcatgacctcaaatgacccgcccacctcggcctcccaaagtgctgggattacaagcatgagccaccacgcctggccgtttttatttttttaagatgaggaaggtttcgctctgtagcccaggctggagtgtggttgcgcaattatggttcactgcaacctccacttccagggctcaggtgatcctcccattgcagccccctgagtagctaggactacagtcatgtactaccaccccgagctaaaagatcttttaaaaaaaaaaaaaacatttatttgtttcattgtgaaagtattgcgtaaataatggcttctgtttattgagtgtttgctaaagtcaggccctcagccagatgtgctcttcatgtgtgttatttcatcctcctctaagtgggacagatgatgtgacagagctgcagggcagctgaggagtggatcccaagacccacggctgggctgtttggaggcatcagaacctctgccagctgttgcctcctcaggacacagtccccctgaatttatttataggataagcaaaaaagaagtgtacaatcatctataaatctttgacagagtcttgctctgtcatccaggctggagtgcagtggcctgatctggggtcactgcaacctctgcctccctggctcaagtgtttctcccacctcagcttcccaagtagctgggactacaggtgtgtgctaccacacccagctattttttgtattgtctgtgtgtatgtgtgtgtgtagatacgaggttttcccatgttgcctaggcagttcttgaactcttgatgacaggcctgagccaccacagcctttgaatctttgaatcttattccttggaaagaaaaacctgatttactttcacaatgcagatttgtgttctttcacatgggactgacgattttgggttcaggacaaagatcaggattaaaatacggagctaatgtaaatgcattagatacttctgcggagctattgtagatgaagctgtgaaatttttctagtgacaattttctttttttttctcctgaaggtacatcagcatagaggtaattccttttcttttttgaaacagtcttgctctgtcacccaggctggagtgctgtggtgcgatgttggcttactgcagcctccgcctcctgggttcaagtgaatctcctgcttcagcctcctgagtagctgggattatgggtgcccgctgccatgtccagctaatttttgcatttttagtagagaccatgttggccaggctggtctcgaactcctgacctcaggtattatgcccgtctctgcctcccaatagttctgggattacaggcgtgagccactgtgtccggcccatagtggtaattttttggcagaggggggtgtgggggcgggacagagtttcgctgttgttgcccaggctggagtgcagtggggcgatctcagctcactgcaacccccgcctcccgggttcaagcgattctcctgcctcagcctcctgagtagctgggattggaggcatgccccaccacgcccagctactttcatgtttttagtagagatgggttttctccatgttggtcaggctggtctcgaactcccgacctcaggtggtctgcccgtcttggcctcccaaagtgctgggattacaggcgtgaaccactgcgcccgtccatagtagtaattcttaaattaactttattcttgtctctatctagcaaggatattaagtgaagtaaattgtcataaatgtttctacagtaaaaacatttgtgagaaaccattccttttttttttttttttttttttggaggtggagtctcgctgtgtcgcccaggctggagtgcagtggcgccatcttggttcactgcaagctccgcctcctgggttcacaccattctcctgcctcagcctcccgagtagctgggactacaggcacctgccaccacgcccagctaattttttgtatttttcgtagcatctctggtctttaccaggtgaagtttcatctgtgttagccaagatggtctcgatctcctgacctttttttttttttttttttttttttttaagggaggcaaggtctcttgctctgttgcccaggcttgggtacagtggtgcaatcacagctcactgcagcctcaagcaatcctcccacctcagcctcctgagtatctgggaccgcaagcatgtgccaccatgtctggctaatttttaaaattttttgtacatacgaggtttcattatgttgtcctggctggttttgagctcctggccttaagctatttgcttgcctcagcctcccaaagtgctgggattacaggcatgtgccattgagcctggccaataattattccttaaagatgaaaataataggtatttttaaaatcattttcagtggttccttaagaggggtgaatcactctcctcccctgataacatttggtagtgtctgttgacaatgcggtgttggggtgctgtggtgctgtcagcacctgataggtgaagaccagagatgaacaccctatcatgtgcagagtagtccccccaaccaagaattatccagcccagaaggtcagttgtactgaggttgagaaatcctgtttcagatttttcaatgtatttattctcctcccaacatatttacttaacttccttcagcttgaattttcttctttctttgttttgttttttttttttttttttttttgagactgtgtcttgctctgtcccccaggctggagtgcagtggcacagtctcagctcactgtagcctccgcctccccgcctcagcctcccaagtagctgggattacagggcctgccaccgtgccgggctattttttatatttttagtaaagacaggatttcacaatattggtcaggctggtctcgaactcctgacctcaagtgacccacccacctcggcctctcaaagtgctgggattacaggtgcgagccactaccctcagccaaaagcttgaattttctttgtcaagtcataagaaggtggtatcaagaatgaaaatagtcgtgagtgtccttgtagatgtgcatttgcagcaagtacatacgtttagatgcaccataggatactgcacactgactgtttcactgcacacagggtttattctacactggctgctcatcccagcatggaagtagcagtggctggatgcccactctgcagtgtccaccgctttccccgcagcgtctgtttgaggcttccagcagccttgtggtgtagttcgtgtcattaagtccattatacagattagagtctgtatgagagtgatttatccaaagttgatcaactactaaagggcaaaaggggggtctcctcctcctggctcctggatccgaaactctttgccattggtttttttttggagactgagtctcactcttgtcacccaggctggaatgtagtggcgcgatctcagctcactgcagcatctgcctccctggtttaagcgagtctcctccttcagtcttctgagtatctgggactacacgcttccactgcacccagctaatttttgtatttttagtagggatggggtttcaccatgttggccaggttgatcttgaactcctgacctgacctcagctgatctgcccactcagcctcccaaagtgctgggattacaggcgtgagccacctcacctggcctaacattgcttttttgtttgtttgtttttttttttttttttttttttttttggtttttttttttttgagacagagtctcgctctgttgcccaggctggagtgcagtggcatgatcttgcctcactgcaagctctgccttccgggttcacgccattctcctgcctcagcctcctgagtagctgggactacaggcacccgccaccacgcccagctagtttttttgtatttttagtagagatgggatttcaccctgttagccaggatggtctcgatctcctgaccttgtgatccgcccacctcagcctcctaaagtgctgggattacaggcgtgagccactgcacctggcctaacattgcttttttgtttgtttgttgttttgtttttgtttttgtttttgagatagagtctcgctctgtcgcccaggctggagtgcagtggtgtgatctcagctcactgcaagctccgcctcccgtgttcacgccattctcctgcctcagcctcccgagtagctgggactacaggtgcctgctaccacgcccggctagttttttgtatttttagtagagatggtgtttcaccgggttatccaggatggtctcgatctcctgacctcgtgatccactcacctcggactcccaaagtgctgggattgcaggcatgagccacggctcccagccctaccattgcatttttaagcaccgtttggaaatcgcttctttcactagttatccctctttcaagtacccaaaacgtggccaaagacctggccaattagagagaccctgacatcccaggtgaaatcacttccgggtcatcatactcaagacgttggcctttctgttgcaggaataggtggagccagataaaattgttgattgctttgaggagaaagtgttttgaaagttgcattttattttttaggctgtaacagaagacaagtacgaaatactgcaatctgtcgacgatgctgcgattgtgataaaaaacacaaaagagcctccattgtccctgaccatccacctgacatcccctgttgtcagagaagaaatggagaaagtattagctggaggtagggaggccgagacacgccggcaggactttgaaaatgtggtgttccctcactattcaaatgtgctattcagttttagactgctttggtatacggtgtagattgaccacctttactctgagatcacatctcccgttggctttgagtacttgggagtttgacaaaacagtcgcactaaaagtgagtagcacttttcataggggactgcaccattttcctttatcttcatccttgaacgttctcaaacatgaatgtggaagttgcttttctatggagccattctctggctgtggagaagtgtccctggtgattccatggttttaaagatgagacaaccagatggtttctgcatgagcaccacgttggagtttaccaacagcctgtgctgcagctgagctgagggcctcttcgtttgtcctctgtcatggctcttttatcatttaaagtgacagaagcacaaagagctgatacagagttttggataaagttttaaactgttgtccaatttttcaaaccacatcattggacctcacgctaataatgtgctcgcagtccatggcccgccgctcgcatgcctgtcttcaggccttatccaaacccctggtgtgcagatggcagagaagataaacgctctgcttggccgcagcataggctggcatagcgcccttgttgctgtttacctttggttctcatagctgattccgactaccaaagcccttctagttgatcaacgtagggacgctggacctttgaccaacaggactctctctgtcaagggctggggctagggcagtcccgcctggtgggcggagttggtcccctttgctgcagatgccttgggatggctgttgtgtgatgcagagagggagttcatttcctctccctcggcctttttaaattttttcctattgaacattttagcatagctaatttattgggagaacatggggaggaggcaagggaagaggattagaagataggctccacctatctctcccctccctcatgagattattccttttagaataactccccacttttgtttttatgtttgttttattttttctttttctttcttttttctttttctttttatttttggagggggcctccaatttttacaatttcctcacagggcagagttgaatgtgctctagtttctccttccctggtccagggtggagatgaattcagcttctgggaaactcagctgccctttagaaagctgccacatcccctttccacctgacagaaaccccttggtcaaactgtgccttgtcttcttattccatccatgaatagaaacgctatcagtcaacgaccccccggacgttctggacaggcagaaatgccttgctgccttggcgtccctccgacacgccaagtggttccaggtttgcattttgttcttctatttgtcttttggtagagaattcctaagttttaacttggctaactgtcaccataaagattccttaacattgacgatagccgtgccgagcttagcacctgcagctgcgcaggtcctaaaggagtgcacctcaacaaattcgaccccaaaagaggctgagactgagttggtgggctgctgctgctgctgctgctttgtgttaagagtaacactctcttgtacacgtagtgacattgcggctggccacagccttggtggtcgccagtgttgactgtttacccttggcaaagcagcaacctgacacttgtgtcgttcatgttgacttgtgccctgggcggtgcctcagactgaagagcctgtgttttgttcccctaggccagagccaacgggctgaagtcttgtgtcattgtgatccgggtcttgagggacctgtgcactcgcgtgcccacctggggtcccctccgaggctgggtaaggcatgttgctgtggctactgggggtggtgtgtgcagagtcttttggatatcccaggaacacttgatggtcacggggcaggagtggcctcttgacgcgtggctggtgtgtactctccagagctgcctgtggagctgctcctgcttgccacacctggggttggggttggggcagtgtgggtcggggccctctgcagggtcgcacagctcaatcccaggagtgggggctgaccaggaggtgggaatgatccctctgggaaggtttgtagatagtctcacgcaggaccagtttttggcagttgcacccttttttttttcagcttgcagttgaggtggtttttatatttgtaaataaatggttagattttaagtaagaagtactacatcataaccttagcttggtctctgagctcacacagcctgctaggatgtcatgtctggtccttgaaggcccctgtcctagatgccctggctcaggcttagccctgaggctttgactttacccgactggttggctatgagtcccacgtgtgccccgacccactcatgcagtgacagctccccagtggcggccggccccatcctgtaggctcttggctcactgtccctcttccctttcagcctctcgagctcctgtgtgagaaatccattggcacggccaacagaccgatgggtgctggcgaggccctgcggagagtgctggagtgcctggcgtcgggcatcgtgatgccaggttggggccttgtgctttgcaggttgcagggaaaggacagggttccaggccgcctcctggcgggtacactgactgggttaggacagcagcagccccgtgtccaccccctagagctgaagcatgtgactaccctctggcaccatcatatccagccctgaccgggtccgcagccgtcattcagagggcggatccggggcagtggtgacccactcccacgtgactttcttgctctgagacacttgtgaattatttctgtcaagggctggacgccgagtgggtcaccgagctaggcatgttttccagagctgggtgtggatggggcgcggggggtaacacacctagttccctcagccagcacacctcttcagagatgctaaaagataatcctctgcatatcttccttgtttcctgccttcagatggttctggcatttatgacccttgtgaaaaagaagccactgatgctattgggcatctagacagacagcaacgggaagatatcacacagagtgcgcaggtatagtcatcgccattgccaacgtgcgccctgacccagtctgtaatcactggcttccagttccattactgggtattcccagggtagcccctggactcgtaggctcaggtcggggactgaaggcaaaaggattgtgtctgatacagggcgccccaatctgggctgcttctttcccctggtgccatgcgtggttttcatctgccccctcccttggcttgctcgagtgccgttttcagacactgtgagtggtgctgggagatgtgtttgctgtgcggactgctccggggggaccttcccctgcaggcccccacatggctccgtgtggcaaccagtccccaggttggggtctcctgtattcctttggaaggggggtggtcacaggctggccttcccccacagcaaggctgggcttgagcagtcaggctctcccctggctggtgggggaccccttgctgtcgtaagggagaccattagcagcccttcagctctgcccctcctcagaaggcagtagtgagcacacactccatggccgggagcacagggcagctgagtcagagcctcttccccttctccagcacgcactgcggctcgctgccttcggccagctccataaagtcctaggcatggaccctctgccttccaagatgcccaagaaaccaaagaatgaaaacccagtggactacaccggtaagcctgcggcggttgcctgatggctggggctccaggaagagtcaccatctgcatctcccagccatgccctggtctctccttgcagttcagatcccaccaagcaccacctatgccattacgcccatgaaacgcccaatggaggaggacggggaggagaagtcgcccagcaaaaagaagaagaagattcagaagaaaggtacaggccgggcgcggtggctcacgcctgtaatcccagcactttgggaggccgaggcgggagaatcgcttgagctcaggagttttgagaccatcagcctgggcaacatggcgaaaccccgtctctacaaaaaatacaaaaattagctgggtgtggtggcgcacctgtagtgccagctacttgggaggctgagatgggaggatggcttgagcctgggaggcggaggttgcagtgagcaactgtactccagcctgggcaacagagcgagaccttgcttaaaatcagtgttgaaaaattttagaagctaaataggtaaaaaagcaggaaggtgcagacctccactagtgctgctgctttatccatctggtcctgtgaaggctcaccctgaagctatgggatggctgcttttgtttcatttttctcacttgtgatttctgagtccttttaacaatgatgaggcatgattggggatgtggaagatgagtaggatggtggtgctacagctggaggccacaggagaggtgcaagctgggctcagtttgtgtggctgccccacccactgtgttacgccacagaggcagccctgggggttaggattggcagagctctcgtggagacctgccatcgtgctgatccagagccaccttgctattctctctgtagaggagaaggcagagcccccccaggctatgaatgccctgatgcggttgaaccagctgaagccagggctgcagtacaagctggtgtcccagactgggcccgtccatgcccccatctttaccatgtctgtggaggttgatggcaattcattcgaggcctctgggccctccaaaaagacggccaagctgcacgtggccgttaaggtgagtgtggccagcatcactgtcttctaatagcagaaccatggtctttgttttgggccccttctgagccattgtctctcagggagggcatgtagattctaaaaatacacatggttagatggcgagtatttgccaagtcacgtggcaagaacgccttcccactgtggctggcaggcagaggggtccccaaacatgattggggcattagggcctcctgggagcaggagctgaaaggaaacagccctcctccagatggcttcccgggtgggtgcctgtaggccatgaggaggccctgcatgcagccctgcttcactgggaccttgggggtcttgccacctctgcaggtgttacaggacatgggcttgccgacgggtgctgaaggcagggactcgagcaagggggaggactcggctgaggagaccgaggcgaagccagcagtggtggcccctgccccagtggtagaagctgtctccacccctagtgcggcctttccctcagatgccactgccgaggtgagcacatggtgggcgctgggagtgactgcctggacagagcaggcagccatgtgtcctgtcagtgaggtggttactggtccttgttaatttgccccaaaaagtggacctttcaggccagaagtccgcacaggaagctgggtgctgccctccgagccgtgtcggggagggccttgtggatgttgtcccagcatcctataggctacactggggtggccttgggttgataacgtgctgttcagaggggaggcacaggaagggggcacattgctggaaggccctcactagagtcagtggagactctggcaagggctggcagtgtatgaagagcagaggccctgcctcagtcctgccactcctcccatgtgactggaatgcccatagctgagtttgtcggtcttcttttctgttttccctgagaacgtaaaacagcaggggccgatcctgacaaagcacggcaagaacccagtcatggagctgaacgagaagaggcgtgggctcaagtacgagctcatctccgagaccgggggcagccacgacaagcgcttcgtcatggaggtgcgcagcctgaagctgcctgctggggcagtcccatggggaggcctggggtccccctgcccctggagggaggcactgagtcatctccatctgcactttccaggtcgaagtggatggacagaagttccaaggtgctggttccaacaaaaaggtggcgaaggcctacgctgctcttgctgccctagaaaagcttttccctgacacccctctcgcccttgatgccaacaaaaagaagagagccccagtacccgtcagagggggaccgaaatttgctgctaaggtgagcagtggcccttgaacctccttgcccaggcatgggttcttctgcaatgtgagcacgaagggaatgtcacttccctgtgttctcttctagccacataaccctggcttcggcatgggaggccccatgcacaacgaagtgcccccaccccccaaccttcgagggcggggaagaggcgggagcatccggggacgagggcgcgggcgaggatttggtggcgccaaccatggaggctacatgaatgccggtaagggccctcatactgcactgtccccgccttccccacgtgcatgctctgggaacaaatgtgtggggctcctggggtgggccggagacactgctggaccccggtaaccctgtctttccctttccaggtgctgggtatggaagctatgggtacggaggcaactcggcgacagcaggctacagtaagtgtgcgtttctgtctgtctgacctgggaagcagctgcagtgtagcgtctgggcctgagttagcaaagggtggccagagcagcctcgaggaggctgtagaaggggcacacacctttttgcggtgattaggtcagacggccctcgacccccaccccttcccggccccacagtgggattgattgtgttaatacacgaactcgtgtaactgcaaagttccttaaaagttagaattttaaatttctctgctttaagccatgcgaagcaccaatcttgtgaatacgcttttccggccagtgcacagctcttgtcttgagaaggagccttcattggggggttacaggagcagagaaatctaaaacatgaatttcaaatgtggcgctctgtgccctttttcaaaagaattctaatttcttctctctgctctgtctcccccttttgtaggtgactttttcacagactgctacggctatcatgattttgggtcttcctagagcgtctaaaagtattgcacacaaaatcaactttttactccaatttcctccaactccaaaacccaaagtgtccgtgctgtgtccctgtgcttcactgggtttctcaaccgtggcttttcaccgcagcttgtctgaaactcttagcctgcagaatttaagacaatggcagtttttatcgtgatttgcctttgaacttggtcctattgaagttcacaataagtggaaaacaattttttcagagaatgtatttttgtgcagaattgcacagaattctagagacagcgttgttcggcatcaaggcaaaagcccacctttgctttttatggaaagcattactttatttaaagagacagacaatgacgcattttaatctacctttgtcttaatttacagcaggttttgtatgaatttttaaccttttaacaaactcccaaatctggttgatgcctttgacagtgatgaaaacgatttcaccacatctgaatccagagaaaccggctttttttcttattgcgagcatgttaaaacgttgggaacatgtggggaattgtatattgcgctgaattaacttctcccgcctcttgtaatgctctggtgggttcttgtttgggaatgcgatattttgtggctggtttagctagagagtgaactctcaaaggtatcaaaactgtgcttccattattagtgcaagaaacagacaggctttaaggggtagatgacgtgaaattttgcaagtcttaattacagctgcagatgcatgggattctggatttttttgttgctttttagtttaatgggactttaaaagtaattgaggagaaagaaccgtgatgttccctgtttctccagtaaaggactggcttttgcttgggcagaggtggtgctgctgggtgtgcagctgccacagactccaaaggcgtagaagtttgtgccaacacacggagtcattctggctctctgctgaggcccctgttttctggcaggtgccctccttggaaactggttttggctctgatcagcggttctttttgcagcaaagcctgcatctgtgttgacttgcaagattttgcgtttattcaggcaaaaactggtcaaaatggttactacatgatttgttcccagaggtttgaaacattcagtgaaactttttaaaactttgattgcatgatgtattttttttttagaaagttattgtttgagaataatgtctttttataccaggaaaatagttatcctgaatgacgttgaaaactccccctcccctttatttttttttaatcaatacatgtgaaagtaacaagccctcggcccttgcgtcttcattcattcccggcttcaggcggggcgaggtggtgtgctcagtgcaggacactggggaagctggggctgtggggctgtggggtgtgggtcctggtgggggggttctgaagatcccatcctcccagtctcctcgctgagctgccgcatgttcgctttctggcattgtgggacacatcctcccccttggtgtcttggctttgtgatggcgggcgagggaggaggcctgcctgaagaacacaaactgaaggttgcagatagttctgtccacgttgtcatgcaggcagcccaccacaccagcgtggggtacacatctccagtgggtggaggcacgtgaggactcccagttaccctacccaggaggcggtgggcccttagtgtcctcaatctgggaaggaaggacaggcagcgtgggagcctccccttccctcccacccaccctgggcctggaggtctgggcagcctgactgggcaaaggtggctgcattcacaagccgacccgctctgagagcccaggaactcagctgcgcctggtgagcgcttgggcgttggccagcttggctggagagccaccaccatgacccagcctcccacctcacccaccctctgagccttcccacacccactgtggaggctccctgtgtggggctcccttgcaaggcttggggtgcagcattccctcagccagtgccgtcccctttgttccactcgagcctctggcggggccgtgtattgacaaacctagtgaccagaagtggggtctcactgctacattttcagcttgcggctgagaatgtagtggctgcactgcacactttcagccctgctgctcagccccacctgcacccagcagctgtgctggggacaaggaaggggcctcgggagtcattagggctgtaggtctaggcctcacccggctttcctgccccagccgtggccactgccctctgccagccaggctggggcttggtcacatcctgagtcacatgcttgcatgagtatcgcaagggaggtgcctgcatcattgactgagtctcgatttgtcttccaagaaccaaaccagctcagaccagttggtcttctcaggatgatgacggtccggggcctctttaaatagcatcttttaggggcctccaggcctgtgcctgtggagcctgttcccagcacagcagggaggaggggggtggctgctgcttctctggggctttgcttttcctgtcaccattggggatctctgggtagccgtcagctagctgtgaatgtcgtcccgcgctcggagtccatctcattgtaatgttgacatccgctgcaaaagctgctggcgcgtgctgcttggcaaagccccattgttgtcatcagctgctgggtgagtggagctgaaggctgggccagcccaaacggctgtgctaaggaccggagccactgctcctctccctccttgtcctactgcctctgacccgggcttgtgggtcagccttcaggacccatggctgccgcctgcccttccctcccttccccctgccctttcccgtcctccgcctgacccactgcctccctgtttaggtcagttctacagcaacggagggcattctgggaatgccagtggcggtggcggcgggggcggtggtggctcctccggctatggctcctactaccaaggtgacaactacaactcaccggtgcccccaaaacacgctgggaagaagcagccgcacgggggccagcagaagccctcctacggctcgggctaccagtcccaccagggccagcagcagtcctacaaccagagcccctacagcaactatggccctccacagggcaagcagaaaggctataaccatggacaaggcagctactcctactcgaactcctacaactctcccgggggcgggggcggatccgactacaactacgagagcaaattcagtgagttggcttccagagcccctcggccgggccagggtccaggccccagcagtgcagcccacggagtggcagaagctcggcactgcccagacctctggctgagggccttaggaggaggacaagtggtgctggctgcgggcgggtgctaggaagatggggcgtgggacctcatggtgccgtctccgccactctctctggtgtgttctccgaaggcagggtagctgaggcctctgtcccgaggccctggctgtgggtgaggctgcaaggtgacttcctgggacttgctctagagagttttgcatccagcccctgcaagagcctgacctctccgccaccgcctttccgcttcctcatgcgcagacccagcaggcccgggctgcaccagtgacccagtggggctgagtaggtgtgtccttgggacccagcagctgtcagcagcaggccagggacttgacagaggctgtgctggtgggtcagaagggggtgctgtgtgtctggtgctgctggctgaggagaggcggctgctggggtctcaagcacttcctcagctgctgctgggaagtttgggctgcaggaacagatgggaaggcaccccagagcagggctttggagcttggtgaccagcccagcccagggccaggtgaccctgcagggctccagctggcccctggtacttacctgatgggctgatgtgcgacattgaagcaggcagggagaagagttagaggcccagggtctgggccaggggccggccgcgtctgaggcgcaccacaaggcccccgggccgcccaaggtgtgtctttcctggggccccttaaccatcctgtcttctctcccccagactacagtggtagtggaggccgaagcggcgggaacagctacggctcaggcggggcatcctacaacccagggtcacacgggggctacggcggaggttctgggggcggctcctcataccaaggcaaacaaggtgggcctggagcccctggtggcacagcatggggggcctggcagctgctgtgaagcgggatatggacctggtgggagcagacagcagcgtgggcagggctgcagtggcaggtgggccctgtgagaacacgcactcggatgcactggcagctgctaaggctttcgggagcagccggagagccagcagtgtccccacgcttaacccctggtacctgtgtgaaatgtgggtgacaccaaggccaaacagctgttcccccggttctggccagtagctcagccttgggctcaggtagcttctcccagaaacgagggtcacagtggtcccacctctcagagtcttggtgccagcctgatccagtgatgtgtggtaggcaggcagagccgcacaggagcccataagtcttgcccacctgcatcctggccgaggcttgggtgtgggctgcctaacctgagccccgctggctgggcccctcggctctaatccaccactctctctcctaggaggctactcacagtcgaactacaactccccggggtccggccagaactacagtggccctcccagctcctaccagtcctcacaaggcggctatggcagaaacgcagaccacagcatgaactaccagtacagataagcccccgcggggcggagatttctaccttctgcacttactccccatcagaagatcgagttttatgcatcacagttaacatgtcagctggccctccaggcccccgcccccatcccgtccacgttgctgtgtcgtgaggtgcagcgggtcaccctgtggcccgtcctgtgacccatatttagccgtgtttgggactccgtgtcttcaatggtttgttagttgccattacaactttgtctgggtagagtttttgagtttttgcagttcagtatccctctgtctattcacacttcgtgttagtggtaactcagtttgtctttaaatagttacagaagggatacgtcatttgttaatgcttttgtgaagtgagttaaacgagctttctgtattttaatgctttagtgtttcagttttataagtgaagattttattttaaaaaccagtgggaaagagtggggggtttctttttatgtctgggtcattcaggcagtacatctgaattaagctgaatgtagacaaataaagaaaaacaaaactgcgcccgtcttaggcctgggtgtctgacccaccagcagtgcaatgggcaggtttccccactctattcctgctcttgggaaagcagcgtgggccatcaggatggtccctggtccttagagagggtccagttcaggcttctagacattttactcatgctcagcgaaggctggttcctggtcccctgggctgtgtagacccggtgtcccaccaggctccaggctcccaccatctacagaggggcttacagcgcccattctggtcttggggaacccatcacaaaataggctttttctgctccccgattctggtgtagttctaagtacacagtgatgtcctctgtaggggcgtgcctgtggtggaacataacgcagttacaaaagaaagggcaggtgaggcctgggtaaccccagccatggaccgtcagtggctggagggagcttcgtgtctgtgctggagctgcagcctgctcgccatctggaggctcagtggagtggggagttggggttctcataccagcagatttccctagagcgtgattctcccatctgaggcaatcttgcctcccaggggaaattttgcaatgtttggaggatgttgtcacagctagtagcgggtgctctgggatctggtggatagatgccaaggatgctgtcaagcatactgtactgcccagaacagtggcccatagcagggacctgccctatcaaaatatcaggtgtatggaggtggagtcccaacgctagagcagcccttctcagctccaccctgcccggggagggaggaggagctctggtttcagagcagtgccgggattgcctttccccaggatctgtgtcggccatccaggaagaactgtactggccaagcctgggaccacacgtctgcagagatcctgctctgctggcctgagccccaggccttggcctcctgtgcttgggtaaccatggccactgggaaaagcaaggaccgtgtttgactttcttggagaggtgaaagaggtgaaagaacaagttgtgtgctagaaaacttttgaggaattcttatttgtgttagagcagaggaggtcccagataccaagtggcgcctcccaggaaaggctgggagaagaggtggcctggagtaccccgagatcccagcagcgcacacagtggagggatgaggatggatgggtcctaacccctgattttgatgggatgtgttcatgtcctatctcctctcctggacacattaaggggttgggacaagaagagactcctgtgagatcagcagacctcgtgtttaaggagagaatgcctgcctgcaacactcatggagagggacacttcctggccccacctgctaaatacctccaaactctgggcaggcgcctgcattctcaacacaggacttcccttaacagtttccggatcagtgaccaccaccacgttcaggtttctgaatgcagacccaccacgagggatggattccacccgcccgccctgctgcagatacatgcggcacagcaggcacgtgcctggagagaacagctcctgagcacagcacccttggagccctcaccccgctcacgatcctcaccagtgctgatgatgccgtcatgctgctggcctgagacagtatcccagctacaacaggacgacaccgggttcaggaatatgtggctatcaccttgagcactgacagtggccttccaggctagttgccttccaaacgcaggtagccgacctgcaggagggcctacaaacgggcccagcaagagctgggcaacagctggcttgtgaaatgagacaccttgaccaatatgctttgggtggacggtctcctacatgttcagtggaggccaccaggagcatccatgagcggggaaggggtccacacccttacatggcaagttgatacgatggggtgcttggtggatgggccatggaggtccgtgagctggaactgggcacacgccatcccagagggctcaggatgccccaggaaggaaagaagggcaacagactacacgattggacgtgtgtggttgactgggatgaagttggagggaggggcagggccttgcaggggattggtactgatcccagggaggaagtgttggggcttcatgaactaggatgaaaggaggcccctgagccatgacaaggggcacatccaggatttccgccaccctgaatttagtagagctagtaggccctggtcgtcactctgggcagggatgccgtcagccttgagggtcgccacccacctgtgtgttgccctctgtcctggcagggaaacatacaccccttgtctcaccaccaaccttgcttgtgtagtcagcagggctggccctgccccaaggactcactgcatgtacccggacccctaggcctggcctttgcagcatagttgggagcttctggattccatctgcacctgtgagccccatgctggctgtgcactgcgcgggcctgagactgctggatacaatgttgggcaacaactcagccagcctgatggcagcctcagaggcttactctaacccatcccagaataaatggagacttcatgtgttcattgtttcattcactcaa

SEQ ID NO: 37107 - DNA, 9320 bp, Homo sapiens
ggcagggagccggagagccggaaccggagtcgcagcggcggtaatagtgcgagactcctctaagtcaccgtccttagcgcgggaccgcggggttcgacgggagttagcgggggtgcggccaggccgttggacgccggggggtcctggggccgatgtgaggggaggcgggggtgggggagccgggccggctctagaatcgagttgtccgctccgagccccggacggacactgatccgcgggctcgtcttggcctttcccaggagacccctgtgcggtgcggagggggcggcggccccgactctgacccgcgccgggggtgggccatggcggagatcagcgacctggaccggcagatcgagcagctgcgtcgctgcgagctcatcaaggagagcgaagtcaaggccctgtgcgctaaggccaggtgagctcgttggccctggggaagggaggccaagccgccgcccacgggttctggcctggggcaaacccaactgagaactttgggcttgcctcgttctggaagctttcccagagaggagcaggatggagccgctgccctcgaggaaaagctagcctgctcggggaagacagagtggataaagacacttaaagtttattagacgatgtgtttccagtggagtaagagtgttacataaagtacttaggaaactcaaggaaacaagtccatctgtcgggggacggaagcttgttggaggggggccgaactgtgggagaggcctcgaataaggaggtggtaaaagagtcagccaaaaaccaaaagtttaagacaggaaagttaaagaccctgtgatttataaaagtcttctaattacaacaacccttaaagattggtggtattgtactcattttacaggtgggaactttcatgttcaaagttacccacaagtaaggaatggggtctgaagccagctcttagtgtcctgtcctttttcaggccataatgcaaaaaggtggagttggatcattcacgttcagggtgggagcctgagaaatcgtagcaagtaagccagggtagaattaagcacgatagggaggccagttcagagttctgtgggaagtaggatgatgtagtggttaaggctctaggttttgcagtgtgagatggctctaggtttgaatctgaactctgccgctttctagctgtgttagtaatcttaagtgtctttatttgtaaagcagaattaatagtacttaataagatgattgtgaagattcagtgagttggtgctggagatgaggttagcacagtgttttggtacagcatacgtgcttgataatcaccaggtattctatttcttttggaagagggcaataatgagatgggctaaagccatcagggagggcttttgagtggaggtaggccttgaaggatgaagataatttggctagctgatggaggcagggccagtgagggaagggcattccaagcaggacgaatgtaacagtggaggccctgagatgcgtggggaacagtcaggggtttaattacctgcctcctctggggaactgtgtgattgtggcttctaccaggctggagaattgtggcagaagagcccacagaattaccctacgtttattgaacagtaaacattggcctttacagggccactatttggcctggcccggtactggcaaaaaacttctatccatctcttccccccagcaatcctatgaggttggaatcatttgctgcattttatcgaataggaagccatgactcgtagaggtctggtgacttaactgaggtcacccactgaggacgtggcagagctgggtcctgaatctgtggccctcaggctctttgcctggccctgcctcacatagactacctgcagccagacagggcctgtgaggggatgatgagcagggtcggcctctttttcgccacctgtctgtggcttttctcttttgccagctgaccagaccagccccatggtgtttttagttgtcccctttccctcagtcctgattggcatttttaggaacttaaacctgttgttgcctggcactattctttaacctcgaagtattgtctccctcacgggccctggatcagtgtggtggtgatggtagacaaagcttagatagcatgctggagtttgcagaatagcaggaagtcgtatattcagtctccatggctccttgcaacagcctaaggaatacgcagggtgggctgagtacttagccccatttcatagcagaggaaactgagcctttgagtagataatgtcttgcccaacatcacgcagctagtcggaggggaagttagttttgcatccaggtctttgactgtgctccgtggtcactgagagccaggcagaggcatttagattttgatgtggggtgtgaggcagcaggaagccatggaaggctgaggggtggagggtcctgcccagttgaaactgagtggaactaggaggtactaggccaaggcctgagttggccgctgttgtcccaggctcagtctgaagcagggccatctctgatacctggttatggcctcctggggacccatcagagacccaggctgaggctggtggtgtcaagagcaccagcttgcctagagggcacagacatgcagatgaaaccagtggaagcacagaggtccgcagtgtctgagctgaaattgctgctactagaaatattagcacagtaggagagctgagcttttgaatcaggtggtcttcagtatgaatctttgccttgtcacctagaagcaatatgaccctcgtcaagtcactttctgattttttgaagtgataatgacatgcagttgagagtccgggtatccgggcacagggcctgctgcgctggtagccgttactgcaggcaggtcctgatagggctggggaagtgctgcaagtggcagaactggggctggaatctgggcctgattcccaggccacactggggttgcgctggcactgaggggggctttgcagagagcacgggccctgcatgtgacctccctgggcttcaggttttcactcagggtctgtggaaggggctggcataaattctcaggaaattgggcttctgggttccaatttagccactctccagcttggtgaccttgaccctcccgcttttctgtaagctttggtttctttttttctttttttttttttttgagacagagttttgctgttgttgcccaggctggagtgccagtggcctgatcttggctcactgcaacctccacctcctaggttcaagtgattctcctacctcagcctcccaagtagctgggattacaggcacgcgccaccatgcccagctaatttttgtatatttactagagacggggtttcaccatgttggccaggatggtctcaatctcttgacctcatgatctgcctgccttggcttcccaaagtgctgggattacaggcatgagccaccgcgcccggcctagcttcggtttctttactgttacgtgaggctgaagagaacctccccagtctgttggaaaggtcactatgagcagttgatggggaaggatgttcagcacaagaagcagtgcaggtgggagagtccgggtactgatgtggcctcttggaccaccgccagtgctgccttctgttcccagaaagccagggcagacctccttcgtgctgcctctgccatacagagcaaggggcataagtgaatcctcctgtccactgagctcaggaaactcattctaagggaagagattggcagaaagaggggggccaggcgagttgggcctcccacatcagaatatcttgataaagagtcagaccccagagccaggcttccctggttcatatcccacctgtgtcactggcaccaagccagcctccttccctgcttcaatttcttcatctgtgtaccgggaatcatcatagtacctgcctgccaagctcttaataacatttgtggcacacagtatgagctcgaatgttcactgctgctattaccaggcaaaatttggaaatacagtgttgcttaaattgggtatctataggctgggtgcagtggctcacatctgtaatcccagcactttgggaggcaaaggtgggtagatcacttgaggtcaggagttcgagaccagcctgggcaacatagtgaaatctcgactctactaaaaatacaaaaattagctgggcgtggtggtacatgcttctaatcccagctactcgggaggttgaggcaggagaatcacttgacccaggaagcagaggtttgcagtgagcaaagatggcgccactgcactccagactgggcaatggagccagactctgtctcaaaaaaaaaaaaaaaaaaaaaaaattgggtgtcttacctggcaaagtgatttcatctcctgctcactcaagtagaagtagactgcactgcaaggagaaataaaaaatatttaagtcctcatagtcataaagaaatactgaacacatggcaagagcacctcacttttttttttttttttttgagatgaagtcttgctctgtcgcccaggctggagtgcagtggcgcgatcttagctcactgcagcccccacctcccaggttcaagcgattctcctgcctcagcctcccaagtagctgggattacaggcacgcgccaccacgcctggctaatttttgtatatttagtagagacagggtttcaccatgttagtcaggctggtctcaaactcctgacctcgtgatctgcccaccctggcatcccaaagtgctgggattacaggcatgagccaccgcacctggccaagagcgcatcactttgaaggcgcatccactgtgggcctgccctgggcacctacccttgtgtctggatagcctgggagaagggctctgtgattggccaagggtgacttaagctctgctgtggagaggatggggagacccgcctcccaggagtgagtcctggatgcggaagagggagcggcagggggagtcagggctggaaaagtcccagcctgctcagaaggcctggaacgctgggataagaggttggactttgtccttttggcagcagggggccacggaagggtgttgcatgctgaagggccgtggtcagcctgttttggggagactgtacgcttcactcctgccccctggagcttccaggactgcctcatatcctcccctccccccaaaaaaggtcaggaattgggctgggctggcctggctgtggtgaccctggtcttctcctgtctccagagagatcttggtagaggagagcaacgtgcagagggtggactcgccagtcacagtgagtacctgctgtccctgcagagccaggcctggtctttcaggcacatgaagtttcctcttcatcttgggggctctataagcccaaccctaagctcttttatctgtcctttccctcaccttcaacggagcactgctaaaagaagtgggggttgctgtgcacgttggctcacacctgtgatcccagcattttgggagggcaaggtgggcacatcacttgaggttaggagttcgagaccagcctggccaacatggtgaaaccgtttctactaaaaatacaaaaattagccacgcgtggtggcacgtgcctgtaatcccagctacttgggaggctgaggcaggagaatcgcttgaaccccagagttggagattgcagtgagctgagatcaggccactgcactccagcctgggtgacagagggagactccgtctcaaaaaaaaacaaaaaaaaacaaaaaaaacaggccgggcgcggcggctcacgcctgtaatcccagcactttgggaggccgaggcaggtggatcatgaggtcaggagatcgagaccatcctggctaacatggtgaaaccccatctctactaaaaatacaaaaaaattagccaggtgtggtggtggacacctgtagtcccagctactcgggaggctgaggcaggagaatgacgtgaacccaggaggcggagcttgcagtgagccgagatcgcgccaccgcactccaggctaggcgacagagtgagactccgtctaaaaaaaaaaaaaagaaaggaaagaaaagaaaggggttatgggaagggactttggatttgttagtggagattcttggccagggcagaaggactcctatttggcgagtgattctgctcacatatctccagggctctgtgttagtaacttgattctgggtactttgtggggagtagagagaggaaggggccgggacatctacctggaaggacttagttctagctcttgcctacagaatagttggtactcagcataggacagtgggtatggttccagaccagactgacttggggtgggagaggagaattttggtcctaggaagtagaagtgcagccaagagtgataaagctcactaaagcagcgggtgtttggagggtagtccctggcaactcccactgcttgagttccaaccccactcttcctgttccccaggtgtgcggcgacatccatggacaattctatgacctcaaagagctgttcagagtaagagtgtggccaacactgtgaaatgtaacggggggatgactggaagacccctgtaattgagggtgggagccttaatttggggcgtggagtgggggcaaggggccccaagttagatgggtggttgtggaagaagggcctccgctggacagaaacaggtagggggtaggggactgtttacgacagggcaaaactttctacttccccacaggtaggtggcgacgtccctgagaccaactacctcttcatgggggactttgtggaccgtggcttctatagcgtcgaaacgttcctcctgctgctggcacttaaggtggcagtccccggcttctgcacccccaacctgggcgacctcgggccgggcctgtcttagtccgttccgccctcatctcctatcgtgaccagccccaccttggagctgtgtcactggtgatggaccgattctgcttttgggggtggtcagagacttgatgggggttgaggccagcggggcagcattctgggaggggcagaggctcactgttgcgaatgtggcaggtcattgatgccactggtgggagaggcagtgtggggccagatgacaaagggcctgggtgccttgctagggacccggtctgtgtctggtaggtgaaagaagagccattaggttcatagttgagggaatgggtcagctttacattctctggaggggtcgtgtgggcctgggaggtggctgatgccacacgattcaggcaagaggtgccaggagtgtgctgggcagtggttgtgaggatggcaggctggcgggcacgaggaggtcagagagggatgtgtggagagaccgtctaggcgccagccctggcttggtggccacccccaggttcgctatcctgatcgcatcacactgatccggggcaaccatgagagtcgccagatcacgcaggtctatggcttctacgatgagtgcctgcgcaagtacggctcggtgactgtgtggcgctactgcactgagatctttgactacctcagcctgtcagccatcatcgatggcaaggtaagccagcccagggctccatgggacagggagaggaggggggcttcaggcctcagccccgtcctctttccctgctctcccctgtagatcttctgcgtgcacgggggcctctccccctccatccagaccctggatcagattcggacaatcgaccgaaagcaagaggtgcctcatgatgggcccatgtgtgacctcctctggtctgacccagaaggtgagggcatgtgggcaggggcaggcagggacagccaggaggggttgggaaagagagggagcagggctggtcttcactgtcactcgtcctccacctgccaaatggctggaaccctggaggaggagcagggaggcctgcatggcaggtgctttgagcacacagtggcttggggcatggcccagagggctgtggaggacaaccaagtcatggctccctgaagtgaaggggccttagaacatgacagcagcttcttcagaggtcagaaccccagaatggtagccccctgagacccctcattttgtgggttttccactagtgtagagcagagctgagatttaaagtcaggtcttctgaggaccagccagagttcctgttgtcacaggcacacacgcacaggcagcctctgctccagcgcagacacacacacacatacacatagcctctgctccatcacagccacacacacgcacacgaggcctctgctccatcacagccacacacatacagacacacacatgcagacacacacatgcagccgctgctccacagtcactccggacctccctgtgacaacacagggtgcccttctgtctctgggagtgcccctttcactcttatgtgctgtttggacggggattgtatgatcactgtgattatgagggggccccaggcattgggcgttctttctcctctggagcttatctgcccctacatttgctgtcctggtccccgccatcccacagaccatattcaggccccatgctctggtcccacgggcctctggtggacttggggaggggccaggctgctcaccctcaaggggcagcgctggcagccagagaagcctgaggacatccctctccatccctccctttccgcatcagacaccacaggctggggcgtgagcccccgaggagccggctacctatttggcagtgacgtggtggcccagttcaacgcagccaatgacattgacatgatctgccgtgcccaccaactggtgatggaaggttacaagtggcacttcaatgagacggtgctcactgtgtggtcggcacccaactactgctaccggtgagccggctgggccgggctgggatgggcgggcatctgagccgagctgctcctgaccctgctgccccgccttccagctgtgggaatgtggcagccatcttggagctggacgagcatctccagaaagatttcatcatctttgaggctgctccccaagagacacggggcatcccctccaagaagcccgtggccgactacttcctgtgaccccgcccggcccctgccccctccaacccttctggccctcgcaccactgtgactctgccatcttcctcagacggaggctgggcgtggggggggctgtcctggctctgctgtcccccaagagggtgcttcgagggtgaggacttctctggagaggcctggagacctagctccatgttcctcctcctctctccccacttgaaccatgaagtttccaataatttttttttctttttttccttcttttttctgtttgtttttagataaaaattttgagaaaaaaaatgaaaaaattctaataaaagaagaaaaatg

SEQ ID NO: 37108 - DNA, 31432 bp, Homo sapiens
gatcctgtagaacttcggaggtaagcctggtgaatcagatcatagggggtctggagggtgaaaaaaaagagtttggtgctcatggatggggctagtattggggtgtaggggagattaggtcaaagcaagaggattcaaaggagaaatgaattcctttagattggggaagataatcggaagaggtagaagacaccgtccatgacacttcctggggaagcagatgtatgtataaggatgtgagtattgtggttttgtaaagaatgcattcctgaagatgttgcataatttaaaacctacatattttgattaattttctcatgagaatagcagggtatgtgttctcggcgctcacaaatgtataatccattgtggcaaatttttgctttcacatatttttttttatcattattgtcacaggttctgtgacggagttctggtttctaaattcacagcataccaaggcagttctttaaagttcttgatactcttttatcatatctaacttgtattccaaaattattgagttggagcacattttcccagcacttagcaccgctatttcatggatggttggagagggggtccaaaaattttacaatcatgttaacaaaagtgacacagcaacaaaacaataagcaaaatcactgccagagtattccttagcttgaaacaatacggttcacatcgatagaatatggcatctatttctgtttaatcagttaaccctgctaagtagcaagagcttacaattcatgtctaaaatcatgatttttttactagttttttaaaaaatgtgggctctatatatataatttaacattttgcttgtaagacttaattttgcctgggtatggtggctcatgcctgtaatcctagcacttcaggaggttgaggcaggaggactgcttgagcccaggagttcaagaccagcctgggcaacacagtgggaccccatcactaccaaaaaaaaaaaaaaattagtcaggcatggtggtgtgcacttgtagtcccagctacttgggaggctgaggtgggaggatcacttgagcccaggaggtcactgctgcagtgagccattattgtaccacaacactccagcctgggtaatagagtgagactctgtctcaaaaaaaaaaaaagactatttctaaatgtgtggctatattataccatataaatgtggcttcttgggcaaggaaagaggacaatatagatgaaaaagaaattgatcctaccagaagtgatccttttatctgcataactctcaggcagttgtggcaaataattggcaatatctattgttctgaaactggttttcgcaacttttattgggaacaccatcccctctcctgcatgatcagtttctcctctccacggatcattcacatgagtaaagtcagtagcgtgctggtaaatgtttaagatcttgttctttgggggaaaaagttcctaagttctagcagttgccctggataacttcaaggtatcaacatggaagttatgtacaaaaatggctgtcacaagccagtatgagctaacaccaacatactacccagtgttcttcaaacttcagctcacagcccattagtggggcttgcaaacattttagtggactataagcagcatttttttaaaatgaaaaagtagattgttttacacataacaggagtattgttttgtacaatttttttttttttttttttttttttttagacacagtttcactctgttgcccaggctggagtacagtggtacaatctcagctcactgcaacctcggccttctgggttcaagcgattctcatgcctcagcctcccgagtagctgaaattacaggcatgcgccacaaggcccagctaattattgtatttttagtagaaacagggtttcaccatattggccaggctggtctcaaactcctgacctcaagtgatccacctgcctcggcttcccaaagtgctgggattacaggagtgagccaacgtgcctggtcaaaatttttgttttcgtaattttaagtatgtgtgtagtaagtctcaatggaaatgtaattcttatggcaggtcacttgaaaaaaaagaagtctaaaagtcaccaatgtagtatcttctctttaaaaaaaaaaaaaaaacaacaggagaaaacctgaatctgccctttgctccactccttcctcagctataatgctgcttctccattcctcctcacagcaaacctttctgaaatctttatagtcatggtttccaccagttcttcacctcccatttctcaacacacttcagagtcagagtcagcaatgacatccatgttcctaagcccattgcttacttccgtcctccttggcctctcagcacacttggcacacaggctgtttctctttctttggcatctgtgacaccactctcagcaaattcccctggttgtcccttctcagtctcatttattggcgttgtcttatctccccagggctgtccgaggtgattttctcccactactctcctaggtggtgccatccaatctcatgatgtcatatcattcttccctcatgcttcagccatactggttggtggcctttgtttcctgaacacatttaatgcattctcaagaccctcagggactttgcagcagctgctcgctaaggctggaatgctcttccccaccatcttcatatggctgtttcctttctttcactcaccagcagcttaaactttgactcctctgagagactttccttgtcacccaactaaggttgccactcaggtgctcccaatttaatcttctctaaaacacatcactgtatgtgtcctcaactagagtataagcttcctcgaaacaagaacaatcaaaactccttgccctcatggagtttatagtcttatgatgggtgaagtaacataaaataaaaaggcaccttatatagtatattagcatgacaaatgttagccagaaataaagcaaggaagagttgctagggagtgtgtatgagtgtgttttgggagagtgtttgcaattttaaatattggtggtcaggaagggccccactgagaactgacatttgagtagacttgaaaagggaaaaggaaatattgagtaaagattttaggatgggagtgtgacaggcctgctaggagaatagcaaagtcgctgtggctgctgcagaaaaagtgagaaggaaagtagtaggagatgaaatcacagtgtgtgaggattcgggcagatcaggaagtgctcgtgtaagaactggatctttactcaaagaatgagcaaaaattagtagacggttggccggatgcagtggctcacacctgcaatcccaggttacaggaggccgaggcgggcggatcacttgaggtcaggagttcaagactagcctgggcaacatggtgaaacctcatctctactaaaaatacaaaacttagctgggcatggtggcgcgcacctgtagtcccagctactcaggaggctgaggcacatgaatcacttgaacacggtaggcagaggctgcagtgagctgagaatgtaacactgtactccactccaacctgggcaacagagtgagactgcctcaaaaaaaaaaaaaagtaggttttagtaagggattaacatgatctgaattatgttttgtcatgacttctctggctgttgtgttgagactacattgcagaggggcaagggcaaatatagggagaccgattaggatactgcagtaataatgtaagagatgtgggactctatctagaagggcccatgaggtcctttgcatgctagtattctttactgctgtgcctggccatgataggcattcagtgaatatttgcttatttaaaataacacactgggctaattgaacaacagtgccaaatgagggagatatttctaggaataagttcttaggatttatgaacattttaatccagattttctttgttaactctgctctctggccctttcactcagccccgtttgcacctaaatatgacttacaaaagaaacacagcatttatgtgtacttatttcaacttattttagctttgtaaagaagtacaaggttgactcagggcccagcttggtgtctcatgcctgtaatttcagcattgtgggaggccaaggcaggaagatattgtgagcccaggagtttgagaccagcctgggcaacacagtggaccctgtctctacaaaaaaaaatttttaaattagctgggcatagtggtgtgcgtctatagtcccagctactcctggggctgaggtgggaggatcacttgagggaaaccctgtctcaaagtggcggggctggggggagactcaggcagaattgtgaagatattcaattgctcctgactttatcaataatctaacatttcaacctaacattgatatctattttatgcaaagcattacactatgcactggagactgtataagacaagttccttttctcaaactacagtcgagttggatagataaaacacacaacacataccaaaagacagctataaatccaaggcagtgtatgtcaagggtaaattcacctattcagattggatcttgagaagtgcatcaggcttggaaaatgggtaaggaggagagaaaagcaacagtgaatcagaacatgagttcccagttatgggacttgtaatgaattcctcaattaaaacaaaaaataatgaaaacaaaagccagggaggagaaagcccacgttaatgacactaaaatatatctttccaaacaaatgtggataaaagccaagtagagaagatgagaactttgaggtccctaacagaaaataaacagtaagcagccagccattccaagtggctgacatgactttgtttaactttatttgtatttctggctggtgtgtttacagccaataggtcaaactatcagtcagtgtagggccctgagaagtcgggtatttaagagcatctaataggcacagaattgtgctccatactgcttaaactgttccctaagtgtccaatttggagaaaacacccacacgcaggataactggcgagtgacgcggagtggctgcgagtccaagttatcactaacggatggggagcttgggctgggcacagtccagcgtactgaacccttcccccaccgtttcacctgcatacagaggtgtgtactgtcaaaaagcagcgcctccaagtctcttctggcactgtctggacttggatccgaggcagacgaggaagctgagaaaaccctggcgttgaccccgtggacctgggcgccccgggaaggccagcgcttggtccaggcaggcggggcctgtgcggtgaccaccctggtcctgaaaagtcccagccccgagcgccctccctcctagacctggaggcctggaacagccaggtggacgtcggcccacctttcttttctttccttcccattttcctaccacctcccaccccactccgccttccgggcaaaggcagccagatccacccaggacacattctttgtccttatccctctgtgctcgtcccacagcaagccagtcgcggtccaaggctccagaggctgtgcaggaggccgagctgggtggcgatcagcggcgggtccctgtccaaaacccagcagagccgccagggacgccccagacacagaaggcggggcgcggggagggtggggagaccacagcagtgaggcgcgcgagccgggaagtgaacgaggactgactcctgtcgcttcccgtagccgcccacggacgccagagccgggaaccctgacggcacttagctgctgacaaacaacctgctccgtggagcgcctgaaacaccagtctttgggtgagtcgcgcgacccccggcctcgggtggcggggcagtcgctagaggcgtggctgctctgagggtctcgccagtggaggatggcattcggatgtcacggctcctaaatcaccatttgatgggtgggacagtgtccagtccaccccgacccgccggtcctcaccgcggcagagccggggctgggtggcggggacgctgcctctgcaggcgaggcgctccggggcataagggattatcaggagtcgcggcctttcttggacatccctggctggggtcaggctgtttgccctggggtgtctcctcgctgcaaacccaccccacctgggctgctttctcacctgttccctcctagcctgaggccgagcgccacctccaagtggaggaatctggggaagtttccttcccggaatttgtagtgacagtggagtgacctccattgcgttccctgcctctaacacgctctttaggatgccgagtcatttgactgcagtgttaaacattgcaaagcgcaagtcatgtgacttcctttgaccgtacgtgaaacttaagtgatggctgcttgtgatgcatacgaagtgttcatgctggcgggacctgtccctggggatacttcgggggttgcgtgatttaatgcaagcagatggcttaaattgggtcactggcttgttattatacatgtgtatggcaactcggcatccattctttttgctcttgttcttacttcctgaattgagtcacggagccagagttttgaggttttgactaacgaattaagttaatgacatggggctatatttaggtggtaaaccaagagggatacagttttttttcttaataaagaaaaagtgatagatttgatcggtgtgtattgttggtgtgcagtataatgacagaattgctggaagtaaaatacaggaagctctggtttcatttcccctttagttctgcttaaagtcgagtttttcctggagctattaaatgtagtgtagtgtccatgagtgcttttatcttaaaaaatgtggctgatgctttccaacactcccctgccctgtgattattatttttttaagcaacagagaaaaccgtatcttaatagtattaaaagtattggatttttccctactttgatttgtttaaattggaggaggaagagcaattctttctattcacaataataatagctaacatagcgcttactctttcgctgttttattaactcaatcctcagaacaaaccaatgatgtgaatactgtaattctcattttatggaaatgaaaatctaaatgaatacctctggtaattgtacgggactgtttgattagtatttaccattaattaattaaatttttttttttttttgagatggagtctcgttctgttgcccaggctggagtgcagtggcacaatctcggctcacttcaacctccgtctcccaggttcaagcaattctcctgtctcagcctcctgagtagctgggactacaggtgcatgccactacgtctggctaatttttgtatttttagtagggatgggatttcaccatattggtcaggctggtctctaactcctgaacctcaggtgatccacccgccttggcctcccaaagtgctgggattacaggtgtgagccaccatgcctggcctattttagtatttttaataataaattccatgttagaaattttctactgatgtattttttaagtcaatatttcctacactcacaatccaaaattatttagtatatgagcacactggtaagaatgggaggcagatcgttgattgtaataatattctattatttggtaaatatcagtaacataatatataatttaaattttaaaataggatatgaagaaaaatgctacatgcttacttttcttttcctctatttttactttacacagggccagtgcctcagtttcaatccaggtaacctttaaatgaaacttgcctaaaatcttaggtcatacacagaagagactccaatcgacaagaagctggaaaagaatgatgttgtccttaaacaacctacagaatatcatctataacccggtaactgatttctataagataactttttacctatgccaggacagatccaatagaatattaattatccattgggagacagggcaagaataaaagccagtgaacatatttaaagcacctactatgtaatagagatggtggtgggtgctgattacaaaacagctcttgtcctctagtggaggaagaagtcacaatgataatatgacgtgatgaaacagtgttatgaacagggaacgtctgggtagagtggagggaatgccaacttttggtgatgggaggaggctcagctaatcataaattgtagtttttaaaggaaaatggatttcttactctacaagtttttcattttcttttttaattagagctgtccatgagaagttaatgtctcgatctttccctcagcctttcaaatactgcttggcccttgagcagggaaaatgtcaaaagccaatggggagatggagagtgtgaagtagtaagggtctcgtgcagttcaggcaggtcctagaatccctgaatgactgtaattgctggaaattgccctgtaatcctgagcagtaaagagcttgttttagttttatgtggtggtgagaatctttaggaatgtctagtttccacgtatctgaagctgaatcctgaatcgaggtctgaaaaaggacagccacttttttagtaaaccgcctagaagattcttgggcaaaaggaagggtgagaatccttaaaatgaggccctaaaccagttttgttagtgtgtgtgggttcaagtttttgtcatttactttatagctgtatttcctttttccctaagttttaatgtcattgtgtaagaatgaggtatcgctgctgtatcaagcaaagtcagttttaggagaaatagcctttcagtggtagtaagtttaaaaaagatgacttcctgaagcggaagcttgtgagacatttaagatgactttgcgcatgttagagttaaaaacatcccaaggttgtaaactgatttcctgcaaagatcttaacaacaacaacaacaacaaactaggctgcctgccacgggtgtctgaagtatcatcttggctcaagctgggagaatggataaaggttacactgttcatttctgcccttcacacagaaaagaagataattttataggtaaaattcgtgcatatcttgattctagcatactgctgattcctgtagtttctggggtcagtactctcaactattgaggtggaacaaaaataagtagacttcatttcttgaggaaggggatctggagaagtagttctgcgctagagcagaaaatgccttcagtcttgtggcatgggctggatgctgttctgaggataatgcatttccaagggagatatttttggcaaatagcttttttttctttcttttcaaaattctctgttttattatcagttctcacaaaagagtcggaaaggttagaggtagactgaactgaatggcaaaaacattttgcgctctctttacgtttcactgctgtaaaatatttatagtataaagggcctgtattgcactgaatttctctcatttgtagctagttgccctttcaatgttccaaaaaaaaaggctgtaaataacttattttatttattcaattaattttttttttttaattttttgagatatagtttccctctggtcacccaggctggagtgaaatgatgcaatctcggcttactgcaatttctgcctcccgggttcaagcaattctagtgcctcagcctcctgagtagctgggactgcaggcacgtgctaccatgcccggctaatttttgtgtttttagtagatatggggtttcacagtgttggccagcctagtctcaaactcctgacctcaggtgatgtgcccaccttgacctccaaaagtgctgggattacaggcgtgaggcaccatgcctggccaacttagttatttaaagataatcaattagtatattttataagctagacttaggaaaacggttttcagctgggcatggtggctcacacctgtaatcccagcactttgggaggccgaggcaggtggatcacgaggtcaggagttcaagaccagcctggccaagatggcgaaactccgtctctacttaaaaatacaaaaattagccaggcgtgatggcagcctcctgtaatcccagctactcgggaggctgaggcaagagaatcacttgaacctgggaggcggaggttgcagtgagccgagatggtgccactgcactccagcctgggtgacagagcgagactccatctcaaaaaaaaaaaaacccccccacacacaaaacctgttttcttgaatcatggttgttttgttactgataggttcaataagtaaatatatttattgtctgttgtattctttattaggcattataaacacaccgccactttttaatttttatttcattaatgtttccaatttttttttttttttttttttttaagacagaggctcgctctgtcatccaggctggagtggagtggtgcagtcttaccccactgcaacctccacctcctgggctcagccttgtaaatagctgggactacaggcatgcaccaccatgcctggctaatttttgtattttttttggtaaagacagagttttgccatgtttctcagtctggtcaagcactcctcccgcctcggcctcccaaagtgttgggattacaggcatgagccaccatgcctggcctatttctaatattttggtccacattggtgttagaccaactgtccacattaagttttcttggaaaagatgaagtaaatattgcaactggcctatgtatttttttccctatttagtatatttctttgactagttcaactgatagaattccaagacttaaaaaagtcaggctctaaggctgggtccagaggctcatgcctgtaattccagcactgtgggaggccaaggctagtggatcacttgagcccaggagttcaagaccagcttgagcaacatagtgagaccttgtctctctataaaaatacaaaaattaactggggattgtggcgcatgtctgtagtcccagctatgaggaagagtgaggtgggaggattgcttgagcccaggaggttgaggctgcagtgagctgtgagtttgacactgtgcttcattctgggtgacagagcaagaaccatgttcaaaaataaaaataaaaagtcagagtccgggtgctgcggctcatgcctgtaatcccagcactttgggaagccgaggcgagaggatcacttgaggtcaggagttcgagaccagcctgactaacacagtgaaaccccgtctctactaaaaatacaaaaattagccgggcatggtggcggtggcctgtaatcccagctacatgggaggttgaggcaggagaatcacttgaacccgggaggtggaggttgtaatgagccaagattgcacaactgcactgcatcctgggcgacagagtgatacttcatctcaaaaaaaaaaaaagaaaaaaaaagttaggcttccttttctgtttttttttttttttctttcttctctttttttttttttttttaagagatggaggcttgctctattgcccatgctggagtgcagtggtgcaatctcggctcactgccacctttgcctcctgggttctagcaattctcctgcctcagcctcccgagtagctgggactacaggcgcacaccgccacgccccgctaattgttcttttgtattttagtagagacggggtttcaccatgttggccagcctggtctcgaactcctgagctcaggcaatccgcccgcctcggcctcccaaagtgctaggattataggcgtgaaccaccgtggctggccacttacttttctttctattgaatttgaatgaataatttggaagacagtatctttacttcataccaggaatgctgccagtgaaatttcttgtttggcagttcattatctacctatatatttaattttgctattgtttatagagttcttaagatatgattaaatgctagctggttaagaaatcatttagaaatgaaacagaattggttgttactccaagttaataagttgcttgtcaacataaatcctacctggtacccagttttcttaggaaccttgcttccatgtttatccttttctgcttagtattctaagtactccttttttaccttacaatttagtcttaaaacacaacacagtcaagtctttcttttgtaacctgtgagataccttctagcctttgtgctgtttttcttctctttttgctgcctgccttcctgactgagagtggatttcctcactaaggctctgccctctgatttttcactctcttttcttttttggttttactagtgaaattttgtctttaatgtctctttcttttatgtctttaccgatcactcatagatttttttttccatatgtatccagttccaacctttcacctaatgtgaacccccaactctcagttgctcagccagcccttcaagactaggagttcaaaaccaaacttgcatcttccttcccaaaccagctttcctcttgcagttttctgcagcaggatccttctgctgtttaacttttgcctcctcccttgtttcctagcacccaatagttggaagatagtctgtcttcaaaattttaaactacatttatgtccaaaccagtggcttttccttttaaaaaaatttaaagataatatgtgcaaatcatttttttaaaattcaaacagtatttaagagtttcagtgaaacatgcattttccttctaccctggtacttagttttactccccaagggcaatcactttttactggtttttagaaatatatccttcctgagatacttatgaatatccaaaagtgtgtgtgttgtgtatatcaccttttatatatcctgtctctttacgtgcatgcattttaccgtataaactgttttctaccctgctttttctatttgacctattttggaaatgtcattttatttagaacttcctcatttattttaacagctgcataattagcagtaaaacttatgtaagcagtcccttgtgaagggctgtgtctttttgcgattatatccggtgctatagtgtacatccttgtgtgtgcatcttggtgtgcctgtgctacgtatttctgtaggataaatctgtaaaagtggaatcactaggtcagagggtatgatccattttctttacttatttattttatttatttattcatttatttttgagacagagtcttgctctgtcgcccaggctggagtgcagtggcatgatcttggcttactgcaagctccgcctcccgggttcacaccattctcctgcctcagcctccggagtagctgggactacaggcgcccgccacccacgcctggctaatttttttgtatttttagtagagacggggtttcaccatgttagccaggatggtctcgatctcctgaccttgtgatccacccatctcagcctcccaaagtgctgggattacaggtgtgagccaccgcgcccggccccattttattatctttatttgcttggatccttcttagcttcttcaatgttaaagatattgacagttttcctcttactgaaatttataaatccattgactcccttgatattattgccctggcctgactgattcttctctctcctttctcttctcaccccatgttgaggtccccaaggtcacacccagttttgatgactcaccagcatagagttgtacttgtgcctatgatttattgcggtgaaaggatatagagcaaaattgcaaacggaaaggcacctggggtgaattccaggggaaatccagtgcaagttccaaggtcgcctcccagtggagtcacataggatgtgcttacatcctccagcaaggagttgtgacaacacttgtgaaatgtggactgccagggaagctcatcagagcctcagtgcctagggtttttactggaggctggtcacataagcaccctcacacatatcaaaaaattctggtcccccagaaggaaagcaggtgtttagcataaccatattatttgcatgaacagttcaggtacaggaaatccccgttaccagttaggttggtgggtgcccttcccaaatcccaagttcccagacaccagccaggggcctgcctcgtaaggaggcctttccaggacagcagtcaggcctgccaatgttaattcttttctgcatacctcctaattttagaaaccaccgagcctttgctgcctgacctgtcctgcttttcgatttctttatctactttgatatctttacaaatgatctttaccctgacttttaaatgtgtgctctggccattcacctagcgtgtggttctgagtctccaagtcttagcagatttgctctcagatgctctgccaacgcttcacaccaagtattacaaactaaactcgtcatcttcctcctgaaacctgtctcccaggccaggcgcggtggctcacacctgtaatcccagtactttgggaggccgaggtgggtggatcacctgaggtcaggagttcgagaccagcctggccaacttggtaaaaccccatctctacgaaaaatacaaaaaaattagccaggcgtggtggcaggcacctgtaatcccagctattcaggaggctgaggcaggagaatcgcttgaacccgggaggcggagattgcagtaagccgagatcacgccattgcactccagcctgggcaacaaaagtgaaactccatctcaagaaaaacaaaaaacaaaaaacaaaaaacctgttttctccccagctttgtcatgtatttagtggccttatgtagacagtttcctttgaaacatctcttggacttctctgctcttccagggccattgccactgacctggaatgtgtccttatcgtttcacgccaggcttatggcagcagtcagtcacccagatgacctcctgacctctggcttatttcacccccactggactgttgttcctaaacacttctttcgtatgtcactctaaaatctgaccctggctgtacctttctttaactactccctgactgcgtgctgagagaagatgggtcttgtcttttcctgcctctctgcttttgtaaactgccatttctacctgaagtggcaactgaaatcatatcttcttcataaactgtctttggctacctcagttagaattccttatcccattttcctgaagcatttctttgactcttctttactgctcccccacccttttttttttctttgagactgaattttgcttgttgcccaggctggagtgcaatggcccgatctcggctcattgcaacctccgcctcctgggttcaagtgattctcctgcctcagcctcctgagtagctgggattacagtcatgtgccaccatgcccggctaattttgtatttttagtagagatggggtttctccacgttggtcaggctggtcttcaactcccaacctcaagtgatctgcccaccttcgcctcccaaaatgctgggattacaggtgttagccactgcgcctgacccccattttttttttttttaaagatgttgaattggtcagggtttgtagttacaagcaacagaagccaactctttaagcagaaaaggaatttgctaaatgatagtgcagagttctcagaatctctagcaggatgaagaaccaggcttggagaataggtagccacagatacacaagcatactgtaggacggttcccatgaagaggcatctgttgtcaccactggacacagatggtactgtgtctctgctactctaccaatgccactgctgtctctgaccccagatgtagctccctctgaccctggatgcagctccctctgaccctcgatatagctgcccctgaccccggatgtagctgcctttgaccccagatgtagctttctccaaacccagatatagcggctgcccccttgccagagtgaatactgcgtcattgtggcttcttcttgtcactggttcttacttaaaagctgagctggaagttctaatgggcagttttgtcacctgctcttaccttgttgcagtctagatgaggtctaatgttcataagctaggggattttcagatatggaaagggataccaattttcagcagccaaatagagtatcacattttcactccatgtttcctgggtgtctgttatgtttcctgggtgtctgactcttaggcttctttcaagctgcagtctgcctaatagagagccttgcatttaatcatcaaaaaggcaaagcaatatgaatcagcaagggtgttttgggaaataacagcaaacctgactgtggcgtaagcttgtggtattgtctccagtgtgatcagatctgtattttaattttttaaatgtaaattaataatgatctgtgaatcaccaaagtagcttggagtagcctagaaaacaatgtatgtcctccgttttcacagaagccacatagtcgtgggttaaatgagtcagcggcagggcactgtgtctcatagttaaaaaaaaaaaaaagtattactgaagtaatgcaggatcttttctgaagtagaaggcatgatgaacccagaaaactaaagcagcaagtggccaccgttcttagcatagttgtttctcaaactggaacaacctataaacagttgtgaacaaggtattagaagtgatgggggccgggtgcggtagcttctcccaaagctcattacctcccaaagcaaccccagtactttgggaggatcactttgagcccaggagttccagaccagcccggccaacatggcaaaaccccatctctctaaaagtacaaaaaattagctgggcatggtggcacatgcctgtagtcccagctacttggatggctgaggcaggagaatcgcttgaacccgggaggcagaggttgcagtgagctgagatcacgccactgcactctagcctgggggacagagtgagactctgtctcaaaaaaaaaaaaaaaaaaaaaaaagtgatgggaatagattgttttgtctcaaaaagctctttccaacactaaaatgaaacatataattaaaaatatttttctggctatagaaatatcgatgcttattatagacatctgcaaagtatgaaaatatatgaagaaaaaaattaaaatcccatcatcccccatgaaaactattgttatcatttttgtctgatttctttagtgtttctctttttctttttttaatttttaatttttttgagtatgtagtaggtatatctatttatggggtatatggcatattttgatacaggatacagtgtgtattagcaaggttttctttttaatgtttatatttatttagttgagatcatactatatatggctctatagattactttctcacttatattactaacttgtgttattaaatattctgcataaagataattttaagatgaaatttgatgttataaaaacttctcattttattaagagattaacgctatgaaacctgctgctatatattcttggaaccagctgtgacccaaaagatcaatgtagggatgtaggtccttccccattctctacacacaaaatcagatactctgatgtgcagctgtagccccagtctacactgtctgttgtattttttgttttctggtgtcatgtgcctcccaccctgctcctagcaattgccatgacaacaaatagataattggcttccgtaatttctcatcttattgcctaaggcaacagagagcttgtgggctcagcttgcggttcagcagctgctttgttgcctctcctctgtatgtgtgaggcctgccagagcccactttccagacaggtgagagttcattcattcaccatgcagttaccgatcgtctcttgacctgtgtcctggggaggtaaaggtgatgagccagttctgccccatgcagctcacagtctaggcaaagctacatgcaaacaaacagaatccaaagtgctatcatgaaccctctgagaggggctgactcagcagcccagggagcttgaagaaggctccacagaggaggctgtgcctcaaggcgatttcggtttaggagccaccaatttataaccacttttctgtggcccgtcttattttatttcttatttcttgacaatcagaagtaccttgggtaggttttaccatgcacatcgtaatttgagtgagcttagtgtgaggcttaacggtgtgtgggctgtacatcctggtcagatgctctagatggaggcagatggttgtgatgcaggagaggcagccacatagcacaggtccccagccagtggactgggaagacagtgtagtcatctctggggaaggggaatgacaagatctggcagtgtggcaggtcccagaaaaaaagggctgggttctgggcagtgagggtgcaggttgagacctgaatactgggtggagccagctgtcagagtccacgcctgcagactggactggtccacggcaggtggatgccatgtcttgaagacccacaggcacccactcatcctcatgatcatgcagttctctggtttctaacagtgcagtctgggttgcagtctgggagtccagcagagaagagcaggccctggaatcccaggtgtgggggcgtggcttaacgtggagtttccttcagaggcagtgagtgcttgtcattgtctccgtcagcattggctttgggcctagtgtggcctcgaaccttctgttgggatcagcagtggaacagtaggaaaaggaatgagtagacatggcattgcaacaagtctttttttttttttctgttagaattatcatattaagcagaagttttgcttcacaaactctcagccaaatacaaaatactatgaatagtatttaccttgtgtctctttccaaagaactcatagtggtttgcagctattgcagatatcctggccatgaggtatgcagttcctttttttttttttgagacggagccttgctctgtcgcccaggctggagcatagtggcgcgatctcggctcactgcaagctccgcctcccaggttcgtgccattctcctgcctcagcctcccgagtagctgggactacaggcgcccaccaccacacccggctaatttttgtatttttagtagagacggggtttcaccgtgttagccaggatggtctcgatctgctgacctcgtgatcctcccgcctcggcctcccaaagtgctgggattacaggcgtgagccaccgcgcccggccgcagttcctttttctagctgtttgaataggaaagatgacttggaaaatgctggattctgagcagatttatgtgcagccttaaaaagtgtagtttttctctatcaataatgagtgtgggttgtaattgcttagtaagtaattttgtttatgtaaacgtacatttgttaaattttttttcttaggtaatcccgtttgttggcaccattcctgatcagctggatcctggaactttgattgtgatacgtgggcatgttcctagtgacgcagacaggtaaaatcactgtgctaaaggaaggagcatgaataggctgtctttttgtgattgtggaatgataacagagtaaggcgggagagaccatttgatactttgaggcccaattagctttcatcagcagccctggccaaggtgctgaggagattggaatgaatgactaaataaaggttattgggatttatttcattgctgtaagtctgatttcagtataaaaaattagaactatcagctggatgtggtgacttaaacatacttttccagcactttgggaggccaaggcaggaggattgtttgaggccaggagtttgagaccagcctgggcaacatagtgagaccccccatctgtaaaaaaaaaaaaaatttaaaaattaactggcttggtggtgtgcgcctgtagttgtagctactcagggggctgaggtaggaggattccttgagcccaggagtttgaggttgcagtgagctgtgatcgagccactgcactatagcctgggtgacaaaaaaaaaaaagaaaaagaaaaagaattaggtatgtcattaaagaaaggaattgtggtcagatgacagggacagtctagttttagtctgacattcccacagcattacagatctagttcagatggttttactgaatacctgctttggatacaagctgtggtatcattagtgttgggctcagctctgtgtacctaacacctgaagagcagtggtttaagatgtgaaaattaagtctcaaggagacagcccaggccttttcagttaactccttcaagtcgttagagaagtagactccttcgagctcaccactctgttatcttgagggtgaggtaaggtcccctttcccgttttccttggcagccagatttccagccctcacttctgtgctttgggtagctggatgggtgcatgtggtgtttgcggggaaacagagctggacaaaaggcaagtgcttgctgacttctaaggcagtttccagtagccttccctgagcacttcacttccatcttaccagcagagctttagctgcacaggcaggcctagctgcgagggaggctgggaaaggtaggtttttattctgggcagattcagacccagttcaaactcaggggctattttactgaggaagacagaaaagattagacagtcagctctttaggcctcatagtgaatgaatgaggagggattggtcagtcccttgtcactgggcctggagtgtagtgcctgctggtcctttactggtggctttcctttctgagcactcatggggcccctgtgtcttccctcatatagattccaggtggatctgcagaatggcagcagcatgaaacctcgagccgatgtggcctttcatttcaatcctcgtttcaaaagggccggctgcattgtttgcaatactttgataaatgaaaaatggggacgggaagagatcacctatgacacgcctttcaaaagagaaaagtcttttgagatcgtgattatggtgctgaaggacaaattccaggtaggttttggagagggacaggttgagtcctcattagtgagcaggagtgcacaggggtgcttttcacatttgtgagcccagccttatatttcctacacctgagatatagtttgtttggctttgtagtttttctccataaaaggaccaggaaggcacctaaatgtgaggtatggcaccactactctccagccagttgttgccatgcagaaatatggtccactgtgaccagatctttttattagatcctatttctcctagcagggctgagttccgaattgacacagtattatgttcatgatgggagggtaagttataatataaccgccaccacccgaagagctaacaagggcaatcccagcgaagaaatcagaagggttttgtaaattcaagtcttgccacaagacagttccgtaggatcatgagattttagacccagaggagatcctagaaatccttgatgtcagttccatctctggcttcatggagtgtcttgtacctagcgtgtatgtgtacggttgaatttggtcccagaagcttacacctgctggccctctggcctgtggagcttgcccacagtagaggtatgtaccaacgcgagagaagactcgaatgcctctggcgcagatcctttctgatcttcgggatactgctcctgcccgaaagtctttctgaatctcccaaactccattcacctctcccttctctggccttttgagcccgtgtctgtatcattctttttcacagtttttaacagttgtgctttggctttacgtgtttattttgcctccacaatgggattttaagctccctgagtcagagactatattgtatgctgctcgcgttttctgcctataacctaacgtggtacctggcatttgagagggagggaggaggagcctcgtagcgtgccgaggacctgcagaagctactttctcgtcatcttactgtagtctgttgaggtagagactgttcctacttcagaataagaaaaccgaattcaaatatgttgggtaacttgtccatattaatttatttagcaaatacaacagattttgagtgtctgccacatgggtggtctccagggacagtgttgtggggagctcgcaggcagatctttaacctgggttcacaatctccagggcacctgtgcctgggcttccaggcgaccttcgaacccagatgtctcacatgtatgcagaggcgcacacaagcacacgcacatatacttatgactgcctgtttgtctggggagagacagttcctggtgcttaatcaaatcaggaactcaaaagaagtttggaagcactgctagtgttttgggtgctttcggttaccatttggtcatgtgtgtggagacctgtgggaacaggtataaaactggacgcaaggaaacatttaaatttggataataagttaatttattaactgtttttttttggtggcggggggggctctgtcttctgtatctctctaggtggctgtaaatggaaaacatactctgctctatggccacaggatcggcccagagaaaatagacactctgggcatttatggcaaagtgaatattcactcaattggttttagcttcagctcggtgagtgaccttccacagcttggggtcttttatgaggatggtttctgatgagatggtagaaaaaatcttcaaataacacttctattgacataaaaaggacgtatctccctgactgtagtattaattttttggaagtgaactgttcacactagcagaaggctgtttatcagccagggcttcattgtctgtaggatctcaaacctagtgtggttttaataaaacacacacagtttttagctgggtagcagctatttcctttgcatgggcataaaatggagtatttctgtaagacaggttcctaggctgggagtgcctgagtcaaagagcacagtcatgtgttgcataaggacagttcagtcaaagatgaaccacatatacaaccgtggtcccataagattgtcatatactgtatttttaccataccttttctatgtttaggtaagtttatatgcacaaatacttaccatcctgctctggttgcctacagtatttggtacagtgcctgctgtacagattcactggccaggagctataggccacaccctacagcctaggtgtgtagttggcagtaccatctaaggttgttaagtaatattctgtgatgtttgcacgatgacaaaagtcatgtaaggacacatttctcagaacatacccccttcgttaagcaacacatgactgtctttgcattgaaaattttgatagatactaactcgcccttcacaagggtaaaaacagtttgcactctcaacagccatgctcccaccttcttgctgacattacatcttattctctgtaatgtttgccaatctgatggggggcggaaaggaccacagtgtcaagtgtatttttggatcatagttttcaagcatatttttagtaccatttataatttttttatatgtcaatataaaatatttagaaaatattttctactggatgttacaaattaatctttattatcttttctcaggacttacaaagtacccaagcatctagtctggaactgacagagataagtagagaaaatgtaaatattaaatcttttaatgagccactggtttaaaaatgttgttttagctgccatgttaatgaaatggcaagaaggctgggtttttgaaaattatgcttttagaacgcaagtaatcacttgaaaattgagatacatacttgtggtgccaggcacgcagtaagtttttgctgatgattcacctgtcagtttctgtaactgccactcactgttcttatgtaaaaagcactctctcactcttaactgctgaatagtactgttctggggtatttccaaatattgaacatcagccagtgcactggcaaatgaacttccatgtgtatcttcaacccctgggagaataactgcaatttaaaaatgcgctgttattaatggagaaagtgaggtcttaccgactggcacgttcacacctcacagacagaacagaatcttagcattctgggggcaccctggaaaggacaactaagacacgtttgaagttcatgtagtgctgggtgaaggtggtggctcaggcctgtagtcccagcgctttggctgaggtggggggattgcttgagcctaggagtttgagatcagcctgggccacatagggagaaccccatctctacaaaaaattaaaaaattatctgggcatggtggcgcatggctgtgatcccagctttgggtggctgaagtaggcggatgacttgagcccaggaggttgaggctgcagtgagccatgattgagccactgcatcccagtgtggatgacagagtaagaccctgtctcttaaaaaaatttcatatagttctatgaaaaattattaatttatggtggaggataaaggactcagatgaacagggatatcagactctcttctcaacccgtgtagcccttcacaacaccataccattccgtcataaagcaccagctgcctggaggtcacaccagagtggagcaggaacatcccaggctccggccaggctcagctcagcacaaccaagacttcagattataaactataattcttccccttctaacattgttgtgttttgtttcttttccaataggttccaaagtctggcacgccccagcttgtgagtatttttgcctgggttatttcatgtggaatattttataaagttgcatagaaaatgaacagtttaaaccgtggagggcagcttcattcattccattccttactgtagaactgtttccctacagcctagtaatagaggaggagacatttctaaaatcgcacccagaactgtctacaccaagagcaaagattcgactgtcaatcacactttgacttgcaccaaaataccacctatgaactatgtgtcaaaggtttgaagagcaccaaattttcttaactctatataaaaattaagttgtaatgagctgttacgagtaacctgtatccacaatagaggcccaaagcagccccctctgcatttgtgtgccgtccctggacggattcgagagtcaaccaggcctgcctctgagccattcctgtgtatttcctcagcacctccctgcttggctgcttccccttcaggcagaacacagtactgcctcagaccccaggcacagggggccttcctggcgtgtttcactcatacagagggcatcgggtcccaccctgtcactcatttcatcgtctaaaatgtaatcatgtgtgtttgcttcgagccagggacagtgctgctgcaggggacccagctgggaccaaggcagactgtctctcccctcctgggatttacagggtcatggctctgaaacattccgtagtgttctttggacacgagttttccctggagatcgctttctgcaggcctcttggtcctgactgtggcttcttttcagaggctgccattcgctgcaaggttgaacacccccatgggccctggacgaactgtcgtcgttaaaggagaagtgaatgcaaatgccaaaaggtcagtatccttcggtaccagtcacagtgcagatacttccgtgcctgttaccgccttccacccgtgaacggtcctgtgagctggaagaagggctagcgtcagaatcttcatttccaaagtgagatgattcaagcaggaggtggttagattgtgaacagccagtgggcagcagagccgactaaggccgtgttctgacctcggctttttctggccagacaagagagtagcatttttgtccacgaggcctatccttgccttgtagaactccagagcagccccgtaagatcaggcaacatcttttcttttttttttttgagatggagcctcactgtgtcacccaggctggagtgcagtgtcacaatcccagcacaccacaacctccgcttcctgggtgttcaagccattctcctacctcagcctctggagtagctgggattacaggcgcaccaccacgcccagctactttttgaatttttgtatttttagtagagacaggggttcaccatgttggccaggctggtctggaactcctgacctcaagtgatccgcccacttcgccctcccagtgctgggattacaggtgtgagtcaccacgcccagcccaggcaacattttttagggcccctcttgtcatgtgatttagaaaatttctgctttaacaactttttccacagacgtccagccttctgaaagcttgaaattagagctatttcctagaaagtggcatactttcaagaaggaaggaacacgggtagatgatgaaaagagaatacctgcttgagaggatcccaggctcctgcagcctgaagtagtcattcagtttagcgttaaaccttccatttctgtccaaccacatctcagcctcaacgctgattttaaagggttttttttttcgtatttttattttgcaagtaacgaattagtggaatgctgactgggtttaaaatttcaacttcacctgcattcccatgtccatgtggatacgtgtgtttcatagagttagaatcatagttcaagtctggtcactaacattgctgaaattgccactactctgtcctacttggttaattaaggtttttttttttctttctttctcaaaagctttaatgttgacctactagcaggaaaatcaaaggatattgctctacacttgaacccacgcctgaatattaaagcatttgtaagaaattcttttcttcaggagtcctggggagaagaagagagaaatattacctctttcccatttagtcctgggatgtactttgaggtgaggttacagtttttgaaaatgggacagcaataagaatcctgggagcaggggtgggataagtggtccatttaaatcaagtcctaactcagtatgtggaagttgtgtatgttttttgtttacttggagattgtaatttgcccctttttataacgtgggcaatcagtataaatggcaaagccagtagagtgtcaaattatgcacattggaattgacatttgtcatcatattaaaattcctgtgtagccccatattgataggaatttaaccaggaagcttgtctcaggactggagtcacacatttaatcatataagcagacttgaggacgtggagaccctaaaactgcttgcttgcactggccatcatctcccatcagggtagacggtttcaggtggcagtcctttctcctaaggagttagtcttgtttgtatgtattcaaggaaaaatacatcagtcccttggaactaaaaggcatgcagtcctgagtccccagataggtgaatattgtaacacatacctttcccgaaatatgtttctgggatgctgagcagagaatagtctccttgtgatgcggatgccgggtgtttggccagcctcaatcaccagctcaggtgccactgcctcacacagtcacttagggtcattggtttaggttatcattctacagcattttaaactgacacattgtctggaccatgtgggttcttgaggactcatcaaaactcgttactaaaagcatgaatatcaggcggaatagatagcaatgtgacattcatatttatccctaagttccagtctaatgcagtgccctggtatgtggagtgtagacagatgtgggctaatcatggaaggttccctgaagttgtggatattggtttggaattcagaaagctgggaaggatgtggaaggctgaaggttggcttttctagatttagggcatgatttgaacaagtccttagaggtgggaagggcagcacagggttgttagcttggcaagagtcaaggcgcaaagggtgacttggggttcactggagggaaacagaggtgagtgctctagaaggaagttgagccttgtggtgggtgacaggaaaccaatgatgtaacttgtttttgacctatctgggccccaagtttggatctgctatattaatataaaaaaggataataatgatacattcaaataatgctgaaaaatactaagatgaaaatacctccaacttcataattcaaaccataccattaggattaggtgaaccacattccaggcatttttttgcagagacagtgaaagggatggctggctgaaggaatgaatagatgaatgttatatgcttttgaacaatcgtcttttccatttaattttctaattcaggagcagtaattatccttgtgttgatcactgctgacgattttctatactgataggtcctttccgggggcttccatctcttgccttttaaatatgcttgcattgagattatctcaggtctttccattatgccattactttcattttaaatcttcttgctctttcaaatacactttagttgtatctacagttttttaaaaacaatctcattcagtgttgtaatttcatctgtgggctcttcctctggatgaaatccgtgttccagctgttcggcagcatcagatggttgtgagggattctgttgttctgttttcttctaggcaaaggatgtgccttcttttcatttgcagtagtctgctcacccggaagcatgtcatttctttgccacttgcttgtaattcactggctttgcacttgctctgatacagtacaggtaactaattgactccctctgctgccaacttggttttccttctgagctatagcatcaggctgtgtgttttgtgttttcttgagattttgttaaatatatctggggtcccttctacctggttggaactgggattcccaccattcttgtggggatagaatctcaggttacacctatttccccaatcctctgtagccacagaagcttcatcttggccagctgttatcagagtgcaggacttgggctgaaatttcctccccttcctgattttccttgacagtcctttccactgctcctatcaaaagaatggaaaccctcaacttgctgctttgcagattcaggttttgtgcttcattctggcctctcggggtggggccgggttagcagcaaggctgagctgcccctctttcttctgaagccttcatgggggcgaggagcacagggagagctcagtgcagggcctcccagtggccttctcagagtgggtggaaacccagcctggcactggcagcgtggcaccagaagtatgaagtgtaggtgtaaaggtgatgtaaaaggctagtaggttttttggtttttcattgtttgagttttgggcatagatgactgtgaagggcgaacactgccgatggatctgaatttgtagtatgtgcaccacttccaacttacgggatacccagctttgacggctttggacaaacacactgaggccaagatgtgctgagcttatcaggatcaggatcaccaagcagctgtaaaaaccctagcaagtgccttaagctgctgaaatttcatattaattgtctggtttgttcatggtcctagagtttgaggcagaaaagtcagtcaggatccaagtcccttggttccaggctacagctggaaacagcatctcggtgaactaaagcaaccatattaggagtgagttttcctgctttaggagagtccccagcatcggcgaggaggggcagcactctggctttccaggagcaaggggcaggatgcggccgagggagaggggctgtgttgaggaaaggagggccgcaggccctggggatggtgtgaggctccaaacatgtccgagtcacttccctgggtgggatgaggcagacagtgccaccaccagggacactttagttagattagggtcttggaagtcagaaggaagtcagcagcagcaggctggaacttttctatgtataatcaaatggtttactctgacaccgttagcatgtaacaaacacaaaattttaaactaaggggaaccactaatggcatgtatcctttcctttcagatgataatttattgtgatgttagagaattcaaggttgcagtaaatggcgtacacagcctggagtacaaacacagatttaaagagctcagcagtattgacacgctggaaattaatggagacatccacttactggaagtaaggagctggtagcctacctacacagctgctacaaaaaccaaaatacagaatggcttctgtgatactggccttgctgaaacgcatctcactgtcattctattgtttatattgttaaaatgagcttgtgcaccattaggtcctgctgggtgttctcagtccttgccatgaagtatggtggtgtctagcactgaatggggaaactgggggcagcaacacttatagccagttaaagccactctgccctctctcctactttggctgactcttcaagaatgccattcaacaagtatttatggagtacctactataatacagtagctaacatgtattgagcacagattttttttggtaaaactgtgaagagctaggatatatacttggtgaaacaaaccagtatgttccctgttctcttgagcttcgactcttctgtgcgctactgctgcgcactgctttttctacaggcattacatcaactcctaaggggtcctctgggattagttatgcagatattaaatcacccgaagacactaacttacagaagacacaactccttccccagtgatcactgtcataaccagtgctctaccgtatcccatcactgaggactgatgttgactgacatcattttctttatcgtaataaacatgtggctctattagctgcaagctttaccaagtaattggcatgacatctgagcacagaaattaaggcaaaaaaccaaagcaaaacaaatacatggtgctgaaattaacttgatgccaagcccaaggcagctgatttctgtgtatttgaacttagggcaaatcagagtctacacagacgcctacagaaagtttcaggaagaggcaagatgcattcaatttgaaagatatttatgggcaacaaagtaaggtcaggattagacttcaggcattcataaggcaggcactatcagaaagtgtacgccaactaagggacccacaaagcaggcagaggtaatgcagaaatctgttttgttcccatgaaatcaccaatcaaggcctccgttcttctaaagattagtccatcatcattagcaactgagatcaaagcactcttccactttacgtgattaaaatcaaacctgtatcagcaagttaaatggttccatttctgtgatttttctattatttgaggggagttggcagaagttccatgtatatgggatctttacaggtcagatcttgttacaggaaatttcaaaggtttgggagtggggagggaaaaaagctcagtcagtgaggatcattttatcacattagactggggcagaactctgccaggatttaggaatattttcagaacagattttagatattatttctatccatatattgaaaagaataccattgtcaatcttatttttttaaaagtactcagtgtagaaatcgctagcccttaattcttttccagcttttcatattaatgtatgcagagtctcaccaagctcaaagacactggttgggggtggagggtgccacagggaaagctgtagaaggcaagaagactcgagaatcccccagagttat

SEQ ID NO: 37109 - DNA, 30198 bp, Homo sapiens
cagcagccagggccgcctcttaaagggaggtggccggccttaaaggacccccgcgcgcccagccggcgggagcgcggcggcccggctcccgcagggccgcgccgaggcaggcgagcccccgcggcgcccaggcgcgggcccgggcccccgccgccgccgccgccgccgggcgcggcatttttattcaggcgacgcttaagggagcccggccgcgcccggtgcattgtgggagcggcccgcggcccgttttcgggaggaggcggagggcgcaaagcgagccggtaagcggcgggcccggcgcgggggggaggcgcaggcttaaaggggaatctgggtccgcaggcccgcggcggccgttgcaaatccccctccgggccgcccgggaccgccggggagccgcgcgccgccggccccgccagccctgcctggagaggggcagcgccgggcttggtggggccgctttaaaaaagaagcgccgcccgcgccgccgccgccgccgcgcggggccggggaaggagggagggagggcggggaggagcggaggggagggcggcggcggccacgcaggggttaattttttcgcccgccgacatttttgcgcggcggcggcggcggcccgtgcgcgcggcgggagcggccggcctggggtcgcggggtgcctccggggcctccccgcctccccttttctccgcgcgggccctgtcgacccggggcgggtgcgtcccggcgtcctccccggctcctgggccgcacgcgcggtgcccgccggctcccgccgcctcccgccggcccgaacagggatggcccggccggggccccgagctgccgcctccgccccgccgccggcccgcagcccgggcctgctgggccttccgaggcggcggcgagggcctgagcctgagcctgagcccgaaggtgtccccgggttccttgctcccctccccggccgcctccgacgcgggcgtcctggagagcgcgccccattgtgcggggccggcggggaggtaggtccggggttggcggggcagcgcgccgggcccaccccgctgaccggctccccggctccccacgctcgttggaagaaaaaaaaaaaccaaaccatggaaatgtgcccgggaaggaaagggctaaacgttgctttaaatattcatgccattgttttaaaggcgtaaacatgtggctgcggggtcgccgggcaccgtcccttattaatgcaaatggatccccctggttccctaatcactgcacatttcccccagaaccccctcccccttcccatgccctccaaaaatgtaagaatctagtacttttttcattaggatgtgaggctgatttgtgtccttagtaccatttggaattttaaatctgagcgccttcctgatacaaggtgttttaaacttttttccacccttaaaactcttgagaagatagtaatttaaaaggaagtgatagccacacaattcccctccccacctttttgggagccaggagaggaatagataggaggtaggaaaataactggatgcctcgtgagttggattttttctttttcttttttttttcctggtaggggtgaggctgtgttaaatgcgaggtgttttttgaggaaaggactttgttgtttttgttgaaaacgccttccaagtcaaagtggtattcaaactttcccataactctaagatggcttcaaaattctcgtctcttgtcacttgcggccagcgcctgctctttttgggcagggagacttcttggaatcgtgttcgaaggctgactcctgctcagttgttacgtttcccaccgaaatcattgctcatcccaaaccgtgtttttgtgaagacggtttggattactgcccaaactcgggcttcgtgagatttatatgagcgatgtgcgtcccaagggatggaaaactctataaatgggaattatgttcttaatcataaattttataggggaaaccgaccttaaaacttggggtgtttgtaattctagtcccaataaagtatcagtctggaggtttgtaaactcgaggaacacatgttgttttttcctttagccccaaaggctaaaaaacgtaggagtgcttgttccagaaacctaacggtggtacacagggccgaaatgctgctgatttagtatggcttaatttattgtttcggttctgcaatgaaatgttaatgaggagtagcatattttgtcaatgatgtgtgtactagtttgttgggctggatgttttgctttctaggaaatagcactgcgtgaaaacatcagagaactttccaggctttcgcctgaagaacacagaccttactgtgttaaactgccactgtagtttttaagttgtgccctttagagaggactcctattagttttggattgcattgtgtatttttttattttttatttgagacggagtctcactctcgcccaggctggagtgcagtggctcgatctcggctcactgcaacctccgcctcccaggttcaagcgattctcttgcctcagcctcccaagtagctgggattacaggtgcgcaccaccacgcccagctaatttttgtatttttagtagagacggggtttcgccatgttggccaggcttgtgtcctgacttcaggtgatccacccgcgttggcctcccaaagtgccgagattgtaggcatgagccaccacgcccatccttgtgttgtatattctttgggctcagagggaaaacgtgtttttctaaaataaggatttagcatcgtgaagaattttgtccaatgcatttacattaatgcccttttctgacaagtttgtatcgggcgtttcattcttctgtgtgataaagcaaaagatatcaaaagattttgcggaaaagtcaccttagcgaggaccgccgctttctgaaccacagtgcttccaggttgacacatgaagtgcccagaggtgctgttctaatgctgagtcctagaagaacctttgggatttgctgttcaaggtggcacggtgtcatgtgaacctgcaggctggccctcttgccacagttaaaaccacagtccagatgtcagattttacatagatgtctgtgctgacgcagtcccgttatgaaaagatctattttgtcatatgcactgctgtggtgaatataagtggtcttgatgatttcagcccttgtcacattgacttttcgctgtcatgtattcacttgattcgctggcaggtcccagtgggaattcttttcatggcatctttgtgttttggtgacacccaggtggatccataaagaacccagccaacccgcagagggaggggaggggctgagctgtgaggagagcggggcccaagaaccatgtctacgcgggagtcctttaacccggaaagttacgaattggacaaaagcttccggctaaccagattcactgaactgaagggcacaggctgcaaagtgccccaagatgtcctgcaaaaattgctggaatctttacaggagaaccacttccaagaagatgagcagtttctgggagccgttatgccaaggcttggtaggtaacccagtgtttctttgatggtctgcgatccaatcagtgagtcaaaaactggatttctcgcctcccatgttgcctatttattttttattattactttttttgcttttatagatttgaggaatacacatgcagttttgttacatgaatatattacataatggtgaagactaggcttttagtgtagccatcacccaaatagtgtacatcgtaccccctttatttttttttaatttttgtgggaaggattagaagagcaatcaatgttatgattgctatgttatgttcttgtaacttatgtagagaaagtacttgaaacgcatcaagaggggtactcttgacagtttttaaatcatggagtatgcaattgagattgttattacagtaaaaactttttaatttttattttcaatttaattgaattgaattttctgttagctgaagattaagcagaaatactttattcccttttcctaaaaggactcctaaaatgctcacattcccttcattgccctaggaaaggcggttccagccttagggttcttgtgctgtacttggatggcagtgactgtgtcaggagggcattggggttctctgcagggtgcatcgggcgaaaagcgtgttacggtgaggaggtgggactgctccagacccaggactggatggatctgttcttgaccccaggatgtcatctggaaccagggcaatgtctttttctttactacattcctgatgtcatgagtgatttcacttttcccaaacacagagcttagaaacaaattctgggctcctgggatattgtttattcatgtttcttgtgcagtttattaagtacacagtacaagactgtgatcacttttcttgtgttcgacgcatagtttcggaggtttggatgttcgataattactgtgtgacttgatcagttttcttcctttttttttgaaatggattctcactctgtcacccaggctggagtgcagtggcgtgatcttggctcactgcaacctctgcctcctgggttcatgcgattcttctgcctcagcctcttgagtagctgggattataggcccctgccacatgcccggctaatttttgtatttttagtagagatgggagttttaccatgttggccaggctgttctcgaactcctgacctcaggtgatctgcctgcctcagcctcccaaagtgctgggattacaggtgtaagccaccacacccagccaaggttttcatttcatttgtttttgcccattatttggtaaggttcattggttatgagcctggggtctcctttactcccagatagagaaagcagataaaagcagacttgcttttgttggaaaggaagaaatgttacaccccagtcgctggtgacctgcaggactttgaggagctcagtttgaaaacagttcctgccgtccagctgatggccaagctgtggagaaataccatgtgagcgagctgggtttgatgttggcttatttgtcgagaaatgagaatatactgaggaagctgttagataactgtcaagaaaaaaagctattaatacttaatgctcaaaaaccaatgaaattaaaacattacggcataaagtaagaattactatttataacttcctctggcacagttacttactagtcactcatattatgtcatgaatgtcacccagccctcctgagcctcagcttcctaatctataaaataataattactgtttggggttgggtgcggtggctcacacctgtaatcccagcactttgggaggtcaagatgggcagatcactcaaggtcaggagttcaagaccagcctgggcaaaatggtgaaacccatctctactaaaaatacaaaagttacctgggcttgctggtgtacacctgtagtttcagctactcgggaggctgaggtgggaggatcccttgagcccgggaggcagaggctacagtgagctgaggtcacaccactgtactgcggcctgggagacagagtgagaccctgcctcaaaaaaaaaaaaaagattactgttttgcattgttgtaccaaaaatgtgtgtaggtgtgccatgtatgtctgtacttacatatataatacatgtatgtgtataccctctgtacacaagtatatatggtatatatgtatgggtgtttttgaccttttttttgttgttgttgagatgaagtctcactgtgtcgcccaggctggagtgcagtggcacaatctcagctcactgcaacctccgcttcccaggttcaagcagtgatctcctgcctctgcctcccaagtagctgggactacaggcgcatgccaccacacccagctaaatttttttgtgtttttagtagagacggggtttcaaggtgttggccaggctggtctcaagctcctgagctcaggttatccacccacctcagcctcccaaagtgctgggattacaggcgtgagccaccgcacccggctgtatgtttatttttttaactttttttttttttgagacggagtctcgctctgtcgcccaggctggagtgcagtggcgcgatctccgctcattgcaagctccgcctcccaggttcacgccatcctcctgcctcagcctcccgagtagctgggactacaggcgcccgccaccatgcctggctaattttttgtatttttagtagagacggggtttcacagtggtctcgatctcctgacctcgtgatccgcctgcctcggcctcccaaagtgctgggattacaggcgtgagacaccgcgccccgccatcttttttttttttttttccttgagatagagtctcactccatcacccaggcttgagtacagtggtgcaatctcagctcactgcaacctctgcctcccgggttcaaggccctcccaggcctgattctcatgcctcagcctccctccaagtagctggaatgacagacgtgcaccaccacacccagctaatttttttgtatttttaatagagttagggtttcactatgttggtcaggctggtctggaactcctgactctaagtgatctgcccacctcggcctcccaaagtgctgggattaaaggcatgagcccccgcgcccggcctgtttatgtttttaacttttttctaattgaatgtcatgttttctggcttcaaaaatggtgttaattgaagggttaaccaaaacagcttttaaatgtacacacgattactaaatgtatcctaattaaagaaatggtaaaagaagtgtgccttagaaccagagacatttgttgcctggtgcctaggagctatcaagtaatgattgctgctgctggcgggggcggtgcaggggttgggggtgggtagtggtgtgataacttaggttgtctttctgatggaggatgtcagtattgctgaaaaccttccagcaagtttgcccattgcctcctggtcattaaacctaaactgttctgtctagtatttaaggcttccccgaccctgtggcattttcctctgttcccagttaccatccctctggaccgtccctctgtctttccatttcaaacgctagtttttcaaggcctgtgggcatctcaggctcaccccttctctcttccttccttgaaatgtgattggtgatttctaaaccaatcactgtagaccagtgctgtccaaaaatacaatgcaagccacatgcgtaattttcaaattcaaagtaatatttttaaaaacccgataacaaaaatcaggtggaattaattataatctattttatttaacacaatatataaaaatgtcttttcagtatgtatatatacgacattattaatgagatgttggtttttggtactaggtgtttaaaatcagttgtctgttttgtacttacagcacctgtttgtcagatgcgcagccaccccctgtgtctagtgtcaaccacattggacagcaccagaccctattctagtagactgtggtggcacaggtgtgaaagagaaaccgtggataacggagctgcttttcagccctaggggcgtgctcaagaatcccccgttactctgatcaaaggacttgctaagtttagaaataaagcgctttacaaatcaaatgtatgtaattcaaatttaagattattcaaattaagaacatttaaagctaacattcagcaacaattttagtttctctttcagtagtcctccagtttaaatggaagcctgaaagaaaactgcctcttactgttttccaaagtgaataataatatactcagaataaccagttgtcagaattatccatttagggagaatccattgagttaaagagtggtatttctatttaggtgctaaagagtgtgatgaaacaaatttctgagaggttgtgcccatgggctgtttacgtgaattatctcacacgttctcctctgacagatgaaaactgatccagtgcctgacattgttgaaacttgccattctgaacttcacttctccattccctaagcgaggtcttccagcaagagtttctgctttgttatctagtgtgataaaaatcagcctgtcttcacagactatggctttttattgagtgagatttcatttttgcagcaggaaagatctggtgcctccatgacccgcctctgtgaggtctgctgctgtcatgagaccgagtgaggcagtgcttcacggccctttcacttacgcagaatattaaaggtcgttttagtgcgattcagatatgatttaaacttgtttgaaattctgaatttatagggtagattcaggcacataatttgcttccttttgtcctaattctggctttttccctgcttttggctattgggctgcaaagtagaagtacagcatccccctctgtatctgcagaatcctcgtgggggattcaaccaaccacagactgaaaatatgcagggaaagaagtggatggttgcatctcaacatgcacagacttttttttgtcttgtcattattccctaaacagtacagcataacaaatatttacatcgcattcacatcgtattgggtgtcataggtgatctagagatgatttaaggtatgtgagaagatgtgtgtaggttatatgcaaatattgggacatttcaaatcagggatttgagcatctgtggatgttggtgtctgtgggagtcctggaaccagtcccccacagataccaaggaacagctgtcctcataagaggacagaagagtgtccttctgaggggtgtagggctgctcactgtgttcagctttcttggtgggaatgctagtctgagtttgtaaaatgcctgcattacaagtaatttttaaaggagtacagccttatctccaagacaaggagtagcgtatcttgactactactggtggtcttgggactcctctgacatagatgccagagtgtttatatccaggcttgattggaaatttccattgaattgtagattgggatttgtcctttcatttcatctgtgtgtgtgtcattttcacttttgactaaaatgtataagtaataatagcatttttcaatgtaaaaatattttacatggtttctgatgggacaatacgataatgtctgtaaagatgtacgcacaataactatacttaagataacccaagttccatttataggattctcatcttcaaagaaattgtatacggtaccagtcacacgctacagtaatacagtaaaataataaaagtcatacagtgaaaaagatttttattcaaggcatcattaaggattaaaactatgccatattggagttgagtcttgatgagtaacattttcattggtattttccatcctaagctggatatgtttcacgtttatttcagttacgcttcttgataggaaacacatggcttcattggcagcctgcagtttccataagtatcttatgagctcttcctgttcagagcactggtgatataaaatgaaatggctttcccgttttatttttggatgctaatgacttccatctccacaggcattggaatggatacttgtgtcattcctttgaggcacggtgggctttccttggttcaaaccacagattacatttacccgatcgtagacgacccttacatgatggtaagcgtgagccgatgtgtttttgtgactggaagggcttatttgtttggtttgggttgtggctggggttttgtatgtatctgtggggttttggttttatttctgttatatcccgactatactgccccaccctgcccagactcctgcagttgctgaagtcaggcctgtcccctgcccacacttggcactgggcataaagcaattagggaggaagcagggaaggccctctgctgctgttgcaactgagtacatgctgtgagtaagaacacctcttgtttagtagcatgtcaatggcctgtttttgtcattttcttctttcttgcaccttctcttctttgacattggtaacctccatcacccctgtgttttaggctggagatgttactgtcctctgtaataggactgatcctaaatgtttccttcaagagattaaggagctagtatctcatcacaattagatgcctcaaacattaattcggatatctggttaattcactcaacccagccacttgcacacccaccaccgtgtgatgtgccgctgtacatagtaggtttctgaccactgagttaaagttcctggctactgatgatacactgctgaggtgtgttccccagttgtttactgcgtagttgcagccagccaccctttgatccacccaacctttaaccccaatttgctaccacccaggaggagccagtggagagactaggaaaatctggtttgctataaaatgccaggtgttcttcgtgtgtggcaaggacagtgggatcaggctgcactgtagggactttatcatgaggcagccacgtggggggtgttcaccctcaggtaccagtgacaaataccagattattggaaacctatatttcttccgcacatctgtccgttttctcctctggagcaatactcttgagactgggcaggtaagccacagcccaggtcccacatgaccaggtggcagggatggctaaaaccacagtccattgttttccagcatctcctaaaatgagagcacccagaacagaaggggcgctaaatcaccacccccctaactagcgattggcttgtgcgagttgtagaccacctgttggccttgtggactggcttgatgatactgaaagtgtggccacagatggttgttgagctgcattgctgacctccaggaatgtataagaaagcctaaagcaagcaattaaacagccactggaagtgataacacttgggagtttgattatccttatgtcagaaggaaaatttgtattttctctttattgtctataaaagataaaaatttagataagggcaacttaacttttaaaaatctccagtggcaataaaaaaatcttcattaccacatttctgttgaattgtattttaaagttcctaataaaatgacatcatttactgggaaatgcttctttttcttttgaaaacaatatgacttcagccctgggtatttttttatttgtttcttaagatgatttttctgtttatctcatacatccttgaaaagaagctacaaaaattttttttgttttttttttgttgttgtttattgacagtcttgctctgttgcccaggctagagtgcagtggcacgatctcagcttactgcaacctccacctcccaggttcaagcaattctcatgcctcaggctcccaagtagctgagactacaggtgtgcaccaccatgcccagctaatttttatatttttagtagaaacagcattttaccatgttggccaggctggtctttaactcctggcctcaagtgatccacctgattcggcctctcaaattgctgggattacaggcgtgagctatcacacccagcctaagctgcaaacatttcttaatccaagtgcacaaagactatctccatctctataaccactaaagccagccatttttagaatctgtttgggatatgtggctgtttccaacttttctttaggagagttgtttgcaggctttttcgctccatagctcttcccccaagactgtcggttctaaacttgcttctcctcctcattcgctgcacatataccccttcccctatctaaataaattgcagacttctaaaatttagaatggagaaaaactggtacattctttgtcctgcacaagaaagaggtggtaacaggaatgtctgagaaaaaacgaatggcctagtgactctgtgatgcaggaaaggttgccagtctgcaaatcatagaaactgaggaccccatcctagtagctgctactcctggaaagtctccacgttctctgtggagtccactccatggctcactcagtttctgcagatggaaagtccccggtcgtcctttctcatgtttccctctcttcccagggcaggatagcgtgtgccaatgtcctcagtgacctctatgcaatgggggtcacggaatgtgacaatatgctgatgctccttggagtcagtaataaaatgaccgacagggtaagtaggagctacccggctgctgcctggtccgtgttgtcccggtggcatctctggccttggttagacttggtttcccatctagaaagcgaggagcccaggccatatggctccctgcactccttctggctctccactttttggcagttaccagtaaattaaaatgaggaagcctggcctagtcatctctgcacttctgccacctgctccctttctctcttcccagtagactgaaaccaagactttttttttttttttttttgagacaggagtctcactctgtcgcccaggctggagtgtagtggcgcaatctcagtccactgcaacctccgcctcccgggttcaaacaattctcctgcctcagcctcccaagtagctgggattacaggcacgtaccaccacacctggctattttgtgtatttttattagagacggggttttatcacgttggccaggctgttcctgaactcctgacctcaggtaatccacctatctcggcatcccaaagtgctgggattgcaggcgtgaaacaccgtgcccggcccaaggcatttgtgtatatttttttttgttttattgagacagagtctcactctgtcacccaggctagagtgtagtggcacaagctcagctcactgcaacctccacctcccaggttcaagcgattctcctgcctcagcctcccaagtagctgggattacaggggcacaccagcacccccagctaatttttatattttcagtagagatggggtttcaccatgttggtcaggctggtctcgaactcctgagctcgtgatccacccacttcggcctcccaaagtgctgggattataggcatgagccaccgtgcccgacctgtgcattttttaaaataaagttttggccatagtaatggtgcctcagtgtgaatcaggcacagccttacagatgtgggacacgtggcacttagagggcactccctctgctgtggctggggatgtcgtggacgtagatggtgacgggggatagggccaccaggggctcacgcctctgtgtcatcgcctagcattctgtgcccttgctgcctgaacctgttctttgaaccagagatgaattcctatttagatagacaggtacttgtttttgtcccaagagcccccaacagtttgccctgccttagagaaacttgagtttccagtaggctctttcctgcccttgaacatgggctgtagtcatcagtggtgcatggtggtcttggcgcaggctctgtcagtgtgggttactcgtagcctgcagccaagccttggtaggatggatgcctactgcagggcaggggacctgtgcttaggaagccagtcttgagattctcaaggagcactggacagctggcttccagcagtcatcagacctagggctggtcctgtgcactgagtccagacaatgttggtgtctgggctttatttacattgttgtctagaacatcttccagcattggataaaatgatgacaatgtgaaatattttctagcttttgtttttgtttgtttttgagacaagatctccctgtgttgcccaggttggagtgcagtggtgtgatgagagctcactgcagcagcctcagcctcccgggctcaagacatcctcccacttcagcctccggaatagctgggaccacaggcacatgccaccacaccaagcaatattttttttttttgtttttgagatgaagtctcactcttgtgcccagggctggagtgcagtgatgcgatcttggctaactacaacctctgcctcccaggttcaagcgattctcctgcctcagcctcccaagtagctgggattacaggcgcatgctaccacacccggctaatttttgtatttttagtagagacggggtttcaccatgttggccaggctggtctcaaactcctgacctcaggtgatctgcccgcctcagcctcccaaagtgctgggaatacaggcatgagccactgtgcccggtcacccagcaatttttacatgtttcgtagagaaaggggtctgtctgcattgcccagactggtcttaaactcctgggctcaagctctctgcccacctcggactcccaaagtgctgggattacaggcgtgagcgattatgcctggcccctaacaaccttccctgtctgtaaactttgaggacttcctttaggattttatggttctttttataactgtaagtgtaaaaaccttcttttctgggttttgaacagaattctttgactttttatttgtacctttttcaaccttaggaaagggataaagtgatgcctctgattatccaaggttttaaagacgcagctgaggaagcaggaacatctgtaacaggcggccaaacagtactaaacccctggattgtcctgggaggagtggctaccactgtctgccaacccaatgaatttatcatgtaagttgatttttgtttcatatcacctgacctgtttttctctctctgtcctctctttttaaaaattgatgtattaaggtcaggtgcagtggctcacacatatgatcccagactttggtaggccgaggcgggcagatcacctgaggtcaggagtttgagaccagcctggccaatgtggcgaaaccctgtctctactaaaaatacaaaaattagccaggcatggtggggcaagcctgtagtttcagctactctggaggctgaggcaggagaatcgcttgaaccccaggggtggaggttgcagtgagctgagatcatgcccctgcactctagcctgggcaacagaacaagattctgtctccaaaaaaaaaaaagacaagaacgcaaggctgggcgcggttgctcatgcctgtaatcccagcgcttttggaggccaaggcgggtggatcacctgaggttgggagtttgagaccagcctgaccaacatggagaaaccccatctctactaaaaatacacaattagccaggcatgatggtacatgcctgtaatcccagctacttgggaggctgaggcaggagaatcacttgaacccaggaggctgcggctgcagtgagccaagatcgcgccactgcactccagcctgggcaacaagagcgaaactccatctcaaaaaaaaaaaaaaatagatgtattaagatataatttgcgtactataccattcacccatttaaagagtcagtggtttggagtatactcagagttgtacagccattaccggagttgatgttaggatgttttcattgctacaggaagaaaccccatcctcctcggctctcactgttcactcctgctccatcctggattttgtcacttagcatagtattagcatacttttaagggtcatctattttgtagcatgtgtcagtattttaatcctatttttaagacattttaggtgtttttgttttttttttttgagacggagtcttactccgtcgcccaggctggagtgcagtggtatgatctcggctcactgcaagctccatctcccgggttcatgccattctcctgcctcagcttcccgagtagctgggactacaggcacctgccaccatgcccggctaattttttgtatttttagtagagatggggtttcaccatgttaggcaggatggtctcgatctcctgatctcatgatccgaccgcctcagcctcccaaagtgctgggattacaggcgtgagccaccgcgcccggctgacattttaggttttttagttgaagtataattcacgtaacaaaatttcacataacatagaattcagcattttgaagtacacaatgtgttggtttttagtattgacaaggttgtgcacccatcaccactatccaattccagaatgttttcatcaccccaaaaagaagccctgtagctcactcccatttccctcctgctcccatcctctggcaaccaagaatgtgcttttgtctctaaggatttgcctgttctggacattgtatagaaatggaatcgtgcagcatgacatgctgtgtctggcttcactcccatagcggaatgttttccgggtccatccgtgttgtagcatgaatcggtatcgcattcctttccatggctgtataatccattgcatggatggaccctgctttatttagccattcctcaggtgacggacctttgggttgtttccacctattaggaatgatgctgccatgaacattctaagtttttgtgtggacataagttccggtctcttgggtgtatacctaagaattgactgggtcatgtggtaattatgtttaacttgaggaatcatcagactggtctccaacatggctgcgccattttacgttcccagcagcaatgtatgaggattccaatttctctatgacccctccagtacttgttttcctgtctgtcttttggattctagccagcctactgggtgtgaagtggaatgtctttgtggttttgatttgtgtctgcctgatgactgatgaggccgagcatcttttcatgtgcttactacccatttgtgtatcttctttggagaagtttctctcctaaccaagttgtcactttccatgtttgatgtcttgttaagaaaagtcagtcttttggccgggcgtggtggctcatgcctgtaatcccagcactttgggaagccaagacgggtggatcatctgaggtcaggagttcaagaccaccctggccaacatggtgaaaccctgtctctactaaaaatacaaaaaattagccgggcacgatggcaggcgcctgtaatcccagctactcaggagactgaggagagtggtttgaacccaggaggcggaggttgcagtgagccaagatcgtgccactgtactccagcctgggtgacagagtgaaactcagtttcaaaaaaaaaagatctagaattagaaataccatttgacccagcaatcccattactgggtatatacccaaaggattataaatcatgctgctgtaaagacgcatgcacacatatgtttattgcagcactattcacaatagctaagacttggaaccaactcaaatgtccatcaatgatagactggattaagaaaatgtggcacatacacaccgtggaatactacgcagccgtaaaaaaggatgagttcatgtactttgcagggagatggatgaagctggaaaccatcattctaagcaaactatcaaaaggacagaaaaccaaacgccgcatgttctcactcataggtgggagttgaacaatgagaacacttggacacagggcgggtaacatcacacaccagggcctgtcgggggtagggggctgggggagggatagcattaggagatatacctaatgtaaaggacgggttgatgggtacagcaaaccaacatggcacatgtatacctatgtatcaaacctgcatgttgtgtacatgtaccctagaacttaaagtataattttaaaaaatttaaaaaaaaagaacatcaactttatggtacaactgagtctgaattcgaagacatttatgtcttcaggtctggtttttggaaaacaagtttcttgcgtagtcacagaattctatttttcaaagctgagagtggatacaaatggtataggttgagctggggagctgggtgttggtattgaagtctgtggccctggctttgttttcatcgacttgggtgagtacctgaggaggccagcatcggggaatggaacgattcaggagctcagctgctgaagctgcgaaaggcacaactctcagacctgcttcctggtagtgtgaatgcaagtctggtagatgtttcattcgggcaccagttgtcatcttttagaggtgcctttttagtattgccttctgtctctaagacagggaccaccaaggcgtctgggtgccaggtaggaaactcaccatcagtcagtctgagtttgagaacctggaggcagaaatcaccaagacattagacccacagattgcctgcaaatccaccaaacccctgggccgaaaaatccgtcctgagtctctagcatatcagtgatcataaagaagcactctctgtttcagaagcttttgaatgctagtgggtctgtagtgaaaattacacatacactcgtatgtggtcgaggggaaatctgggcctgatgaaacgtttgaaggctaaatgtttcattctttttaaaaatatgtatattatttttgaaatggggtccttgttgtgttgcccaggctggtcctgaactcctgggctcaagtgatcctcccctcttgacctctcaaagtgctggggttacagaaatgagccactgtgtccagcctgatggctgaatgttttgttccagcaatagcctcagtagcaggttgcaaggctctgtcccatacatgctggtagttggcttcaatttaagtaaatgcaaaggcagatatatttttgacagattattccttctcttgtgttaataacaatgagctcatctccttggttagtttgactagaacatgcccttttcttttcttcaggccagacaatgcagtgccaggggacgtgctggtgctgacaaaacccctggggacacaggtggcagtggctgtgcaccagtggctggatatcgtgagtaaaccactgctgtgatgggagggaggggaatggtacgtttgcaggtaatttttgttggaggatttgggaaatgaggttttttagtttcatatccagggagttaatattagtcaagtccttaaagaaatcctaggaattgttcatagtctttaaataacagttttgcatattgaatgcttgattgcagtaggtaagccccagcttggagctttaagatttttctgtaaagaatttgctcggcagggggttagctttgtttacttggccctgagatagcttcgtctttcatgtcttaaacatcactaagaaataatatgaaggagaattggtggaaggcgtagtgtttggggtataaataaaaccagggttattgacagtttaaattgttttatgcagtttttggttgtttttgtttggtagttttgtctttttaaactgatgagtaactcagaacattttgataaataattctcttgtgcagaatgaatctatctataatgaggatatgtcttgtgagtcatttttccagtgagctataatcatactttaagattggttttcttcattgccgtaacaactcacaaattaataagattggggtatattctcacatatcatggtgcatttaatttctacaactatcatctgaaactaccagtcctgagaaacagttgaaagagaataatcaataattacacgtctttcatcaacctggtatatcttagcttgatgtcgcagggtagagaaattctctaaggctgccacgttctttagcagtttttccctcctccccctgtgatggggagcagagcagaaggccactgcggggatgttgcgcagaggtgccttccagccccacctcccaggcctgagctagcagggagctggaagcaggtgaggcagggagtgtcacggatgggggagcccttctccactagcaggacactacactgcatgtacagcagtgccgccgtgtgtcccgctagactacacatacccaataaatcacagcacttaattacagaaatgtgggatgagaacagaaaagacgccatgctgacaggtctaatggacacctaaaatactatccacagaaaaaccagagttggaaaattcagttttctgaattaaagtccctagaagttaaataagaaaaagttgctgtttttctcagttgctagaagtaaagattaatcacattttcctctctttctctccctcacctacatttctattatcagcctgagaaatggaataagattaaactagtggtcacccaagaagatgtagagctggcctaccaggaggcgatgatgaacatggcgaggctcaacaggacaggtatgacaggtgggaagggcgcttcggtcccaggggtccaagacagtaaatgtcttaggcttttctggccacatactgtctcagggtaggtggccagatttttggccagtgactacagaccgtcttctcctggtaccaggttggcattccatagatcactgcagatggtccctgacttacagtgctttataattaagaaggaagtcctaacttctgacataccagaggaactatttctagaaagcgtttgtgtgggttacctatgtaagatttggaagcaaaccattcagaatggaaatttagaaagtttaagatactggagctatttccagaacataaccttggaagtctagaagtgcccccactcccacccatcccctgcattcctgcttaggtgtaaccactgaattttgtgtttattttcttgcattttagaatatttttattgcacagcccttgtgttcttaagcagcaaattagttttgcattttttttacttgttttgttcaccattgttcctgagagtctccttgttatatgtagctgtagtagattccttttggctgtgttgatttttccactggcttctctgctctcctgtttcacactggggcgactgctatggacttccttggcccagccctctgaggcacgtgtaagagatcagtactggctcagcttttatagatagtgccaaactgtcttccaaagtgttcaccacagtttacaatggcacactatgtttagaaagcgttttttaatatgtcttctcttcccatttattttatacattttttctactataaaagaattacatgcttattatagaaaagtttttagaaaatggaaaatagtacagaaaaaagttgtccatagtccctccacccaaaacagctccggctagcatttttatgtattcttccaggactttttttcatgtttggctggtgatttactattgttgttttaaagtagtggttagtataagttttcactatgtaatggttagtatatgtatttggagtgcctgcttttgttgttttgacatgactaatgtttcccatattatgtatcctagtaaactttttttttttttttttttttttttttgagacagaatctaactctgtcgcccaggctggagtccattggtgtgatctcggctcactgcaaccgctacctaccaggttcaagcagttctgttgcctcagccttcccagtagctgggactacaggcacgcatcatcaccatgcccggcggatttttgtatttttggtagagacagggtttcactatgttggccaggctggtctcgaactcctgacctcaggtgatctaccctccttggcctcccaaggtgctaggattataggcgtgagccatagtacacataatttttaatgactagataatgttctaccagagaaatgtaccacaattatcttttacctattgttttacaattcatttggaaataaaaattttctgtaatttgttgttacttgtaagaaagttatagccaggcacagtggctcacacctataatccagcactttgggaggttgaggcaggaggatcacttgagtccagcagttggagaccagcctaggcaacatagtgagaccccatctcgtctctttagctgcgcctggtgcattcctgtagtctaagctactcgagaggctgaggtgggaggattacttgagcccaggatgttgagactgcagtgagtggtgatcatacccctacgcttcagcctgggtgacagggtgagatcatgtctcaaaaaaaaaaaaaaagttatagatcagaggaacagaatagagaatccagaggtaggtccatattatagtcaactgattttttttttttttttgagatggagttttgctctttcgcccaggctgaagtgcagtggcaggatcttggctcaccgcaacctccgccttccgacttcaagtgattcttctgccacagcctcccaagtagctgggattataggcgcccgccaccacgcctggctaatttttgtatttttagtagagatgggttttcaccatgttggccaggctagtcttgaacccctgaccttgtgatccgcctgtctcggcctcccaaagtactgggattacaggcgtgagccactgcacctggcctagtcaactgatttttgacaaaggagtaaaggcaattcattggagaaaagagtcttttcaccaaatggtgctggaacaagtggacattcacatgaagaaaattattctggatgcagatcttatacctttcgtgaagattaactcaaaatgaatgtttagtgtgttttcacactgctataaatagccaagactggataatttatttattcatttattattattattattattttttttttttttttttgagactgagtctcttttttttttttttttttttttttttttttttttttttgagacggagtctcgctgtcgcccaggctggagtgcagtggggtgatctcggctcactgcaacctgtgcctctcaggttcaagcgattctcctgcctcagcctctggagtagctgggattacagggcgcacgccaccacaccccactaattttggtatttttagtagagacggggtttcaccatgttggtcaggctggtcttgaactcctgaccttggcctcccaaagtgctggaattgcaggcgtgagccaccatgcccagctgactgggtaatttataaaggaaagaggtttaatttactcacagtttcacatggctggggagacctcaggaaacttacagtcgtggcagatggtgaaggggaaacaggcacctaggttcttcatgaggcagcaggacagagaagagcaggggaaactgccacttacaaaaccatcagatctcatgagaattcattcaccctgacgagaacagcacgagggaaaccgccctcatgattcagtcacctcccaccaggtccctctcttgacatgtggggattacaattcgagatgagatttaggtggggacacagagccagaccatattgatgattcgtagacctaaataaaacacaacaatataaaactggaagaaggtaacatcagagaaaattgaggtggctttgggtttggtgatgactttataacaccaaaagcactatctattaaaaaattgctaagtttggctttattaatataaaaaacttctgctcggtgaaaaacactgttaaggaaatgaaaagacaagccacagactgggagaaaaattttgccaaacacatacctgttcaaggtcaggtatccaaaatatacaaaggactcttaaaactcaataataaaaaacaactcaatttaaacatggcccaaagaccttgacagacaccatgaaagaagataacgcagatggcaaataagcataaaaggaaaccttcagtgtggtacgtcaatagggaactgtagattaaagcagtgattgagatgccaccacatacctgttagaatggctaaaatccaaaacactgagaatagcctgggcaacatggtgaaaccccatctctaccaaaaaaatacaaaaaattagctgggcatggtggcttgcgccttagtcccagctacttgggaagctgaggttgggaggatcccttgagcccaggaggtcgaggctgcagtaagctgtgatcgcaccacctcactccagcctgggtgacaaagcgagaccctgtctcaaaaaaaacccaaaaacactgataataccaactgctggcaaggatgtagagaaacaggaaggaactctcatttattactggtaggactgaaaactggcacagccactttaaaagtcagtttggcagtttcttatgaaactaaatatgttattatatgatgcagcgattgtgctccttgatattcactcaaaaaagttgaaaacttacattcacacaaaagcctgcagacaaatgttcatagcagcattattcataattgccagaacttggaagcagccattcatttcttcagtaggtgagtggatgaatggataaacaaaatgtagtgtatctgtatgatggaatataattgagcagtaaaaagaaatgagctatcaagccatgaaaagatgtggaggaatcttaagtgcatattactaagtgaaagaagccagtctgaaaaagctccatacagaaggattccaactgcatgacattctgcaaaactgtagagatgcagaaaggatcagtggtggccagaggttatcggagaggaaggggatcaggtagagcagagcactgaggatttgttacttcccacttaatttctttctaaacgcaaaactgctccaaaaaataaagtctgtaaatttttttaaaattaaataataggtcgggtgaatggataattaaataatagtaggtgagtggatgaatggataaacaaaatgtagtgtatctgtagtatggaatattattgagcagtggctcacacttgtgatcccagcgctttgggaggctgaggcaggacgattgcctgagcccaagtgcagtgagttatgatcatgccactgcactccagcctggtcaatagagcaagactctgtctcttaaaaaaaaaaaaaagaaagaaatttaaaaataaacttgcacgcaattcacctttcgcgggagtaccttgatactgagcaaggccttcttaaaaagtgctggtcttggccgggtgtggtggctcacatctgtaatcccagcactttgggaggccagggcgggcggatcatgaggtcaggagttcaagatcagcctggccaatatggtgaaaccctgtctctgctaaaaatacagaaattagctgggcgtggtggtgcgcacctgtagtcccagctattcaggaggctgaggcaggagaatcacttgagccctggaggcagaggttgcagtgagccgagatcgtacgactgcaccccagcctggatgacagagcgagactccatctcaaaaaaggaaaaaagtgccggtctttggttttaggatggtcttggccggtttaccttccactgagatcataatccctctgcatagtttttttagtttactggaaaactactattaattgaagcttctgatagttttcaggtggctcaaagtgaaataagaacttttggaatttcactatgtctttggttgattttacattgcgttttcattattccgatacgtcatctccctgacaagtaaggaagttgcagattaattgtggacgtaagatttttgagttgaggaaaggtgttttttctcagagccgccccctctctctcccagctgcaggactcatgcacacgttcaatgcccacgccgccactgacatcacgggcttcgggattttgggccatgcgcagaacctggccaagcagcagaggaacgaggtgtcgtttgtaattcacaacctcccggtgctggccaagatggctgcggtgagcaaggcctgcggaaacatgttcggcctcatgcacgggacctgcccggagacttcaggtacaggatgctgggcgcatctgaggactaaatagtgaggctaacagaaagctcagcgagaaagcagcagccccaccccgagtgggcccccactctgttcgagttccatgctgctgacctcggcctccgcagcagctggtgcctttcctcctcccggtgggtctggtccccgccatcctgggtggatccagcagccttgctgaggttgagtggcctgtgctctttttgatgcaaggatatggtgatgggggaaataaggtagcattcagtttttactgaaagcttcgcatttgaaattaactgtaatacccctaggttactttgaacaggtgatatttttttccttgaaaattgtctaacgttgttttaagaatgatagagagaaaaggggccaggtgtggtggctcttgcctgtaatactggcacctcaggaggctgaggcaggcacatcacgtgagatcaggagttgaagaccagcctggccaacatggtgaaaccccatcttcactaaaaatacaaaaaaaaagtagctgggcgtggtggtccatgcctttaatcccagctgcttgggaggctgagccaggagaatcacttgaacctgggagacagaggttgcagtgagccgagattgcgccactgcactccagcctgggtgacagagcgagattctgccttaaaaaaaaaaaaaaaagaaaagagaatgatacagaataaaaaagaatgcaataggatattatgtctttaaaatgccatttttcttttttcttagatgtgcagtaatttattagaggaaacataaatggaggataaacgggagatggagcaagcgtaggtagagagagccatcagacagcagtgcaggtctgacaccatacgccccagtagtttgactcctagggagcttttatatcccttatcatttttctaagattaagctccttttgtttcctgattaatttggtggccacatctgtccggaacttgtgggacgtcctcctcttcatcatggcaggtactccagcatggcctgccggccgccgaggccgccacccacagcctacaggctcgccatcgctcattcccactcccgcagccccagctggagccagatggcgcgtcctcctgaagtaccatttctcttttgccccctttgttccctttacctttactgttttcatcttttaagtctccctgtttttccctttttttcggtttctctctttttctatttcctttcctctagaactctagttttctacccgcaaaagagtggaatcaccttaggattttaaatatacacatgccggccaggcctggtggctcacgcctgtaattccagcactttgggaggtcgaggtcaggagttcgagaccagcctgaccaacatggtgaaaccctgtctctactaaaaatacaaaaattagcggggcgtcgtggcgtgtgccctgtaatcccagctactccagaggctgaggcaggagaatcgcttgaacccaggaggcacaggttgcagtgagccaagatcgccccactgcactacagcctgggcgacagagtgagactctgtctcaaaaaaaaaaagaaaaatacacatgcctagccccagcctcccaaaaacggtgggatccatctcgggtgggcctgggcctcagcatctgtgaaggctgcctgggagattccgtagtaggccggggcaagggaccacagtgctgggaccacaaagccctggtcacgtcgacctgtgctgtggcgagggggcttcaggactctgccaggcctctcaccgcctttatagaggacgcttcagcctcccgtttaaaaaaacaaaccattttctagaagtaagctccaacagggcagggtttttttcccctgctggttcaggctctggccaggacagtgtctgccacataattgggcactgaatggaaattgaatgaattgacgaatgttaccagccatttaaatttgtttcctttcttcagaaataggaagtttttaattttatgatggagttttcctcttgtcacccaggctggagtgcaatggcgcgatctcagctcactgcaacctccccctccccggttcaagcgattctcttgcctcagcccgagtagctgggattacagggctgtgccatcatgcccagctaatttagagacgaggttttaccatgttggccaggctggtcttgaactacctcctgacctcaggtgatccacccgcctcggcctcccaaagtgctgggattacacgtgtgacccaccatgcccagccacaaggtttttacattttgtagaagtagactacagtttttcctcatcatcttatttctacttagagaaataaattttggcccggtgcagtggctcacgcctgtaatcccagcactttgggaggccaaggcgggtggatcacgaggtcaggagatcgagaccatcctggctaacacggtgaaaccctgtctctactaaaaatacaaaaaattagccgggtgtggtggcgggcgcctgtagtcccagctactcaggaggctgaggcaggagaatggtgtgaacccgggaggtggagcttgcagtgagccgagatcacaccactgcaatccaacctgggagacagcgagactccgtctcaaaaaaaaaaaaaatttatggcctatttactggaaagagcaacaaaggtttattttaatgtattttatactgtttgtcttttggatataatgacagagtcatgactggaacctagatactttggggcatacactgtttcatgagtcttaaattttctaaaaatacaaaaaagcattctcggtaaaatgagagagtcgatgtagagaatcaaaagttcccttttgtttgtcaatatttgtttcagtgtagcttggaaaaaatagctaccacatgggttattgaagccccaaacaccttacccctacacagtgttatgtggttcacgaataggtcattttcacagttgaaagttggagtgtatatgtgtgtgtgttaggagtttactagcaattgcttaattacagcatagaacaggcctcttaggctgggagtggtggttcattcctgtaatctcagcactttgggaggccaaggcaggtggattgcttgagtccaggagttttagaccagcctggacaacacagtgaaaccttgtctctacagaaaattagccaggtgtggtggtgcacacttgtaatcacagctactgggaaagctgaagtgggagggtcacctgagccaggacattgaggctgcagtgagctgtgattgtaccactgcactccagcttgggccacagagtgagaccctgtctcaaaaaaaagctgcttagttgaatgggaagagctacttgcatataggtggcagcaagttgttgatggaagttggatctctgcagaagcagcagaggcagagaagctgctgtcatgtcaacactaacagtcattcttgttttcttttgccaggcggccttctgatctgtttaccacgtgagcaagcagctcggttctgtgcagagataaagtcccccaaatatggtgaaggccaccaagcatggattattgggattgtagagaagggcaaccgcacagccagaatcatagacaaaccccggatcatcgaggtcgcaccacaagtggccactcaaaatgtgaatcccacacccggggccacctcttaatctagacagaaatagctgtttggttttgtttttaaatagatctatttcccttatcacttcaattaaagactataaacaacaaaaatctcattgtgtctacacatcggggtgaccttaggtcggtttgtaagtggatacaattaataaaataaaatccattgcctttttttcctgttacattaactgaagatgcacctaatcttgaggcagcttctgagttgagaattatattgttatccaatactgttgattcattttgaatctttagacacttatctcttgccgcataggctttttaaaggtgctttcacatagcacaggcattacccgtagtcgtgtcaaatagcagttggtgtcttcattttatgtatatttatcatataagtctgatttttttttttaagcgtcttgaatggttttctggagagacagcattggtaagtggcacatgacggtatcccagtcataagagggttgcatgattcctttgagtgtttgatttgaaaagcctagtcttgtctctcaagagcatctcggacccagaacattctccagtagtgcattcagttcaacacagcaagtgcttcattgcatggaaaacactttgaagacaaaaaagaaatcttatttctttttttgtagccttcctgatatttacagtaataccattaactgttttatcgatagcaaaaaaggatactttttgcaatgttattagatgttctatagtgctacaaggaattgccttccgaatggaggttcatgtataatactcatttacaattcaatatataattacacaaataatttttaaatataatcaatagtaaagactgttctgtggatggtagtgtttaatacattttctattttgtacagtgatttcaggccttttgttttcttaaaatcagcagctgtttggcctaattcttagcattattttgtcctttgcgccagtacttttttgtgcacgctttttgtgatctgtgttaaaaacctgcattgccaacattgcagctcgaacttaaacttgttattcaaataaatatttaatttttt

SEQ ID NO: 37110 - DNA, 87631 bp, Homo sapiens
ggagagggagaaggctctcgggcggagagaggtcctgcccagctgttggcgaggagtttcctgtttcccccgcagcgctgagttgaagttgagtgagtcactcgcgcgcacggagcgacgacacccccgcgcgtgcacccgctcgggacaggagccggactcctgtgcagcttccctcggccgccgggggcctccccgcgcctcgccggcctccaggccccctcctggctggcgagcgggcgccacatctggcccgcacatctgcgctgccggcccggcgcggggtccggagagggcgcggcgcggaggcgcagccaggggtccgggaaggcgccgtccgctgcgctgggggctcggtctatgacgagcagcggggtctgccatgggtcgggggctgctcaggggcctgtggccgctgcacatcgtcctgtggacgcgtatcgccagcacgatcccaccgcacgttcagaagtcgggtgagtggtccccagcccgggctcggcggggcgccgggggtcttcctggggtccccgcctctccgctgcgcttgacagtcgggcccggcaacccggcccccgggcggaaacgaggaaagtttcccccgcgacactcacgcagcccgactcccgtagctgcagggattgtgagtttttcttgaaaaagagaaggaaagttcagttgcaaggggcgcggggcacgtttggtcccctttgtgcgagcaggaaaggcgttgtgttggccgcgttcgaggcgagcccccacccccggaaagggaagtttgagaagttggttatctgaaggcggccggggagcagcggcccggagcggcagcctgagctgccaaagcagccagcgcacctgggccactccgcccatggcgatgccgcgtgcccacccagctctttctgagccacccgttcaaaaggccagctcctcagtccttagctcctggagacggccacgctttccctcaggccggcttcttggcccggagtttttggaaacaagtttcaagaaaataatcgatttccaaaagaaagttagctggctccactgacgccttggcatggatggatagggagtggagatgctcaggtgaaaccgagaatccctcactgaatgcctactgggtgctagaggctgtagattttgcctggaacaagatagtcctgtcttcagggagttgatggttctatgcaattatcgtttgttggaaaccgaagggttaaaatcctaactaggctacccacctgatcgctgtctctgaaggtttttaaggaaaaaataaaaataaaaaaatatatatatatattatatatatataaatatatatataattatatatataaatatatataatattaatatatatatgcatgcaggaatgggggttcttaactatttgttatggaaagtgtaaaacctctgagacttcaaaagttagattttttttttttggagacggagtctcgctctgtcaccaggctggagtgcagtggcgcaatctcggctcactgcaactttgcctctgggttcaagcgattctcctgccttagcctcccgagtagctgggattacaggcgcgtgccaccacgcccagctaatttttgtatttttagtagagacggggtttcaccatattggccagggtggtctcgatctcttgacctcgtgatccgcccaccttggcctcccaaagtgctgggattacaggcgtgagccaccgcgcccggccaaaagttagactttttgcagctatgatccaaataacagtatctgcagctgtggtctgggtaaccgagtatttgggcaagtcatagagctttttctgggccttagtttcctcatctgtaaaatggccagcttgaatctgggtaattttacatcatcttcatgtttaacatcttacgtatcgtgcccctcccctcctttcccctggctcttctggtgacttggagatgacccatgtagactttggatgaaatgtagaggagttgacagtccacatcacccggaggcactcattttatttatccagggacatgggcagatttacctttaggtttgtctagaaaaaatgcgcatcacggtcagttgtaaattttagagtgtttgaagtggattgggaactttttaaaaattatggcatacattgaaggtggcatggagatggaagcttttaatcaaattaggaagaggcactattgcaagcaaaaagtcttgacacacatttgagtcctatggttttaataaaatcttagtgtttcgttcttggcgtttttcctgcattgcagtaccagaatgttcaattgtctctcattttcctccagacttttaaaacctaagtgacattttgctaataaatatttaaaatggcacccttaattttctgtggatgttaaaaatcattacaacttttgttccagattataaaagaaggaaattagcaggccctgatgttgttagttaggttctgtttacaaggataaggtttatgatttgcaaattccagacccaatagttcacgagtcactttcatttcatcaatatacacacttttaaacaattagcttaaaaacgtggtggctttttatttgggtatttagacagttttacaaggcccacagatttcatatttttatagaactgaagtttcaaaatggttgaattaatgaatcattttgaatttgtattcatttgattcaaattaaattttcaaagttggccaatggttgaagacagatatattgaagacgagaaacctaattctacttacattttaatttttcatgtaagtaaatagtttcagaatttctctaacgtaattggtaaactgaaaacattttttcaaaatatcttaatgcaagataatatatcaggtaatgagattgtttaataaacaacaagctccttttacgtcacctaaaaaggcccaaaaatctgtcttctgtttagtagcttctgtacttctgtttagtagtatgcaaaggatttaaataaaagaacaaatttcactaagaaatagaaagtttttttttcttcgtttttgacttaatagattcactcttcctaaatgatcaaaattaagaaatgactcttttggggaaaactgtaaagtgcacaataactcttcaggtctgaaaaatatgacttttcaggttcctggaagtagatagattcttattgaggacaaagaatttgtaaaagtgtcatagtgatcaggttcttcacatcactttaataacctgcttattttgtcagggtaagagactagacatcattaggccccaaatctgatcttcagtctactcgtgctttttttccgcctcataaaaacacatttccacctttaggccactcaacatcttatttttaatgagttatgatttatacaaaatactaatcacattttgaactcattgccttcttttcaatgtagcattccctaatgatgactgttgtctatgtagtcaacataactactacatgttttctactcagttatgaacatgactttttaattttttcagtaaggttagtttttaactctggatcaataaggcacctctgatatcattgcaaaaactgggcattttttcttctaccttttcaaccatatttattgagtatctcttgccaggcaggatgctcagacctgggataccatctcagatgaataagacagacctggtctttgccattgaatttaacagctgggagcatgttataagtaaagaaaaggatacgtgttttaactgtttatatttgaaagcattatggaatactggtgttttattttctacacctcattttcaaaagcctcatttttttttgttgttgtatgcactaggaggatgtgcatgttgaatgtttccttctaggtcccattgaatgtatttttgaatcaatttgttgtctctttcctatccctgccttgtcacggagccccagttgggcagcctttaattgcattctccattccatagccagcatgatggacccaatgcgttcatttagtgctctctttgaggataggctggtggtagaagagtgtagggtataaactttggaatcaggccgtcctgggttccagacccacttgccatgtactggctgtgtagcctgttgtagttgctttacctactagtcatccctggtctcatttgtaaaatgaggattatggagttatggtgaggattaaataaaatattgttttaaagtatttaacatggtgcctgcaacatagtaaatgctcaataaatatcagcttctgttattactattaactccttaattgggcttaccaggggcctctgacctggttcccatttgactctgctgcttcacatcccaccacagcccacattttcccagtctatttgtgtcactacacatacacacaatgtgagcaatttaggcagctgttcctttgttcaggatgtctggaactcctgctacctggctaattttcactcatcttttaagacgtagttcaagtgtcatcttcttgaggaaacctgctttgaatgtcccagtttgaggtaaatgtctcctatgagatacagacctctcacttagctggtaacaataccaagccaaagtcatatctttacgtaactctcttgcccattatacctttaatcctctcaatcttattcagttttctatctctgggatctctggcagtgcctgacacatcatttagcacccaggaagtgctgagctgagcctccacttcatcctactgtatctaatgcaactgaggtcgagcatttaactaagcagtcactgtttgttaggtgtttggtccaaatagtaaaatctttactttcagttagaatagttttagttctgatcacaataagtaatttgactgtttttgaagtatggaattggttcttgtattctcatgaaatatggaaaaagatgtttcaacttctgacaaacatgatggaaagctgctagaagttttcatgcaattcctttagccataaattttgaatcagtgtagggccttgaaagccactgcaaaattttaaataaagtcaccagaggaattatccagtagatactgattcctcttttttttttttttcatagaagggtgtcggaaagagaattttattacgaatgaagtgctaaaatctaaatttattttttaagtttcttttttcattgggttttatgttttggtttataagggtgaagcagcgttggttgaagggaagtgtggtcttgtagccaccactgcctactctagagtagcgtggatattatttaggtctgatgcaaaccaccaaagcagttttaaatagggtgcaggggaaacatacttcctggctacagcatggcattatttggccaagttccacataaaagcataactctgttaccttgttagcttctaccctccaggtccttatgtacaacttcagcagatttaagttatgattttcagtagaacagatatgcattcgcagcaagaatgctcaccgcttcttttgcactctctactttcctggtaatattttgctccacaggtacttgttgcttgtgactgaggcaagataatgactcatacttctttgcttggcatgccaaagggtttggaatgctggacaggcaaattgtctcatctcagggagaaggaagagaaagacaattaacatttgagaacctaccctgagacagccacttgatattatgtatctcatttaatcctaggaagaaatctccaagataagttttattatctttattttatggatggaaagatggatcctgctcagggtctctctggagttttgcctgggtgcatgtatgagtgtgtggcccaagcttcttgtgcttgcatgctgctaggttctttcgtgtggtctctatgtgtgtatgcgtgtgttgggagggaggctgaagaggggtgaatggatatcagatttgagagaggggaagcttaccatctaatgtcatcagttcagtgctcctgatttaattgatttggtttgcttgcattatctgcctccttcctgactacatttgtaccacagaaaatcaagataaggcagagtttctttgcataaggaaactctacagcccacagtttgacaatggtgtcttagtggtaggactcatggtgggtgacctgtggtttggccacttatagcagttggacataccccatttgcaaagatgtgtattgtaaaccccaaattttgagtgtgtaggacaatcatttgtgtacaatcgtgtacaactgctgatgagggcaagaagagccgactttatccaacataacaaagaagaaggggacagtttgacttttgaaggggacaatttgaaaacttataggaggttaagattctcttcctcacccattacatcaggagtacttctgccttttacttgccacagtcagctttctaggtcttagcacccaacaagtagcaactatcctcttgggtgtagtcagtttagtctacttatggcctcctgcttagactcttaagggttccctagcatctgtgttttgtttgtaggtttgaagctatcattattagatgagatttagcttcagggcccgtacctatgactggggagattctatctgggaaaggtcaagacatgcagctcttttttttttttttttttcttctcttttctgagggaatattttcctccaatttttttcagctctacaactaaaatatagacctagtatatgaacacaactggcctctgtcctgggccttagatggtactctgctgtcattcttctctggtcagagccatgcctatggggtgaggtgacttttgggccttccagtcttactctcttttcatttttagaccatgatttggttatgtgggaacccacattcgctgtccagaaggccctgaactggtatctgcagtttgcatggatccttgaagccatcttcctgaaggctgtcattgctactggttgtgcaatctctgcacgagggttgtttaagggatagctctgtgtgtgtgtgtgtctgtatgtgagagagagagagagagagagagagaaagagagagagagacagagagcgagcttgggtgtccacatatcacaaggcccctcttgatgtaggatggagcaggcaggggggaggaaggcaaattgattaccagggctcaggatgatgtctctctttaaaccacccatttctgtggaaggactatgaacattgtaggagttctaaagttgtacctggtcttccaagacattgaaaagatatatttgtcagtctaggtagaaggataacacctattttattgagcagtttgctagcttgatttgtaactttaaatgttttgacttatggtacatgggcctctatttgctcacttgccttgggccttcccatgttgggggtggatctgcagcagcaacattcctttgcagagatgttgggtagaaataagttttggttaattgtaccattttttccctggaatagacaacattgaacattaaagaaaaaatgagttactttgtagacatagtgctctatttcctttgggaaatgtagtttttcttagtttgcgttgtcctgaagtgaactttagctctatactttttttctttcctttttttttttttttttttagatttcctagtgccctagttgcatttcttctgtgtattgagagaccaccaggcgggcaaggtgaagtttatctgaatgttttttcctcctattgtaaatattttatttgaaccaaaaaaaggcttggttcttctcaagcctctttaaagaaaacaaggaaaaaggcttctcagtgctttagaagatataagattgtcaaaacttcattttagagaactagggatttggttgaaccaacatgaatgcctttgaaagaagatatgggttgggtgcatattttcagtatatgctgcagcagctctttattaaagtataaatcattacgaagtcttcatttcctatggggcgataacactgctgctttgtggatgactacctgtcacgcccaaatcctgcaaacttttctacatagggaaatgaaattgggcttatttcccctgtagcttttctcaagagacttcatggactaatttcccaataatcatagtagctaccacttattgaggtcttgctactgcacggatcatgctgagtacttcaggtgtattaaccctcaaaacaactttagaaggtaggttatattatgcttattataaatcctccagagtcaataaatttgcctaagtccacctagttagaaaatgattaggctggggttggaaccaagatggtctggtttggggatctagattcctaattgttatactgtactgagactagtctgccttaattgacataaactacttgtccattatagcatgggtgttggaagactagaggttaagagaaataataatatccaacatttttctagtgttttagcattcttcatatattatcccattgcattttcttagtgtaataaaataacactcggtttatacaccaggtagtcaaacatcatgcctgtcttgtgatctcaatggaaaaatgaagtgtatacctcaagtgatacagtcttggctgaatcatggaacaattatgccatcaggaagtttaggtattctgagtaaaacaggcactttatttgaaaggactgggagacttcacagatgcatcaaatatgttgaggatataaatgccaggctcaggtggatttactgtgaagtgcttgaacttaaccttcaaggctacctataccctggtataggtccatctcctggctctaggagaggccctggcaatgtggttaacaagtgtcatcaagtcaaatactacgaaatcttgcagtgccctgaatcttacagctcacatataaaagaaacctgataaaagttttccaaatttgaagtcaatccaaaaaatttatatgacattacctgtaatgaattatgaagctgaaaggaacttttccaaattattcaagaataaattacaaattctgatctacatttctaaagggaagactgaattatttttctattctctcaatagagaatattgcaaaatgttattggaagagatgatcaaagagtgtgcaaccaaaaaatataggagaattatttcagaggtatggcaatcagttaataaaaatatttgttttttaaacacttcatatttgtagtatttatagcttttaaaaatttgttgtttgtatgatactatttaaaattttttttccagagatgagatctcattctgtcactcagtctggaaagcagttgcataatcataactcactgcagccttggagtcctaggttcaagcagtcctctagagtagctcggactaaaggcatgcaccaccaagaccggccagttttttgttttttgttgttttttaatttttgtagagatggtgtcttactatgtaccaagtctggtcttgaacactggggctcagaggaacctgtccacctctgcctcccaaagtgttaggattacaggtgtaagccactgcacccggcctgtatgccattttaattctaaataaatattcactttattcttaattttatattcactttattcttaattttgtattcttcttcttaaagagtgcccctgaaatttacaagcttcagattccaaagacctgagtctttgactaatggtaggatttgtttgttggtttagaaaataaatgttaaaaaatgcctcttcctccttccccccattgcaaacagagactgaaatctgcattgttatttcacaaaaccaaaatatttttcctccaggtttagctaaacccttcatcattttcctactttagagccccatgccaagtagaaaagaagttgcaaagatgtaattatcacaaaccttcatcttggatgaaagataacctagctctgacccttagtttgagattagaaggactctacctaggagacagctggtaaagactaaggtatgttgtaccaggaatctaggtgtctgggtgaccaggctgtctttcttcccactggggctcattttccttctatacagtgacaagaattggactaaataagatttccagtattttctcttctgaaacatttcattctttgttatccctgtactattttgttagtagaataaatcattgaagttgagttagaaaatctttagctaatcaaaatagaaaactaacaaaagtcatgacaggtcagaactgagaaataccacagacttccactggtgttcattggagatgactactattaaaaaaagagaagaaaaaaaaccatagctattttgaaaatttccgactacaggtgtctgagcatacatcctgactaaatagcatgtttacttcagctagagctcactccttcctaaataaaaggcttacttggttttggtggtaatattattcctctttggttaattatggtattttcattctccccttcctctgaattggttaaaatgtctgtgaaaatttttcctaaggtagaaagttatgaaatgctttgctatgcctaggagatgtaaagcctaaaggaactttcatattttttgggaaaaaaaaaaaaggaaacttgtctagatataattagtgttctgttgcctttcaaatatttctctaccacttttcttaaaatattctcagaaaagacagaatttgcaacagattggcagttttcagactgctgttttaggcaggggagtagctgccgcaacctctaattgcatttctgtagagtttgcagacacttgttagcgtagactaggaatctttcaacttttgctgtgagtgactaccttgttactacatatcggatttgcgtctcattctctaacgctcatagtattggggaagaaaaaaagacaatatgatataatttgtccttcaagtatgtgaaaaggaaaaaaatctaataataacattttatgttcattattttggaatcccttaagttatatcattataaaataatctaacaatctcaatacccctgggcactcttacttttatttttataatttatattgttagaatacatttctattctcttaggcctttgttcattctactttctcacttctttaggagcctcattccttcctgaatattacattttatgagttattatatgcatcaaggcccaaagcttgagctccagcattctgaccccgaaaatgatggtttcctatcatcttctgataacagcaactgaagatgttctaataccttgccgcttacaggaggtctggcatcactgagaatttattggaaatgaggattgtgggtcctctccccagacctactgcaacagaatgtacactttcacaaggtccccaggtgattcctgtacacatagcagtttgaaaaacactgctgtaatagcattaaagcatgttccaaagagtagccaaatgatctgcagtggttttagtggatcacatcaggcttgtttctgtcaataaagaagaggagaattcaaggaagagttggcttagttttatgagagtcttttgactcttcctaagccgttttaactaaagctagcagaagacagaaggcactggtagcaagtcaactaaatgagtcagtttttaaccagtctgtttccccagtcatccttcatgagtcttttgtccactgattgtccatcccttgaccatggtgaactgtagaacccaaggacccatttcttttttctttcttgttttttttttttttttgagatggaatctcgctctgttgcccaggctggtgtacagtggcgcaatctcggctcgctgcaacctctgcctcctgggttcaagcgattctcctgcttcagcctcctgagtagctgggattacaggtgtgcaccaacacacttgactaattttgttgttgttgtatttttagtagagacacggtttcaccatgttggtcaggctggtctcaaactcctgacctcgtgatccgcccgcctcggcctcccaaagtgctgggattacaggcacgagccatcgtgtccggccccaaggacccatttctatatcgaactcactgcattaatcatgtttacctcattaggcatttactcacagattgccttgacatatgtaggccctaattcattctggagctattataccacagcatttcttaaaataggtagcactctgctctatacaaagtaggtacccaataaattaatgattcgatgacaggttttcaggaagtggttttactcttcaacattttttaatcctcttttgtcttgaggaacttatttgtctgatgctcagtgaagacccaataaatttctcttgaattgctcaacatttgttttagacttttctgagagtgccactgtaggctttttcattgatttgctcctttattttaatatcataaggcagctttttgtgacttagttacttttgtcttccagaattatgggtccctgtcagttattaatgctcttaattaacagtagccacaataaccagtccttacaagcagtttctgatgtttccaaataattttattttctgacttttttttctttgcctttgacatctgaactatacttggcaagaaaaaaaaacataaaaactttccattgcaactcatatctcatggtgattcctgttgcatcaaatcttaagttatccatcagaaaagttacgcaaaatctataaccatttggttttatttttgcccttgaattatgctaccgtaacacaaacctgaactcttatatttgtcatctgtaaaaatcacctaattggtctctgcttatggacaccctttgttctttctctgtcaataacacaggcattgccctcagttaaatctccccccagatggcattttgaatagctggcctctgttagaaagccttccatggattttatgaatcctagatcatcacatggccttccctttctctttgagcatgggggctgcctcagtgtcccttggctcctaagagagtgccttgtgctgatgggacacaggaccagtttgatgactacgtgcacagatgaagccaaacctcttgcccatcatctattccacccttcacatccctcatgccctggttccacttgaacccagctgcctcacacatcctttttgcttacaaatttcctagcttgtgaccattctccaccacctccccccaagttttaccattctctatttgtgccctacaacggctccaccctttgaaataacgcctggtctaaatgttactttttctagtgggccttccttgattatccatcccactgtgattccttttcctgcccatagcctctccgacaagccttgcattctcattcatatgaccttgtttgccaagctacctgtgctgtctctgtgtgttttaaactattttactagccaggcgtggtggcttatgcctgtaatcccagcactttgggaggccgaggcgggcggatcacgaagtcaggagatcgagaccatcctcgctaacacgatgaaaccctgtctctactaaaagtacaaaaaattagctgggcgtggtggcgggtgcctgtagtcccagctactcgggaggctgaggcaggagaatggcgtgaacctgggaggcggagtttgcagtgagccgagatcgcgccactgcactccagcctaggcgacagagtgagactctgtctcaaaacaaacaaaacaaaacaaaactcttactagaatgaaaactctttgagggagaaacttctgtctgattttgccatagctcttagcacagattctcactaattctgtttatgtgttttgtttgttgctgtttggaattcattgcttttaaaggccgaggaaacttgcttttagatccaaggcggggagtgctatttttttttctcccagatggcttttcaccaccaagtgtaaatgtcaatggcttaaagccacctgtagtattgtttgacagaaccataggcttatggaaaatctcgtatgatctgctttgtgtaaattgttctttacagtggagacttgctctgtctgcagtctttagtttctgtgaattttggggagctgtggtgtgtgggtgttaaggttaattttccatccatcactggctctgcctttgattcatttattctctcatgtgtgaatcttttgcagaaggctcaatgcattatgactatagagaccaggcaaagtcataaagtaaatcacaccatctcacgcaggacaattttttgtcactcctgccttttctctttatgagtcatagatgatttcagtcattgggattgctggaatagggatggctgaaggggtcttggtgcaatgaagagtgcctgaagatactcttctacctacctgagggtaaataatcccatattgcaaaggtgacccctggttgtactttttggaaagccctgttaaaatgatacatgctaaggagacttaaatatgaggcctttcttacctgggtgcttaataggagtgggtttctaaggatggtcttgaatttggccttcagccttctcgtccaccatagtccccatccatcctgaataaacatgcagtctaggtaccacaagtagtgttctcttgtgcaagcacagcttccagctgtgttgcctgcctccctttcagccagatcatcacccatgtagccactcctctatgggaattctggagctaccactgacatcacattacatagatttggactggtagtgccctacctgctctatctatagaggaaaaggagatgaaataagaattttaatattctttttttttttttttttttgagacagagttttgttcttctcacccaggctggagtacaatggcacgacctcagctcactgcaacctctgcctcctgggttcaagttattctcctgcctcagcctcccgagtagctgggattgtaggtgcccactaccacacctggctaatttttgtatttttagtagagacagggttttgccatgttggccatgctgctcttgaacttctgacctcaggcaatccaccctcctcggcttcccaaagtgctgggattacaggcatgggccactgcacctgaccagaattttaatattcttaagtcttaatattctgtggcacttattggaaatggttgaaatataatgcttttaatttagcatgtcattggttcactctcaaaactactgaaaagcacttatctttcaagattttaatgatgatgttggtgaggacgtttgtggtaagtagataatcacttacattattcagcactttacaaagcattttcacaaactcttgagtattggttgttatcagtttattactgagatgcctgtggtgtcttcaggggacaggagagaatatgttaacttcttgaataactgctgcagccgtagttagccccctatgagccaagcctattggctttgttactcccaaggtataacttatttcatatatataagcaacttgactaagtattagatgtctgtgtaagccattttctgtgagtcaaaacaattttgttcttccttatgtctttcttcagaggtacatctttaataagttctgggaagggaagtgaaaaacaatgcttgacctctgatacaatgtactgttttgattatgatcagcactttaataaaatttatcatcaagaaagtctttggagtgagcccctgaaaagcttgggaaagtgattgatatggtgtcacttttcttaaattaccttcccatgttgctttagatgaccagggaggctaacttcactcttgtgctctctaaattgaactgtcctgaagttttaagaaaatgaaatgatcagactcagcagttcaagattgtgttggttgatagcagccacttagacctcagttcactatgggtttctgtgtactttattggtggtcaccaagatgcaatgaaaggtcctgattttgtgaacatttctgcccacacccttctttggtacataccttttgagaatatgtaaaatgtctttcattgttaaaatagctgttaaataatattaaaggcaaaaaaaaaagtcatgaaaatagtcatttgcgtacttcttcaggcagatagaaaactagtaccagccagtgcaatggctcaggcctgtaatcccagcactttgggaggccgaggcaggcggatcacgaggtcaggagtttgagaccagcctgaccaacatggtgaaaccctgtctttactaaaaatacaaaaattagctaggagtggtgggacacgcctataatcccagctactcaggaagctgagccaggagaatcacttgaacccaggagacagtggttgcagtgatccgatatcgcaccactgcactccagcctgggcaacagagcgagactttgtctcaaaaaaaaaaaaaaaaaaaaaaaaaaagagaaaggaaaaagaaaaagaaaaagagaaactagtaccaggaaaacagaaaaaagaagtgatttgaataatttcagtatgattgagacatatgggtgaaagatcaccagagggaaaaatgtctagtctgataactttgaagaaaacatattgaccatgtctagttataataatcttttaataatctcacagtaatagaaagcttcattattttcaaaacagtttcactttcctgtcatctgtaattttaaaaacagctctctgagatggatataattatcctgttttacagatgtggaaatggaggcccagaaagatgaaatcatctgccccagctgtaataggactgcccatccactgagacatagtaaagtatcattaattaatcttttcatcatttttctatttttagtcatgctccctcactgcttaatttgtaagtaaatctaagataaaaatctatagtctcctcgtattttcatattttcatagctaaattgttaaagaggcgatggcagtgtactcatcaggagacttgttcttgcctcgaacattaaaagcccaatttaagactggagaatttcttctttgagggttttgtccacccatcataagagatttcaaactatgtaatgagtcattttacttttccccttttcttatggggacagcttctctttaatacaccgtgtggtctgccctcttggaggttgtgtcaccattatcagtagacaaatgctgccatgtgtaaaaggctatgccagtttctgcagtcctgtagttttgcccctcactagaacttcaagttgcttaacctaatcaggaatacgggcatctttacataggaagtgcacttcttcatcatatagacatagaggtcaggtattattatctttggcttcctttctcagaaattcttaaacatgaatgtctgaataaacatacagagaagaggttgggcgctgtggctcatgcctgtaatcccagcactttgtgaggccaaggtaggtggatcacctgaggtcaagagttcaagaccagcctgaccaacatggtgaaaccctatctctactaaaaaatacaaaaattagctgggcatggtggcgggcgcctgtaatcacagctactcgggaggctgaggcaggagaatcgcttgaacccaggaggtggaggttgcagtgagccgagatcatgccattgcactccagcctgggcaacagaccaagattccatctcaaaaaacaaacaaataaacaaaatatagagaagaacagaacaagaagtgttttgagtagcagaacacgactcacacagacatctaatatttagtcaaattgcttttatataaaagaaggtatacattgaagagcaacagagcctacctctatgactgacattttcaaagaaaatggctaagaatcactttgatggccaggcacggtggctcacacctgtaatcccggatctttgggaggccgaggagggcagatcacgaggttaagagattgagaccatcctggccaacatggtgaaaccccgtctctactaaaaatacaaaaattaactgggcgtggtggcacgtgcctctagtcccagctattcgggaggctgaggcaagggaatcacttgaacctgggaggcggaggttgcagtgagctgagatcgtgccactgcactccagcctggcgacagagcaagactccgtctcaaaggaaaaaaaaaaaagaatcactttgattagcagaaactatttcacttgccatcatagaaagctaagctatacttctgcttttctactactagctttatataaatgttatttttcttgcaacataaaagaaaaattgagtcatattgttttatttaatttttcttgaagaacacattaaattagctctcacactgtggtgtggacttctttctgttttccaccagtgttcttcagggtgatttttccagtgggcttgattaggactgtgtggatcattgtgatgctttgttctcagtggggattttccagcaaagatgagcttcattaaacaatgactgggttcatggatttataattggagtgattttcttcaaactgtaataaatttcagtgttacctttttctgaacgccctttttaaaagggattccatagcaagtcttctggaataataccttttatataattctttaaaaactgtaatttttacatactgattcctgttaaggcagatgttattgtatcaagaaaagactcaaattttgaacatattaaaaatagtgtttcttcagatctggtggataggtgatgctcaatatatatttgtttaatggaataaaaaaagaaaaatattaaagatcctaggaagagaaattaagttgcagggatatattgcttgtgtaacgtctgtttagcattgcaattttctgaagggaaggctatccacaactgttaattctgatctaaggaactatttcccttcttaacttctttgctaggttatctaaagggagatatgctttctcacatttgtttccttgaacttacttttaatgttgccttgtagggtcaaaactttagaaatacagctttctcaggaaacttggtcctcagatctttcagacattatcttcctttaagcttattgtcctcttgggaattggcaaaggattcccaccctttaaaaagataggaaattgtaaaatccacacttaaaaattaatctaaaattatttttcaggaagaatttatacaatggcaactaaatgccctgcagccaattatgtttatgattcctgcctcatctccaaatggtactagagtttgagtcatatgagaaaattaattgggttgggcttgattgtacatgtatatgtatataataatgttctggttataatgcagtttgcagtttttctagttacagctcaaggcaaagatgagaagcaacacctatgggcctgactgcctctgtccagtactaccatgccccatctctaactactacattttttcctattgaattctccagtccatgtagcataagtcccttcctgaactcagtttatttttctaaccctggctgcacgttaggatcacctgcgaacttctaaaagaattccaaagcctgagccaagcacctagaagttctgactcattgccctggggtaggactttggcatcattattgttttaaaagatccccagatgattccgatgtggaaccatgttgagaaacactaatctagcctaacccagtgaggttacaaatgaagaatttcaccagagaggtcaaagtacttgatttcccacagcaaagaaattccatttactgggttgaaaactcccatctgttgactttaaatccagcataacaaatatgagcaaggttttagaaggttttggaaactcatctgcagaacagagcaaatacaggcctatctaaaagcatacctcacagtaaagatggttaaaaaccaaaaccggaggaggcagagtactcttggtggggctggtagtggggggaatggatgattttccaaaagagaaaacacttgacctgggtctgaaaggctgggtatgatttaaggcaggcactattgttcacttgttagccccagggccatgctactccacttccttcaaggaaacagagggaagccggcaagtggctgcctggggtgtgtgtccacacaccatatagaggcagttcttcagctctgtcagccatggccaaagcaggcagtatttgaaccaccttggaccactcctgaggggcagcatcagacaccaggcatcctttcagacaccattcttggagtctcttccctccatcacgtaaacctcacagccaacagtgaaggcactgaactccttccaggggctgagcaggctgccttgggcatgctcttcttgaccttaaaatccacctgatagatctggtagggaggtagaaattttggtggtaggaaagccagcaattatcaggtcaaagggtttctgataaaaggagttattcagcagaaaggtaatcagattatgggagccttaagtgccagtttgggctaaattctctgagtcactggcagattgtaagtaggggaatgacgtaataaaaccactgcaaagccaggagtttgtgatgggaagataggaaatccctttctttttttcccacatgggaaataaaaatctaaagatgtgtggggaagctccttagagtgccaggactttcagtatcccccaatttatcattaggttctgtccagacctcgttccgcacacagtagcctagagacacctctggaataaggtgtgacaaaaaacaaggaaataaatttattaattttggaaaatgccttctttttcctaggcctccctcatagacattttcctgacaagtccccacttcaggtttcagaaagagatgcaccatcgtttggaattctgaagaaactcaagtttcaattgagctgagtctcagtggcatgtattttattacatctaatgccattttaatgtacttgaaactggggagatgagggcaattggtacacatgtgtaaaccactacaaaaagttcacctgagtgtagaaggtagccagtagcctaaaaaccctgtattttggaggctgttacttcataatctctattatgaaattgggaaaaattatgtaattatctctctaagatggtcttagatccactgttcaatagaactttctgcagagatgaaaatatcttatacctgggctgtgttaaggtttaaggacagcactggtataagatattttcacctttgcaggaagttctattgaacagtgggtctgagaccatcttagatgatacatgtggcttgaaacgtagcaggtgcaaataaggaactgaatttcaaatatagatatatttttatttcagttaacttgaatttaaatagccacaggtggctcttgggtatcataatgaatagggcagttatggagcatcattaaagtccccattcttctcaagtcccaaagaggtccgttcaggtaatttcttagcacctataatcacagtgggacagattaaattacttgtacttttccattcctgtgctttggaattataggctgtttctttgtcctggaaaccagatagtctaatgtttgtggaaatactacttagtagtgcactgcaattataatactttattgtaggaggatgcagccaggccttttttttttttttttaatcatctgtgtttttagttttaatcttaaaaggattataaaaatagtactgccttgtgggagaaaaatatgcttaaagtctatgagcatggagtggtagggattataaaccgttacaaacttctcctggaaattctggggaaagggaagttaaagcggccaatagaaatctcctaggagaaaacttgccctgaagggatgcttttaattgggttcagtatttatcagaagaaccctgcaaaagtggtttccctgaaggcatttggattttcccctgtgaataaatttcacccaccttggtcacctctgtgctgtattctcctagaaactcacctttatttggcatgctgtgacttaaatcctccaaaaaaaaaaaaaagcctttgaaaaagcctgtgggtttttttttttttttttttttttttctctaaaatgttaatttcctttctttaggcttgtgtgggctttgactggaaacttaatctgtgtgcctgggctctgcattaggtttcagtcattgaaatggggcttaataagaattacttgataccttaggagtcagacgagccttacatttatcttgggctcagggatttgcattttgagaggttgtgccagctgacatgagcctttacaggtttcagcttgttgcaaacctagttgggtccatttctctcacttctgagaccttttgctgctgccactcatagctaacgtgttttccatggaacactactccttgtccctaattgtcttctctccctacctcagcagtgacactacagacagccagtcatttaatacgagactcattccttaagaagttgggatagaactttaattacacaaggcatccaagccagcagtcagggccctttccaatgcgattacttttcaagctctgccctgcttctccttccatttccctctgggccttcgttttcagatctcctcagaagccgaggaacgcaggtccttttgaatttctttagatcagtgttgtcctataggactttctgcaatgatgaaagtatcctgtctattcctggccacatgtggctattaagcacttgaaaatggctggtctgacttggaactgaatgtatgatttcatttaactttagttaatttaaatttataaatccatgtgtcctcatggctactgtgtagctctatctagattatgcccttgacttttgaacaatgtgtcttgggagagttctcttggctctggccctccactttcatgaaccagctcctcccagtggggaaagaagaactctctttgacttcagaactgacttccttttattgctaagttagacaggctaggccttgagcttaaaactcttcaccaactgtttataccctccatacctggcctcaacatgtccttttttctctgtgactatatccttattctttatccagcaacagcaaatatgcattaattttctgcagataaggtttcctttggaacttaaggaagaggtatgaaacttggctttggaggacttagggataggaaagccatcaccaagtgtttatagagtaccaaccaccgtgtgccagccaatgtttgagatttggggaatacagagtgaattaaagtccatgtgtacaagctaataaacaagattctatcaacatgtcagcagataagtacagcgcgagggtctgagaacaatggtagatgcttgtaattttagaagcggttgtcaagaatggcatctttgataatgtgatatttgagcagtaattggtatgaaatcgggatgaagaaggcagatctctgggttaagcgcattctagttggagggaacagcaagtacagtgtcctaaaaacagactgtgcttgtcatttcctcccctcctcccccatggtttctcatttttgcttctctttctaagagttacatttataggcatacatttttacactggacatcacaagaaattgagcgagttcacaactccactggtgctggtaaaaagattatgctaagatggataaaagactatgaaacatagtcaaaatgcacttctcagtcacctctggccatacgattttacacatctgggttctcaccccagaatgagataggtttaatagataagattcagtgtggggcaaatctaaggtgccaaagttaggtacatactagaacttccataaagagttgtcttaagaaatagaaagcattataatttgactttgtagccaaaggtcattcaaaacatttcaaagtttagatcacttattccagttttatctctagtactaaatgttatttcagcacacaaatgtggtcattccccatggatggaaggagccagctgtgttccagaactatgttggaagattgcaccttgaagactgtgtgcatggttctcattttccatcttaaaatcactgctggaatctatcttgacttttccacagcccattgacaactgtcattatgtaaatactgtccttttttctcaccaactactgtggctgatgtctcccctccaaaatttatgttgaaacttaatccccattgtggtggtatcaagagacggagatttgggggaagtgattaagtcatgagtggattagtcccacataaaagggctggaggtaaccagcctggatccttttgcccttccattttctgctatgtgatgacacagtactggtcctctctagaggacacagcaacaaagcaccatcttggaagcaggaaagggggctcttacgagacatcagaactgccagtgccttgattttggacttgtcagcctctagaactgtgaaaaatttctgtcctttataaatcacccagtctcacatattttgtatggcagccaaacagactaagttaccaaccttagtgggattgctaggacttggaaaggagtagccttttttttttttttttttttttaaatacagagtcttgctctgtcgtaaggctggaatgtagtggcacagtcttggccatctgcaacctctgtctcctgggttcaagtgattctcctgcctcagcctcctgagtagctgggactacaggcacgcaccatcaagccctagctaatttttgtatttttagtagagacggggtttcgccatattggccaggatggtcttgatttcttgacctcgtgattcacccacctcggcctaccagagtgctgggattacaggcgtgagccaccgtgccaggccgggagtagatattttaatcacaggaggtagcatcagaaaagttgcagctactcaccacaagagagacctttatgatgtttactgcaaattgcatcaaggtcatgacagcaatgagtaatgcccaggaaaggcgaagatcaaccttacactttttcatctaactgcactgtgagaaaacaagcaaaattgcccagtttaagggcagattctcagattttgtttcaaatttcctgccctttgttgtcctttctagaagccttaacaatacttgcaacttctttcttttttttttttttttttttttacttcctctgcttgaaaaacatgaagggggaagtttcaaagtgtttggtgttatcttagaaaccaaagtgaatctgaatgtgtctttctgtcctttttgtgtcatttttcaaaatgaaagggacctttaagttcatcatgtccaacccatttgtttgactggttggagaacaggcacagagagtggttgggtaattgcccttgaactcaaagccccctcatggtcgattcagagccttctccactgcaacctgctgccattcccagcatggtgaattctcctccagtagaagtcatatagcaatgttttataattaacttttacgtgagcaaatgagctccaggagagaagattaaggaatattgctttccatatatctggatggcccagaacactttttaactaggtacttaaaaatctactacaattgttgttgcccatattcttctgtaattctttcatcagctgtgaatgaaagtacagcagttttatttccttgaaaagtaagccaaacatgattttatttcaatattttagaattccacaatcttaagacacatcattgccttcccatctctgcatgtcaaacttactaattttattagcatgttgcgaaataacacactaagtgtctcaaagccaaagtagatcagctctcgcctgataaatgtgcaggagtaagcagaggatttgaaaattgaactggattctcaagttactgcctgtttgccagacctatgctggttatgaacaatatttcaaaaccagattatttggttctagatcctaaacactcttggcaactttattgtaacgatgattgattccattgtatatttgaaagcatcagggcacagtggtaacaaaaaattattatatttcaatttgtctattcattcaaatttcctgaaaggttttttagaagtcatcaaactgctacattctattgatgagtaggaatagatttaccaaactcatacttatcttgtcatttgtttcctgcaattttctttggtgtgagagagcattgcatggaatgttacctttctagcaagtgaatgcttgtgtggcattttttactgtctagaggattttcacaggtacttcaagcatgtttgctcttcatcatgatcctacatgggacgatttcataaatcaggaaatggaggtttcaagaagttaagtggcccacagctaatacatgtaagagcctgaattcacactcaagtttttaccttaaaactcttgggcttcaccaagctgaccttattatatatgtctcctaaaataagtgaagtaattacaaagaaccaaagcttttgtctaagaaacttattgcttccccaccccttgtatactttcttcaactcctagtagtcacacctgtgtctttgccttgtactggaatgtgtgtaaagttctactcttaaactttttgatggaatatctatttcattgtggagtatcaggaaggatgagggcttgtgtgtcaccattggctttgtcttttatttgctttctctcattgatatgatatgataagttatttcatctctttgacccttaatttctccatctataaaatgttaatgacaaaattgcatggtggttgtgataagtaaatgaaataatcatcacagtacttaatactggactaagcatttggtctgcattcgataaatcatgatcatggtaataataattattaacatcacatagatctgatttctaaagtagatgtcctctggccttgaactgaaatgtgattatacacattagagaattacatgcatgttaaaaatattcatattagagagttaaatcatgactttttgcattctagttaaaccctaatattagaagagagaattgaatgtgcaggtgaaataatcattaattgtaaacattcaggtggccacaggggcctggcaggggagtaggtgacatgaaggagtgtcagggaggaggcaaatttgaggacacagagactttctcaagaggagcatctcagctcacagtcagctgactgttgtcttgggatggtgtgggcccactgtttccaagtcttttttatttctttaagtggaattagaaaaccagttttgcatgtgaaatctctgaattttaaaacttggtttatattttaaaaagaaaagagttcaggccaaacagaacacatctgtgctctgtgtccagctcttgtacccactgtagcaatttctgctttagcttctcagtctgtgcccaagttatttggttgttagaaaccaagcgccttggacctcgttatattactttttaaagggatgcctttcccaaatatggtagtactctggcccttttccagagaaaatatggaaatcatctgttttgaccaatattttcacatgtttaataaaactgtaattgaaaaacctttcaggtaccaggcatgcacaagaaccccgcagcatattttgaaaaactgaagcaaaagcctccacggagaaatttatcagtgaaaattctgctctcacagaacattgatattcggaccaaatcccatgcttagttgaggcaaatggttcatttcaggggctgatttttcagattctctaatagtcactatcttttaaaaatctgttcttaccagattttgtgttagtttctgcattttccattaagctgcctcagtactttgagataaagaattgtttaaatcctaaatgaataacttaattaaaaagcacatcttcatttagaccatccttatttccaaagctcttttgatgaaaatcatttcgtgcatttttaaaaattccctagaagaacttaaagatcttgaggaaaggaccatgtcttatcctgtcccccttccctcaagggtttaaatatgagggctgtcagaaagcagcacattttcgtttaggttgactaattttgctggtaagtaacaaattactttagttgaattggaatgttgtaaaactccgtcagtcgtgtatcattatcttgcctctatcagtctgtgccatttaccaatgttttgaccatcaccaagagagttatttaatcatcttttattttcaataataaattatttccttgttgctacagcactccaagtcctgtcaactgagggagaattgttttctcagttgctgtcactttaggtaaagtaccaactttaaagcacttctcagcagaggcataaagttattattttgagagttcatgaaatagtgctccattctactctttcacttgatctaatataccatttgcatttatatggcttaacttttttaactggcttcctgttcttctcagccccaaaccctacattctggtttttgactcatctcatagtccctgcagtcagtctttgccagataaaggcactgttaaagtgagctttatcaatgaaaaacttaagaatttcatgtattgatgacagtatttactataaactgcttgcttctccccagctttcagaaatttgttttattcactgggtcctattagagctgaaagagcatgattgagaaagttacaattgtttcagctttttgaatatggcacaagtgctagaattctgaaatactgcctttggcaacaatgtgtagatatttccacctgcaagagtcattttaaatgtttagattttgtctcctgttatgtggcctgtatctcagagaggtcccctgccactaaaaacaaaaacaaacaaaaaacagaaaaataaatgaaaattcagcaagcgttggggggactcaaattgtacttcattcttcaatgatacaagaaagcaagaaaaccaagtatgcatttttaggatttatttggggtcattggggctggtaagtgttaaataggaaaggatgcaattgaaattccagctcagttattttatgtttgtcactggagaaagccaattatttttccgttcagctacagcttgtttcattccgtagaagactaaaaaaacttccttgtaaattgcatttaaaaaaatttgagtttaaaggtacagccaagatttcaatttaaagtacctcattggatgaattcatttgagacacaagtaatcattccttaatcccttaatttgtttggtaaatacaaatttatgtttatgcagttttcttaaagcaatcatagcaaactactaaattcatgagccaaaatgctagtgaaactcaaacctacaaagctaaattccctcagttgaacaagtccaaatgaggaaatcacacacataaatgcataaacacacacactcacacacacacttcccgtatcagctctgtctccatttctgacctcatgtttgcatttaaaggcaagtaactgattcacatgaggttgccgttgttaatgttgcctctcaaactagaatataagccataggagggtagggaccaacctggtgtttgttttagatgtcttgttgtgtggagagtatcccagacatttgatatccttaattgttggccagatggtaggtagtttcagtgtgaaaatatatatgtatgtgtgtgtgtgtgtgtgtgtgtgtgtgtgtgtgtgtgtgtgtgtatagtactgggattacaggcgtgagccaccgcacccggcccgtactaggtattttactagaattatttcctgctctaagagattttagagtattgattatgtcattcttgacaggttttaaaaactatattagtattacaaaaacatgtgcatgaaaaggaaaattgatgcttttgagcttatctctttattttctgcccacatggtggtctccctattaggtattgtttctccacttctgatcctggtgcccagaggctatgtggggctgtcacttgaatgaaagctgcatgcatctgccatgacagaatctgccttgcatttgctcatttataatgaaaacattttttaagtacagaaaaataatagaaaattcaaaagtaacagaagggtatgaaataaaaagttgcttctcaacctcagttttctacctatttattttccttttacagggccaaataatgtttgattctcatgtccttgcatctactcccagagaccgtctaaatatataagcatgcatgtgtgtgcacgtgtgtgtgtgtgtgtgtgtgtgtgtattccctttaaaaagcagtaacaggccaggcgtggtggctcaagcctgtaatcccagcactttgggaggccaaggtgggcagatcacgaggtcaggagatcgagaccatcctggctaacacggtgaaaccccgtctctactaaaaatacaaaaaattagccaagcgtggtgttgggcacctgtagtcccagctgctcgggaggctgaggcaggagaatggcgtgaacctgggaggcagagcttatagtgagccgagatcgcgccactgcactccagcctgggtgacagagcaagactctgtctgaaaaaaaaaaaaaaaagcaataaaagcaataacaacaaaacagaaatggtggtgtgtcaaccagggttccagttgcaagcagatggcaccctcaaattagggagatttaaggagagtttagtaaaacaagtacttacaaaggtatggatagagtcaagggaaaccaccacaaaatgggagaaaccatagtgcagatacttaggactagtaattgctatgttgacttgctaggcccaaagtggcaaggagagggaagaagtaaatcttggaaatgacctcctgaagagaacctgtgacctccaagtgagggacttggccagctggaaaagattccacagagggagccagaacacagataccttaaatgtgctcctcattgcttcccttagataccgctgggtcaccccattggccaaacttactggaagcttgagggcaagagagccggttgatgtagtccataaagatgagcctcctggggcagacagtctggtgaccaagggtggagaactgatctctaagggcaatagaagacacccagcccaagtaactctatacattggtctctaccttgcttattttcttgaatgctatagcctgggcttcaacacttataaagatagccacatggagctgccctctgctttttagtcgttgcgttgtgttccttgtttggatttgtctaatttattttactagtcttctcttgatgagtggttaaaaaaaaaacctgtttgtccttacaaacaacactgcagcgaatttatcaatgaatatcataaatttttagaagcgaaagtgcgaggcaaaaggctatttgcgtttgcagtgttgattgatatcaataacatgtactcctgagatgttatacctgtttacaacacagcattatgagaatgtttgtttccccatactttacccagctcactgtgttatctgacttattgatctttttcaaaatgagttaggtgaaatatggtatgcatttttaatctgcatttcacttgttagcaatgaggttgacatgcttcgcttttagagcttattctctggtgatatgatcaggaagtaatatttaaagtagcgtttttttaacacaatatagagaactcatatgatttgttatttgtttccaataagcattgataatgattttaaatggcattaattcttctggcacttgtagaatacttactatttaaaagcaagaattataaggcattgtcatttcacagagattttagagtattcactttgtcatctctgaaaggttttaaagtattattactacaaaaatatttgcataagaaggagaattgatgccttcaggtcacttgtctctgttttcttcctgcacacgccatagtctccctgttagctaaatgatggtatctctagtattgaccttggtaccccagagaccatgtggactgtcagttgaaggaaagcccgatacctctcttctctcaaggtataattagataaagcattagggttcaaacacatttttaaaaactaaaaagaaggtattgtattagaagttccaattagagtgtgcaatagatgttcagcaaaaagaactattcctaaaatgttcctatctttggtttaatcacaaggtgtttgtttggttggttggttggttgtagtaattggccaaggtatctgattggcttggggatgtctttcctgaagaattatacagggaatcctctcagattgcttgactttcttctttgttctgggtgggaggaagtgtgtgactagccaatagccttgtcccaccttgtctcaagggtcggagctgctgttgctagcatcacaggccacagcggctttctgccagatggctgcctcagtatctgactcggaaatgctgcaggcaattaaaaacctcctttcagagaacatgtctttcaattctgggcccatatggtgatcagggcctctgggtttgcaatcatttaagaggtcaggctcaagagaaaagcatatggaaagaactggaagatgagaaatgcctgtaaaaaggtgaagaataggtatttaatttcactaactccaaaatgactggagaaagggaaacaattattaaaaactgggttctccacagccttcccactcaacatatagtgggctggcatcacccagggcagcagctcccttcctatctgtaaggtcagtttcgtgtgtacttggctaggttctggtgcccactaatctcattgttgctgtgaaggtatgttgtagatgtgattaacagctaaaatcatttgactttaagtaaaagaaatcattctctataatgtgagtgggcctcatccaatcaactgaacagccttaagagcaaaagctgaggtttctgagagaaaaaatactgcctcaaaactgcagcattgatttctgcctgagttcccaggctgccagtctgccctataaatttcagacttgccagcccccacaataccactatgctacacctgcaggttaaaaatattcccaaagtacttgtgtattaatatttgagaagcagtactctaaaacagtaaattctatccaccagtttccatggattattctttgagatgttatttaattgtgtcaatttcagtggtcttactatgaatatataacactaatcaagacatccacaggtatttgtagaacaaataaatttctgagtttccccccacaaaaaacactccagaaaacaacagtcggtagatacatgaattcaatgatacacgaatgcatgaattcagtgatacatgaatgcatttctgacaagtgtttatggttattgttaaaccttgagattttacctaatggttcagctaataatagacactatttcaaagatttggactaaggtcatattcagaatttctaatatttatctgaaataagtctaaatcttattaggctgctcatctgaccctcaaagacaatagtacagttccagaaatagacacagctaagcagtcaattcatattctcaagacctggaacctctgtctgtaggcagtgagtgtggggaaaatgtgagataaaatggggaaggtggtatgacctagagtgaaggttttgatattactcatgggcttatttgaagagaagtgaaatattatgggccatgtgatactatcatatgctgagagatgctacccatgttcacttcctttagtggatggctttctaggtgacagatattcttattggaacttctttctggagaactttatgaataacgaatttgcctattaggggtagaaaattctctaaagatggttagctgctcacagagagtctataggaatcgaagtacagtcatctcttggtacccatgggggattggttccaagactcctcgaggagaccaaaatctacagatgtttaactcccttatataaaattgtgtaatatttacatataacctacacacatcctcccatatcctttaaatcatctctagattacttatacataatacaatgtaaattctatgtaaatagttgttatactgtgttgcttagggaataatgacaagaaaaaagtctgtacataattcagtacagccacaatcatcaatttttttaaaaaaatattttgcatccacggttgatggaaaccgcagatgtggaacccacagatacagaaggctgactatatactgccttaatataagaatatcttaactagagagacttagactaatataacaatctggattaaaagtaatgttgaagttgggttagggtttgctatagggttaattaggtgggttttgtatcgttgtttagaggaatatctttattcctagctatgcacatgtatgcacttactttccttcccattcctttggctttttaaacattatgtattaaacgtaaggagatgttgtttgatatctgaggtcgtggctggtaacatcttttcctgtggtttggagtgcacagatgcaatgtcccatacagcaaatgactgttacccttccctcccactggccctcatcccactctgaccagcagtataccacttagcatgttattagtgactcttgaggattccggggttggcttgggatgccttaactggatcttacgggcctcagagaatctgcaaaccttctcagatgatctacaaattttgtatttgtttcttttccccaactccaaagtgtgttcataaggcttttatcaaacttaggtgactccagcaaaggtttagagtagctttgccctctgaacttaactacctattccaccagtacatatggtatgcataaaaggacctgaggacctatatcatatagaggaaaagaatactggtttaaaacaaaggttggaatgtatatgacctcaagggctacctggaattgttaaggtggggagtctcctagggtcaactaatagggagtcgatggctggtgctgaacatgtcctgcatacaggcttttgaaaaaaaattctggttaagctcttgcagtggtagcttctgctgtaacaaggagaaaaatgtggcatccctggctgggttcttgtgaagtaatatgctgtatcttaggcaactttcctcatatacagtgggtgctcagcatgtgcaaattcttattgtacactgcccttcccaccatatgcctgtgtctatatgcagtacagttgcttgtttggcttttcttcaacattcaatggaaaggctttctcttgttgggtctacccatcaagtaacatgtattatatctcgccaggggccccgttacagtggtgctcctggagctgtgcaaattggtggaccttctctctctttctctctcctccccctccctccttgtttcccttcctcccttccttcctctctctctccctacatccttcttccctttctctccctttctttcttctaatggtccttttttcttttccctgttgattgtgttctgcaagcatcggacttaaaccacttgcatttgtcaatacatctgtggccaccactgctcccagcacccatctcatctgttttcatttctgtcttatctatcgctgctcactcctgtcactattctcacgtttctaaggttttgctagaaaaggactggccagcacggagaagaatttctatctgaggtgtgaaagagctaatcacctctccttaggtgcatgtttttcacaagggaactaattccagctatatccaggtgctgtcccctcagcagcataagttgtatatgtgtttgtggtggtggggtgggagtgggggggttgctgttttgttttctgtttattgtgttttttccaactaactataggtctgggttctcaaccttggttccacattagaatcatctgggcagcttctaaaaatcctgatgcctcagttaccttccagaaaaattaaatcagactatctgggagtgggaccccttcagtattttttaaatttcctcaggtgatggatttcaacatgctctccaagttgataaccaccaatctaagctaaaatcctaagatgttggaagactgaatttcaagtaatggaaatttggttttatatttacaaacaacaaaccttcctaatcagcaaatagatgcttgtccaaaacatactctatacaaaaaatacgtatgtatgaaataaacaaaacgtggtttcactttttttttgctttaaacaatgttaaagaaacctaaagtgttattagttgtttcaaaaattgatccaagtataaccatgttagaaaaaaatacatattaattgttgtgtttctcccaaatttcacacagttcagagagtatttctgcctatatttttagctaagcatagagctcttggtctgggagacactgagaatttcaaaatagcttgttacctaaaaataaacttcctgaaatgaacttgaggcccgagagggatgaatggctttatttttttcttctatatttactgttaccacaagaaagcaaatcttaaatttatatacgtttatatttttagagacccaggaaacaggtgctatgcccaagctacaaagacagttgcagggcaaagtatctatgacagaatcctaaaattcacaggacagagagtgactgtggaaaggcattgaaagtgttcctctctaggcaagagcggagggaacatgaggcttttcttaggcctctctaagggttatgccttggaaaagtacctcacaactttctgtggcccagcaactgttccagcaccccatgcggtctaagtgcttaatgtttcttagtctagcatgtaagtattaattcatgtttgctggttgagtgcctagtagccttgtcatacttcactgactgtccaaactcatgtcttaaacatcatcaccatctcattgaggaagaaaatggggaatggggtgttacacctttatttgaactgcccctagtttgcagcctgtattttgcaaagaatagtctgtcttccatattttattgaataaatgtgaatgaatatcacatttataatcacattcctctctaatctgagtgaagaagttctgtatcctatcctacatggcatcaagggccaaacatggactccttgtattcatcctgtgttcactcatttatccaataaacatttttgtatgcctgctatgtgaaaggttctcttcctggcactggagatatagtaggtaagtgaggtggagaaagtttcatggagcttacatttttgtggatagattattagcaagtatgcgatgcagatagtttgtgcagacaataaataaaacagagttgctataggatgaagaggtggcatttgatcagagatcagaaaagtgacaggaagctaaacaaaggtaatagcaagtgaaaggcctgaggagggaatgaacttggcttcttcccagaagggggcaggagattggtgatggtggtgataagggagaggtacagaaggcagatcctgaggtggattcagcttttatttgctgcgatcataactccaatgcctcaccaatgcttgggattgtgtctaggaggcactcagtaagtgttagttaatcaattgatttgcctcaaacacagagagagatcagtagaactagtcccttgaaaagaagacccttatagctctttcaggagtaggtcaggaaaatggcggcaaaatcttgtgcctccagcaacggttcctcctttggtgtggcacttcatgactctgtgaggttatagcctccctgcccagctgagcggtgatgctcgcctggctcccacatcctctgtgctgccctctattttgggtcaccctgacttggtctgtttcctgtcttattcaccagctaaactataatttccttaagggtacttttatttgtgggcccagcactccgtactatgcagtgggcccatctaggtttctttattgaatgataagatttttgtagaaagtggaccttatgacaaccattgacaaaagcaaatggctactcaaccaccccaacccctcaccacccctcaccacggtacaatggattttattacaaattgcatacaccagataattctaatctgatgtgaaggaattattttgcctttcttcagattcattctcatgacatcaagttcatttgaaattgcataacatcttcaggaattcattggcaggctgcctggcagttggataatcatttaatatatctttctctctcctcagttaataacgacatgatagtcactgacaacaacggtgcagtcaagtttccacaactgtgtaaattttgtgatgtgagattttccacctgtgacaaccagaaatcctgcatgagcaactgcagcatcacctccatctgtgagaagccacaggaagtctgtgtggctgtatggtaagcaagccttttaagaagttattctttcttttcccctttttacataatgtattctcatagtacacacagtcagtgtatctctgtctcctaaatgtaaacacctgttccatttccctttcctttagaccatctctctttcgattattaaatgtagtttctaggggtgttctctgcatgtatgtgtacgtttatgtgggtatataaacgtatcatgattataaaatgatcatgataaatgtaaagatcataaaatgatctttaatataataaatctggaaactctttcttgtatcaagaagagggatttgccgcttagtagtcatttaaccgacacctcctcagcaccccatagtgagaccaggagctttgttctcttgaggcaatctcaggtctggaagaagaggtgatgaaaggttggctgttggaagagaaaactaccagccaaaaatggggaatctacttggagaaccacaaaaacaacctgtttttttagtcagaaattctggttatattattcatataaccattgggatagatatgacttctttctctcagctcagaactacatatttcttttttttttttgagatggagtcttgctctgtcattcaggctagagtgccatggcacaatcttggctcaccgcaacctccacctcccaggttcaagcgtttctcttgtctcagcctttcgagtagctgggattacaggtgcccactaccacacctggctaagttttgtatttttagtagagacggggtttcaccatgttggccaggctggtctcgaactcccgacctcaggtgatccactcgcctctgcctcccaaagtgctggaattacaggcatgagccaccatgcccgaccagaactatatatttttatcggatcacattttctcctctctctctctctctctctctcattccctccaactcatacatacatctcaaataataattatacatacacagtggatactcatgaatcatttgattaattcatggttatagattgtgagcatgaacaagaaataaccttgatctttagaagagttgtaattttacaaaagtacataaattcattaatgagatatgacattttgcagacttattctgatgtttttaatttattggccattttaaaaaaagtaacttatgtgtctcctggctagttgacaaacaagaatataaacccaaatatctctcccccttttttgggaatgagtcatttgagacccctagaccatgtaaagctagccttgatgatagatctggaaaccttgcaaacttctgtacataccacgggatgaactggtttcttaagaactgaaggaatgttaacagcaaagacttgtcatgacatacttgccaatatgatatgatacctgtccatgtccacttctaggtaacgctttcaaagaaaggatttggacaaagaatgtgttcagaggagagggaccagtgtggttagaggcctagaaatcatgctgtctgaggaatggcctgggcaattagacatggttagtacagtgaagagagatcgtgggttctgctgatgaaattgaaaggctctcaggtagaaaatataataaacatattctgcataactctgaagggtagagggaggatccataacatttgcaaggcaggcagacttgtgctcagcataagtttagacattttcacaatcatggtttcccaacagcagaacaggcttccttttctgtaagcaccaagtgaagttcaggagaggctggatgaccatatgtcaaatagaatgcaggaaagattgagacaccagactagatggcctcaaagcttccttccgtggtttcttaaatatctacggtggtgtgagcacttgcttttgcaacccaaaaaggctcttttaattaagatttttgttttcctgaccagtaatacaagcccaaatcattaaatgtgaatcaagtctctctagaatagaggctttgctagcctcaaaaaaatgtgagcatgtcgaagagaggaggcctccctgtcttttctgtgtcccagctataaagggtaaatacaatgaacattattttgacctgtgctggccaaagaaaattctcccgtgaagccaggggtgttgataatgagaaggggaagtatagggtacgctatagtgccctccttgatcctccttcatgaccaaggcactcattccctgggagtgttggctgttgaaggatcactgctgagccttccctccagtgatgggagctgcctcattcacgttggacacttttcatgggtagccatcatcccatggctagttgatgcagagaaacaaattcctggttattttgccataatgtggtacatctttgaaggacatcccattttcagagtttccaaggcattcactgaggcctttgctgcaacctgcattatagtttagctttttccttctgtgcaatactgttgcctttagtcgcttacagatgcatctccaaaaacctcctgcacagaactctcacagcctcaaggtctgtttccaggaaacctaaactaagacaggaggctattgtaaaaatagccagtgtggaaactgaaaggctctactatgattgtagatttcagtgttgttgtttttttaatcagttttagtgttttttcattcattcattcattcattcattcatttaactaatgtcagttgtgtgcccattccatataaaatgcttaagctgcctccaaggatagaaatattttataaccaaaattattattattattatttttaaattgagagggagtctcccactgttgcccaggctggagtgcaatggcgtgatctgggctcactgcaacctctgcctcccgggttcgtgcgattctcctgcttcagcttcctgagtagctgtgattacaggtgcacaccaccatcacgtggctaattttttgtatttttagtagagatggggtttcactgtgttggccaggctggtctcgaactcctgaccttgtgatccgcctgcctcggcctctgaaagtgcttagattacaggcatgagccaccgtgcccagcctccaaaattaattttatcatgttggttcttctttcagtggaaattgacaacctcttcagtggctcagagcaaatgttgcaggacaaaaaaagaagtccgtatttacttctttgtatttacctttcctatgctcagctatatccaaaaagagtttgaaaagttagctgtgcctggctgttacaggagtgagtggagaaagcagttaagggctttaccaggtctcaagtattacagttgttttctctctgtgatgttagttctctcagtagctaagaggtagaaaaccggaggctctggaagagctgcccaataattatagagcagctttctttcatggctcacagttccttcttaggcctctataagcgtcacaaggaaaagagaccatgcctttctgtgggcacagcataccttcgttttattacccaaaccaaaaacaacctacacacacacacacacacacacacacacacacacacacacacaaaactgtgggggcagggaggaaggtgttcttgttccatgactacagctgatttgaagactgccaagtagctttggggttaaagatgggtagatttccaaattatacatcatttgttgtatgatcatgccaactttcatttagtttcatttggtgtcctgatagccaccctcaaccaattattctgcttgtcactcttcctgtcacagcagggaccaacttagcaaagccttgctcctcttgtgtctttcggaattctagtttaagaacccttgagccccttcacaagcagacacatgtacctccactggagtcaactctgggctgcatggatgttgacactggcaccattcctgcctggattgtcctaacccatacccttgcccttatccctttgtcaacatattgtcctttaatgtccttgacttaagcactaaaaaagtggtattggtcaaagttgctctttctctcatggggatggccccgcatcttttataggtgcaagctgtgtcttagctgcttcttgcttctagcctgccttccgttttccttgctgtgagcagtgagcctttgtgcatggggcagggaggattaggggaaaattggtgagtgagtacatgcatgcattggctcatgtgtgcactcagaatcttcatagaagattactctagcaaaactgactggaccagattagcccttccttccgctccctctctagacagagagaatgcgattcaagacaacaggtattttgcatctaaaaaggacagaggtgaaagggtggatgtcagactagccttgttggacagtcatccaagatagtatgttcatgagggagcagagggaggtagatagagaggtgatacccttttccaagagagccaaaatgttcttttgttcaattataatagtgggcattaatcatgttgtttaaaaatctaatgtacactgacggccaattgagcatttcctagggcccaaggaaaatgctatgtgagaaattctctgagccctgggctaaattagtcttcaaatatgtgctatgaagtgatactgtcaaagtagttagtttatgacagcataaaatatttcattgaactgtaaatgaagaacaccctgacatccctttccatttcttttatttatttgttttttttgtttgtttgttttttctgaattgctcctttctgtaatttgggaaagactgcagttctttatctgcgatgtttcttcccgtttttctcagcagaaccagctgttgacaaggagtataccctttacacgcaatgctctggggcccagcaaacaaaaaaaagaggaactgtgactatttccccaggcatgctctttgaaaacagtatagctagacaggacagattttgccacttaaactaggggtgtgatgtgaggtttgcattacattcaggatggaagatttaaaattatcctgagtacctaggaatgttctttttttccatgtcttcccctttaatgatttaattaagacttaaatatgtaaagttctccaccaggactgccccgtggaacgctgtctgctccaggtgatgtttataatcacaaatgggttccaagaataaacaaaggaaaaacagaaaagagtagaaaagcataggagactataggacagcctgcgaatgctggagaacaggaaccagctgccgttgttaggaacaacttcatgaaggaaaagtattccagattgcctttctgtctggaggccatattattcatttattctctttctctctctccctctcccctcgcttccaatgaatctcttcactctaggagaaagaatgacgagaacataacactagagacagtttgccatgaccccaagctcccctaccatgactttattctggaagatgctgcttctccaaagtgcattatgaaggaaaaaaaaaagcctggtgagactttcttcatgtgttcctgtagctctgatgagtgcaatgacaacatcatcttctcagaaggtgagttttcttctcttaagggtgtgggacctgagatctgtgccaattttttgtatccttggtctgcagtgtcatagagcacattcctcctgtggtggattgcatacagtggattaggagctcattcagctggtggaaagaggggcttggggagtagcagggtttgttctggttctcatcaaatatggttgactggggcaaacattattatttgtctttgacaaatagtttctttcacctagagcagtgtttctcaaagtgcggcctcttgagcagccagcatcagtatcacctgggaacctgttataaatgcagattctcaggccccactaaatgagaaacatagagggtgaaccccagctatctgtattttaacaagccctcccagtaattctgtgcagctaaaatttggtaactattgttctaaagatttggatggggttgtttaatcttggaggaggactttctttataactgatgttgtttcttgtacatagtcccaggatttgtctttagggtacttgtcatcgatcccatttgagagaaacattgcaatacagagaggaaataataagccaaagtttacccctagagccaggagaagagtagattagatactagcctccatctttgaagttcagcgtttactcagcttgaaaggaaggcatacactattccctcaatttttaataagaagagaattcagtggtttttaattacaaaagtagtatatgctcgtcatcaaaaatttcaaacaatccaacagtgtgtgaaaattaaaaatgaaagtacattttcgtcctcccctcactcccaatgcaacagatcatctgtattgacaatgtattagatgcacacacgtctctatcattcattcatattatctcccactccatcctctctcccaatctctccctgtcttcctttctctttccctcctttcatccatctgtccatccttccatccactcatccatctttcagtacaactatctgatcatactataaatattattttgcaacacttttttatacccaaccacttttacaattccttctaaacaagatagaacacatagatatactgtacatcttttaatttagtctcgaatttcatattatctcccacgatggatcttatcatgtccctgttgatggattgtcttcagtttttccacttaatgctacattgaatatctttgtaaaaatatctcatgcatttgtgctaatatttctgcaaggcagattgccagaagtgaaatttctagattagaaatatgtgtattttaaatttgaataagcactactaaactattctcctcctgaaaaggatgtaagcatatggatttccgtgtaccttctccaacactgggaatggataagtcttttaattttaccagcgtggtagtgtaaatgttagtttagtcaacaataggtctgatttaattaaaaaatctttttgaaatacaaatgctggctctacaccctatctctgcggccatgtgcattccacctgcgagaagctatgtgtcctcgtgtttcgtgtttggtgctcagtagcactgcagatccagcttgttctcttcctgtgtccttcacctactgccattctccctatcttcctgtccaacatcccccaggccaacttctcagtgaactgaaggcaggcatgcacatcttgtcagggcaacgctttccagattactcttccttcctatgttctcatcctcatcctgtaaatggtccatttctctcgttttcttttctggttgttttttttttttttttttttttgacggagtctcactctgtcgcccaggctggagtgcaatggcacgatcttggctcactgcaacctctgcctcccaggttcaagtgatcctcctgcctcagcctcctgagtaggtgggactgcaggagtgtgccaccatacccagctaatctttgtatttttagtagagacgagtttcaccatgttcgtcagtctggtctcgaactcctgacctcaggtgaataacctgccttggcctcccaaagtgctagaattacaggcatgaaccactgtgcttggcctcatgttctttatgtgatttgagttaggagggaaatctaaatagtttaatcacatgaaacatggtaacacctgatattctgacttaccaggtcagctttcttcaagtagatcaccttttaaaagaaggcctaggctaagccaaaggaattaatctctgacagtagaatacccaggcatgtttactagcattgaagaaacttttctctccttctgtataccagcttgtctacagtagacaagtttatttcctccaaaaggacaaaagttgataaatggcctgcaagttggatctatattttatcattgaatatctttgtcaaaatatatcatgcattttatattttactatgagcctttcagatactaatgacttccattttcagagtctttcaactcaagtgatcatcatgggcatccctcatatttttcctcttatttattctcagactttcttatgaagtgagataataagcataaagacaatttctcactgtacagtacaggaagcctttcacagctgacgactcaaatgtctgggtgatttcagagtcttctaaaatgctccagaaggtagggggtgtttgctttttaagcatctcttttctgtgtggtgggatatttcttccacctaaaacagcagacattaggagcaacattttatattccatttctccccttattgccaccatctcttctttatcttgaggaatgaaaactttttttttttttttttttgagacagagtctcactctgtcacccgggctggagtgcaatggtgcagtctcggctcactgcaacctctgcctcctggattcaagcaattctcctgcctcagcctctcaagtagctgggattacaggcatctgccaccatgcccggctaatttttatgtttttagtagagacggggtttcaccatgttgatcaggctggtctcaaactcttgacctcagatgatccacctgcctcagcctcccaaagtgctaggattacaggcatgagccaccacacccggccagaatgaaaactcttaatgttgatttgtctactccaagtccaacaaggtggtgaacacaaaagctatgaagtgcattgtggctgtattattagtagtacagtactcttgttggcaagttcctgatctgcagctacacaatggatgataattatgtacatctaccttttttaatatgtaagaaaaaaaagttgagccacaagattttaagtatggatctttatttctagtgctactattaatgatagttaatattcagagaaaacatactgtcgctgtgcagggagctcagccctttccaagcatgacctcatttaatcttatagccaccccatgcgagtaggcactgttaggatccctgtttatgcatgagaaaaccaggcttagagaaatttaacactttgtctacaatcaaacaactagtgggtatcaaagctaggatttataatgggatatgtaaggcactaaaacctgtgaaggttttccttttttccttttttaattctttccttttttcctctttttatttccttctttctctttatatctctgtatgtttccaaagagataatatatgcatatgataaaaaattcaaatgctagacaaattcaaacatctagacaaaatggtgcagagatttaacatttgttccttttgttgttgttgtaaatgaggcttggttgtctgtagaggcagaggaacacggtaacatcttgacatcagacactggtgtcatagatgccctttcctcagaggactgagatcatggtttttagaatgaaagagttaaagaaaccttgctgtttttttctttgaaccgggtacctacccttaaccctggaatccctcagtggggcctagtgccagttcccctgcctccctacagtgaccaagggcaggcaggggtcaagaaacaactagaatggggctggggtctgcactgcacaactgttctctcacattcatgcttccctcccagtctctgaagattccctcctgccagaacattttgtgtagaattctaaggaaatcagagtctatccctgtactaaccaacatataaaattccaattagaagagaagttgtttggattggtcatgatggatggcctggtgacagctgtcagtcagacgagacctgatgggcaccaggactgaaggcagcagcacaggaggtaggagaggaaggaatcctgagcaaatagccatgctgtttacttgccaatgacatccccactttgcaaagacatgatatggttattgatctctcactgaacctgtaagaatcaaacacaacaactcagttttattcatttcataaatggtttccaagtgcagtcagacatttaatttgtggaacactgagcgaagaggtgatttctgctggtttaggtaagagagaaacggtctagtgtaatactcaagaatgagctagatctcctggatttaaggcttattctacagcttattagctctgctatgttgggccagtgacttgacatctccatgcttcagtctcttcatctgtaaaatggaaatacaaagcgggtgggaggtgttgtgaggattgagtagattaatgcatgtaaagtgcttgcaacgttgcctgacatgtcactgtctgttagctgttagcagtagttgggctttttatagagggctggtgacttgtgcttgtctgaatgcaggaaaccaggcctgtgtagccttcggtctgttctaacactgaagttttgtagttgagtgctgactgtggtgcataaactgagcatttggatacctacatatcacaccacaaggttttggaggggctcactttgctttaatccctgtttcatccagtttctctttttctccacatgccttcacagaggcaaggggagcatgctgagtctagaatttctaatcaaagctaaccacatccctgtcattgttggataatattacaaattagacacgttgttcctgttttgactcagaatcacagcaggaagcagctaaataaaactgaaacaacccacaagtgcctttcacataagtgattagggtaatcgcagttctgtacttgccaaagggattcattccctcttcattttttccatggaaagcttgctttgggccacaaggccttctctttgaatgactgcgccattattggccaagtagtgctgataaatggtacctgtgggttgttgtgggatttaaggagatgatgcttgggagcgcccagcacagtggctggcacacagtaggtgcatcctttcttacttcttcttcccctgattaacgagaacactctacaccaagacacatacctcttctgaacggtataaaccgttgctactgaaagtgtctagaccagcagcagcaggatcacccgggagcttattagaactgcacaaccttgggtcctctggggcctattgcattagcatctgcctgtaacaaggccttcagtgatttgtttgcacactgaagtgtgagaagcactggtgtgaactcaccaggtagggatggaaccagagatggaggtcttattaacttcatgctggtaactccctgagctaatgggcccatgaggaataaatttggtctaaagcctggtcatttggaaatgaactaaatatactttactcagtcagcttgtgtaacagagctctccagtggcatgtgggtctttttcagcagtgacaatagtttattttttaaatatactccacaaatgttgttctggtgtggatcttaatgtggagaaaatcagacaccttttcagtaagcatttcttttgtttctgtgatcatgttcatgttagtttattgtatttgtattagtttatctgtgggactatcccttaatatttcccaaaacaagaagacatttgcgaatgttttcaagatgcattgtacaagatactgttttgaactggatcaatgaaggagatgtttggtggccttggaaagccctggagagtaatagtgtggttctaagaagagttggcctgaatcagttcattcttgggttgtttgctaagattgtctgctgaaggtgggtacgtggaaaacaagatggtaagccaaggaggatgaagggaggcatgctgctggaccacttccagctcccaaatgactggatcttggccatcttgcttttcctgctaacttagaactgaactgcttattctagaaaatgagaggcactggggccatataggaaagggatagcattggacccaagtcctagactttcagtagtttgtttgcaggaccagggtcccaccccttttccaattgaaatgtaggcaaggtggtggcaagcccatggcctaggctgtgggaactcatagaacaactatagtgatgatcgctgccttggattgcagcctactctgaatgtgtgcacctgtgctaactactttcaggtgtgttgtcttgtttcatagactcattacatttttatgatgaagtgaaacccgtgaattggctcctccagacttctcattttaatgacaaaaaagtgggtctccagagaggagctgggattttccaagatctcatagtttgttcctcactttttgtccgtaggagaatcatagaagaaccagataatcttgtctcttatagaaggaatacccttacccttccacattcccgtggtggtggtgtgtttgcttttttatcagtcttaacccatgggaggctgcacaacttacataagaggctacctgttctgtttgccaaacggcagcccagacccatcactgagcatgtccttggcaagaggcacaacctcaggctgacactgtttccatgtccgtgagaaatgatgtgtataaacgatggccagtaagatgctcatctgttgggaagacaacagagggcagggctgagagcatggcttccctgctgattgcctgtgttcagatcccagctcagccgtgtgtaagctcttggttcttggggtaactacttgtttacctctctgaaaaatgggagtagaaataatgaatacttttaataggattattttgaggataaatgtatttatttatgtagagaacttggcacggcacctggcacagagtgagcacttaatgaattttgactgtaaatagttattactgttccactagattcaaatttcttatctttgcctttagctggatgagtgaggagatttgtaccaacgtcatgtattctcctcttccctgcaaattcctccacctgagtcctattgaggtgctccccattataaggagtcctgtgaatcaaagtggtatgtttactgtaaagaatgtggaggatgctgttcactgcattgtattgttatcttcatgaggaagccaggagacatttattttggctctctgttttagaaaggtgttctcctcatgacgacctgtttgcctctgatcttaaggacactttgaagcataccgagcaggggtctgcaaacttctttgataacaggcaagatagtaaatattttcagctttgcagggcagagtctctgtcacagctactcaactcttctgtggtagcagccacagacagtgtgtaagtgattggacgtggctgtgttccagtacaacttcatttacaaaaacagggctcaggccaacccctgatagagatattcatggtttttgtgtttctctctcaaatgctaactaccagaaaagcttagagtcaaatctgaatcatgcttctagcaaatatgtacctacacatttagcatactaatatcactcttgcttaccagtttttaccctgttttctcacatttatattccatttgtcataattatagctcctgtcttgactgtatcttctttcactgtgttttttgttgttgtcgttgttgttgtttttgggaatgggataggactgtaagtaaataaatcaattatatcttgctagcttagaaaccaggacttgagtaaccacttctgactcaaagttcaatctatgtggttaaatagggaagcagaccataagatgtatgcccagtggtgcacgttgctgactcgcaagctatgtgcaggctttagcatttagtgtggtgatgtgtgccctctaacctgagatgttgagagaggggcagagaagaagacttcttgtagccacaaagtttcattccttcctctctcattgttgtagcatttcttttaagtgaaaacagcctttttggtttgctagcctatctctggcaggaagacaaattatttttttacagtatcagacacgcggtttcctgtctatgtttaacttgctagcagaacatctcagccagctggttccctctggacccattgtgtccttaatgtcgttgctttacaccatccagcaaacccactctgtgtactgatcgcatgcattgagcattttgttgacttccgttgttttccgagtaagggaagtcttagaaatgctgccctctttctcccaaatctcattttatgtttgttcagctccaacaccagggagctggcttcttggggaaatgattagttcttgcatgtaagaaatgaaaagagtaaatggtgttttggtagctctgggggattttaggtatgctgccttggaactgtgcactcacgcctcaaaatagctggctttccagctgtgcatttttgtttcaaaagaaacaaaccagatttactttctggtctaaatgcagaagaaaaaataagtgtggaaatatggttgagaaaagttgttagaagaggaagaaaattatggattaaagttgctagtctcattcctgagaagagaaatcagttatttgaggtgatgactcagagctgaagcagctttttgttgtgaaccagccttggttagaaagcacacttggaattcatcaatatggccctatgtctggccaaggaaataataaagattttgcatgatagaggacactgtgactcagttgaaggaagcttagaatgtatttgaactgaattaaggcaaaagcaactcgcttttcaagatttttttttttcctaagtagcaaagtaaacaaagctgcactgaggccagatgtgctttctggttgtgaatatttgtactctagaacctcattctggtatgaatcagcagagtggaatctagtatggacacaggctgtctcaaattccatccactggatatgagtggccaagaaagcagtcggacccatactgctggtgctgtagcaaggttcgggtggttcctctgcagcctcaggtctctcccactgcggcctccatgtgttccataaactccacacccatgagtaatggcaagaagggtccactgagaccttttgctgctttgcgagtgtctcagtgtcccaccaggggaaaaaaaaggctcagggaggtggctaaccactgtgaaattgacttttatttccacccacgtatactccagaggctgtattcaccaccatttggacatctggatgacttgcctttggaaagtccttttgtattctaaatcgctcctgcatgttacctgttgtggaaaatatcaattttgccattacaaattatgcttttttttaaaaacatgttaacttttagagaaataatttatatttgcttatctacttttaaaaatatacatatatatgccttttgttgcctaattagaggatatagttggttccaatgtcaagaacaatttctctgaaatgtagtcattaaaattattcccatgtctttcattttccaggccccatcctattcgaaatacctgtttcttccaccaggctgatgtagttatgcttaggcttggctgcacattggaaacacctgagtagctttaaaaactactcattaactgggtcttactcctgcagtttctgacttaattggtctggggcctggtatcaggaattattttttaattcttcaagatattttaatatgcagcccacattgggaaccactggactcaagacagtttgttctgccaaatctttttatatttttcgtcacgttccccctgtagcctggaaagggacggtaacaattaaagaatggcagctaccacaggaaggagccaaaattatgccttcgaaggttagaggaggagaaaaaccaacacctgttttaccccatccttggaggaatagcaagacactttaagaggggatattattttgttttctacaacaatttacaagcaattgctttggaacaaggtcaacggcctcattgggaataggcatcttagcttttaaaactgattaaattatacgttaaaggaaagcacattttaaaccttaatgtgtccaaaaggttggatggcaaggtttgggtgctactgccttggcagagacaaggcagggaccagggaggctgtgtgcatgattttaggaggtgagaaactcaggtgggaaggaattgcagaagcctgtggttcacctggaaagccagggagagagagaggatgtattctggtgacctaacaggtattgtgaataatgaatatgcttttccaaagcgatctggtctccctgttggagagcatcctgaaataacttaagaaatgtaccttgctttcaggtttcctgagaacatgagggcccctagacagagtacaaggtgtaattcagacagccagccagaaaaagaattaaagaatcagggcaggtgtggggatcctaacaaaacctaagcttttagtagtcagaaaactgcaataacacagaaaagaaaatgaaaaaaaatcttgttccaaagaacatatatcaggtgtgaaactctctttgtgggaggacagatgtgtcatcatttcctggacaaagcctggtaccttgtaggcaccctcctaatgttggttgccctccttttaaagtcagagcaagagaagtagcaggaatctatatcctaaggaggaacataaagggtgaaaagcacagtggaagggatgcctaaaagagcaaaggctgaatcagggttttaatggcctgaaatgaccaattttctaaaacttgacaggtagatgtaaaatcagacatataggttcaaacaatcgattgcaaaggagcacttgtcaaaacactggctgggaatctgctcatgtgatgaagaccccagggtttagaggtgagttaaggtcattttgaaatcaggatgatctggctgaaagaatcaaaacaaaacagaaagaacaaaccatcaggagccttaaactccacttggtggaagaggaggtgagagtcctgctgtaatctttgctacacaagttatattccaagtattatatctgtgtctatcaaaacacatgatgaagaatcttaaatagcaagcgtggtttcagagaacagatcactttacccttagaaaaaaggtcctggcatttattgggcgctatatgctgggcaggctgattttagggtctgataaatctgtcagactttagagtctcatcaatgtatctcttgaaaagtaaccgaggaaaacatggctgttcaacctgaaaatgaaatgatctaggggttgtgagtttcatatccagcaggagtttaatagttctcatcccatagaaaacggattcattttgttactttttgctttagagaacagcagaaggaccaataatagaagcacacagaggctacatttgacttaatgtaaagaataattttaaacatatcccaatatttagactttatcccaatatatctgcagttagaaatattgtgatttgattatggaatgataacaaaggaatgatgtccttctaccataacattttcaggcagaggtttcacctctacctctcatgggtattctagaaagagattatcatactggattagaatacatgcaaggcttttccatctgggagagagataagaaggaaataatacaaaggagactgtgccatgggataggagaggtggcgaatagctttgttctgaaatatgtgcagttggaataaaacaaccacattgattggagagaagacttctttcatcatttgaggaaaaaatactctcaaaatatatccagaatgtcaaacagtgctatcaatagctagaagttaaattaaatccttcattgctagtgagcttactgtccttttgttgtttaattgaaatgactttttattgtttgcctaaattggtgtgctttttactaggatgatggatggggaagcatatctcattctacactcctccaccagttaattgactagaaaattatcatgggccattttctcattggctagtgctgaatacagctgtaccagagctttgcaaacaattccactaagaaattttttgtaggaggaaagcatctctatggcagagtaccaaagaacttaactttatttttgctaaactgtttagcaagaataaaatttacctctgaaacttgaatgtgtaaatgaatcactgagagaacttttaaatgtagattctgattcagttagttgaggacagcgctaagactctgcatttccagtaagttcccaggggatgctgatgactgctggtctgcgggcacacttagaataacgaggtgacaagttattctttatgtaacatgccaacaaaatttttaaaggtacagaaaatgatggcaagatctttgaactctgcaatatgaagcatatatgtgagtgcttagctttcactctctttctgtgtgtgtgtgtgtgtatacagatactaagacacagatacattcacatatatacatctaaatatatatacagtacagtccatattcagatttcttcaaggttaatgggtctattgtttaaattcggaatccagtcaaggacaacacattaaaattgattgttttgcctctacagtgtgtttttttggttttcatgacattgactttgatttgaataggtcagaccatttcatgtactttataaaggcactttgtagatttgtctgatgatttgattaattcagattaaacattttttaaagattctggtgtttttattgtaggaagtttttttaaaacagtaattctgcaaaaaagcaaggtttgccatttgtattcagtcatattagtagcaagacgactacagatgcatacttggatgataaaacaagtttaaaagctcaagaaaatgataactataaaagccaggaatagtgattactttttagaggaagggagggatctccgattgagttggggaacatgaacagacttctggggtggccagcaaaattatattttctgacctgaccagtggttacaagagtgttgatcttatagtaattcactaagccagacacttgttttatgcacttttctgtatctgtgttttattttggaatgaattctttttcacaagagagaaatcagagtaatttctctagttttgagggccatactgtgctcttgggccaagtatattattttaaatacccttaggagaaaggaaagaggaagagagggctaacttttttgggggggggagttgggggggcagggggagatgttctcgttctgttgcccaggctaaaatgcagtggcaccattatagctcactgcagtcttgaacttctgggctcgtgatcctcctgcctcagccttttaagtagctcagattacatgcccacaccaccacatccagctaatttttttttttttttatacagacagggtctcaatatattgcccaggctggtgtcaaactcctgggctcaagtgatcctcccacctcagcctcacgaagtgctgggattacaggtgtgaggcaccatatcttccccccatttttttttaatcatctgagtggcttcaaagcttttgttctttccataccaccaagctatctccttaacaatgaactgtgagatccatttaataattctgaaaatttccagtcacttctgtcactcatagaggccagacttagttgcaaataaggagccatttgcaaatgtcagagtcttgttacataaatatttttttaaagacaaatgtcaaattctttttttttctgtcttccaaagataaatgttagtatgccataaaaaaaaatacaaactggcagaaaacctcaaggggaaatcctgtggtatactttcctttggagtgattgaaaagtaaacaatttgtcttataacttgagtatgcatgtgcgcacacacatgcacacgcgcgtgcgcgcacacacacgttgctctcagcctcttttatgtcctttgttatgccgacaccagttcctaaaaggaacttaaaactgaacctccctaatccactattttaaataaaagtcacttggttaaaaaaataaaagcattaaattaaggccaacttggtaaataaaatcctatgtggatcagttaatgtgtcttgataaaaagcaaatcaacatagctgaatttgggagataggctcctactttaatatttgaagtagtttggcaattcctccactcggtaaaggagtttagggtgaacatttagtgggatactaatttatccgagcaatagaaagggacgtggatgacagtttttcgcacaccttggtgtattagtgcactaatgagcctcagatgccaagagagattcttgtgaagttggcagtgaagctctagccgcaaggatgttcacatgccagcatgttcacctaaagcgagagtatatatgcaactggctgagatccaaagaaggaaactgtgctaaagagagatagctgaggggaaggaagaacttcctgtctcaagtcatgttaattataacattaaaaggacagcattcatttattgagtacttactaggaacaacttttacttaacaagaatacttatttactaagtagacaaaaatgttgtagaagcaaccaaggttcagtatcctcctctgtaaaacgggggtaagagaatctaactcatacatagggttattggagaaataaagtagatcatgtttacaaaataaattgtccggtgcctaacccaacaaagcacatcgtatatgagttatctttcttattgttacaagatttcaaaggagggcttctcctcaaattctacactgcggagctcccttcccactccacagaagctccgacagcatccacagttgtccatgtgcagcacaacaaatcaagccaggcagatctcccattggcactagttaccaacttcctagagaaacccatcaatctcaaaattcctgctctagcaagtcctggaaaagagactagagcccaaatgccttcactctgccaagggagcttccctttttgtgtgtctgtgccatggacttcttgaagtagggaagcctgtggaccccttctcactgtgatgttttttaaatgcataaaatagaacatggagtatttcaaagaaaaccaattacattgaaatacaatgaccaaatattttaaaaatgaatttgtgttatagtaatatatgtttctataataatgctttaaataacaatagcagcagatctaaacaattgaaatgtctaaatggtgagcgtaagtcacatgctgagacgtctgcaacaacaaactcataggtacagctgatactaggaaatattaatttttaattaaaggttagagaaaataaaaaaagatgcaatttttgcccattcaaattcacagacccactgaactctatttatggaacccaggctaaaaatgtttactattatagcctcatttttttatgggccttggataaattccacccttatttttaatgcccttcagagctatatctggttcaatgttattactattcatggaaggtcccaatagtgcaacaattatgttttgagctctgctaagatctaggccatgagaataggctctgagaaaagaaaaagatttgggggttctccttcacataaaactttttatttcctggcaggaaaaagatgcatatttacagagacactactaaactgtggttcttagttcagaacaaaggaatataatccccatacccaaaatatactcctttagacacattatacaagaattgccaatgtcagtcggtggatggctgtaaaatcacttagtccaggctacactaaagaaaaacactttatcaaattgggagcttatataaagtcattcttcccctcccccgcaacccctacccccccatccccgcccgcacaaacacagggtcttgctctgttacccaggctggaatgcagtggcaggatcatagtgtgctgccgccttgaactcctgcctcaagtaaagtaatcctcctgcctcagccaccgtaatagctgggactacaggaagcaccacagtgtctggctaattttttttttttttaagtttgtgtagagacagtctcactatgttgcccaggctagtctcaaactcctaggctcaagtgattctcccgccaaagtgctaggatttcaggtgtgagccaccacacccagcctaaggtcattgccattcttagttggctctcaccaatatgaagtttagagatcaggtatggggttgagatcagaagtctctccaatcaggcaatgctcattgtaaataccagctttgctgttgcctaaatttatcatctgggaaaattacttaaactgtctgatctttagcttccctatctgtaaaatggggtttataataatagcagtttctacctcatagggtttttctatcaattaaatttaaatattctataaaatccttagcacacagccaggaacttagtaagtgttcagtttatgagtttctctgtaactggcggctgatgaaaagaagcatttcctgttggtcttcgactaaaggagatgctggcttgtacctacaccaacagctgttgggttttctagtagcaacccaagggttaatactgccagagggtgtgggtggctcctgtttagataaagccacatcccaaagcttccttccagccctggttgctattgttagagtttttcaccacctctttgaagtttcaagattgacagatgttattcaagaattcctccccctcaaattttttaagtgtaagtcttctaaagaaataacaggaaattttaggagaaagtaaaactttggtttctgacattgaactggggatttctagaatcttcttcagtcagtgccacacataaacttaaggggatttctgtttttgtgtttcctttaggctaaaaaggaattgaaattagcaaatacgactgtttttatagatatttaggaattgtaaaataaaattatccatgatgaatcaacatttcatctggacgttttagtgaattaaggacaaagctaagtaattatgcagttaatatttaaattttttcaaattgtatttctcatatgtgaaaaaaaattgactacatattcacatttggccaaagtgaagtctctccagattctgccaatgaggttattaaaataacacctctagaacaggggtcagcaaagtttttctgtgaagggccagatagtaaatattttaggctttctgggccagataagatctctgttgcatgaacctcttagttttattgttttttaaacaactctttaaaaatggggatggaaatcattcttaggtcataggactatacaaaagcaggccatggacttctgagccatagtttgtcaaaccttgctgtaaaatataaaaaatttgagaagtatcattccacgtaagtaatcattcagcttctaaaacaaacgtttgttgaataccataaattgccccattctgccccaggtgctgtgtatatcatgatgatcaaaacagacctggccactaccctgctttgtcaggagagaagcaatcagataatcaagtggatttctgattataagacattccatgtagttacagacacagagaccggagacaagtgggtacttcaagcaaacacattcattggataccacatataatagaggtggagtttcaggcagggagcattgtggaagtggtaagcctaagtggaaatgccgactgctggatcggctgttgtgtttgaatttgtgttgtgttcatctgcccccttaattttgtttgctgtacaacagggacagtccatacatctccacaagagcatcttttttttcttttgcattcaatcattctgtaattgctttgtcccaccccatttctgccctactcttgcctgttctttgtcccaatccaagcctcccagtgtaagaatttatgtttttaaggatcaatcaccaaattttctcactttccctatacttttaaaatgcattcatatatctttccaaaaaatggtgattttttttttccctcttggttgctggaattctgatatcttggggttacttctctggttactagacccaagattttcatctagaatatatagtcagtggaagttggcatttccactcagacttaccttaagaacaagtaatcatattacacataaaccttaaaaatggatatgtaccagcttcatttctcactgtttcgttagatgaaagtttcagatgctgggccaagcgcagtggctcacgcctgtaatcccagcacttttggaggccaaggcgggcagatcacaaggtcaggagttcaagaccagcctggccaacatggtgaaaccccgtctccactaaaaatacaaaaaaaaaaaaaaaaaaaaaaaaaaaaaaagctgggcatagaggctaaggcaggagaatggcttgaacccaggaggcaaggttgcagtgagcagagatcgtgccattgcactgctgcctgggtaacagagcaagactccatctcgagaaaaaaaaaagaaagtatcagatgctgaagtagctatgtagactggggtatataacctggggttcatcatcatgagccaggaaaatttaggatatgaacacacatgaggagtttaggagtggaggtttaataggcagaagagaagagaaagagaaacaattctctctgtagagaaaggagtctccaagcggaaaggacgggccagtggtgaatgtgctggattttatagtcccgtttgaagaggcggtgtctgatttacatagggctcacagattggttcaatcaggtatgacgtttacatagtgcatggggaagactggtcaccccaccctaatcttattatgcaaatgggctttccagttgatcagcaccatctggtctgttctttgttgtacacatggctgacaaagagaagggaagatggagctgccatcttgaacatgtccttagttcctgctggcattcacccgtgcaagctcccagcttgcctgtctatgtctgaagctcaactttacaggctgctctttgttagaaaatgatttggggctgcttttcattaaaaagaaacaccttaccgaggacttccatacccttactatctgcccaagtaatttcttcttaactcctttatcagtatcatttaggtaatgggttccccttgagagaatttggttatatcctcattctacctggactatattctcatcacttttttttttctctttaaacacctactgtaggtgaaaactgacaaatgaataatcaaaagatccttttctgacacggagtttggttccataccacctacccatttttttcctttctattccgcaggtgcagagtggtcagtatgggataattgctcttccttaagtagatcatatattctttctccttaacatagcactctttccactcatcactgacttttcccattcttcagagaccaacttaaaggcagttttttgctactgtgccttccatgtttctctaagcttttccacattccactaatatatagattacattgtacatttagcccctatcccagatgccatatattgcttacttgtatatatgccctaagtcctctactgggtactctctgagggcagtgccatgcccatcatagacactcagtagtgatatatttaatgaatgattctaggatctgagcatgaggcctgctcattaatgggtactttggagggcagatggatgacacataaagcaatagaattctgcatgtttgcccaatgaaagcagcccagcacaagctcccagtgaactagagctgccttttgctctctcctgtccactgtctgtttctattcatgtccttcttccaaaaaggaaaactatttcaccagagccaacaaggccagcacatgaaacaaagtttgaggcacaagatattatagttagatatctggtgctaaggactctccttgtcagcccacaggggcctgcttcagaattccaagtcaaaaaactgcagcatttccatttttaacttgttttacctttgcggccatgtttccattgttgctattaaatatttcagttccatgaaactacaattcgtatgcacactgaaaagaggaatgttgggtggatgtaagataactgtccaaagagatcctttccatggactcctctccctgtcacccatgggcccagggtagcctgaatgctgatcagagcagaacaagttggagtttgaaaaagagcaaagattttggtgcaaactgtggcacgctctgtgtttttaccagatgtcatacatgcagattttttgaaggcagaagctgtgtcattttttttcatgttcccaatgtcctgagcttagataacactcagtaaatggtttgtctttttatttggcaatattgaggacctgctgtgtgctaagtgcagtttacagtagtgaagaagacatggtaccttccagcatggagttccctgtccgtgggggatggcaagagtagggaaagacagatgtgaaatcaagaggtagagtcatagttcatttagtttaagttgtactgaattgttacctaggaaaagtataaggtgctatgaaaatgtataaaataagacagttttccaagtttttctaggcctctcttaagcagtgacatttaagctgaagtttgaaggaagagcaggggatgacgaacagatggccagaggcagggaaggctgaacgagcatgcacttgcatccctgaaataaaaattaacaatatcgtatctacaaaaactatgcagatgctaaaatctatagatgctcaggcatgaacccacttcctgacagtacttacctaccacatccaactccttctctccttgttttgtttccccatcagaatataacaccagcaatcctgacttgttgctagtcatatttcaagtgacaggcatcagcctcctgccaccactgggagttgccatatctgtcatcatcatcttctactgctaccgcgttaaccggcagcagaagctgagttcaacctgggaaaccggcaagacgcggaagctcatggagttcagcgagcactgtgccatcatcctggaagatgaccgctctgacatcagctccacgtgtgccaacaacatcaaccacaacacagagctgctgcccattgagctggacaccctggtggggaaaggtcgctttgctgaggtctataaggccaagctgaagcagaacacttcagagcagtttgagacagtggcagtcaagatctttccctatgaggagtatgcctcttggaagacagagaaggacatcttctcagacatcaatctgaagcatgagaacatactccagttcctgacggctgaggagcggaagacggagttggggaaacaatactggctgatcaccgccttccacgccaagggcaacctacaggagtacctgacgcggcatgtcatcagctgggaggacctgcgcaagctgggcagctccctcgcccgggggattgctcacctccacagtgatcacactccatgtgggaggcccaagatgcccatcgtgcacagggacctcaagagctccaatatcctcgtgaagaacgacctaacctgctgcctgtgtgactttgggctttccctgcgtctggaccctactctgtctgtggatgacctggctaacagtgggcaggtaagttagagctagtgctagatcccctttaccttgagcctggcctcaccctacctcttgatccatatctcctggctcttatctcaaacagccctgtactctggacactggtctagggaatctagccaaagtatggagtctgccttgagcatactctgctctgtcctgcctgagcatttttgctaatggacagcatttctcctcctatcttcaaatccttcccagttcagcacattttttcctcctggatcaatcctcatttctcttccagcaaatgttttttctttgtttcaagcactgttagtactttacctctattttttccctctcttatggttgtactcagtcctttctgctctatactagctgtagttgtgttggtttctttgtattaaaagcatcgtggaaggcaatctccctgaagtccaaatctacatccacatggtcacccaagatatgtagcacaatgccttgaacattgaaagtaaaataagtacttgtcgactgagtgagcacttccactcttgaagcactctcacagattaaaatggaaatgtttttggctaagaaactattggaaggtgattggaaatcaccacaacatcccttataaatgatgagcccagtgttttcacacagtggagtccatggagagcagcactgtcttctttagccaggtggcaggacacactttgaagcactcggttactgctcagtcagccctgtgtccatggcagcgcacgcagtgttgaggtaaacatcgaaatatggacagactaatgtgccagagtaatgagccatgcaatgacctcttgagaagaaaaaaactctctaatacatgccaataagaaacattccttggaatgataatatcaactcacttggcttccctagatccttgggaaggtaggactttattgttatttagtcagtttatacatactacaacactaaatatttaagtgagccattctctggaatatttttttcctttttcatatggatccgacgtttgcatattatcagtcatagagattagcacaggcctaaaagtcaaaataaaactacatggcccacaagttaaaattataaagtgatccagatttggtcttttactgtgaaaatgcttttatacaatttaatttagtagagatgttatgcaattgtactatatcctttgcacactggaatgtgccatgggataaacaaagattaagactcagtcctaaagtgatcaaaactgatagcaattattatttttaccataagtcttggagtttcaggaataaaaaaaaattcaattttggaaagcaaaaataaacatttaaaatatcacaaatattgtctctcaggttatctgtaaggatgttattgaaaaatgtgatgacataagtcatggggttagataaggcagctctggggtttggcacttccttattttggcatgctttgtttatggtctttagagggttttcagggagagaacatctattttaaaaaataaccatctatctgtacctttctgtgcatttctcattctttaaaacagcactttgattttttaaaaaaatcctctgcacgtgtcaggggccaccatcagctatattgtgaaaataaaaaggcagctggaattaaatgatgggcctcactgtctgtttttgctataggtgggaactgcaagatacatggctccagaagtcctagaatccaggatgaatttggagaatgttgagtccttcaagcagaccgatgtctactccatggctctggtgctctgggaaatgacatctcgctgtaatgcagtgggaggtaggtgtggaccagcatcattgtgtagtggtaaacttgtcttcaaaataagatcatgtgttgcttcgagcattattccaggggttacaaagcagttattagagctagttgagatctgatattatacaaccatcccagaactatttggggttatgctaaacagcctaggtttttaaactgaaagccacatttggagcataaagctttgtatctccttttataaacctttgtataattactcttctcttgacacatctcttcacagttatttaaatatctggcaagagacgaatactaataaatgtataagaattatctctaatgatcatgtgggtaatattcagataagcatctgatttcttttactttgtgttttaagatttttcagaattatgtctgggaaaaagatttgattcaaaatttacttttatggacatgacattgttttattgggcaaaaaaaaaatcattgtttgagatatttgtttaggttttgaaaattctagtgaagaggttattgaggaaggccgtcttcttactgcttaagcctgcaagactgattaggagacctacttttctcctgaaaagctggcttgctctttttatccccaagttcagccacctactgttttttttttcttttaggatcatttttccctgaacacactgtcatagcctcccaggtgccctctgctatgtcttctctgcagttgtatgctgagtccttttcactgttagaggctgttactactattgaccatgagactgtagatagaatgggcaacaaacatctggggtgccagggtgaggctattgttctaggaagtattatcccttgttgtccagaaggcaagaacagttgaggtctacattactataccctttcctgactctcttctcagtaccttggaggacagatgcatgacacataaagcaatagaattctggcatgcttgtccaatgaaagcagcccaacgcaagctctcattgaactagaactgcctttcgctgtctcctgtccactatgtgtttctattcatgtccttcttatttcttaggtgagacagggtcttaggtctcacctgagaaatctgtgcacccaagttcatcctggttggctgccaaatgaagccaaactaactccaccctttttttttttttgagacagtctcgctctgtcacccaggctggagtgcaatggcgcaatctcggctgactgcaacctctgcctcccgggttcaagcaattctcctagctcagcctcttgagtagctgagattacagacatgcaccaccacgctcagctaatatttgtatttttagtagagacagggttacaccgtgttgatcaggctgatatcgaactcttgacctcatgatctgcccacctcggcctcccaaagtgctgggattacaggcgtgagccactgcacccagcctccattccatgtttaactttttgttttgtgataattttagacttagaaaatagttgtaaaaatagtggagtttctgtatactcttaactcaactttgcctgttgttaatatctaacctaaaccatagtatggctatcaaaaacagcaaattaacctggattcagtgttcttaattaatccatatacgtatttgtacttccaagtccccagtaatgttcttttctgaaacaggatccagtctaggatcccgcattgatctaatgtgcatgcctccttagtctccttgaccttgtgagagttcctcagtcgatttttgtcttttatgaccttgacacttgtaaaaagtttaagacagttatttagacggtctctcactttgggtttcactaatgttttctcatgattagattgagattacatattttgggcaaaattaccacagaaatgatagtgtgcctatcttcagtgcgtcatatcagggggaataagatgtccatgtgtctggttattaatgttaaatttggtcctttggttaaagtgggacctgctgctatttgtccatttgtaagtaatacatgcctttgacctgtttctaaagatactaaatacctgtttagcaaaggtactagaactttcttattcatcatttacccactaatttgatgatctatgactaattcctgcctataacaattattactataatgtttacttaaggaagattttctgtttttcttgttccttctatatttattaatatgcattctcctttaaaaaagatctgtctcttctgacaccatcccctgttctttgtttactaattatgtatttatatcagcaggggatttggggtatttgtttcattatatgagtatccagtattgtcattatttattttgttgctcaggttgccacagcttgggtcactggtccaaactacccaacattttgcccaaggcagattcagttggcaccactgctggctctgattcttcatcctgttcagaatatgcatagccaattctccagcgtgggtccgggtcaccccctcccatcctgcaccctgctgaacctcacatgttttcctgagacccccgcatggggatggcacttcctatctagctgacatagttattattatctagtttcttgactgagatttcttcccccaaaacacttccaaaagttaactttgtttttccttgcacagtgaaatttgtttaaccaagtttcagccactgagaataattttatgcttgaaagctttgacagttccaaaatgaatctttagccgggtatgagttgtatcagagacaatgctgttgtcactgtcagaataaatttacctagatttcagtatcattccctatcctttcaactctgttattctataaacatgagctggagattgtgtctctgtctttccctctgtcagtgcagccagcttattaaggccctaggtgagctcccagctttcattgttatcactgactaaaacccttgcctgttgatatttgctgagtgtggaagaatttaagctaatgaggaaggagttcaccaaattttacaaggtctaaaaacagttagaatataaacaagttttcccaaggaaggaacaggatatggtttattcagctagtctcaaaaaaccttttataaccttaggataagaagagacagccctggggaaccggaaagaggccatcccagttctcatttcgtttgatcttaagcccacagtcctatttctcccatctttgctcgggctgcagacaccaaggttatttatccatcctcacgttcgtcctgacacaaagccgttcacttgattaagcgtgtgaactcacgtagtaagctccttctcccaccttgacttcttcttttaaaagcattagtggtttttgtttgtttctttttggcatgtctcaaaaaccttaaagacagattttcagcctagtcttagtttcagaggcttttcttttacattcaaaaggtcctttggaaagtacacgaagcctgaagacagatggattccctccaactgcattcatcttgatgttgtccctgctgtagcttttgtagaaacacagatggaaggacaggttttgacctcaagaagcttgtagtctacaggaaacagttgtttgtttcctctcccttctttttaaaaaacttacacatgcagatatgtttcttatcttacaaattaaataatgaatccccctgtttgatgttagactttaattttaaggtataaggaagagggaaggatgtaaaaggtctttccttaagcttgaacttctgcagtttgcagtatagcagatgtaattaccatttttttaaaatcagcagtcttatttcaaaaaaggaaatgtggaatgtgcttacctttgtatgatgaatcatagatggacagtaaagggaaccagatctccagagtcatcttctctgtaggctctgagtctgtgtgcttgtgggatcatggatcagggccacttctgtgacatgaaaggcttatgatctgacccatcgagccagctaccaagcacctgcagagaagcctgctcaagaggtatggtcctgccgggcgcggtggctcacgcctgtaatcccaacactttgggaagccgaggcgggtggatcatgaggtcaggagatcgagaccatcctggctaacatggtgaaaccccgtctctactaaaaatacaaaaaaattagccgggcgtggcagcaggcgcctgtagtcccagctactcaggaggctgaggccagagaatggtgtgaacccgggaggcagagcttgcagtgagccaagatcatgccactgttctccagcctgggcgacagagcaagactgcgtctaaaaaaaaaaaaaaaaaaaaaagaggtatggtccacctcaactgtgtgcagaaggatgatgggatgcaagtctccagtgaaaacagctaatctacatgacaagtatagtggatctacccactgaaggagagtaagtgtggctgcttggatttctcgggatgactgccattggtaatatggatatagcaccccatcctgtactgagagagtccctagttgtattgatacttttttaagctatggaacattaacctctctgttcccagttgttaatgagctattgcagaggtgactatttgttttactttcttggatgttaacattacagtactcactacttgaagaaaaatgttctaagcagcagaaggtctaactgaatgaagtaggatacaaggattagggacagaagatttcacagaaaactgtgaagtcccacctagcctgcctttaagtgactcataaacatggatattaaggctccaagctcacctccacgccacattctcattctgtgttcatcacttcatcatgatggatgtcttttaggtcttacctccaggctttgtctcatgctatttactggcactggaacacttaactagtctgtttttaacaggcaagtgtggttcagttgtgataaatgcttaggaagggaaggcagtgagctcaaaggactgaatgcccaggttggctacagggagtgcagtgttatggtcagggaatgagacttaggtcagctcttaaaggaagaggaagactctggggcatccttctgagttacttctttactagccagtctcccctgaatgcaggggagcacagggaaaacagagaaagaacagcactacactggagaagcctcacttttatcaggtgagaaaacataaacagatgataatagagctcttcaaaagccaggtggtacagcttcatttcgcacaaaattccaccaggggcctcgggagatgtgttgcagttaggtgaagagagtggtcagagagaaaggcttcttattgaaagtacatttggtccagataaagaaagccataaaggaataattaccacttcttaagcacttgctccacacatcaactcatttaatctaccaaaactctttgaggcctgtactgttattaatcccattttacaataagagaactgaaggctcaggaagtgcgaaagttgtggagccaggaatcaaagccctgttgtctgactctgtagctcacaggccttagtattcctggtatactgctagcctggccaatggagaacgtatttaaaatagtagctatggccatgtacaggtacaggctcacgcctgtaatcccagcactttgggatgctgaggaaggcagatcatgaggtcaggagtttaagaccagcctggccaagatggtgaaatgccatctctactaaaaattaaaatattagccaggcatggtggcgggtgcctgtaatcgcagctactcaagaggctgaggcagagaattgcttgaacccgggaggcggaggttgcagtgagctgagatcgtgccactgcactctagcctgggcgacagagcgagactccatcccccccgccccccaaaaaaaatagtagctatgattcctatgatcagtatggatacgatagtcagagctactctgtgcatcctggcagtagatatgaagccttccagcagaagctgaggagacaatcacatgtttgaggaacattcagtgatggcctcacttctctgggtgaatccctgttaacagaatccaaggctgttaatttgtgtagcaggtcacagtattgataccttaaaatttgagataactgttttatctttatttccctaaagatatatttattcattcattcactcaaaaagtatttattgagtacctattgtgtcgcaggcattgtttaaaatgccagggatacagcagtttaaaaagcagtgtctttctttgagagacaggaagtctagtgaagagccagtattttagggacaggtaatgaacaaagagattatgtaatataatgttggagttgggtggggtgggtgggatgattttagaaagaaaaatagacttgggggatagataatgaaagaggctgtcatttcagacattttaatcctctgaaagaatacaaaagaaaaaaaaaagaaaacaaatctttcagaattgtttgaagtaagaacaagacaagaggaggtgattggtgtgttactgttctacgaaaaaggagaaaaagcttcatgaaatcgccattcagcaaggacagaactggagatggcttctcttttacaaagaaatctctgtcccaggctttcagtctgtttggtgttcatacaagtgtttgtgtgttgtgtggaaggcgggtgaaggcgggtgaaggcggtcctgttcagggccccctttggtgaacacagcaggcaaaatactctcgtcatccccagccaaactggcctgcaagcacactgacttccacatccctagcatttaggcctttgaatagaagctgacacgtagcagccagctgaacaagtatttaatgaggagcaacacaactccaagaagggctccttagtgtattgtcaagttgctgcagccttgtgagatgaaaaaaaaaaaaaaaaaaaaagtgcaaatgaaccaaaaagaaagggaaggggctgggggaagaaagagacagaaaaaaaggaggcgttggagagacggctgaggagagaccaggattgaaacgcttcattttcctggatttcaagggagcacagtctggaaagcagatatgaaaactcgggggtactgctttggggaaaaccatcaacaactttgctgccctgttacattgggactacagtcaaaacagcagctgtgcaccagatgctgactttccgaggaataccattgctgtcccagagacctgccctctgagggttgtggaactgggaagagacaggcaagcgtagttttctcttaagagccttttgagacaaattaaaagaagctgcgagggccgggcggttgcgggtggcttccatcagtgaaaagactgcagagagaggtggcgggagggagatggaagtaagagaaagtcgttctcaagcagtgaaataaagaggttttttagaaaagatgccgtttgaggcactcagggaaattctgaggtgttcagccccgtctgtctggcttcagaaacagtctgagggtgagacaaagacttggtttgatgaactaattctgctgtgtaggcatatgtcttgggtggagtgcctccaaccctggaacaagaatttgagtactagtagtttatttgggaagagattgcaggaaatgccagtaagagaatgaggaaatgagtcaggaaagggaaggaaaccagtaaaggatatcttatcaagtgggttaccaccatgggcaactggagtataactacgagcagaacacacacctcagtgtcataccacctgactcaaaggaagctgggtgttttatctttccaattcccatcagtttgctggagggctgctccaggccgagctgggagggttcactccagcccttctgcctgttcctcctggagttgggccagcctaaccggaagagccagtgcaatggggttgggaggtggcggtgcagctggccctgcagcatcacactgaataattgtagggggcatatgtgactattcttattttgtggatataggaagtgaggcacaaactcttggcatctcttttctaagtcctcatatctactttttaaaggagtcagggcaaaaacaacaaataatacttacaatgcatattgttagctcttccacttttgaagtgctaaactcagtcatactctctaagccttcgctttttctcttagaggcaattccaattttttttaaaaaggtggttcttgttataggttagccaggtgtaacattttctctggactcagcccacacactcctgaacttgctttttatgcagttcttcacaagagagaggcccaaggtcaagcatcatttgatcaaatgtgcaaagaggaactgcattaattctattgccaactatgccccaatctgatgcctgtagctaaaatgagattctcatccttacctcacctccaccaccagtcacatctacttccctaaacccagaaaggacaagtgtttgggtttaatgtgggtaaataataccagctaaggagagggctgctctttgtaattgtttttttgcatagctggcttagaaattacaaataacaaccacccagcagatcccataaggttccccttctcaaggttgtatgctgaggagggccccatcaaggcagggagggacacacttgtcacatttgggaagggcatgttcataccagggactgccccagctgtacttgctctggttaggggagaaatctctgcaatgcttggcagagatgagcaagcatgaaagcttcctaaaaaggcaaaggcaaatttcttcagagtaacagtaataaagtgcacaattctaaatgctcttcctggaatccagtgtactatttgggcctcagttttctcaactgtaaaatgaggatgttggatcccgtctctgaagaccttttcaatattctttgtctgactcatttgaaacccttaaaatatgtttaataacttgtgctcttttttcctgtgtcaaaatgcatctcacattccttaagaagcatttagggcaatgttgctccaagtgtggtctttggcaggtgctggtcctcaaactctctgttacagatttgcaatataaggacagaaaccaagatgtgttttgtgcctttaatagcagtttgatgttgccacaacactcaagtgggattcatttttcttgtaattcatttctactgtattttaccaaagcctttattcccaatgaattgagggcaaaacatctgggcttttataaaaaattgattgagaagtgctcatttgcaagtaataagggaaaaattttaatcacttttaatctcactattccacctaagccacttttgtgaaagaaacagtggttaggagttggggagagatttacatttctttatacatatttgtttagtcatttcatagttttaatcacatgcattttccaaaataaaaatattttaagcaccatcatgaaaaataaataagatacacagtttggacccaaagattttgccaaagtggattaaacatcccagtctccagctgcctgaaaccctggggaaaaagttgggagtgtcaaaggtctcaggccatcaacttgttgccaatcaccagctctgtccagttccccaggactgcctgggctctgttacatgaggtctcatcctaggaacgaccattggtacccacctggctggcagagggctttctgctttctaacctcctctcgcagggttcaggctatctctggccacgatcttcccttcttctgctgagtcaaagcaaatatctgaggcattctgagggacacttagaactgaggagcaattaagaaatgccctccaggagggactggcctccatgttacatggtcatcctacaagtcctaatggaggccctgagaatggcattgccttaatggccatagtaggaaaaatgagcaatgttgcctgatcgctgcaattgaatatcaaagatgttaactgagaggcacatgtatacacactgccaaacattaaaccatcttcctacacattgcagggcatgagaaaaaaaaaaatggaggttgggagtaggatgtccaaaatgagagagaagggtaaagaaagaagaattgcaaaaatccataattagaaagaaaaaagcaaacatgcatttagctgttttggaaaatctatgttacataaataggacatttttcagaagttaaagaaaggtcagcctaaatcatgcacacactgcagatccccatccgtactcctaatctgaaaaactaatattaaaggattagagtatgacagtttaggtcaaatgatgatcctccctccccagacttgtctattttaagcttaggaggaggcagaagagtcataaattctcccagtggggcacaaggagccagtccttttgccagcacctttcagactacccgtgacctcccttccttgtgaaattacccataagtcgaagatgggaagcaggccttgtatcccttgggaatattagggagtctcacaactttccaagattttaggaaaagtaggaagtaacctatttataagtctgtttgttttgggaagggattattgcctttgtcttcctttctaaaatagcattcattaatttttctttaagtaaaaatatgcccaatgccatcttctctcattccccatggaaacttgctttgatccacagagtacctataaaaaaaattacaataaattgtgtagtgtttgtaactaggaagattaggacttggaatgaattggctctgcgtttatagtctcaaggacaaagactttgtctttgttctcaaggactatcagccatgagattgacagctggggtttattctgatcccaacattttcctcctctgatgttggtcatgtcctcctctgtcacttctgaccatgagtatagggattgttgttgatagtcagaggagaaagaactctctgaaatgcttggtagaaaggaaaaagcatgaaagctttctagaaaggtaaaggagtttcatcagagtaacggtaatacaatgtgagattcagaatgttcttcctggtttagtaatttcaccttcacaagaaggggctacatcaaggcttccccagggtagctttgcagctacagtcagattgtgcagattcactgagacaaaggcctagggagagaggagaaagcacttccttggcggctgtgttgggccagctttactagaagtggagtctgacacacttttgtgcaatgatttattgaggataagctctcatgagaaggaagtaagagaagcaggaagaggcatggaaggagttaagtgaacttgtatttcaagagaggtctaacctcagcttgatctcactggaagctctggagagtgtgaattgcaccatagttacccaccaagagccaagagaattggactgttaaacttcaacattaatttgtcatcggctatacgctgcctctgagagtaaggcggtcatgtccacgaatctctaggataggcaactcccattggccaaggacaatcccccagaaaagggtgaaggtgtgagcccttatgagccaacacctgtggcagctgtaggctgctggccctagcttggtcaaggggaccttggcaggcaccaactgcagctgctacataagccaaaacaattgaagatggaaggtctgtggactgtaccttatctaaggaacaatttatatcatatacaaatcctatcctttactattatatggtagtacatatatctcaaggtatggtaccaagggggcatcatatttgattagattggattacaagataaatctgaagaggaacatggaggtagctcagttcagtatattcattttatagaagagaagaagtacatgagagtaaacacttactgggaaccagatctgattctcagttttctcttttgcttgaattcaaccgaactcatatttattaaattcttactacgtataaggcacgattttaggcactgagcagataagtgaaagacaccaaattcagccactgccttgtgccttaggcatttacagtctggttgaagataaggaatgaaagaaaaaaataagagtataaatgctatgcaaatcacaattcagatctcacccaagagcaatgtggattaaatgcttgggtcctttgaggcaaaaagcatgacacacaggaggatagtttgtggtttgtcttaatgtgatgggaggccttcatcccaaattcccctgtatttaaaactataaaaaagaaaatatcctggcagctctactatttggtgaagctgaaaaagataaatattcaagtagagttctggaaaaggggaaaaaagcaaatgaacaaagaacaaaaacaagccgtcccttttcaaaatgtcatcttgccatgaaagcttcttcaattcgttacctagaagtgcaaatgtattgaaagttttactcattaaataagattattttgaagctaaaggccaaagatcctacttactttggagaacagtgttgaatccagcccaatctctcctttcagcccaggcatgttttagtactgggatgttttctatctttttaagtgtcctgtgctctgtttacactatattaatctgctcatttaaattggtgttttgttttaatgtttggccagagtttatgcactgccactttggagagaatctaagattcattcattcattcattcattcactcactcaacaaagcatttgttgacagcctgttggcatgggagacccttgcaattggcaccaagaatacaagaatgagaaagggactcaacttgcacccaaatgctcacagtccagttaggtgagaaaaataagcaggtgaatatattaaataaaatatggtatatgcacgaatagagccctgcccaggatatctaaccaagattgaccctaaggatgttcaaggaagtttttataaagaatttgaccttagttgaagcctgaggccccggtgaagggttacctcctcctttatcattttctttattgaatataccatcagaggaaaattatcgttttaaaattttgttgatgttgttaatctgtcccctctgtcttcccactaaaacagcatttctcaaccttttttaaaatcagtgatatcgtaaggagcctttttaaacaactttttttgtttgcttgttttgttttttattttgtatagatagaggatctcgctatgttgcccaggttggtctcaaactcccggagtcaagatatcctccttcagcctcctaaagtgctgggattacacacatgagccacagcacctggcctgtagacaactttttttctaaacactactctccatgatgtttttctgtagcaaaataggcataatataaaatgtaccatcttaaccatttttaagtgtacagtttactggcattaagtaccttcgcagtgctctacaaccatcaccattattcatttttctgtactgaaatttgctcaactgaaattctttaccccttaaaggataacttttcgtaccctttcctcccaggttgccccctggacaaccaccattatactgtctctgaatatacctgtacaaggtacttcatacaagtggaatgatacaatatttgtccttttgtgtctggcttatttcacttagcataatgtcttcaagattcatccatgttgtagcatgtgccagagtttcattcctttttatgcctcaatacctacatgaaatttaataccacattttaaatctctttgtatactctgggcctttggaggctcacaaaccattgtaatacataagatttttccacttcccaagaaccagtttcacccttttgctgcaatatccccctgtagaaaatgcctgtgttaaaacctaagctccgtgaccctctctatcttgttgtccactgtgtcccccagcgtaacacctagcacattttaagtactcaacaatcatttattgaatacttctctagcccttccccaaccactccttccttcttatcttagccattattattaaaatttgctcttagagtaattacgtatgtatttgttacttagtgcttcatgctccccagccaggcatctcaccatgctcatttcctttggctgcacatgccattctcagtgaccctgtgtttgctggctttcttcacagaagtaaaagattatgagcctccatttggttccaaggtgcgggagcacccctgtgtcgaaagcatgaaggacaacgtgttgagagatcgagggcgaccagaaattcccagcttctggctcaaccaccaggtaaggagtgagtgtttacaaaggtcagtaagattcaaccaagttgcctcttaggtggcagagaattctggaatattgagcttaaatctgagggaaggtcccattgtgttctatggccctgttaaattttgtttataaagcaaatttcaatacagtggataacccaattattataggctccaaccagctgatatgtactctgagagttcacaaatagccattcggaggacatttgccacattttccaagcccccttggtcctgggttaaaacattttgtttgcagcctctgctacttactcctgggccttcacgtcaggagtttatatttgattccctctggattccaaatgttttcttctgggaatcttcagctccataaggaaatacttagcagatgcaaaacaagcagggtttgtcaggcagctgtagtgagaagtgactgtggcatgcagaaggctgtgtacaggtgtttgcaggctgtgctcacagacttgggagaggcctgagtgagcacgcgtgggaaagaggagaccgactcctcactctggaattaaggaaagcaaagaagaggagaatgccctggaaggaacgagaaatctgtctgttgggaacatcctaatggcctcttatttttccttgttaagaaatgctagctaaggctgtccatagcagggcagtcattctggactcataaagaggctgatccaaattgtttgtttgggggcactttgatgagggcaatggtcagagaaaaaagaaaacgataggttgtgagtgagtcagaaccagctatatgtctgacacacccaggaaggagcccttagtgaagaatgagagagaacagtgtggccctatctcactgagaagactgttctttctactgactaaaaccttttattgcctcttttggatgaattccctcaaccatgaaggccgaggctaagttgttggtttccctaagggcaaggcaaattcagataagaaacagaaacaacaaatcaggcacaatcgggaagacaaatggagcaggaagtctggtctgtgccagtcctggcccagagccacttcagcagacagaccttaataaagtccgaggaggttggcgagggggaaccaggctgtggtgggtcacaggcttctctggagttttgagcaaatcctctttgacactaaaactgtaagaatattttgcataaattctgaaatcagaatgtgctggagtgttatgtttctttcaaactctgttgcctcctctgctgtatagttctcgtaatgatgccattattcatgatgataaaattctgaaaagaatttgcataatacattttttctcataatgagatttgttgccctattgatttcaagttaatgcttaatatttaatttaatttactgcctgtaattacagtgccagaataaaataaatgttacttgtgtaccaacaatagcactctactcttaacagggccatctgtcaatactgtcaattaggtgaattatgcaattaatttaacatcatgaactcatcgggtggggagggagagataggctcctaggtgtgtttggaaagttgttggtattagaaaacaagtagaaaaagtgccagctctcccaggtagttttgagatttatccatcccactcccagccacctgtgtgagggatcccattagcaatgttgatcttacaattgggaggagcacactctatttccacctatcagaccatttacttaactcctgcctgctttatttccaaaaaggatttgaaatgataacaaaaatatttgcaatgcaaaataaaaattaagccagtgagagaaaactcttgccaccttcctgggcaggatctcctggatggtctccttggatgggagcttgattcggttagggtgaaccctaggaaatggcatagagttaagcatgcctgacccacataggcagctgtttcacagggttcaacccaatgttgttggagaggaatggagcatcccagaggtcatccttggcagctcgtagaagctgctactgaatcactctacaaaatgtgtggcctatagaaaatgaaaccatgctaatgcctgcatacaattctgacgggggtaatcagccctgttaaaatagaacagtgtatatgacccaactatatgacactctggaaaaggcaaaaactacagagacagtacaaaatcagtggctgccagaaatttaggggaatggagggagggatgaataagtggaatgcagggaatttgaggggcagagaaactattccgcatgatactataatggtagatacatgtcattatacatttgtcaaaacccctggaatatacaacaccaagagtgaaccctaatgtaaactatgaatttgattgataatgatacgtcagtgttagttcatcagttataacaaatgtacctcatagatgcatgcatgatgtcaaggtggagaaggctgtgcctttatggggaaggggttttgtgaaaactctctgtactttccactcaattttgctgtgaagcgagaacttctctaaatagaaaggtgttgaaatgatattaagggccactacatggggaattttcaggtgttgggagtgttagtgtaccccagaagcccagcagaggatcattgtgctgtcaggacctattgtgatcagatagcaccagagccaaaaagtatggtaggttttgagcacagctgccaccagcacaaaccccccaccaccctttccacatggaactggctggcctgcagcagcaggcactcagtcagcacatgttaaatgcacaggcacttttggaccctgcttgcactcactatagcaacaaggtcagcaggccaccttgccttccgcggagcccaccaactcatggtgccctttggatctctttcccgctacagggcatccagatggtgtgtgagacgttgactgagtgctgggaccacgacccagaggcccgtctcacagcccagtgtgtggcagaacgcttcagtgagctggagcatctggacaggctctcggggaggagctgctcggaggagaagattcctgaagacggctccctaaacactaccaaatagctcttctggggcaggctgggccatgtccaaagaggctgcccctctcaccaaagaacagaggcagcaggaagctgcccctgaactgatgcttcctggaaaaccaagggggtcactcccctccctgtaagctgtggggataagcagaaacaacagcagcagggagtgggtgacatagagcattctatgcctttgacattgtcataggataagctgtgttagcacttcctcaggaaatgagattgatttttacaatagccaataacatttgcactttattaatgcctgtatataaatatgaatagctatgttttatatatatatatatatatctatatatgtctatagctctatatatatagccataccttgaaaagagacaaggaaaaacatcaaatattcccaggaaattggttttattggagaactccagaaccaagcagagaaggaagggacccatgacagcattagcatttgacaatcacacatgcagtggttctctgactgtaaaacagtgaactttgcatgaggaaagaggctccatgtctcacagccagctatgaccacattgcacttgcttttgcaaaataatcattccctgcctagcacttctcttctggccatggaactaagtacagtggcactgtttgaggaccagtgttcccggggttcctgtgtgcccttatttctcctggacttttcatttaagctccaagccccaaatctggggggctagtttagaaactctccctcaacctagtttagaaactctaccccatctttaataccttgaatgttttgaaccccactttttaccttcatgggttgcagaaaaatcagaacagatgtccccatccatgcgattgccccaccatctactaatgaaaaattgttctttttttcatctttcccctgcacttatgttactattctctgctcccagccttcatccttttctaaaaaggagcaaattctcactctaggctttatcgtgtttactttttcattacacttgacttgattttctagttttctatacaaacaccaatgggttccatctttctgggctcctgattgctcaagcacagtttggcctgatgaagaggatttcaactacacaatactatcattgtcaggactatgacctcaggcactctaaacatatgttttgtttggtcagcacagcgtttcaaaaagtgaagccactttataaatatttggagattttgcaggaaaatctggatccccaggtaaggatagcagatggttttcagttatctccagtccacgttcacaaaatgtgaaggtgtggagacacttacaaagctgcctcacttctcactgtaaacattagctctttccactgcctacctggaccccagtctaggaattaaatctgcacctaaccaaggtcccttgtaagaaatgtccattcaagcagtcattctctgggtatataatatgattttgactaccttatctggtgttaagatttgaagttggccttttattggactaaaggggaactcctttaagggtctcagttagcccaagtttcttttgcttatatgttaatagttttaccctctgcattggagagaggagtgctttactccaagaagctttcctcatggttaccgttctctccatcatgccagccttctcaacctttgcagaaattactagagaggatttgaatgtgggacacaaaggtcccatttgcagttagaaaatttgtgtccacaaggacaagaacaaagtatgagctttaaaactccataggaaacttgttaatcaacaaagaagtgttaatgctgcaagtaatctcttttttaaaactttttgaagctacttattttcagccaaataggaatattagagagggactggtagtgagaatatcagctctgtttggatggtggaaggtctcattttattgagatttttaagatacatgcaaaggtttggaaatagaacctctaggcaccctcctcagtgtgggtgggctgagagttaaagacagtgtggctgcagtagcatagaggcgcctagaaattccacttgcaccgtagggcatgctgataccatcccaatagctgttgcccattgacctctagtggtgagtttctagaatactggtccattcatgagatattcaagattcaagagtattctcacttctgggttatcagcataaactggaatgtagtgtcagaggatactgtggcttgttttgtttatgtttttttttcttattcaagaaaaaagaccaaggaataacattctgtagttcctaaaaatactgacttttttcactactatacataaagggaaagttttattcttttatggaacacttcagctgtactcatgtattaaaataggaatgtgaatgctatatactctttttatatcaaaagtctcaagcacttatttttattctatgcattgtttgtcttttacataaataaaatgtttattagattgaataaagcaaaatactcaggtgagcatcctgcctcctgttcccattcct

SEQ ID NO: 37111 - DNA, 80528 bp, Homo sapiens
caggatgccttccgtgccttccatcaagatctcaattttgtgcgcaagttcctacagcccctgttgattggagagctggctccggaagaacccagccaggatggacccctgaatgtgagccagagccctaggagaggctcagcccctgagggagggggatggctggagggctgggagacattgccacatggccaggagcagctccctcggcattcgcccaaggggatgcagagccagggctgagcctgccctcccctcccagggggcaggcagttgaaagtgaagctgtagggatgccctgagaagtccagggctccagatctggtttagccaggcacccgtttggatcccgaggcaagctccctccctgttgtcgcccagtgtccccatcaaaaggaggattttgatgaactgatttctctcctggctgtagcgtcttacccaccccataccttttgggagggagaggaggcttcaccaccagccagtgctccagctcacaccccgggctgggtactcttgtcacttcattcctctttgcccacaccccttgggcctggcgatgggaggagcggctggggctccaggagaatgggggtggggaggaatttcttccttggctgatcggcccctctgctatggcaggcgcagctggtcgaggacttccgagccctgcaccaggcagccgaggacatgaagctgtttgatgccagtcccaccttctttgctttcctactgggccacatcctggccatggaggtgctggcctggctccttatctacctcctgggtcctggctgggtgcccagtgccctggccgccttcatcctggccatctctcaggtgaccccagttctgtgttgcagccaccttaactgcccaacagacgtgggcccccatgcatctgggcattgtgaacatatttgctaaatgaatgaatggacctatgaaaggatgaatggatgaataaacagatgaatgagtgaacagtctgaaggcccatcaggcatgtctgtgggtcaagctgcattccagatgagccaagaagttccttcttgaacagattccgatcaagcacagggccactgagccagaggctgctgccctgcagcttcatgacacttacgagcccctccacctccctgggactcagttctcatctgtaaaaagaggacactggcccacaagggtcttgaaatggagcattagcacgggggtaccctgcaagctgaaaggattcactggggccccaggccctggcgggctccgtccttcccaacagcttctgaccctgcctctctccccaggctcagtcctggtgtctgcagcatgacctgggccatgcctccatcttcaagaagtcctggtggaaccacgtggcccagaagttcgtgatggggcagctaaaggtgagggtggggtgggtggtcagccaggtgctgggtggcgctgggtctgcccaagtgtgtgggcacagtcgggggcacagcctgccctgagagccccctcctcctccacagggcttctccgcccactggtggaacttccgccacttccagcaccacgccaagcccaacatcttccacaaagacccagacgtgacggtggcgcccgtcttcctcctgggggagtcatccgtcgaggtgggtggggagggacgtggacaacctctggctgggcctgcagctgagggggagctaatgcactgggtccccactctgcccctgacctagcccctgatctggcctccactctggctgggccaagctctgcccccgtgtctttccttcccacctcccaacctgctggggacgaccagcccgcttgctagaatctagagttgcctttgacccttggccccagccagccccgtgaccttgcccgggagaaggaggtggcctggagagctgctgtctccagccgccgcctgtctccacagtatggcaagaagaaacgcagatacctaccctacaaccagcagcacctgtacttcttcctgagtgagtgtccatctgtccttctggggtgggggagtgcctgggcctgcactgtcctccctgctgtcctggaccactcccagccacttcctggggcggggcacgtctgtcaggtctccctggtcatggcatcctcccagcctctgcagtctgtacacactctcccagcagcatgcctttgccccagctgtctcccgtgcctgggacaccttgcagccacgggccatcacagccctgctgggagcttccccaagccccacgtagaatttcttcttgccctcactagagtggtccggagccctagagtctttgggcagttgttggggcggacagagtgaggactcaagtctggccctgacttgcggtgaagggtggtgggaggtggtggggtaagggcagcctggggaggcttggacacagaattgggggtgatatggggtcattcagctggatgtgaccagcaccaacgtcccaggggcattcctggagtaacagagcccctcactctggcgcccactcaccttggcagcccagccccactcctgaacactctcatgccccttcttgcagtcggcccgccgctgctcaccctggtgaactttgaagtggaaaatctggcgtacatgctggtgtgcatgcagtgggcggtgagtggggttgcccaggaccccgggcatacggctgccgtggcaggaggtggtgcctcgggggacagtacctgcccatgaaggcaaacagggtgcacatgtgcgtgcaacagtgtggctcacatgtatgcgtgcaacagtgtggctcacatgtgtgcgcgcagcaggagagcgagtgtgcccgtgactgtacgtgtggtgggggggggttgaggaacagggggggtgtgggtctctctcggtgagggtgtcttcccaggaggagttgctgggctgactctgccaggcatctgtgtccctggcagggtcttccccaacacaccctgcatgacaccttcgtcactaaaatcagcctcgtgagctggcagggcaaggaccctgttcctttactcagctgagaaaaccagagagggtggtggcctgtcctgggctctgaggcaaatcaggcagaagggttggatgcctgaggtcctcctcccacccaccaggcctccagacctccgggcacctggagacctctcggtatcgcctctgccctcctctgcaggatttgctctgggccgccagcttctatgcccgcttcttcttatcctacctccccttctacggcgtccctggggtgctgctcttctttgttgctgtcaggtatggcagggagtggcgaggtcacacacaggcgacaggtgacccccactgcagccccccaccagagcttcccttttcccgtctgcagaatggggccagtggtactgcctccctggcttgctggtggaatcacataaacacaagcgtggcaggagcccagggtcggtgggtttagggagcgtggcctggcttgtaagtggcccggtgggtgtcggagctgctctggactcagcctcacagtggacactgctccattcagattctttaaacactggcaagggggcgatggccacaatcctattgtacagataaggaagtcaaggccacttggggacagctgctctccagcctccactcagggtgcctaagtggtgagctggacctagggcagtgcccgagcctccccacagggtcctggaaagccactggttcgtgtggatcacacagatgaaccacatccccaaggagatcggccacgagaagcaccgggactgggtcagctctcaggtgggcagcaggggtggggcccatcctgggtggggtggggggtcccagctaggagccagatggcaaagcagggatgaggccctgacggggctgccaggtgggggatggtgccgtggggtcagggatctgcaacggcctcctcacatgtgccccgccggcttccggcagctggcagccacctgcaacgtggagccctcacttttcaccaactggttcagcgggcacctcaacttccagatcgagcaccagtgagtgtgggtgctgggggccagtgggaggtggggagggggtcctgggaggggatcctgggaggggacccgtgggtggggcctctctctggaatctcccacttcaggtgccagcatacgctccccacccccagcctcttccccaggatgccgagacacaactacagccgggtggccccgctggtcaagtcgctgtgtgccaagcacggcctcagctacgaagtgaagcccttcctcaccgcgctggtggacatcgtcaggtgaggctgcagcccggcccctctgttctggtggcttccccagggcctatgcctacccttgtccaggtcagcctcatgctgagcccccagggtccctgagcctttctgtccacgtcccatgcccttcctcccttccccagccttcacgcacacagtgagaatttctggagcacctactgcagactcacaaacagcagtgcctgcggtgagcaggtctatgcaaacctacccccaaaggctgagggaaagaagctaacagatccagtttctcagaaggaaacacttaacagggactcataaacagaagccatgtctcagggccgggtgcggtggctcacgcctgtaattccagcacttggggaggctgaggtgggcggatcacttgaggtcaggagttcgagaccagcctggccaacatggtgaaaccccgtctctactaaaaaaaaaaaaaaaaaaaaaaaaaaaaaaaaacaaaaattagctgggtgtggtggcaggtgcccataatcccagctacttgggaggctgagggaggagaatcacttgaactcgcaggggcggaggttgcagtgagctgagattgtgcctttgcagtccagcctgggcaacagagcaagactctctcaaaaacaaacaaaaaaaccatgtctcaggcagccaagagttgggacatcccctcacacgccctctagaaagaaccctctatatagcaagcttttagggtgaaccccatgcaggtggttcttatgaacctggtgaccactggaggttagataagcgtctacaagaggaggttatctatgccatgagcttggcattcagggtcaagcatcggtcatcagacagttttgcttgaagatggcattgcccttgtagcaatgcaggctctagagagcttcctgccctcttggagctgatgttccttccagcaaaggaaacagcaagcaattaaaataacaaataagtacattacagaagatgggcaaaagaacaatgaaaagcccctcagggtggggacaggggaggggaggggggcggccaggcaggggcggcagtttctaaataggtggtagggtgggcagtattgacaggctgacgtgtgagcagggacagggaggaggggagaggtctcgccacagggacatctggcaaagagcgttcaggcagagggcacttgaccctgaatgccaagctcatggcatagatagccgaggcaggcatgcaggcactcagagaagggacacgcccggcttgcatcttggaaagctgcccctactgggaatgactggcgggcaggagtcgaagtggaaaaggagagcagaggacactgcagccatccaggcgaggggtgatggggctcagcccttgtggtcaccttggaggtggagaacagaggccagattccaggtcttatacctctgcgcctttgtacacgctgttccccttacttggttgcccttccttcctgtgctggtgttcagatgcccacttctccttcatgatctctcccagcctgatgctctgagcccctgccatttggcacagccctttagagcgcctggcacagggcttcctagcagattgttgacatttctggctccactgaccaatatcaggcccaagatcgggtgggcaggttccacgtcctctctgtccttgggttgcagcgcccagcaggaggcagcaatggagaactgggtgcaggagggacaggcccacccaggctcatgcctggacttggccttggctgccctccagctcccctacccgacacccgtcaccccggtctagattccattccagagaatgagcattcagctgttctcccaacccaccctccagcccgcatcgctgcctgcccccagggaagggaacccacagggaatggggatctccgctcacacttaccatgggggatacaggggtgttaggatcttgcaactgagctcctaacacccacccccactgccacccccacctcccaggtccctgaagaagtctggtgacatctggctggacgcctacctccatcagtgaaggcaacacccaggcgggcagagaagggctcagggcaccagcaaccaagccagcccccggcgggatcgataccctcacccctccactggccagcctgggggtgccctgcctgccctcctggtactgttgtcttcccctcggccccctcacatgtgtattcagcagccctatggccttggctctgggcctgatgggacaggggtagagggaaggtgagcatagcacattttcctagagcgagaattgggggaaagctgttatttttatattaaaatacattcagatgtattatggagtggagtggtgaatttgcatgagttttgaagctggggtctgcccagactccccaacagcattcaggccctcggccatcaatgtgtgtgttggggccggcggcggggttgagggggagcgctaaggagctccctttagctctagatgccctgggcctgggagcccagggatgcctggactcggacctgcccgagggcctattcacttcctattcatgctgggcttcaagtcacttgacgcttctgcatggtgggatgagcgggcccagcagatgaggacccagggctgggggccatgtctgcggacgcttctggacatggactgggaaagacggttgtgcctcttgacctgcactggcctcccacagccctccatgatggggggcctgaaagggccccgcgcagcgggccacctgctgatcttagcgccacatctggcatcacaccagtggtggtggtgcagcctgtgcccggtggcccaaggaggcaacgtcgatctccctcaagcccacctgggaccaggtgcttgtctgtagttactgcagtgaataggctggacccccgaggcatggccattcctgtccctgagtccctggagtcaggtcttaggctccttgtctggcagtgggctggactgtgcctgtgggtttcggacagttctggggagggctttgagttgcctcttggggcacccagaattgggaagaagatctggctggaccaatcagtccccagcatccacacagcctgacagctccaagctgagctgagggtttcatctgaagtgtcggcagcttgaaaaagaaagctgagtgaggatttctatgaggcctttctggagtgggagctggggtcgccctaccagctgcaggggttgccccctactttttgggcttccattggcctggactgggttctctttgggaggtggaaaaggcgcaaattctgccaatttttgttcagcccctccaaggcccatcctccgtgggacggagctggaggggaagccccactgccccatcaacccgccccctactccacacacatacaaggtggcgctgagtgttgctgcccatgaacttctcttccgagacagccagaaagctcctcagtgctaaagctgatcaccgtagtctcacacctgcttcctctctgtgaggaggggccgtctgcacattcccatggactcttgcggctcttcccaggggctccccttctagaaagttctctctgacccgcagggctcctccccttccctgcccagcctgtgactagggtctctgtgacggcacctggaatactgacatcatttgctgctggaggctggtggcagcccagagcctggcccgggagaccctggggtgtgttttctgagaggatgacagacagggtgtttgggtcctgcttccctcaccctgacttctggggcaggagagcactgggggaggtcctgttcggctcacataatctcccagacccaggagcagacagcccaaagctccctatggcctcccggcccagggcagtgccagcagaggcctcctggtagggccagggaagcagagggtggcagccccttcagcttggttgtgagtgagatgcctgccctcctccgggtgccacccagccccaccggatccactcaagtcagacagacttgggggtggggtggggtgggggcaagtcctgtttctgccaggacgcaggctgtgtgaccttgggggagttccttgaccccgagcagcagtacctagggtgatggaagaaaggctcttagcaaagggcacagcagcaggctcagtttattcacaaattttgtgcacacaacccaattccccaggatgaccatttgctctgtcacctagggcaagttcttttttgccttccctgagcctcagttttcagccgagggtaagattggatgctccttgaaaggtacttcctgcctcagacacacgcttctcatggccagggcgtgccttgcattcagggtctctgcacaggctggtccctctgcagggactcccccttcctgtcaccgcctgtttaaatcctgttggctcctagtgccacgcgggcgccctgagccagcgcaggctccgaatggcattccctccgtccacaccctggtagagatcgctgtgcgctggctccgaggcgctcgccagggagatgctaacaccgaggatccacgacagctgagcctgcagcgccacccaggggcgcccggagcatctgcgccagtgtggggcgggccgtgctccctactgtccctggtaacttgctttgcggacccctgggaggccccgccttcagcagccactcctagatttctccagaccacctgggacccatcactggcaggggaatctttgctcttgtcccactgtcccccatgctagatcccctgggaacaggtcaccctcagtcctgagctgagctcccccttctccatctgtaggtctcctagtctcagaacaaaggcttagggcacaggggccaggtttgtaaaaggaaagaggctttggtggaacctctgaacctctgagaaaccgtgttccttttttattgtctgtacaagaggcgtgggcccggaggaaaaacagctcccgagggaaaccataaccgcagtgttggtttgttcctttgatcatcaacatttgctacgggtctcccagcccaggcagatgttggaaatgatgatgcccaagagccagcccctgcctggtgtgttgggagtagctggaggggagcagggcgtcaacaaactcttttgtgacgggacaggccatgggtttctcaaggttcctccccccaccacactatgtcctcaggcaatgagccaccacaactactgggagcttggcctattccaagctcttggctgctgtcactctttctcttggacacttgctcttgaatgggacgatttagaagaaagacctgaacgcctttaaaatccaaagcaaagtgtttgtgatggtggaggacgatggggacgtgatcctgaaatctcagcacgctggggggctgcttgttccgtgtatgcactggccacatgaagccagtctgctgagaaaaggaaaaccagtcccgagggcagtggcgtttcagcctggggcaagccatccccacggcgccccatttccctctcagatgttggaacagggactctttgagaggcagcttctttggccagaggggcacacctctcgggggagggtgcagcctggctcgctgaggagtcccgatgggcccaaggcactgtgtcacataagcaatggccagccactcctgatggcagcccaagcccagccccagtggctgccagctctgccctggtccagcttggtaaaggcttcctctcccctccgagtaggcacgagggcttcggagtgtccagccagacaccccgaggatccgcctgtggtgccacagcaccctcccccgccccacacacacacagcttagacttggggcgctgcagatgtccccgctacccacaaagctgatacccttttatctgcgtagctacactgcccttatctcctcctcagagactaactgccctccactgcccccactcctccagccagccgctgggcctcctgggagctgtctgacatttgacgtgatgggggcagggtctgggaaccagccctttctgtgcaggagaggtggccaggagcctgcgggttaggagcagggtcctgctgctgtgtggcctgcgcagtcctgtcctctctctgggctcagcctcttcgcccatgatggtggtgttggggtttgattgctcagggccttgaatattggggcaccatgactttggcaggggatagggattagaaactcacaattctgggtgtgttggcaagggggtcagctgagtacagggacaggagggggcggttaagcagagagcagatatgaatgtcctcagcttcttgacccagggaagtattcaagggcaaggcggggctgggtggggctggggaagtcagagaagctccaagtgcccggtgaggctaggccaagatttatctggtgccctcatagccccagcgtccatctggcctccagtatccccaattccaagccccctggttgttatgggtgatggacccatggatttccaactggtagggttgggaggcctgggctggtcgccatcctggaggcgggtcacaggcacagggcagagggtgggagccgtgcctgccagggtcttgtaaccttgaaggccactgccagcgggtccaccaggagggcaaggcctagggtaagcgggtgttgagataatggcatccttggggcccctctagcctgcccctgtggactatggcccacagggccagggagggcaaaggactccccagagccacttggtgaatctggggtgagtcggccacctcgctcagggcttctgtaatgccaggccctactcaggacaccctgtggccactggggagccatacgtaccccagccagtctgctggctgtccctacctggctggatttcggccaggcaaagcgggggtcaggggaagcaggcgggggctgaggtctactcaggagccctccccagccctgctgggagcagctacaaagccaaggggaggccccaaggtgttaactagccagtgcctcttggcccttccttggcactttcccaggatcagccctgccaggaaagccagcccagagatgatgacggagcagcatgggggtccatgggaggccgactgtacaagtgcccctggcatgttgctttagactcttcccagcctctggggtcagacagacctaggatccaatctctgtgcctatgaactggtgaccctgggctaggatgatatcagccccccccacagcctgtgggttctgaatgagccattgcatatatgggcacgggagccacaaaaagaatcatcagcctccagagccttcttcagcccccttttaatttaatttaatttatttatttatttatttatttgagacggagtctcactctgtcgctaggctggagtgagcgatcttggctcactgcaacctctgcctcccaggttcaagcgattctcccgtctcagcctcctgagtagctgggactgcaggcacgcaccaccatgcccagctaattttttttttttttttttttttgagacggagtctcgctgttgcccaggctggagtacagtggtgtgatctcagctctctgcaggctctgccccgccggggttcacgccattctcttgcctcagcctcccacgtagctgggactacaggcacccgccacctcgcccggctaattttttgtatttttagtagagacggggtttcaccgtgttagccaggatggtcttgatctcctgacctcgtgatctgcccgcctcggcctcccaaagtgctgggattacaggcgtgagccaccgcacccggcctaatttttgtatttttagtagagacggggtttcaccgtgttagccaggatggtcttgatctcctgacctcgtgatctgcccgcctcggcctcccaaagtgctgggattacaggcgtgagccaccgcacccggcctaatttttgtatttttagtagagacggggtttcaccatgttggccaggatggtctcaatctcttgactttgtgatctgcccgcctcagcctcccaaagtgctgggattacaggcatgagccaccgctcccggccttctccagccccttccaaggaggccaggaattctgtttggcctggcgctctgtggaagctggctggcccagggatgggagggcagattgcacttggggagacagctggggggggaggatgttaggaagagtctctgcaagcccctccatgccaccctccttgggtaggggtcagctgctgagaggtggctctcagccctgttttagaattgggctggggtcggctgctgagaggaggaagatgggccaatgtttttgggtcatttccaccaagttccgggccccagaatgaatttcagaggcagcagggagaggcgggtgggatggccacaggggagggaggggatacagagagatgcaagcatggggacccctcctggtgcccaggcccagctagaagggcctcatctatcacccaataccatggcctggcattggcgtgcaggaaacacaggaagtgagaataaaattccttattttatttcaaaaaatgtaggggtggggaagtaacatgataaacattacgatcagctccctatgggttcattctgcctctgcgggggtcgggggcatacagtagctggggggcatgccattgccatggcaacccagatgcttagatgcaggtccctcctggctgcttagagctggggggactaggcgccctccccgaaagcccccattctgagttgttggtgcctgcccttcccctgaatctaagaactgattagtgggttagactgcaacagcagctcaggatcctcccaggacttccctccctcccctctcacttgcccgtcccctcagctaccagcacctccagcccccacctcctcctcttctcagctccaccctggtcctcatgaggtaccccctccccagcccctcagggcagcctcctcctgagactccctcccgctctgcctccctggccctccctgacagtcagggccaccgaggcaaggccatgtggtgaaaggcagattgtcacaaggcccagccctgccgccccctcctatcagaatgcatcctggagcaacaggttaaacacagtaagggcaggttcagacaggagagtgcctgaggcagcgccgtccacacagcagccccgagatggggagggctgggacgagacctcccagctccagtgccctcctgcagcctgcagggcccacgtcccctggggccaaatggccagggattggctggcactgcccagctgataacagagcctttggagaagggtcagattgctccagaatcttggacctcaggacaccctgaggaaaagctggagggtgggctgagcctccaggccagccggcccctccctgaacgtggccactgcctctgctgagtcacaagagacgagggactccccctttggtcccaaggtcacaggctcaagttggggaggcggtggaatggggcccgtgaaagcccagggtcagagcactctagtgatggggtggaggactcttccagggcccaaggtttgggctggctgtgcccgcgggcctggggccctggacatcttaagagaggcctcgggtacttaaccgagctgcaggagggagacccgagctttgtaacaaagcaggcctctctatgaaagggtggaccaatggcagccgtcagggagagtgaagccaggccgggagggtcaggggccctgcccgactaggacctgcccctatgaaccccaagagcatctgaagaaccaaagcgggggtgatgcctagtgaccaggctgcaaggggagactcacaggccagacccatggaccgctggtctcctcccatctttaggggcagagagtggaggtaggacagagccacccccggtggccacctctctgctccttggaagaaggggctaggaggcactgggagggccatggctgatggctgacggctgagggagggcaggtcccatgagggcagggtgctatgggggagatgtgaagagaaaaaggagaggagaaagggagaaagatccaacatggggtccgtgagcagtgcatacaccagcctctcggacacccctcagaacaaaagcccatcattcctctggccatcaccccacctgcaccccttccccacggtgtcccgggggctgtggcttcatttgtgaaggtaggcgtccagccacagcttcccagacttcttcagggacctgcaaagttggggatggaccagggtcagggaccaggacgggagtggccccagggagtgcaagggctgaggaggccatcattaaggtggcatgtatgtccccttggccctaaccagggcttaccactgccactgggcctgtggggctgtcagctcagagcccaccaggaaccccacacagaaagggatggtcttctcgcagcccagggagaaaagcccaacagctcctaacacaggctcgggagtaaggcaggtgccctggtgggtgactgtgccaggagggcccagcccctcttgtgatcccactgtctgcaccacgggtgatcccagggcccagcgcctgtggacctccacccctcacctgatgatgtccagcagggccctcagtagcggcttctcctggtattcaatgccatgcttggcacatagagacttcaccagcggggcgatcttgtgtaagttgtgccggggcatggtggggaagaggctgaggagtgtgtagggtgggcagagcgtgaggactcagagggccatgctgctcccgcttcctcccaccacctgggcagaggctggctggggccctcagagaccctgtccacagccaggaccagtctcaaagtgtggctcctcgtgtgtgcccagtggggtgccacgtgtgtggaggggagggtgcagccctccgtgagcaggagggcgtttgtgctctatggagctgggaagatattgggtggccagagacaaagtgtcatgtttttcaaaaaagaaatgaaatagctggggaatgctaggaaaagaggcagtgaggtgaggcacggtggctcacgcctgtaatcccagcattttgggaggccgaggcaggcagatcacttgaggccagaagtttgagatcagcctgggcgacacggcaagacctcttctctacaaaaaataaaaataaaaaattaggccaggtgcagtggctcacacctgtaatcccagcactttgggaggccaacgcaggtggatcacttgaggctaggagtttgagaccagcctggccaacatggtgaaaccccgtctccactaaaaaatacaaaaattagctgggcgtggtggcacacgcctgtaatcccagctacgtgggaggctgaggcctgagaattgcttgaacctggtaggtggaggatgcagtgagccgagattgcgccactgccctccagtctgggcaacagagtgagattctgtctcaaaataaataaataaataaaagtaaaaaaaaaaagaaaaaattagttgggcatggtggcacgcacctgcagtcccagctactcaggaggctgaggtgggaggatgactttagctcaggcgttcgaggctgcagtgagccaagaaagcaccactgcactccagcccaggaaacagggtgagactctgtctctacattttttattttttaataaaaaaaaaaaaaaacagtgacaagaggtgaagcaaggacaaggggcagcagggcagtccctcggccgatgttccaggcaagctacgtagccctgccctgctagcctcacagggtcatgaggtgcgtgtgcaggctccataactacaaagtcccaggcccacatggagggaggtggtaaccactatgaccaagtggcacagcatgaggggcacaggatgaccctcagggagatggaataggggagcccctctcctgacctcagcggggctggctgggagccttgctctatattgggcagagaccttgtcagagagacaaagaggtggcccccacattctgcattctgcccagtgggatagcggccacttccctcccgctgtgggtctccccgcctccccgcagccccgcgctcactggtgctcaatctggaagttaaggtgtccactgaaccagtcgttgaagaaggactgctccacgttgcaggtggctgtcagctgtcagtggaggggatgagtgtcagggaacaaaggaaggcccaagggcccggcctcattcccagggggcccagccttacccagggtctccaggccacccgtccacatcataccgtcctgcctgatggcctcagcccacccagatgccccacctgtccctctgggggattcctgctgccctttcttgctcagccctgaagctcccagcaaaaggacacaggcagccccgggaggcccagcacagccctgtgttagcaggtgcagatcatctggggccaggacatggacattgggaccaggctctggtgaccggccctgacttccctacctggctactgaaccagtcacggtaggcctcctggtcaatctccatgacgatgtgattcatctgtgtgacccacacaaaccagtggctctccaggaacctgcaagagaacacagctcagcgcaggggcctccgggggcccagccacagtgggaacagatccactctcccaaccagcccaggacagcccctgccaaggggccaggatgggaggtccccaggcaaagtggagccgtccgagcctcttctcatgccaaagccatcatcagtgccagtggagggcccagggatgaatcagcaaagcccaggcacctgatgaagttgaggaaaaggagggctcccaggatgccgtagaaagggatgtaggtgatgaagaaccggatgtagtagctgacggcccaggccaggtcctgcggggaaagatgaagttaggtgcaacctgccctctcctctgccctggcaccaagtgcgtgccccagatgtgcacacacctcacactcaggcctctagaagctggaccgcagcccactgaaatgcaatgggcaactacacgccacctgcttgctcggggtttgcatggctgcctttgtttctagggaaatgctgagtgttttagcatcaggaagtgactgtgccctgtttttcgggagagaaacggaccctcctgctgaggggcagccatggggtaggggtgggggtcagcagccctctcgtggggcaagggcgattctgaaggtgcgcccccaacccggggccaggtccccaaccgtcccccagtcctgtccctcctcctcagcacctgggtctcctcctggcatctccttccagcaggacagagggcttggaggggtagggaaggtcagaggtaccatcgtccctatctcagagctctcacagcagaggctggcctccccacgccccactgtcatcctgtgtccctccactctgctctcctccctgcctctggctggactggtgtcagggactgggcttggacgtcttctctcatgtactgggagggtgacttcacggctccaccctgtccactgtctctctgccacccaagtcttgtctcaactggaccacagcatcagcttcccacagtctcctgcttgtcctcgtggccatggcaaccagagtggccttcgctccaagcaggtcccaactctcccctgctaaagcccccatcccacccagtcacccacggagcctcatggggttaagaacctgtctttactcagccccctgacctagcttactccctccccggggcctctgcatggcctgttcccactgccagggcgctcatcctgccatgagtttaggtatggtgacatgccacaggctcagcacaggtgtccgaggtggaaggtgaggccaagggactgccctgtctcacttcaaacgactgaagaacaaggtcacatttgtgtcttaaaatagatccccacccactggagagggggagactaggaagttattccagcggctcagacatgaaatgacagaggcctaaaccagaacccacggcactgacaaggaggtgacagattccagaactgtcagaggcaacggtggctgcatttgtgcctgcttggctgtggggaatctaggctggtcctaggtgatcaggggtcgggtgccagcagctgaacaggaaaggaggaagggagcgctcaggagaggctggagatggccttggggccaacattggccgagggcaggacctcacgttccaataaggtggccttcaaggtgaggagggaggcagatgtagccagttctgctcccactttccatcacattccttctattctgtgtgtgtggtgcaatagtgtgcagtgtatctacacatatatggaaacaaaatgaggatggggttacggattatttttttttggagatgggatcttgctttattgcccaggctggagtgcaatggtgtgatcatgactctgtcccaggctcaagccatacttctacctcagcctcccgagtagctaatttctgttttttttttttttttttgagagggagtctcgctctgtcgcccaggctagagtgcagtggtgtgatcttggctcactgcaagctccacctcctgggttcataccattctcctgcctcagcctcccaagtagctgggtctacaggtgcccgccaccacgcccggataattttttgtatttttagtggagatggggtttcaccgtgttcgccaggatggtctcgatctcctgaccttgtgatccgcctgcctcaggctcccaaagtgctggtattacaggcatgagccactgtgtctggccttacctggataattttttttaagtttttatagagatgggggggtctcacttacttgcccaggctggtctcgaatgcctgtgctcaagtgatcctccagccttggcctcccaaagtactaggattacaggtgtgaaccattgccctggcccaacttttatttttaagagacagggtctcactctgttgcccaggcttgagtgcagtggtgtgatcacagctcactgcagcctcaaactcctgggctcaagccatcctcctacctcagcctccaaagtaggtagattacaggcgcgcatcaccacgcccagctttttgtagagacagggtttcgcccatgttgctcaggctggtctcaaaactcctggcttcaggtgatccctcccacctcagcctcccaaagtgctgagatcacaggcgtgagccaccatgcctggcctggacttcttttgagtgtagagagcaacacatacacagagatcgctggtttcaggggcagagagcccaagagatcagaagcagccaaagaggcggagcgagggggttgggaagaagccagcagaggtggggacctggaagccaacaggaagaactgcaagagggagtggccagtggtgtcagatacagcaaaattccaggagggtgaagcgtgggagcatctcaggatccaggacgtggccccgggaacagggaaccttgccagagcatgtaaatctccccgggaagcctccttcaaagatcttagggtttgtcacctctttcctctaagccagggtcccccaacctccacactattggcacctgggacaggctgcttgttgtcatgggcggttctccagggcatggcagggtgctaagcaccatcctggctagacgcccaccagatgccagtagcaccctcctctcctgaagttgtgacaattaaaagtgtctccggatactgccaaagggcagaacagctcccctgagaaccagtgccccaggtcataggtgcgctcctggctctgaaagccccatgggctcatcacattgtccccactctgccatccccttttaggaacatagggtgatttcttttcctgtttaatactttgttccttagggaacaagcacagtcaaaaacaaacaaaaaaaagaagttgctcactgcaagctccgcctcccgggttcaagcaattctcctgcctcagcctcctgagtagctgggactacaggtgcacaccaccatgccaggctaattttttgtatttttagtagagacggggtttcaccatgctggccaggctggtctcgaactcctgacctcatgatctgcccgcctcggcctctcaaagtgctgggataacaagcatgagtgactgcgcccggcaataggccacttatgagttagaacgggattggatgctagaggcaaggagagggtgtaacatgtataaggagggaaaaaacataatggtgctagtctctaacttgagccactgggtggatgatggagccattcattaacatggagaccatcaggattaggttgtgggagaagaggagaggacttacattgaatatgttggatttgcaatggctgggacacctccaaatggagttagattggatatatgggtccaagacttggagataaaatttgacttggctgctcttaaattcacagtcagggtgaaaaggacaacttcagttagcaagcgataaaacagtaatcaacaggccgggcgcggtggctcacgcctgtaatcccagcactttgggaggctgaggtgggcagatcacctcaggttgggagtttgagaccagcctgaccaacatggtgaaaccctgtctctgctaaaaatacaaaattagctgggcatggtggcgcatgcctgtaatcccagctacttcggaggctgaggcaggagaattactcgaacccaggaggcagaggtttcggtgagccgagatcacgccattgtactccagcctgggcaacaagagcgaaactccacctcaaaaacaaacaaacaaacaaaaaacagtaatcaataaacaagtccacatttggttaagagaggaaaaacttccccatggctattggttggagcatgagggacaaatagactgctgagaaagactggattttaagcaagcatttcagaaagtgacaatttagtctttgataattttcagataaacaatttatctgccgggtgcagtggctcacgcctgtaatcccagcactttgggaggccaaggcgggtggatcacgagtcaagagttcgagaccagcctggccaacatggtgaaaccccatcactactaaaaatacaaaaattagccaggcatggtggccggcgcctgtactcccagctactcaggaggttgaggcaggagaatcgcttgaacccaggaggcggaggttgcagtgagccgagatcgcaccactgcactccagcctgggcgacagagcgaaacaccatctcaaaaaaaaaagatgacgtaattacaatgggccctaatgcaatatgaccaatgtccctattttaaaaaaaaggaaaaattttcaagaatccacttttggtgaagaaaaaaagaaaattaaaaaataggccaggcgtggtggctcatgcctgtaatctcagcactttgtgaggctgaggcgggcagatcacttgaggccaggagttcgagaccagcctcgccaacatggaaaaaccccatctctactaaaaatacaaaaattagctgggcatggtggccggtgcctgtaatcccaggtacttgggaggctgagtcacaagaattgcttgcacccaggaggtagaggttgcagttgagtcgagatcacaccactgcactccagcctatgtgactctgtctcaataaataaacaaataaacaaaataatttttttaaagagggatatttggacacagatacagatacaaatatgcagagagatgatgtaccgagagggaggacgaaagccatcaaccagccgatgagaggcccagaacagagccttccagagccctaaggaatccaccctgctaacacctcagttttggacttccggtctccagaaccgggagaaaacacatcgctgctgcttatgccactcagttcgtggtgctttgtcatacggtcttcgcaaacgaccacacctgtcatctcagccaacgcccagctgctccaacttcaaaccagggtgtggggcaacccagttcatgggactcagggcccacagggagcggggaagggagatggccacacttgcctctcatcctgctgcctttgagaactttctcgggggctctgcaaaagcaggggctgccccagtggactccctatgtctgagggagagtagagatctttaggactaggtcctggtggccccagagggagtcctttcctgagaggcagctaccccagggaggagatgcctggggccccacaggctccactggggcacacgaggaggcagcgtaggacccccgggtccccctgtcccagtcaccctcctccccatgccaagccagctgtgtccccaactcaccacccagttcttatggacgatcatggtcatgatgatctggtactggaaatacatggggatgagcagcggcggcccaactgcaggagagagacaggcgcttagaggcatccattccaccctgcctgtgccggaaggtcaggggaacccaggcccagcactgagtgcaggggccagccctgcagacgtgggcagaagcagccagggaccccggggcctgcagagaaggctgggagcccttgaggacgtgtgtcacccctgggactctctgagcctctgtgtccccatcaggcctgtaacacaggctgaggggtctgcacagcaaggctgctgtggcccccgcttctaacaagtttagtgtcactttctggatctgaaaaagatgtcaggtaggagggagagacacgccactctggggggaggggagggtcccagagtgatttcggggcgccgagcactcactcaggaagaagtattcgtgctggtgattgtagggcaggtatttcagcttcttcttgccgtactgaggagagaggagagatcatgagcacccagtagcctcagctcccagcctcccatgttccccaacccatcctgcagccaccatcccttctatctgctcagggcacaccactgtccctttcctgtcaatctgcaccctgggcccaccaagcctggggcccctccagccctctgggctccccatgctacagccagcagcggccaacgcttcctcagccctagccgagcactggcccgatggcatcgatcctctacaaggccggcacttctgaggctgaggctcagcgttaagccatggcccaaggccacaggaagtggccctgactgggatcagaacccaaaaagctgactctgagcccatgtgacaggcactaaacaaatgtttgttgaatgaatgtgcaacagagcaactctcggcggagcataagcacccaggggagttcctaggtcaccatggagagctcccggagcccgcagtggcagggagaacctaggtaagggccccagaattgctgccagtcatcaggctgggagcatctgcctccctggagcctccctgtaatttacaagagtgaatcactcctccccagctggagcctaaccttgaggacagaggaggccacagcacagactcctcaggccacatctggctacctgaggtccccatgacggcaccggtttcttccccatcagagcctgcaccttgggcagcctgatgcccagaggctctaatggaggagggctgggctgggtcctgggcatcgtcattgtccaatgccaggcataggaaccacggccccaggggatccctggagcccttaattccatggtccagcccctagggaccagcccaccctgcacttccaggactgagaccaaaagatgccgctcactgagtgacacctgctcctctcccttgcagtgtggggaggctgggcttgcagccagcagatgcgcttgagccgactctgcctctcaccagtgctgagactatgtgagtcgcttagccttgctgagccttgtctggcatttgaatcagtggttggtaagaggagccaatgagaacatgggcataatgccaagtgctgaccccaggacactgcccgtcaccctccctatacccctggatccgaaggccagagatgcctcctcctatagtgtccagtcatacttattgcagtcaggaggtcaaagtgagttacagagggaagggaccttggatgatgcctaggccagtgcccctctcatccaggtgagtaaaatgattgtccaaatcacagggagagcatggattcctgagggaagaggctgtgggtgggaaccaggtccaccctgtccccaaggcttgcatcttggcgccaatggccatggtcacggcacaaccagctgaagaacccccagaaacagtccctttgttctgtgtggcctcctgagccttggcaaggatctcactcattcccagaaaggacggccacttgcaggaagactattattaaggccagggctgaggccggccatggagaggtccgagccagggaggcctcacaggagcctttcatgagtctccagtggacggagttgctggaggagccagcactgcagacgttgctctcgaggtggccagtctcggggcctgcagtggcccacagaacaggcccctgagtcctgctctaagcttctcccagaggccagggagcaggctcatagccccagccttggcatgcagtgtctccagctctgctcaagagctcctccccaccgcatctctgtcccacagagcatcccatccctctcgggctgggccggctgtactcggaagtgagcacagagggcaacccaggcaggtcagcaggggccagggcatcctatggagggactgagggctggccacgctgttgtgggggcctgggaggcacctggggagtctgtttggagctgcatgtgcacagtaggcaccctgttctcatgggtgatggtggcctgtgggtggacaacacaggttacaggggctgcctctgctggtaagcactgctggctttagtgtgcgtcccttcaatgccccagaatgaccctcgggagccagggggtcctgcttgccaggcagcagcaggcctcagagtgggcctctgtgggacggtgagcaaaatgctcatcacagtcacgcacgtgtatgtacatgcgtatggtgacataccactacacatctgtgcccatctcgatggcctcagctgcagcggctctgctgggggatggccaatactcccctcccaaaccagaaagtacaactgtgggtttgggatacgaagccctgccctgtggctaactctctgctctcatctttcccacgctcagttctttgccagagctttgccgtttaagtcatgggaccagggaagggagggagaggtattttagaatgtagcaagctaggggggtgagtgcctggctgtttaattgatcagaaagctggggctacccaacaaacatatttcacaagggcccccaggactccgaagctgtggtttgcagccagatggtttgggttcggacagtggtgttgccttttccttgctgttaccttgaacaagtcacttcatgtctcttggccttagctgttccatccatgaaatgggtcgatgacagctcccgcctcacgggttaagcaaggattaagtgacgttgtgcacgcacactgcccatcacagtgcccggtccacagactcactcaacaagagtcaggcttcttcccaactgggggctcagagccccaagtgtggggagtggaggaccccacacatctcctcctccagaggagtccccgtcacacacacagagaaagcccaagaggcaaggaagacacatgactttcacctggctgggctgcggccaagggtgtgggtggcacacatggacctccccctgatcagcaacagtgccttcccaggctgcggttgacaggcagagacgcaggccaggggcaagggagggagtgcagccagccctggcggcggggctgactctcctgtcctcggcctctccatgcacctcaaggccaggcttggatgagggcctgggggatgccgggccatgtggaggggacctttcagctttggaacaaaatgtctgaggaatgacaagggccctccttgtccatcgagggttgggggaggggagctgtcgcaaagcccagtctctgcctctgggaacctgcaaactcacacacagagagaaacaggcggcacgacctccccagcaggagcagaatggcaaggtcccagtccaaggtccccgagagggcggcatgtgtgtcccaaggcgggatgggtggcttaagcctgttcatgaaggtctgcctcaagcaggaagcccaggaggttagcttcagacagtcagagcagcagaggtggtttcccggatgggaggaggaggaggatctcaggcaccgcacggcttctgaggcccctttacactgctaccgggataatggtctcaccagccccctcagaaaacggggatatggcaaaagaagaacaaaacaaggctgctgccaatatcaccgctattaaactcagctctgaaatttcccgtcaatgcaataaaacccaaagcagaaaacagagtggagctattagaaagaaagagactacttcaacatccagattagaaagaaagaaggaaaggaaggaaggaaggaaggaaggaaggaaggaaggaaggaagggagggagggagggaagggagggagggagagaaagaaagagagagagaaagaaagaaagagaagaaagaaagagtgactacactttttttctgtttgttttgttttgttttgttgttgttgttgttgttgttgttttgagacggagtctcactctgtcgcccaggctggagtgcagtggtgctatctcagctcactgcaacctccgcctcccaggttcaagcgattctcttgcctcagcctccagagtagccgagactacaggcgtgtgccaccatgcccagctaattttttgtatttttagtagagacggtggtttcattgtgttagccaagatggtctcgatctcctgacctcgtgatccgccagcctcggcctcccaaagtgctgggattacagatgtgagccaccacgctgggccgagagactacgttttcattattttctaggatatgatcatctacccaggaaactcaaaagaatcaaccgaaacacaactagaattacgaagagacgtaagtggacactagcgggacaaaagataactatcccattcattggaaggccatgcaaacaaaaatttagaaaaaaaagaaaattaagataactaccccaatatccactgctttcccgagtactggagaacctccaatcataatgacaaaatataaaacatataaggattgcgttttaaaagaaacatccatgagacatataaagaagtacagaccttggccgggcacagtggctcatgcctgtaatcccagcactttgggaagctgaggtaggcggatcacttgaggtcaggagttcgagaccagcctggccaacatggtgaaaccccatctctactaaaaatacaagaattagccgggcatggtggcgggtgcctgtagtcccagctactcgggaggctgaggcagaacgatggcttgagcccaggaggttgaggctgcagtgaaccgagattgcgccactacgctctagccaaggtgacagagcatgaccttgtctcaaaaacaaaaacaaaaacaaaaagagagagaaagagaaggggaaaggcaccccactacgagcttccaatgagttaagtgccaaggatgaatgagtgtgagtgtggcccccaagtcatccagacggtggcctgggagaggacagacagcccagcccaggccaagcccgggctcaggagcactcactgcctcatatgaagaagcaatgccacctcatgggggtgccgggaaaactggccgactctggagaaaagtgaaggccgaacatcatcctacccatatcccatttggcagaagttaaagattgaaacacaaaaccttaaagaactgaaaataatatgtatgaagaactttctaagcacacaagaaatgaatctctgggtaaagtgaatatactttgctacatatgacaaaaagaatcctcctggacagcatcaataagaccaaaatgcagaaaacgaggaaaagggctttactgcggagcccgcgctattcacagttccacgtgctgggagccgcttggcagggctgctttgcttatctgtccccagagatagaagccctggccggcatccttgctctggagactgggatggtggcttgaggccctgggacctggccgccccacctggccctgctgtggtgtgtgggactggcatgtgacaagtcccatcagacccactgtcacttcagtcaagagaccagggttccttccagggcggccgggtcctgcgagagccagagcacaggtcaaaacaccaggaacccaggaagcaccaatcctttccccatgagtgtgagagcggggatttccacagaacaccgcggcactggctggggacttccaaacgccgctggtaactgaacaaccagatcctcacagcctcccacccctatctcctgccccaaagccagcgttccagaagtgtcgggggtgagaagatgtcgggaaaggagaggcttctctggccaccacgcacaagaaagacgccttcttgccagtgcagctggtgggactagactttctttgttggagacacagagaacatctgtcaggacagccaacggctctacattacaaagcctcgccgagaaaatgaagcctttgtccccacttatcagagggcctcaagttcatcagttctgttttctagacacctctaattaaagctggcaaactgtttcctagaagaataacaatagcctgtactttggcagaaaatggaatccctggcagcttagagaggcttccaaagtacagaactgtggctgatttcctgcgaattggccatgttacagaaaaatccacgttcctgctcagatagtctcacgggtggaaatgaaataagaagagggtgtacaaaccagaactggggagccaggctgtctcctcgccttgttccaagccttaggcgccaaggctgtcgggaatactacttcactcacggtgccactccttagtgagggaaaattggcctcacttggcagatgctgattgaaccctactctatgcatggctttgtggctcctaagatctgcataaaagcaacaaggatcttctaaactttcattttaatcattaatgtatttccaaaaagcagcgcatatatttatttttttcttctaaattaggtcccgacatagaggctctacataaaaaaaaagaatgtattaaataagaacatttttttgtggaacgcattggtggggcttttattcaaaagaaattatgggccaggcgcggtggcttacacccgtaatcccagcactttgggagggcgaggtgggcggatcacgaagtcaggagttcaagaccagcctggccaacatggtgaaaccccgtctctactaaaaatgagaaaattagccaggcgtggtggtgtgcacctgtaatcccatctactcgggaggctgaggcaggagaatcacttgaacctgggaggtggaggttgcagtgagccaagatcgtgccactgcactctagactgggcaagagagtaagactctgtctcaaaaaaaaaagaaaagaaaagaaaagaaagaaattatgaactactgacactcaatttgtctaccatataaaataatgtaggtcctgttatggttcagaagtacaacagaataccatatggctagagggagacgagacctgtctacatgaactgggggggaagggcatccacattcgcagaggtggcaagttgcaggatacaaggtagaatttttttgttttttatttttttatttttgagacagagtctccctcttctgtccccgctggagtgcagtggtgcaatcatagctcattgcagccttgaggctcccaggctcaagtgattcccccacctcagcctcccctgcacctgggaccacagacgcacaccactacacctggctaatcttttgtatttttcgcagagatggggtctcactatgtagcccaggctggtcttgaactcctgggctcaagcacttctcccacttcagcctcccaaagcgctgggattacaggtgtgagccaccacagctggcctaaaatttttgtttgtaaagaaacagatatatgcatgtttatacacatataaaaatatctagaagactgtatagcatcttgttaacagtggttaccctcaagggcataaaatttggggcaaaggggaggtttgagagactcactttttttttcttttttgagacatagctttgctctgttacccaggctggagtgcagtggtgtgatcatagctcactgtagcctcaacctcctgggctcagctcaagggatccacccacctcagcctccccaataactgagactaggcacgtgctaccatgcctggctaactaaaaaaatatgtatttttttagagacagggtcttgctatattgcccaggctgagactcgtgttttaattctggatatttctgtactgtttagaagtttataccaagtgtgttctatatttgtagtaataaaatgaactaatatgaaaataaaatggtatagtaaatggaaggcaatggcctagcagtccaaaggtctggggcctcaccctagactggccactaaattacgtgactctctcggctgggcacgttggctcatgcctgtaataccagcactttgggaagccgaggcaggcagatcatgaggtcaggagtttgagaccagcctggccatggtgaaaccctgtctctactaaaaatacaaaaattagttggcatggtggcacatgcctgtaatcccagctacgtgggaggcggaggcaggagaattgcttgaacccaggaggcggaggttgcagtgagccaagattgtgccactgcactccagctctgggcaacagagcaagactccgtctcagaaaaaaaactaaataaattatgtgaccctgaacgtgttccatcctctcgctgaccttcaatttcttatccactggtgaagcagattggaccaagccacgttgaggctcctcccagtgtacaggatgatgattctccaaataaggttttctcaacatgagctagtcggttggcgaccaagcttgagcccctgaaatcttgccttcctgctgaactggaacaagatttccctctaccctgggaaaaaacaagccagaaaatgcccttcctggcctaagggtaggagggagacatctaccattctaatgaggagctgtgtctgtatttacaggtgaggccattccacatacattccagccagaacaattcagggtacctaggagaggtatctgtgtagcaggagatgtggacctgcctggctgaatgtcagctctctaggcttccttccctgctccctgctcaggccaaacacttcctaggtcaacaccaaccccttagtcgtacctcgatggctgccattcgcccaggccaaacacttcctaggtcaacaccatctccttagttgtacctcgatggtctgccattcgcccaggacaaacacttcctaggtcaacaccatcctcttagtcgtacctcgatgggctgccattcgcccagaacaaacacgtgcagcatgttcacatcgggatccttgtggaagatgttaggcttggcgtggtgctggaagtggcgatgattccaccagttggcagaggcaccctgtggggagagaggggtggggatgagccatgcaagccaccagggaaccgagctcgcttgtaacaggcccttcttaggagcagttcccggaaccttcaaccctcggggatagcacttcaggcccccacaaggccagaatccagccctgccatgactgagctcagagcatgcgccagccccagatggagtgaagtcactttatctctctaggcttcagtttccctgatcataagacgatggtggcagatgaggcgtgctgctgagggaccacacggtgagcgctccagcaggtgtggcagccagtctctgcctctccgtcaccaggtgtggaaccagagctgtgcaaggtaaagccgaggtttcagggacagtgagaagtggtccctactatgtggcccagaaatctccctcctgagcgtatatccaagagaaatgaaaacatgtccacacaccaactcatagagcagtgttcacagcagcattcttcaaaagaaccagaagagcaaaagcaacacaaatgttcatcaacagatgagtgggtgaatgaaatgcagattatccacacagtggaatatcatttggctgtgccgtaaaacagaacgaatcactgacccttgctacaacacggatgagcctggagaacatgctaagggaaggaaggagccacaaaagaccacatatcacatgattccaccgacatgaaacgcccagaatagggaaatctatagagacagaaagctgagcagttgtgtagggctaggattggggtaggggagggagtgagggggttgggatgtgatggctaagaaacgtggggtttcttttgagcatcatgaagatgctctaaaatcgactatgatgatggttgcataaatctgtgaatataccaaaagtcattgatttgtctactttaaatgggaaaactggctgggcgtggtggctcacacctgtaattccagcactttgggagacagaagcgggtggatcacttgaggtcaggagtttgagaccagcctgggcaacatggtgaaaccccgcctctactaaaaatacaaaaattagccgggcgtggttgtgggcgcctgtaatcccagctactcgggaggctgaggcaggaaaatcacttgaacccgggaggcagagatcacaccactgcactccagcctgggagacagagcaagactctgtttaaaaaaaaaaaaaagtgagaactgtatctcaataaacgatttggagagcgcagttgtgctgctatgctgagggtgggtcctgagattcgtgtcacaccaggaaggctggagggagggctcaacaaacaactgctaacatgaacaagaagaactttcctgtttctaacactcaaataggatcccatgagacaagacacataacatggatatttcttttgaggccacaggtgtccgtctcctcagctcagagttatggccctcgacagttgcccagcgacagatgaaagaaaacacactttcctgaccctttggcatcacgactatcctggtgaactgttgccggatcaatgctttggctaagggtttgcaaaaaatgcctatttgctaaacaaacattttacttgggagatgcttttggcacacacagtctatggacactaatagccatgggtgggaacagcaacggacagctgtggcctttgcagtaacctcagggccctggaaactggcaggcctcaaaacccatgagagagagagagagagagaaaaaaaaaaaaaaagtcagagagtgaaagctcagaggcttcactttgggaggctgaagcgtgtggatcacttgaggtcaggcgttcaaggccagcctggccaacacggagaaaccccgtctctactaaaactacaaaaattatctgggcgtggtggcgggcacctgtaatcccaactactcaggagtctgaggcaggagaatcctgtgaacccaggaggccaagatcataccaacttcactttagcctgagcaacagagcaagagtctgtctcaaaaaaaaaaaaaaaaaagaaaagaaagaaagaaagcttagaggctcgaggaatcaaatgacacatttgcgtttgttgtcaaaaggaacaaaattcctgggaagaatcaaatggaaaaatctctggcacaaagaaactgaggagcaaggcatgaaacaagtaagcgtgatgtttggaggataccaacccagagatgtttattgaacaaacagatggaggaaagcaagacgggctgacaacaaggaggcagtgaggtgggcagtcccggttctccctggactcgggatgagatgtaatgaaagcattttttgttcatgctacttcctctgctgtgattctcttccattttttttttttttttttttgagacagagttttgctcttgtcgcccaggctggagtgcagtggtgcaatctcagctcactgcaacctccgcctcccaggttctcctacctcagccttccgagtagctgagattataggcgcccgccaccatgcccggctaatttttatattttcagtagagatggggtttcaccatgttggccaggctggtctcaaactcctgaacccaggtgatccgcccacctccgcctcccaaagtgctgggattacaggcataacccaccgcaccgggcctctcttccattcttctttgccaggtgaagccctgcttgtccttcaagagcccctccttccgggcaccgggaagcccgccttgcccaggaacaatggccagctccgtgttcccagaatgtggtgcagatgttgcctaccctaagccagctgccgtgctctgcctgggaggtgaaccaagagacaaagcccttgtcctcacggagctgcgagggagggtctggcctcatcacaccaaacccaaactgagctggggccaggaaagctaagtgtccacgcagctggagaagttggccaggcagagtgaggggtgctttcctgacagaggcaagagcctacgggaggccctgggagaggaagggggagtgtagagtgctccagaagccagaggaaagctcctcggtataactgtgaccagcagtgctgggtggcgccatatcagagcctgaggcaaaaaaaaaaaaaaaaaaaaaaaaaaaaaaagtgcacttctggctttaatggaaacaaactcatcgataacattttcaaagcctactttttgcctcatttcattttctttcttttttcttttttcttttttttttttgagacggagtcttcctctgtcgcccaggctggagggcagtgatgcagtctcggctcactgcaacctctacctcccgggttcaagtgattctcctgtctcagcctcccgagcagctgggactgcaggcgtgtgccaccacgcccggctaattttttgtatttttagtggagatggggtttcaccgtgttagccaggatggtctcgatcttctgaccttgtgatctgccctcctcaacctcccaaagtgctgggattacaggcgtgagccaccgcgcctggcctcatttcattttcaatggaaagaattgctgagtttgatggtttctgtcaaccaagcgattagcttaaataatttttatgtttattttttatttttgagatggagcctcactctgtcacccaggctggagggctgtggcacgatctcggctcactgcaacctccacctccctggttcaagtgattctcctgtcttagcctcccgagcaccctcgcctggctaatttttgtttttttagtagagacagggtttcaccatgttggccaggctggtcttgaactcctgaccttaagtgatctacctgcgtcaccctcccaaagtgctgggattacaggcatgagccaccacacccggccaagccacctcgcccggtcttaactaatttctaattacattcaactgaagcaaaagtataataagttctgttttggtataaataaagcatttacacttagaatgttatgacttttaatacatcaacttcttcattgttaaatatttttttaactactttaatcctctggaaaaaaaatcaaccattaaaaaatgacacacgaacatgtttagagggttgcatgtttttccatttccctcagttcatcctgatctttatttaaaattttgatattttgttcattgtggatttttttgcattaattttgatttttttaaaaacatattgcaggccgggcgtggtggctcatgcctgtaatctcagcactttgggaggccaaggcaggtggatcaccttaggtcaggagttcaagaccagcctggacaacatggagaaaccccatctctactaaaaatacaaaaaaattagctgggcatagtggcgcacacctgtaatcccagctactcgggaggctgaggcaggagaatcgcttgaacccgggagacggaggtttcagtgagttgagatcacgccattgcactccagcctgggcgacaagagtgaaactccatctcaaaaaacaaaacaaaaccacattgcattaaaacatcatttatcttgataactgaatttgtctggtgtccccttagaatttgtctggtgtccccttagattttataccctaagcgagtgccttacttgtttcaccctaatcccagccctggtggcctgagatgaggctgcagaaagtctggtgatgtccatttccagatgcagcgcccagatggcactgggcctttcagcttgcatttatttatttagagacagtgtctcactctgtcacccatgctggaatgtagtggcaccatcacagctcaccgcagccttcaaatcccaggctcaagccatcctccggcctcagcctccccagtagctgggactacaagcatgcaccaccatccccggctaattcttttatttttagtagagacagggtcttgctatgtggcccaggctggtctcaaactcttggcttcaagcaatcctcctgccttgacctcccaaagcgctgaggttataggcgtgagccactgtgcctggctgaagtttgcatttcatcctaagtacagtgctgaactacgaaagagttttaacctcagaatcgtctttgtaaaagatcacactttggaagaaatgtccactgggcatgacacgggctgaaggcaaacaggtcaggatgtgaagaactcccattaaatcccattagcagtgcagccaacaggaagaagggggtcccagcctctcacagcacctggtaacctactcacaggtctttccagcctgtgctaagacatctgagttggcgaggcccttgaggacctccctgtagccagtcccctttttcccagtgatgggaagagacacagacctacaagatttgtccccatggctgtgcacctgccgagtgctagagccaatttcaggcaagcttgacctccgtgctctggggcacccctgagtgagccacatgtccatgtccttggcctgtctctgtgacacagcaccaaggacacagccagtgggggctggtgggccatgagtggagcccacatccccaagcccaaggaccctgtttgctgtcatccacgttctacatggagaccagtcctctgtcctggccccgtctcccgcctgacgcaacagccgtgctctggggcccctcaaagactgagggcaattggacaggaacaatcccccctgcccggcccctgcccagaatctggaagcaggacacagcccatctttgttaagtgtgtgggggctaacatgggtcaggagttaaatgttactttgccatactgaggagggtttgatccaacagagaagagtataaaatgaaacaaagcactccactatgtgcaccctctccctttgcccctgagattctggacagagaccaggttctcaggccgcttcaggctcagggccaggcaagctgctcgctgcgaaactggtgaccagctcaggggtggttggccaccagtgagatctgcagccggcaagccaagggccccgttgcggtctgggtggaagaggggataagctacaccccacatgtagctcgtcccttgccagggtgtggagggatggattctttaggacccagcttttctcaggaagcaggtactgttgggtcaggctgggatggggatagtctatttcagagagcaagttggcaaagactcattttcaaaactgaggagataacgcctgtcagatcagaacaaggcagttggcaattccagcttgtctttctacaaacatgctgagactctgtggtctgcttccttatctagggggaggtgagagtggaacttccttaactcctgcacttctaatgacttttgtcctttgggccagctgatcattccgtagtttggtgtcccctatctgaggccttataggatgacttttactttttgtaccccgcttatttccaaagagtatttgaagtggcttgagataaaagactcatatataacggaaggctaaaataaagataaaagcataaatgccagatgaggaaggagagaatgggggcaccaaaaacacagactaaagatagttgctgtttcaaatgctgctttgtacctcttggcttctgaggggaagagaggagcacaatgtgtttctttttcttttttttttttgagagatgggggggggtctcactatgttgcccaggctggtctcgaactcctgggctcaagcaattctcctgcctcagcctcccaggtggctgggattacaggtgcatgccaccacacccagcacaacgtattaaagagctcacatccccagtgaaaggaagcataccaactcatcaaaaaagatgctacaggccggatgcggtggctcacacctgtaatcccagcactttgggaggccaaggcaggtagatcacaaggtcagaagtttgataccggcctgaccaacatagcaaaaccccatctctactaaaaatacaaaaattagtcaggcatggtggcgagtgcctgtaatcccagctactcgggaggctgaggcaggagaattgcttgaacccggaggtggaggttgcagtgacccaagatcacaccattgcttccagcttgggtgacaagagcaggactctgtctcaaaaaaaaaaaaaaatactgctactttactgtccccaaacaaaaacagatttgttagatgagtccttagctaaggaacatcaaaaaatacaatccgctgagccaaaagacaagaaaggtgtgtgcctgtcttcataatgagtagtacaccatggctttgtggttcggacctgatccagagacagggctcaggaagtcagcagaatggagagtcaccatggccctcagcataggcacacctgccttgtcaccctgtagcctcagagcactgagcagagaggaatcctggtccctctgtctcaactgctgtccaacaggacagatgcccagggctgctgacacttacctttaagtggccaatgacgaatttgtggacaaggtggttccacttgggttttctgtagacagacaggtggccataatcatgttgcagccatccagcttgggcctggggagagagggtcacacgtgctgtcacagcctcagcaaacaggcaccaggcctctgtcagctaggggaagtgagggtgtcacgcctcacctgagaggtagcaaggacaaaggccgtgatgagggtaggaatccagccattgccaaagtaaaagacagtgaaccatgcaatgctctccagggcgatgatgtgggccaggaggaggaggaagaacacgtggttggtcttgaacaggttcatgtcctcagccgtcttcctcagggcccggaagtcctcagtgatctttgactgttgaccaagagcacagggaaaggagtcagccaccagccactctggagggaacatatgtctcgagctgccatttcaacagccaatgcacaacccagagaagctgtggcaagagggggccaagccacaagcctcgaccctccaggagtccctacaatagctgctgttaccacatgccccacacagccctggggcctgtatatttgtcacagctaggtaagagtgacagagaaaggctttgactcaaaagcttgcattttatacaccctgtgttcatagctctattcacatcaggaaaaaggtagaaacaacacaaagatctcgtgatggatgaatggatcagcaacacgtggtctatccatgcaatggaatattactcagccttgaaaagggaggaaattctgacacatgctacaatgtgagtgaactttgaagacatcatgctaagggaaacaggccagtcaccaaaggacaaatattgtatgattccatatacaggaggtccttggagaggccaaattcagagacagaaagtagaatggtgcctgccaggggctgagaggtgggagaatgaggagtgagtgcttaatggatgtggaatttcaatttggggaagatgagaactggatggtggtgatggttacataacaatgtaaatgtgcttatttgatgccactgaactgtacacgtcaaatgaccaaaatggttgaccacacttttttaaaaaagaaaactttaatcccagcactttgggtggccgaggcaggcagatcacctgaggtcaggagttcgagaccagcctggccaacatagtgaaactccatctctactaaaaatacaaaaattagccaggcatgatgatgggcacctgtaatcccagctacatgggaggctgaggcaggagaactgcttgaacctggaggcggaggttgcagtgagccgagatggtgtcactgcactccagcctgggtaacaagagcaaaactccatctcaaaaaaaaaaagaaagaaagaaaagaaaagaaaaataaaacttgcattttccaccaccaaacagagcaccacttgctctgcgcacactgttgggtcttgaggggttgagttgggggcgacacaaactagcgcaggagggcgagctgaggcaggcaggagggggctgtgagtcccgggcacatggagccagggaggcaaagcggagtcaaggagggccctgggaacacaatggcattgcgaggaagaaggaacttgggacaagaggcaggggcagggccggacggggaggagagtggatacaaggagaggagcggtacccacagggcatgaccaaggtgctatgaagggtggttctggtggtgcctggtgggagcttggatgctaaatggtgcaggatctgcagcagaaagggagagcagtggagagagccaaggagcaaggccatggacaagggagctacagggcaggacgagcagagctggggaagccgcaggccaggaggtgctggaggtgagagtgggagatggacccacttgcgaaggaggcaggaggggacaagcatgggctggcatgggtacagggcaggtgatctcatgtgccatggagggcaaggtgagaggaggggcattggcctttgaaggacctgcagggtggcccgcagctcatcaggaaagccagaggcaatgggggtggtgggggactggccaagagtccaggccgggagagaccctggtcctgccctggctctgctaaacagaggggtctggcccaggctggcaacaagaggaggaagagcttgctgaggccagggtgggacttccatgaccaccctggtcacagcctgtgggtaccactcctctccttgtaacaactctcctccccgtcctgccctgcccctgcctcctgtcccaactttcttctataaacggctccgccatttacatggagacttcattgttgaacaaaacaacagcccatgagacctcaggggttgctattttcacacatggctgtcctggaagcccagcacccaggggggcgtctgacctgcagacaatgaacagatgaccagggaatggtcattctttctcaaagaggtgccccggaccacacaccccaaagccactcttgtcatcaaatgacatttttcggtgtttctgtcctgtctttcccctagattgtcatctggcaccttcctggaaagggatggaggagaaggaaaatgaaactggccaggagagaggagacgccactagttgttgtcaaaccccggctcccagggaggctctgaggccctccctgaacacaggtgaaccacagtggctcctccaggacaaaagcacccctgcctcagccccagttactggtcatggggcaaggggagcctctctcagactcccagccacccccagcctcgtctccacccccacccaggttgcaagccagacttacgttcttgccgtggtcctggctgggctcctccggggccagttcaccaatcagcaggggtttcaagaacttgcccacgaattccaggtcagggtggaaggcgcggaaggcatcctggagagcagagggcagtgatgaggctaagacctgaactctgtctgctcttgggccccaaggaggacagtgctcaccagcaacagctccatgtgtgcacccagacaccaaacggggtctcctgtgatctggccccaaatgccgtctccagcatttttccaggacagagccctcagtgcccaacgccaatggcaacagccacctgggcttctgtgctggtgcaggcatgctacactccccaggggtttgtgaatagatgcataggctgcctttgggcaggtcgggaaatggtgaccctccaggaaggcgcaccaggcagacacggggctcagggaggacttgagcctcgactgctcgtgagctgagtgccttgcatggtgcacaaaccacaccacccaccatctcttactagttcctcacctacatgtccagggtggtcaatgaaaaggacaagaccgaatactaccttggcactggaaatgtgctgtgatgaagtaaataaaaaaataaacacagaattatgtaaaaagcgttcctgaaaaaaagcctaggaggatctaggctattattgcacatgttaaggtagctggattatgccttgctttattttcattactttccaaactctaacactgctataatgatacacattttaatctttttttcccaattataaagtaaaaacgtgctgagttttggccaagttagaaaaggcacagcagaataaagaggaaaataaatatcacccagaaagtggtcattattgctaatattttagcatttttccttccagcttttttctatacatattatgcatattacatgaattatctcataaaaaatctagtatttctattagagatgagccagcaccaggctcccctgaggggatgcaatagaatgtcccagtggtgaacactgtgtaatctgcatcaaatcaagcttccagacattggtaggattggcaaaccagtcaaactccaccatgagaaacaatcagaaaaatcaatatagctggggaaaaacatacaagtttgtggaaaaaacaaaagtacggaagcatggtctagattaaaagagactaaaatgatataaaaactgcaactcttgactggtcgcaggggctcatgcctgtaatcccagcactttgggaggcagaggcaggaggatcacttgaggccaggagttcaagaccagcctgagtaacatagcaagacccctgtctctactaagaataaacaaaattagccaggcatggtggcctgcaccaataactccagttactcgggaggctgaggcaggaagatacaataagcaatgatggtgccactgcactccagcctgggcaagagagtgagaccctgtctcaaaaaacaaacaggccgggcacagtggctcatgcctgtaatcccagcactttgggaagccgaggcagggcgatcacctgaagttaggagtttgagatcggcctgggcaacatggtgaaatcccacctctactgaaaatacaaaaattagccaggtgtagcggcgcacgcctgtaatcccagctgctcaggaggctgaggcatgagaatcctttgaaaccaggaggtggaggttgcagtgagccaagattgcaccactgcactccagcctgggcgacagagtgagactttgactcaaaaaacaaacaaacaaacaaacaaaacaacatcctgcaattctttaatgtgacaggctctcacttgaaggaaaaaagaagttataccaggtttttcgggagttgaatgagaaaaaatgaatatggaccagatatttgatcatatcaaggaattactattaattttcttaaatgtgacaaaggtactgtgatgatgttagagcatctcttccttttttctccggaaatgttgaagaccttagggatgtgatcacacaatgacgcagcttattttcaaaaggcaactgcacacatataaagaggaaaaacgcaaatgtggcaaaatgttaagactagtgaatcttggttgaggatacacaggtgtttgcttgttccttcaacatttaaggatgttgggaaaatttcaaaattaaaaagaagagggggccgggtgcggtaatcccagcactttgggaggccgaggcggcggattgcctgaggccagaagtttgagatcagactggccaacatggtgaaaccccgtctctactaaaaatacaaaaaaaaaaaaaaaaattagccaggtgtggtggcacacgcccgtaatcccagctacttgggaggttgaggcagggaattgctttagccagggaggtggaaggttgcagtgagctgagatcgtgccactgcattccagcctggcgacagagcgagactccatctcaaaaaaaaaaaaaaagggtcgggggaaggtggagaaagtgctaaccactcctggaaatcttttcagccccacacgtaaggatctcccaagggtaactgccagtctcccatcatctccttactgcattgctggcatcaagtcctttgcttggtctttgttctatttgtgtctagaacagactgacaaagcaacacttcgtgcaggagaaaactgggcccacggtttcttaaaaaatgcctgtgacccactagccgagccgaaaagggatggtagcagaggatcaggtcaagagtattttcagggaaaagagacgtgctattccagggccctggggaggcagggagaagtccctggggaggcagggagaagtccctggggaggcagggaggaggccctgggggcaggcagggaggagggctggggtgggggggcaggcagggaggaggcccagggtgcgggcagggaggagcccagggttgcagtggtgaccagctttgctggctctgggtggggtgatcagtccccaccagagcctcagccgcctatgcaaaatgagcaaggccctgggagaggcccggaggagctgccaaagtcagggcccagggctgggcctgaaaaagccccttcattggtcctcctcacatcacaccacggcctttgagaaatgaacaggaagtccctggtaaggcagtttcctgagaagcagctgcagtggctgataactaatggattcctcttgtctcattgaaaggcaagactcaatggcttgcaaatagactcatctccactcctgctgcctccccaacacccgaaccctgcagtcgaggttccaactccaagggagcagacagatgacgagccctgccttgaccttggttgctgctcagccatttccagagggctctcgggcagcctcacctccctgagcccaggggtaatgggcatgcgccaggcagggagccaggagtgttgctcatgttactcccttaggcctcaagccccaacttctgaggtgaagatgcaggagctcaggaagcaaagtcctgggctccaggtggcagagccaggatcaaatccaggtccatctgcctctaaggactcttttctcacgtgccacacgcttcctgccgttttagaaaaccgagcagtctgttggatcagctccttgcccatggtcagtgtggcagctttccgagcaggcctggtgcggaccgcccttgaacataccacgctcctttccacaccagggctgcctccattcgggactcagcctcaacatcacctccaagaggcttttcccaacatcacatccaaaagagctctcccagccctgggccttccctgggtcattgccctgttagatcttcatagcagtcatcaaggttcgtcatcagactgcgtgacgtacccacttgtttatggcctgcgtcccccgctggagcataaaccccagttgggaaggcctgcacctgtcttgttcgctgcaataaacacagtgcctgtaacggggcctaataagatggctcacgagggaataaatggacccaggaccccacagctgcacacactctgatctcatactttcccactgtgcagtcatgaccagacacttgtcctcttccgcgtttcacacaacttggcttctgcctctggaacaccaaaagccttctccggcatccccacgctggtggttgctacagctgccacctgctgaggtgacgcaggcgagccacggggccatgggagtggcttgcatacatcagccaggcatctttaccaaacttcgtgaggcaggtccttttttagagataagaaatcaggcgtaggttggcagagccacctgcccactatcacactcgggaatgagctgagtagagtttgagtcacatgtggctaccttgagcattgcccgctgttcatacaaaggcttccctcaacatgagtgtcctcctccctgagagttgattatattttgtgtctctcccttcacattgccataaatgtgtctcaaacgctggcagaaggtttccagcacctgccgggttacagaaatatctggcaggtataaggcagaccaggattcaaggcaagggagggccaacccaaactttgtctttggaccaagaattggaaccaggctctatcctagtgtaacgggagagaagccagagactttccaggaagaggacccgggacatggggaagagaaaggattggtaaacaggtggagaaagcagagatgcacccgcctcggcagggcaggtgtgtgaggtggggaggtcagaacaccctgattctgaagcgcttgtcacacttcgctctttgccagttcctgcttctgccatcacccaggtctgatgccagtcaacttctccacagggacattttccctgcccctgccccactctgggtacaactcacagttgctcgccatccactgagcacctggtgccaggatttgtttatggccgtgcccatgtcctctggggagcaaggctaatctctgatcgaatgctgcacaactgggcactttgcctaggatttgggaagtgcagcacgggcaagcacagggcacacagtgcagtaggtggcagccctgcggaccagaactttatggaacaagtgatctaagagtgtggagatgcacaggagggatcctcgcattctccagtggaaatgaagagcaagacagggatgctgacttcctttctgcagcagagagaggcaggcagggcaggaagcccctatgccatgtcccctccaaggaaagaagcaatggaggctggtggggcagtgctctgtggccaaagagccccgcagtgagagcctcccccataacacagggtccatgcactaccctgagggcagaaaggcagggctgcacaggagacaggcccctacaaaggcaacctgggcatgaagaaattgatgccattctccactttcatctcagaactgcttcctggggatgctgaggctacagccacagaaattggacagctcccacccagatctcagctggggagatggagctgccctccaggcctgggaattcataaagctggggctggaacccaggtctcctgcctctaaatactacaaccctcctgccccgtgcaaaggaggccagagttccactttcgatctgttgcgttttcacaagaataacataggagcaggttgaaaggtggaacaaacctctggtctcttctcaccttcccttgattctaagaggtcaccaatgcagaccgggcaggaacagttgctgagacaagggctaggggtagggggctgatgtctagaggcagagggtccagatccaagccccagcttgagagagagcagggggagcacatcccacagcttcaggtctctgtctgtgaataattcatctctgtgtctgggcccagctcagagccatggagacactcaattaatgtttgatgaattgtcgctgaagatgaacagttctgcagtggtgggactgctgtgaaaagagcagacacgctcttagggcgcgggtgagggttccttttgcccacagcaaggaaaaggcgagagaagcaccgcagtaccaaagggaagagatcagaggtagcaacaggaagggaaggaagctgggaggggaggacttgaggtcagattctgagtttaagtctgagcactgccacttaagccaggtttgatacctcagagcagtgagagatgcctacggggctgatccgagtatgaaatgaagtgatacatatgaatgtgttttgtaagttgcaaaaatcaagcaacttgcattattataggcaaggtcagggtttagcttctgtggaaggaccacgtaacagttgccccatccttctagggagatggatcttgactacctggatcttttgctcttcaaaaaaaagaaaatgccctattgaggcccctgattgtcccgagaatggcttccctgacttcgaggattgtcccaagaatggctaccttgacttccgacctgtttccagccttgtgttaggaatgactgcactgtgatgggctcagaacattgcctgggaatgttgcagggaatccaaactgtcttctgatcagtccctccccagactgtgcctggtccataaattgtcactccccatgctctgggggacaaaccatcaccccaaggggcaaagccacttgctcaacagcctaggcaagggtctctggatttcagtagcctgttcctgcttctctctttaggtcccctttccacatgccccacccaccccacgctgctcaaggcctttttccaacctggtcctggacagtttaaaaaaacaaaacaaaacaaagagaacccagctgctcactccatcatcaccatcattcaaatctgtatccccagttcgtgtatttcatgccccaaaagtcttattttagaagacaggaagctctggggacagggattgcttttacgtgttgctacaccaaataaagctagcatagatttaaattttttcttcaaattcctctttgcatactttccattctagctgtttcataatacttgttcttattcccgtttgcctgataacaccccattgcattcatctagtggttacagttgctgggtgctttgccacaaatcagtctcattgaaacaggtacaggtgtaccttatagatgaggagatggggctcagtcaagtgacaacacttagtggatgagcccagtaatgacatctttcttcaattctagatctgtttgcagccccggttggctcccaccctagcttatgaaagtaacaaagcaaccaacatccaagataccagatttatagtccatgaaagttatacagaaagcgctggagcaggaccagaaatgacgagactattacatttttatgagacagagaaaaggtcagggaagagtaggtcattctagtcctctgttaggagagatgtgagcactgatttttggagggaactcagtgttaaggtcaggtaagcactgagaacatccagaacaaggaagaaataaatcaatctgatatggtaattaaaccagaaaggtcaaggcaattgccagactaagcgttcacataagaaaatatgtttaacaatgtggaataatcagaccaaattcatcgtatttgacttttccttctggaaactttttggtgagggcctggacaggacaggaaccttctacaatttacctatgaaatcagaaacagaccagcccaagtccagcaacatatagtggaaagatcccagccaggatccagaaggtcctttacttaggagttacattaacccaacctcctcactgggccgcgtaaaggtccaggtgagatagcactgaaggtatgtgaaacatacccacctaagttctaaatagcatcacaaacccactgggcttaagcaatgtccacaagcaagtaaaacaggatgggactgaaagctgtagggaatttcagtatcgctgaccttcccaatcttagataagccctggccctgctggcccacaccacctgtccattgtccagcttgggttatggtggcctggtctggccttcccctaggcctgtctccatgagatgcaagaggtggggaagttaagggtcgggcctacacagcttagagagcaaaagcccaccaacagttgggcatcctagacctccaggtggaatgatctacgtcaagttcatccctcctttctgcctctctcctattcactttccccaatttctgtatcccatcagaccttttttctctgcatccaattcactaccaccaccaaaagccgccctttcttccctccttgcctctgttcttttccttctggcccattcgaatccatgggataccagctgcatccttaaataaatgccaggatttcagactggggtccccggtgcgggtagctggtgcggggtaatcactgagccacgcatttggtgggggtaaggtgggcagcaatggctccagagaggcccacaacctttaggagtgcaagatgagggaagggtgttcttggcaggatttaaaaagagagagccattgagttgaacgcccgagagtaacctcgagtgcagacggacctgttgccaagccagtctagtgctgctaaatccaccggctcaaggcctcactcgacctgggctttgcaaaccccaggccgttctccttccaccaatcccggacgccggtccccaagaaggccggctcgagcttggggtgagtctagataatccctggagcgtgggaacccgagctgctgggcggtttttcccaggtggccattgaggaacttcttagacaagagtcccagcaggagcgatctccggccggggacgagctttccttctcgccacccagtctggatggagagtgcgggacaagcgcggagtcccacacctggctgcctgcgctcccgctcctttcagcggcgcgcaggggcggccatcttccccgctgggggcgccaaagccgtctggcccgagcgcccctcttggggagtccctgcctccagacaaaccccgaggaaggggaggacgcgtgggtcccggcgcgcgcggtagatgcttgccctgttctccaccgctgggactttcaccgcagcgccgcctccccgggtcccagatccggtctccaccccagtcggcccagaggaggaggaggattggggagggggtacgagtgcaatagatgcactttccttccctacaggacgtcccaagctccattcagcgccggaggtctgtttggcccacggggagccagggatcctgactccgcctgcagcagagaagggtggctggggcgcccccagacccttaccgttgcatcttctccagcgtagtgcccgatgacccgctggccccccgggtgctggatggaccatttggtgatgttgtaaaccttgcggtcaatgaccagccacctgtcggtgcgcaggttatgcttctgaatctcctcccagctgaaggtgggcaccgacacctcgcgctcggcggccccctcgccctggttccctcccttccccatgctgcctgccgactgtgacgccccgtgcactgcggcctccccgcgccggctgctcgctgcacagacggctgcctcccagccggtgtgtgcagcccgggccctcttcgctttcggcttttgtcttctcctactcctcccaccgcgccccctcccccagccttctcgcctgcgctcgggagtgtccctgccttcctggcggaggatccctggcttcccagtgcccccaagcggtccccttcctccgcccctccctcagccctcccgctatggacttttgcctccagtaaaaactccccgggagctcagggcctcgacacctcctctgcccgcccctccggctccccccgcctcgggttccacatcctcccgcgttccccgccgcccgagtttccacagcgatcagcagagcgcctgcaccaatccggtcgcgtcgccccgcctgccattggcccaggaggatctttcgaaggccagcgggctggagcggcgggtccccggctcccccgccctcccgcgtggagtcgagccctgctgcgaggcaggctacgtgtccgacctcctccctcccccactctccggccccgggcgccggaggagatcctagaggagatcccggtgggggcaacgaatgggctccgcgcgctccggggcgcgtgcgcgcacgcccggcgctctgggggtttgcacctgatgccgacacaaagccggcgcggccaccagggtgccagcaagcggccgggcgggtggaccggcgggctgcggggcactcaactccagggccggcttggctaggtgacgcccttccttggcgcgcggcagtcgagactccagtatcccacattgtccgcgccatccacattctggcgcctttctgcaacctccctagagacacaagccggccttggattagagggctttgaaccctctagtcagacaatcttagaaaagaattgcggaacctctgctctgctttcttggtctgggcgccatggctgcggtgagggggaagggaggggaaggcagaggaagggggcgatgaggaactggcgcggtccttgccctggtctcagtaagctcagtctctttgggaatcgtggaagcagacacatcattgggcagtgatgttgtgcagactccagcaaataaagactgccgtatcgaagggataggaggagggttaggtcttttaggcgtggggcaagagacaggcccctcagaccccagctggatggggcggcttagtgccgggcgtcctgggggaaatgggcctgactgcatccggagggctaacgggacacgtgggaagtaaggatgaacagagagggtggggtgcacgaggcttgggaatcactagaggagttatagggccctcagatttcaatgggatttacaggtgcctgtgtgctagcacaccctaatcattagattctcatcacaggctgagaggtaaacaggacgcatattattacatctcacttgaaaatggagagcctgagattgagagagatggtcaaacgggccctgcccaatctaaatttcacagcaatgcaggggtggtggggggatcactctgcccaactggtggggttgtacttgggggggcagatgggctccctttcctcacattcacacagtccccaacctctcccatcacatttcatgctggtgtcagccctgagcatccttcattcactccacagactgcagacataaagacagtaaggcctctctgtctttgagtgtgagcagacatcccaaacaaaagccttctgtacaaaataagaggatgaagcaagacctccagagagtatggtggccttgaggactgtcaaacgttgacggaaatggaaccaagaaaattattttctcagaaatggattaacataccatatagataactttaatgaacatttgtaaagggtgtggagctcggagcagggagtgatagctgaaaggcagaaccagggagtatctcacagaggctttgaaggttcaggccctaaaagggagcacgtatgggtggcctgtgtagggtggctgagaagcgtggaccggccagggcctggggtccccagcggctcccagcacagtaccagccagggtaggtcctgaaaaaacataaaaacatgtgttgaagacacaaatgaatgaatgaagttcaaagaatggctccaatgaggccggcggtagatggggctcaaattgagaaaagccccagcagcctcagtaaggggtaggaagggaggactttaccatggaggaggcttggacatccgtaaagcaggtgtactgtgatcagatccatggtgtagaaagataactccagaggctggggctggactgggatgtacgggagaaactggggaacagtgatgagttcaaagatgagggcagtgctcgaggagaggggaggggaggcctgaattaagagagaactttagggggctgaccccacactggacactgccatgtgcctccctgccctctaatttttttttgagatgcagtctcactctgttgcccaggctagagtgcagtggtgcgatctctactcactgcaagctccacctcccaggttcacgccattctcctgcctcagcctcccgagtagctgggactacaggcgcctgccaccacacccggctaatttttttgtatttttagtagagacggggtttcaccgtgttagccaggatggtctcgatctcctgacctcgtgatccacctgcctcggcctcccaaagggctttttctttcttttttttttttttttgagacagggtctcactctgtcgcccaggctggagtgcagtggtgcgatctcagctcactgcaacctccacctcatgggttcaaatggttctactgcctcagcctcctgagtagctgggattacaagcacccgccaccatgcccggctaatttttatatttttagtagagacagggtttcaccatgttggccaggctggtctcaaactcctgacctcaggtgatctgcccacctcagcctcccagagtgctgggattacaggcgtgagccaccctgcccagcctagaatatcctttggaggtagaatcaagaccgcattagttggaggtacaggggcaggggtgatggtagagatgaaggaataagagaaataagtctgattctagcatttgagttgagcaaatgaatagataatgggaccatttaccaagatgagggaacagagttagtacaggggtgaaaaattaaaaattctattttaacgttatgtttgaaacacctaggctgggagcagtggcttatgcctataatcccagcactttaggaggccgtggtgggtggcaccatgcccagataatttttgtatttttagtagagatggggtttcaccatgttggccatgatggtctcgatcttctgacctcgtgatctgcccacctcagcctcccaaagtgctgggattacaggcgtgagccactgcacccggccaacacctgattctctcttactgcagaagggtctcctccatgtgacaaaaaaatatggctgtatttgctaagctacgctagcagaaataattctcccccattccctgctcccaaggattaattccagtttaatgggctctgcatcagatgctaaccattgggccactgttatcagacggctgagttactctattaggtgtaggtcataagccaagcagcagacctgggctttggggaacagggtctgttcctttttgtgggaagtcacaaaccaaaagcaattacagaccgctacagtattcctttcccatacctaccatgtgatgttagacctctgtctctgaccttcagtttcctcatgataaaaaggagacagtgatttttctttctttctttctttctttctttcctttctttctttctctctctctctctctctctctctctctctccctccctccctccctccctccctccctctctctctctctctctctctctctctctctctctctctttttttttcccccaagatggagtctcactctatcccccaggctggagtgcagtggtgcaatcttggctcactgcaacctctgcctcccgggttcaagcgattctcctgcctcagcctcccgagtagctgggattacatggcatgtgccaccacacccagctaattttgtatttttagtagagacagggtttctccatgttggtgaggttggtctcgaactcccgacctcaggtgatctgcccacctcggcctcccaaagtgctgggattacaggcataagccaccgcacccagcggagatagtgatttctaacctatctcatctattttaataacgaggctcaaaggacacaaggtatgtgaaagtgccatacatgtattttcttaactagcaatattggtgaggtcaaactttaaccaagctcactagataatgatttattaatatgtggtgaaagtcataactatttttaaaaaatgaataattttcaacaacaaaaatggcatcaacttagtaagtgcatcaaatttagatgccttaaatgacaggctggggaccctatctaagaaactgggttaggccaggcgtggtggctcacacctgtaatcccaacactttgggaggccaaggtgggaggatcacttgagcccaggagtttgagaccagcctgggcaacacagtgagaccctgtctgtacaaaaatataaaaaattagttggatgtggtggtgcatgcctatagtcccagctactcgggaggctgaggtgggaggaatgcttgaaccgcagaggtggagacttcagtgatccatgatcgtgccactgcactccagctggagtgcaagacagagcaagaccctgtctcaaaactcaaataaaataagctgggttattatctctaggtggacattgataaaaggtatggtatgttaggtaaaactttaaagcacagattgctagtgctggaaagcatctggacaatctcttcactttacagataagggatccgaaacccatagaggtggacataatgtccaagattacacagcagtaggtggactagcaggtccaggttgcaggtgtctcaactacaatccttattctttccattctaccacattgcctcccttccttggtacattctactgaaacttgatggatccttctccaactctgaagtgcacagagaatagaatttgagatcttcacatcccagagtctagtgcttcgttgctgcatctttagtgctcatagtattggtggagaggtacttggtcaaggagctgtaggacaccattcctttcctgttctggtgataagaagtgcagtaaaactaaggaatgcatactaagtgctcgaggaatacctgtgaaataattcagcagtaaattggtaatttggcaacaaatgacaagagactaaaaatgttattacctgatccactaattacacatgtagaatttatcctaagaaaatgttcagaaatagaaaccaatatctatatacaaaaatatccatcgcaacatttatacaagcgaaacttctacacaaatgtccaacaatagggaaaaagttaagtatattgggagtatatatatgtgtgtttatagatatatgatgacttactatagtgaagtaaatattctcattataaaattttaagcttagcttttttgttttattttaaagagagatcatttgtactggaaagttacattaaaggcccagcaaaatgcttacaacaacgcctagaggactccagacccattccccgggcaatctgaagatctgggacctacctacccaggcctcccttctcccacttaatagaggcaggtctgagggcctgggaggaagaaggcaccgcagagaagcaaggacaacagccttctcctctttgaaccagggtggccttataccaaaacatttattgaactcactgctaaggaactcatgtagagaggaactaaaagttataaataagttctggggtaaattctagccccaaatatactaaatttcatgtgtggcttcagctctttggatctgtcaccttgtctataaaacagtgggtttaatatatctgtccctaaggcatctatattctatacaatgataagaagactgggccgggcgcggtggctcacgcctgtaatcccagcactttgggagtctgaggcgggtggatcaccaagtcaggagatggagaccatcctggctaacatggtgaaactttgtctctactgaaaatacaaaaaattagccaggcgtggtggcagacgcctgtagtcccagctactcaggaggctgaggcaggagaatggcgtgagccctggaggcggaggttgcagtgagccaagacagcaccactgcactccagcctgggtgacagagcgagactctgtctcaaaaaaaaaaaaaagactgcattaaggaaatcccgtgaattcctccatgagcctgcctctgccccatcccaatctcccacactcttagaatgcagcaaaatgagagtcctgtttctagctctcgctctgcctctaatagaggtatgattgggattctccctttagtttaagcactatatgtcataaattatttttaatattacttaacattaatctgcagaattattacagatgacttttcttaaaacaaagactgattctgtcaactttattagtgcctactgtgttgtagtcactgcacccccataagttatccaatttcacagaaatccagatttttcaaaaatggttttggtctttaatggcctgaagggctgctactgaggggaggctgcagcagaggctgagcacaaccggtattgcttctcctatatgtgttgactttgtaaaggatccaggctattggccaactattatgtttaggatcttttgttaaaatggatcaaaatttgaactcacaattcaggttattccaacagccactggcagttaggttattcaattatggcttcattacaatcggcattaaggtctttttttttcttttctttagagagaaaatggtgggacagttaggaaggggtctcactatgttgtctaggctggtctccaactcctgagctcaagtaatcctcccacctcagcctcccaaagcactgggattataggcacgagtcactgtgcctggcctggcattagggtcttaagctcatttcgttctgttccttgaggattaatttggccagaacagttagtattcacaagtggcaacctaaaattaagtatgtgattcatatccaggatgaggcaagttcccttaggatcaacagggcctgcaaggcaaaggtttcctttagttgacctggatatgggtttattgcagtctgtgtgaccacctgtgtaggtgggtaaggagatgagagggcaacacgacatttgcctagtggcctataggcttactcacctgtattttttcaggttgaaatcatcagttgattcagcaaattttttatttatttatttatttagagacagagtctggctctgtcacccaggctggagtgcagtggtgcaatctcggctcactgcaacctttgcctcctgggttcaagcgattctcctgcctcacccccacaaagtagctgggattacaggcaccccccaccacacccggctaatttttgtattttagtagagacagggtttcaccgtgttggccaagtgggtctggagctcctgacctcaggtgatccgccctcctcaccctcccaaagtgcagggattacaggcatgagctgccacgcccggccaattcagcaaatttatgtgggattccacctagaactccaaaccaaggtgctctgaatatgtattggtagtataaacagaatccacagccctatcctggattataagctcgttagggaggtagcaaaatacatgacactgacctaagaacacatgaaaagcaaagaaacatgaatgcaaagtcatgtcatataagctgtttaaatcctgagtaagatgaatttaatttgcatctatcctactgacctataatccgtgactcacttgtctctctcctccagtagacatgactaggcatgacccatatagtactgaactttgtattcccagcaccttaccaaagtaggtgctgggaatacaaagaggagacaccccacaaatgttaaataaaacacttaatgaatggttctaggtaggtggggttgatcaaggaattatcttacaagtggtatgggttttttggttttttctgaggtgcagtctcaccatgttgcccaggtgattctcctgactcagcctcccaagtagctgggattacaggcactaatttttgtattttagtagagacagagtttcaccatgttggccaggtgggtctcgagctcctggcctcaggtggtccacctgcctctgcctcccaaagtgctgggattacaggtgtgagccaccgcgcccaacctagtctttttatagaacagttatctctgtagccaaacttacatcatattatttaattttccttgattcgggggaggggggagggatagcattaggagatatacctaatgctaaatgacgagttaatgggtgcagcacaccaacatggcacatgtatacatatgtaacaaacctccatgttgtgcatatgtaccttaaaacttaaagtataataaaataaaagatttacataaaacatttttccttgattctgtattaaaggaaagatgacattattttcaatgtctgcaaaatatttcactgatgggcatttagagtgtttccatttcccgctatcatagatactgctttaatgaatattttttgtttataaatagttttctttttttgtgtgtggatatagaatcttgctttgttgcccaggctggagtgcagtggcacaatctcggctcactgcaacctctgcctcccggattcaagcaattctcctgcctcagcctcccgagtagctgggactacaggcgcacgccgccacgcccagccgatttcttttgttcaggctggtcttgaactcctgagctcaggcaatccgcctgcctcgacctcccaaagtgctaggattataggcgtgaggcaccccgcctgacctataaatatttttctaagaacatttccttaggctatattcctaaacatggaattattgggaacatttttatttttctattttttttcatctcttcagtattcaaaacattcctaaattctggccgggtgcggtggctcacgcctgtaatcccagcactttgggaggccgaggcgggcagatcacgaggtcaggagatcaaagccatcctggctaacatggtgaaaccccaactctactaaaaatacaaaaacaaaattagctgggcgtggtggcgggcacctgtagtcccagctacttgggaggctaaggcaggagaatgccatgaacctgggaggtggagcttgcagcaagctgagatcaggccactgcactccagcctgggcgacagagcgagactccatctcaaaaaaaaaaaaaatcttaaatttctatataagttgtcaaactattttttccagtttaatcaacttacacttctaccagcagtatgagagcttttatcccactgcacagtcacataggaaaaatggtttatgtaaaggacctctcttctgttatttaatacccatgaatttcttatatagttgtaatcagcgaacccatactactttgggttctgcttatttcacggggaaggattctatatctatcaatatagttcacattctagccatttaaaatcattctttaattcttcattgtgttaacagatcccaataagcttggcgattttcttattgtcaggactcgggtttatttccagtttttgctattaaattggctatttctgcatctttgcacagtctcccctactttaccaagagtgaaactgcttgatcaaagaatagaaaatgttttgtagctcgcattagacactgccaagttgttgggcaaggtttttaaaaaaggaatattggctgtacagaggtgcagctgtgtggaccatcattcctgagcagggtccaatagcctggcatcttacctggaagtcaggacatctaaacttccctatgggaacttggtaagccccttccccatttcgaacctcaattttcttatctataaaatgaagaatttggatggaatgaattaatccttttctaccagaaatctagccatatttcacctagtctattctgtatcaccctctcctgactcctacgtgctcagaatctagctcagtgcttgggacagttatgtttcctttccctttgaagtgcccaaataccagtgtaatgagaaatatggcagagcctgagagttcagagcacaggccagggtcaaatctcagccctccacttacaagctgtgtgacaaaataacctcccccgggctcagtttcttcactgtaaattaggttaattgttccaacctcatagggttgttaggagaattaaatgagttaaggtttgcaaaacgctaagaacagtgcctggcacacagtaagtgctttataaagtgtttgttgaataaataaaattttggacctaaactctgggtctcttcaggactgcaacagctttgtaactggcaaccccacttttaggtgcgttcccactcctctaaaacccagagatctaaatgccaaatctctctgcttaaaaagtctcccagggctcctaggcgcctccaggctagaacagaaatgcctcagcttgaagacccaggcttttcaggtgaaacacctaagggtcaggagacgctaggatcatcactcaaggatcccagtgaatttttccaaaatacaataaaaataaaaacaaaaagaggcaaacagggttataaaaattgtggggcattttaaatgtttcattgaacaaattaaagcattaacagccctcccccaaccaccaccaagcccaagagaccgtaaatatgctgttcacaagataactgcaactttcaagggctctcaggctgctacttcgggcagcacaattggcggcacgacgtggcaagcaggcagtagtttccaaccctggagggtcagcgtctggagaccccggccaaggcatccacagcctaaagatgatgtccgcgaccgcccgggcagcctcgtgcacggaaaaacctcaaccccggccccgcccacccttcctgcggccaccccgcagccctggcccctcagtccattcactcctgcagcgcggccccgcacccagggcctgcactagaaccgctgttcctaccgcggcgccccctgggagccaacgccgcgatgcccgcctgacgtcaggaagtcgaatccggcggcgacgcctttagggagcccgcgagggggcgcgtgttggcagcccagctgtgagttgcccaagacccaccgggggacgggatctcgctccccgcgccacgaggctcggccaatgggaacgcgcgctgcgaggcccgccggtctgccctgcggtgctgaaaacccggcgcgcaggcggctggctctgggcgcgcgccagcaaatccactcctggagcccgcggaccccgagcacgcgcctgacagcccctgctggcccggcgcgcggcgtcgccaggccagctatggcccccgacccggtggccgccgagaccgcggctcagggacctaccccgcgctacttcacctgggacgaggtggcccagcgctcagggtgcgaggagcggtggctagtgatcgaccgtaaggtgtacaacatcagcgagttcacccgccggcatccagggggctcccgggtcatcagccactacgccgggcaggatgccacggtgagcgcagccaggcgggggcacaggagagggcgggaccggaggctgagtgcaggggagacagagttacgcactccgagccaaacaccgactaattcggaggaaagcccggaggcgcctgatcatacctgttgcccggtgattgggtgtcctgcggatgcgggatgaaaaggcgggagagaggcctggagaagtggagtctggggagtggggatggaggccaacaacacgcacacacaaacaaagggtcccgcctccctgccgtgcattccatctgcagccccgagcctcaggtctctgggcggggacagaaccccgagctgggtaggctaggagggaggagagcaaggatgcaggccgcctggggagggagggggtcagtggccaggggagggagtcacatcctgtctcgatggctaggagaggcagcgcagccgcgtctggacctaggtgccggtctccactcgccagcaggagcggagagggagcaggaaaggagcccattctcgaggatggggctgaaacgggaagcttggggagaccgctgccttggggacccctgcgtcgtgtgaagactggaggacgcggaagggacagcgctggccggggagggcaagcggccgctggcgtacataagggattgggaatggcatacacttagcgaggacccccagagctgttctcgaatcgccggggaggccactgagccgcaggccagcgaggtcttcagctattccgcggagcggaccgctgtttacgctctggggcggtaggcccttcgcggggtcctgtcccttcttcccttggtctcactgcggggtcggcgcgcgccccagccccaggcctgctgcttccctttctagaccacagccctcagagctaaggccccggcgcctctctgctgggttggagtcctggggactcagtcctagggactcgaaagtcggggcgttcccttcaccgcgtttcccccttggcggccagaatggcgtcccctccccttgcatccccctctgatcccgtgccctgcagcgtgatgccctccactgtccctatccactaccctggcgtcccagagtgtgccgcgggtcaccaggttcccataacgtcgcagcagagcttagacgctgcggggcgaagacccgccccaccctctgacgcgaccagcctagtgggcgaggccagagcttgcgcgggtcaaccagagtgaccactcgggagccctgactgcggccaagggcgcaggcgtgtcccggcgcatgcgcagacgaaacaggcaccaacgctggagcttcccgcagtgtgatttggggccgggaatgccgcggcggggacggcgattggtccgtatgtgtggtgccaccggccgccggctccgccccggcccccgccccacacgccgcatcacttacagggcccggggctgccggacctgccaacgtgaatcttatcgccatggaccttaccttgcacaacccaaagtagctgccttggggcagggggtggccagagtgcttagggaaatgtggagccctacccagaacaacggtggagggaaagggaagaaacgcagaagtgccccagttcggacgtagggaagtcttcctcttcgtggtttttggagaaccctagctaagagaggaaagggacttattgaaagacccgcaagaagggacggaagtctcatagccctgagaggtgaagccagctggagttgatgggtcgaatggggacctagagaacttttctgtatctagaggtttgtaaaatgcaccaatcagtgctctgtaaaaacgcaccaattggcgctctgtagctagctagaggtttgtaaaatgagccaatcagcaggacgtgggcagggacaactaagacaataaaagctggccaccccagccagctgctgcaacccgctccagttcccttacaggctgtggaagcattgttcttttgctcgtcacactaaaccttgctgctgctcattctttgggtctgcaaagagtgttattcctttaagagctataacagcgggaaggtccacggctccattcttgaagtcagtgagaccatacccgccggaaggaaccaacgcccgacacagccccacccatctctcctgtttctcacctatactgaaattcttgggcaaaagctgtctgtggacacacccaggggaaaggccagcccaggcaggtgtttcttagtggttcccctcagccaatgcttcccattccttgatgcatccttctaactagagcagatactcggtgatcttaaactgtggacacctgggagcaccctcaaaaggcagctgggcctagggagatggcctgtgcttctgtgtcaggagttggttccttcaggtgggctcgtggtctcgctgacgtcaagaatgaagccatgaaccttcgcggtgagtgttacagctcttacaggtggcgtggacccaaagagtgagcagcagcaagatttattgtgaagagcaaagaacaaagcttccacagcgtggaagggtacccgagcaggttgccgctgctggacgttggggggtgtgagggggagcagcctttttttttttttttttttttgagacggagtctccctgtcgcccaggctggagtgcagtggcgcgatctcggctcactgcaggctccgccctcccccggggttcacgccattctcctgcctcagcctcccgagtagctgggactacaggcgcccgctacctcgcccggctaattttttgtatttttagtagagacggggtttcactgtgttagccaggatggtctcgatctcctgacctcgtgatccacccgccttggcctcccaaagtgctgggattacaggcgtgagccaccgcgcccggccgggagcagcttttattcccttatttgtccctgcccatgtcctgctgatttgtccattttatagagcactgattggtccattttacagggtgctgattggtccattttacctctagctagctaaagagcacggattggtgcattttacaaacctctagctacagaaaagttctccaagtctgcactcgacccaggaagtccatctggcttcacctctcacttcaacttgggtacagccttctggcgggcaggaggatggcctttggtgcgaacactgccggagtccagggggctggctccctcacctttcatcttctcccggcacttgcaggatccctttgtggccttccacatcaacaagggccttgtgaagaagtatatgaactctctcctgattggagaactgtctccagagcagcccagctttgagcccaccaagaatgtaagaccctgtgtttgctatgtcgcaactattggttgttgagggggacagagagggggtggaaggagagtctagatgggatcacagtcatagtaatcacagtcagtagtagctctggggagtcttgaggtccctgcttctcttgcatagtcatgaggtcacaggcccaagggagcatggctttgcaacctatggctcccccaaggctgccactaccatggctgccatcattgttatcatcattgttatcatatgagcacttactatgcaccaagcataaactcataactcttacacatttacagatgagataacaggctcagggaggttaagcaacacagccaaggatcacacagttagtaaatggcagagcaaggacttagtcccctgaactcttaggcactatcccatggcacctcctcctgtcatcctcattgtcgtggtatctttgcctaggactgtggacttcccacagctacctcagtgggaggtccttgagcctgagagggcccttgtctccagtagcattggggtgcagatgagaagaataacagctcctcttcctcttctgcagaaagagctgacagatgagttccgggagctgcgggccacagtggagcggatggggctcatgaaggccaaccatgtcttcttcctgctgtacctgctgcacatcttgctgctggatggtgcagcctggctcaccctttgggtctttgggacgtcctttttgcccttcctcctctgtgcggtgctgctcagtgcagttcaggtgagagcctttggcttgtcaagtgcacagcaatgctcagcatccctggggaaagctccttgggtgtttgaggaaggccaagagtgcctgccctccaagcagggcagatctgaaggtatgcaggagtgagtgcaggaacatgcattctgctgtcttgacctgtctgctctttagccacatggacatcttcatttctctcactgcctttttagctgcttctccaagggttctcttcttcctatgcggtttgttctctgccacagcccacctgtgccaggagccaagtttctggtttcttagcaaagcttggctccctccccaccactgacattgcccaatatgttaataatgattgagcgctaattcttgactgtcaggacccatttggcaagccttctgctcatgtttcagtcctttctgtattctagatgtcagtccatcataagtcatgagcttcaggccaggtgtggtgactcatgtctgtaatcctagcactttgggaggccaaggtggccggatcacttgatctcagttcaagaccagcctggccaacgtggtgaaacctctactaaaaatacaaaaaggccaggcacagtggctcacgcctgtaataccagtaccttgggaggccaagatgggcagatcatttgaggtgaggagttcaagaccacctggccaacatggtgaaaccccgtctctattaaaatacaacagttagctgggagtggtggtgggtgcctgtaatcccagctacatgggaggctgaggcaggagaattgcttgaacctgggaagcgaaggttgcagtgagccgagttggcaccattgcactccagcctgggcaacagagcgacactctcaaaacaggccaggtatggtggctcacgcctgttatcccagcagtttgggaggccaaggtgggcagatcacctgaggtcaggagttcgagaccagcctggctaacatggtgaaacctcgactcttactaaaaatacaaaaaaatcagccaggcttggtggcgggcacctgtaatcccagctacttgggaggctgaggcaggagaattacttgaacccaggaggcggaggttgcagtgatctgaaaccgcaccattgcactccagcctgggcaacaagaacaaaactgtctcaaaaaaaaaaagtcatgagcttcggagctggcgaaacagaagaacagagaagggatggtgatttgccccaactcacgtgtgagtcagtggcagaggcagaactaggacccatgtttcctgactcctgaggtgcatcacaggccttggcagatgaaggaagtgggagaggctgaaggaggcatcgaggtcagtgaaggcgacactggggctggtgggctgctctcagtgttgactcttctcacctaggcccaggctggctggctgcagcatgactttgggcacctgtcggtcttcagcacctcaaagtggaaccatctgctacatcattttgtgattggccacctgaaggtcagtgggatggggaggagctctctaaaactccaggcaatgaagggctgccttgggggaagcttttcatactcgtgtccctgcttttctgtagggggcccccgccagttggtggaaccacatgcacttccagcaccatgccaagcccaactgcttccgcaaagacccagacatcaacatgcatcccttcttctttgccttggggaagatcctctctgtggaggtgcgtggaggtatcagtggaaaggtcttggggaataggaggcagccaacataggggagttggggaagatgcccacgatgttgtcagtgtgggcaagacactggggctgggctggctggggcttttgccattttggaagttctggaaggcaacaggcaatagatgggggctgcccaggagggagtcaccatcctccctagagagttcagtcagcaaaccgttactgcataaaaggcacctcattttgcaaaggatccagcggatgaccagaaggatccaaatgatgagatagcctatccttgaaggtgctgatggcacctcctggaggtgcttttttgacactcttgccccaggcaagtattccccttgcactttgtatttctctcccacacttaggtatccttcttgtcacagtcttctctgtccagggctggactgtcttactcttctttcatgtccaatatctggaacattcattcactgagtacttcttcccaccctgctgatccccagcctgatttcctgggtggtcagcgttgggtttgagatgtcgtctgaagttgtaagcagaaataatgtagctgctgaaggaataatgcctgggggtggagatctggtgagcttttagtgagcattaggcaatggaaggttctaaaaggccagcagaattctttgaaaagttcatttaaagccctttgtcccaaggctgtaggctgcagagttcttccaggtccacctcctccactttgtgacatttcagcttgcgaggaattaaattgtcgttaaaacacatttcagttctaggcatgagttcaaggtagcctggcgttcctctcgcccctggccatgagaactttgaaagggctttggcagcactggttggcctggcatgaggagctcatagcttgaggctcatgccccacctgtccataatgttcttattttcccatcatgagcatggacttgggtttgttacatgtccgataccattatggtcagtactatgcagatgacgaagcagccctgtcccccgtctgactcccatggctgcttcaagggcagtgtggttatttgctgggcagtggcatggggcttgtgcatttctactgtcactacagagggtttaaaaaaaagacatgggcaggttaagtggaagggaacagtctcacaccactacctttattgcttcttggtacttgggttttcaggaaattcctatcagcagacatcaaaaacagagaatgaagggacgcagttggcatgtgcctgtggtcccagctacttgggaggctgaggtgggagcatcgcttgagcccaggaggtgaaggctgcagtgagtatgatcacgccactgcactccagcctgggtaacagcgcaaccctgtgtgtaaaaataataattttttaaaaagattaaaaccaaaaaaaaattgtaaacagagttcaacgtaacttacagattaaaaacagtaaaatatgacagaaactgagaggtagtcatgatcagatatggcctccttcgggtgccgacatctgaactgagacctgaatgatgaaaagggccaacactgcaaaaattcagggaaggaacatttggaacagagagaacagtcaagtacagaggctcccggatgttcagggacagtaagcaatgagagaatgagaagaccagaaaactagggaggggccagatcatgtagggccttagaaagccatggtaagggtgtggtaagaagtttgggttttattccaatagcaatggggagtcacaggagggtttctggtgggtacagcaatctgctttgcactttaaaaggcttgctctggctggaggtggagaggatgaattatagagggtaggtataatcacagatataacctcagtgaggcggctggagcgagtccagaccagaccacggaggagcaggtgaagccaatggatttgggatatgttttggaggcagtgtaagcaacgcttgctgaggacctggatgtggtggtgagaatcaccccatctcgagcaacattaactgaggaaaaaattgaaaaaggggcgcccttgcttgggggcttcctattgtggaactgttatggaaaggagccccatccattgcttcctccttgaatggcaaatgcctttatgatccctataacttgtcccattatgtttagacccttggtggtcagaagggttctatttagggcagtgtcccctgcccctccttgtcctccaaaaattttgggaggcactgacgtggatgtcatggggtcagcacaggcatcaacatccccagagggatggaaccaagcagcctattgcccaggcattcactaacaggcagcccatcctcagcctcatagctggccggggagaagaaaggctattttgggtcccagatctttttttttttttttgagacagagtctcgctctgtcacccaggctgaagtgcaatggtgcggtctcagctcactacaacctccgcctcccgagttcaagagattctcctgcctcagcctcctgagtagctgggactacaggtgcgtaccaccaagcctggctaatttttgtgcttttagtagggacgtggtttcaccatgttgcccaggttggtctcaaactcctgggctcatgcagtccgcctacctcagcctcccaaagtgctgggattacaggcatgagccactgcacccggtctctgtttacaaatttatcaccagcttcatcccctaaggttataagctccatgagggtgggaagtctgtattgttcacctctgtatcctaagcatctagaacatagcccggcacacagtaggtgctgaagaacttgaatctgttaatgtagaaaggatgtttcatctagctgaagtgtcttgtacagaataaactctcaataaatgaactgtggacacatggaagggtgagctagagctctgctcaggggttgagtgctcctcttgtgcccttgtggttgtctggttacctgaactaattggagtgcgatgcagacatagtcatggagtgagacagcagaactttgctgtcttgtttgtgagcccacatcaggggttctagactggctggttgacatggtggccccagcctgtctcttcagcagctcggcttataaaaaataaccaccacctactggggaaaactgctggaaccttcagattgccaaattgttcttggtgtcttttccagaaatatttgccaaactcgaattagccttcaggagatttgataaagctcatgtttaagtcaagagaccaaaagattttgatggggagaattaggggctggatatagagggaatacttaacctgtataggggcagatatggttgtccatggagattctggtgtgaaaaagtacgatggcggccgggcgcactgcctcacacctgtaatcccagcactctgggaggctgaggtgggtggatcacctgaggttgggagttcaagaccagcctgaacaacatggagaaaccccatctctactaaaaatacaaaattagctgggcgtggaggcacatgcctgtaatcctagctacttgggaggctgaggcaggagaatcgcttgaacccagggaggcagaagttgtggtaagccaagatcgtgccattgcactccagcctgggcaacaagagcgagactccgtctaaaaaataaacaaaaaagtacgatgggagaaaggggagagggcagtggggcctggaaacctcatgacaaagagaatgaacacaagagggcctgtggtcctgtagactctgtgctgtgcacatccctcatgtgagcatgggccatccagctgcaggccatggtgtgacacactctgcagattacagtctagggcttcatgttccatgtgctggaggtaaggctgggcctcttggagctttccaatagcaccaacaagctgtcagccctggaggaggcctaaacctccaagcaaggaaaggtcaagtcacagagggaggaatcactggtctccgaatgctcatgtgtttgcttttcttcacagcttgggaaacagaagaaaaaatatatgccgtacaaccaccagcacaaatacttcttcctaagtgagtgtccccatccaacacaggggagctgcctcaggagggaatgctgagggaatgaggaggatgtggctgtccaagggattatggtattttaaggaaaggggctagaggaagtaccccactcccacccccagttactccctgcatgacagcagtttgccatctcagctgagcgaagtgaagttaggctgatgattggttgaaggcaaactagttcttcccatccaaccccagtttccactgggaagctgggtgtttggggtgtagaggggcctcttgctttatcctcaaccttatctttttttttttttttttgagacggagtcttgctctgtcgcccaggccggactgcggactgcagtggcgcaatctcggctcactgcaagctctccgcttcccgggttcacgccattctcctgcctcagcctcccgagtagctgggattacaggcacccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggcccctcaaccttatcttaaactttgtcaagatgggccaaggtaacctggtagagcccagtccaacccccagaggaacaaaggtacagatagttctggaaggatgggtcctgaggagagaatggaagagctgttagaacgaagaagatctttctgatgactgccacatattcccagctttaaaagtctgtcccagctactaaggaaactgaggtgggaccatcctttgagcccaggaatttggggctgcagtaagctccgattgtgccactgcactccagcctgggcaacagagtgagatcttgtttcttaaaacaacaacaactctgctccataatgcctaaaatgagctttaaacgcctttaaattttcaaattttttaaagaaggaagggaaggagtccactgatcttattttagtttgaaggaattcatcctaactgcctatcaccaactatcacgaatagagaaaggcgatggggcagaagggtagagcagagacctctggaagaaatagttttagaatccatggcacatcaagatggaggagccatgggtgagcattgtcatgctaggagttatgggtagcatcaggtgccacagagaagggctacagaaaaggaaatgaggaagcatgtagaatgcaacacttcttcaactcccagttttctttcaagagaggcccctctgttccgtcccacagctgacctccagggcttcagattggggtggcacaagcccatctccctagtttaaggaagtgagcttcacagcctgtgaaggatccacagggtccctcccaacacacacacactttcctgctcctgccccttcacctgcatggtggagctgccaggaacaaagggcagatgactgtagggacagggctgtggccaaggtaagtaagagagtattagcacccttttaaaagtgtgggatccttggagtgtgtatgtagaaaagagaagaaaaatgaaaaataataaaggtgtgggagcagagcaagtcccatgcgtggggcctgagttcccaagcacctgtcactgaagagtgccactcgcacccctcaccttccctggcatcctcttgggagtttttgccttccccagacttggatttatgcccaccttcagtgcctgctggttccagtggattgcagagcactcaagcacctggaggggagacagaagggatggttggaagaggcagccccctgctagaggccatctctcccaacatcaactggccctttcatgaccttcctgtgctcatgcctcctctttgtctcggtttcctccccagttgggcccccagccttgctgcctctctacttccagtggtatattttctattttgttatccagcgaaagaagtgggtggtgagtatccatggcccaagaagcccacatccttgtctccagcacccagagtgggggataggggttccccaggggaaacttgagactgactctaggcctaatttagaacaaaataatagaaccagacacagatcctccttatctctaagtgggacgaaatgatttgagcttagcaggcagcctgattcccaatgtgtaatttcatgcggtcagtgtctccagaggttcttgtactgggcataatgccagggggctgagttgggaatggggaagatgaatgagagacaatacctactttcaaggaaacttctgatgaagcagaatgtggttattaatcagaaaagaggtacaggcaataggttctggggactccaaaaggggcctgactgcacctggctttgtgaagtcacttttctagctggccttgaggctgggcagggtttctgacaggcagaggtggagcaggggggatgaactctgagcagagaagctggaaatgaggggtaagtttgaccaccagacatattgtggaggactagtgtcaggggaagagtatggtgcttggttcagtgatgagagatttgatcagggcactggcatggactgagccatggtcctggcagattcatttggcggcatgctgaaggatttagattggctaggaagagctagaggcaaagagaccttgtaggccttggtacttttgaaggggacatgcaagaagggctggggggtgccaatgggaatggaagaaaggagcagtggcactagatactgcaggattggacccctgagaagctgaagatgagtgagtctggataaccaggagaatggctgcaccatgcaaacaaagagctgctgagaggaagaggaagagttgttcgtgactgttatgctcgctgcttttctcactataggacttggcctggatgattaccttctacgtccgcttcttcctcacttatgtgccactattggggctgaaagccttcctgggccttttcttcatagtcaggtagtattcggtgggggcggatagggactggtgaaggaaatgttggggagtgaccagtctggtctaggggccgtgctggggctttgggtaacagtgggtgtttcaggagttggcttgggaaagtagacaggctggagcagttatctgaggggggaatcagaattctgggctctgtgtgtactgtttttgtctgtgtaatacatctaacaggttcctggaaagcaactggtttgtgtgggtgacacagatgaaccatattcccatgcacattgatcatgaccggaacatggactgggtttccacccaggtaagggacagtcactcagaagactggagcataacacaactattgaaaaggatgcgtaggtgaaaacagcaaaaacaaaaagtcccccaaacagcattttctcattagcctgaggctcttgttctgcaaccatgtgaagggagtgaccaagacagtctcatgtcccttcctcagccagctttacctggagaatgctgggctggcctttccatctgatattcaacatgctctcccctgaccttttccgccagctccaggccacatgcaatgtccacaagtctgccttcaatgactggttcagtggacacctcaacttccagattgagcaccagtgagtagggagcctggggaagcagggtcctggggagggtgtaagtgttgggtacaggtgggagcagagaagcaggaaccactgactcccccgttctccctaaagtctttttcccacgatgcctcgacacaattaccacaaagtggctcccctggtgcagtccttgtgtgccaagcatggcatagagtaccagtccaagcccctgctgtcagccttcgccgacatcatccagtgagtatctgagaccaggaagatggctagtagggagggaagagggcagggcaatggaaatgatgacatgtagggtggggagtgaacagaaggtgttcccagtcgtgtgggatggagttcaccatggcaaaggcaggattctttattggacctgtggccaggtcaggcctttgccctcattggggttcccctcagtaccatggcccaagctagctttctctaaagtagaggggaggaaaacctccagatggaagaaggccttaacctcactgctccatctccggtgggttcaactctgcttgtctccctcactgtctgcccccattttgtccctgcagctcactaaaggagtcagggcagctctggctagatgcctatcttcaccaataacaacagccaccctgcccagtctggaagaagaggaggaagactctggagccaaggcagaggggagcttgagggacaatgccactatagtttaatactcagagggggttgggtttggggacataaagcctctgactcaaactcctcccttttatcttctagccacagttctaagacccaaagtggggggtggacacagaagtccctaggagggaaggagctgttggggcaggggtgtaaattatttcctttttctagtttggcacatgcaggtagttggtgaacagagagaaccaggagggtaacagaagaggagggacctactgaacccagagtcaggaagagatttaacactaaaattccactcatgccgggcgtggtggcacgcgcctgtaatcccagctacccaggaggctgaggcaggagaatcgcttgaaccggggaggtggaggttgcagtgagctgagatcacgccattgtactccagcctgggcgacagagcaagactccatttcaaaaaaaaaaaaaaaatccactcatataaaaggtgagctcagctcactggtccatttctcagtggcttctccatcctcatttgcaaacctcagagggataaggcagttgaacctgatgagcaagaattataacagcaaggaaacattaatgcttagaattctgagatccagcacaactcagtctgtgggagctcagctcgctgcccagggataggtatgacctatgtctgccttaggctgctgggagatgccattctccagtttcagaagcaggcagggcaaaggtcaagactgtggtattggggtcttttggctctgaaggatcctggaaccactgattttggtttattccctccagggtctaaagagaacaagaggtgctagctcttaccaaaacagatggtagagagagttgctggctatttaaaaagctctttcatcttttaattcacctcttcttttcacctctttaaccactcctcaggaacagaacacttctaggactgggggtcttttagctccataagcaagtgagcagatgggacaagttagtcttttctccctagaaacaaaggggatgcccagtggtttccctttgcttcccaacctaaaatttcaagtttaataaaatagcaattagcagaagtgaccaaattgggagataattatcagtcatgaggaaagacacagatttcggtcataaagaatgtaagggctataagtagaaactttctataacctaaatgatgttatagaattatttttgagcaggagcagaaagattaaatatgatcacttcatacttctaaatcagaaataggaagattaaaaccacagaacagtttgtgatttctattgctgtagctaggtatcttactctgtccactcttgttcaagtatctaactcttctggaaaccaaataggctttagaagagattatcctatattcctatcagtataatactaaaatgtaactttttaatcatctggtttttaaaagataaacagtttagcccatctctccagagagcaaacataggaatatgactcaggagcctcctagggcttatcatcagccctcacacccgcttccccctccaacccacagcctttgcttccaggtggcaggattactactttgcctcttcagcagcatctactctaggcatattgatcattttagacactgggagaagagaacctcaaactaggaggaaaagacagagcctccacttagttttgggaggggatggcagacagtcaaggagatgagcgtcctaaggcatgttgggatagggtcagatgcaccacccatggagaggtttgtcaacacaaagacatggaaggttagaggtttgtcaacaaaaagacatggaaggttaggtttgtcaacacaaagacatggaagattagaggtttgtcaacacaaagacacaggaagaatgggctgcagaagatttagatgttttccatttgggcacattttacttagctggagaactaggtttaaaacagcctgggtaggaaaattagaagcaagctggatgcagtggctcatgcctgtaatcccaacacttttgggaggtccaggcaggaggatcacttgggcccaggaggtcaagcctgcagcgagctgagatcacaccactgcactccagcctggggtgatagaacaagaccctgtctcaaaaaaaaaaaaaacaacaaaaacttagaattgaggagttgtacctccattggcttcctcactccaaaataggtgctgatccttcctattcctattctttgccaccttttgggtgtggtgtcaccagcctgtttagccaagtagctttgggcataggctgcccaatctgagcaaacaccagtgaggctctattgagccaagaccaagtcctcaaagcacctgaaccactgtggccttctcagcctacagcagtgtggtctcttacatggccacaaagggacacacagtgacaaaaggctcggaatgttacaatggtaaaatgagtgatctcaaatccactgacagatataaaataggcttagagaggaaaagctgcctctggtcaagtagatcatggcagcatgaattccaactcacttttttacaactccaacttctatgtttatctttgttactttcacttttttacaacctggccagaggcattttttaaatcaggcccaatatcagtattctttttgtgtgtgccaattttgttatcacatccctatgaagttgaaaaataaagttaattttgaccaaaa

SEQ ID NO: 37112 - DNA, 80528 bp, Homo sapiens; identical to SEQ ID NO: 37111

SEQ ID NO: 37113 - DNA, 55181 bp, Homo sapiens; identical to SEQ ID NO: 36848

SEQ ID NO: 37114 - DNA, 27447 bp, Homo sapiens
gtgaggcgtgcgaactggtggcagtgagagacttcggcggacatggctcccagcgtgccagcggcagaacccgagtatcctaaaggcatccgggccgtgctgctggggcctcccggggccggtaaagggacccaggtgagcggcaggactgggcttggcggcggagcctgctgaactccaaggtcaaggcggccggagatctagaagccctggacctgcccggagcgggccggggactaaggcctgcggggaacgctggccggggtctcggttctggtggggcatttcggagagggtccaaattggaggtcggggcagtctgagttaggattggagtgcccgagggattcagtgttgaagtgttgggttagggaatgtgagggctgattaattccactaagggtctagagactggaaaggtttgaggggtagagtgagccctgggccgaggcatctagattacaggctgaatggaggcaattagctttatggcccaggttacctgcgagttggaggtgaattgtccagaatcagggttacattccaggcactggaggtcgggagattttgataatgatttatgacttagggggaggggaggagaagcatctccaacacgtggggcagagtgagaggtgacatgtgctgtgtgagccagttgaattgagatgggaggaaacctaaggctctccctgtttgaaagttgggggtgaatgtgtagaactggtttatagcctggagacccatgagtcgcaacctttgagtagtgtccacaataagggttgggagtgctcatgggacctggcttggagttaggacctgaggctactgaaggctaagcagcttgggatgacgcaaatgattttagatgaaaaggaacttgaatttttttttattttgtttttattatttttgtttgtttgtatcttccttccctttggtttttatttattttttcctttttttattttgttgttgtttatagggaacttgaaattttaactttatcaatcaacaggttaaaaaacaggcccagaaaggtcaggtggctttcccaaattagtgaaatgagtttcatgagcctgagacctcaggaaccatggagttagagtctgaagttaccatctgccctagcaggcaacaggggcctcacttgggatctgggccccttctagatctgggacataatggggccatagattagggttgggatcgatgatctcatttcggatttggaagcccgcaggttggattattgatgtccccttcttgcttggggtctggcattgcacctggggccctaagcctctggctcttgcctgttgttaggcttcaaagagggaagtctgagctcccaaatgaaagggaatctgaggactgccctgtgcccgcttttctcttcctagcacttgccaagttttaaaaatcttggcaaacagaccatcttactcattcttggtaccccttgtggcacctagcacattacttggcccttgatggggttagtggaagtggatgaatgtcacagattaatgtgggtgataaagaaagaagttctggaacactccattcattcctgtgacctgggcactaagtcagaaaatacagctttcttttctctccacagactgagatgattcttctttggagcttacctgtacctgatccctttatcctttatcctcagcgttgttgacatctctttcctgttgctgccacactcatttattgggtaatctgcagcttagggaagtttaatcttagactctgcagacttttgctgtgagtgatcaagtataaacagtagctcaaatgcttcattgtttttctttttctttttcttttttttgagacagggtctcactctgttgcccaggttggagcgcagtggtgtgagctcaagcaatcctcccacctcaccctcccaggtagctgggagtacaggcacatgctaccatgcccagctaatttttaaacaattttttgtagagacagggtcttgctatgttgcccaggctggtattgaactcctggacacaggcgatcatcctgccttgacctcccaaagtgcagggattataggcacaagccactatgccctgagatttttttcttaactcatattgaagttaataatttcagtaattatggaatggacaacctatactagtatagtactgggacaagggttttataatttagctagctatgtaacttccgagcctcagtgttcttacctgaaaaatggggataatacctaccttgctcattcagcatttcatgagcacctaacattggggatataaagcattgggcaagactgataaagttcttgccctcatcaactaaacattcacaatgatactggaaaattatgatatatgtgtgtgtgtgtgtgtgtgtgtgtgtgtgtgtgtgtgtatcaagcacccacaacctagatgacagcctgctatatagtaggtactcaataaattttgactcccttttatcttagtaacacatctcccttcccctccttcaacttggatgtttcagtgtaagacatgatttattcaggaagtttagaagaacattatactaatgagttgattgataagggtgcatgaagatgagagttggtcagagaaggctttgtagaaatagaggagatgtgattagagctgggagttgaaaggataagatttacacaagtcatttaacctctgtacactttccagagttgtaacaataggaatactggtgattgtatgtatttttgtggagtttaaaaaaaagttcaagcctgggcaacatggcgaaaccccatctctacaaaaaaatgcaaaaattagccaggcatggtggtgtgtgcctgtagtcccagctattcaggaggctgaggtgggaggatcacttgagccttggaggcagagtttgtagtgagctgggatctcaccattgcgccccagcctgggcaacagagtgagactttgtctcaaaaaaaaaagatcttaaatcagactttacaaatggtagcctacaataacatttagcctgcagagacatctcatacaccttaactttttattatgaagaattttgaatacacaaaagaagacaggatggcataatgagcccttacccagccccaaccattaactggtggccttcgctcctctagccattctcccttcacaaattattataaagcacctcccaggcatcataacatttcatttgtaaataatattagtatgtattgctaaaagataatttttaaaaacataagcataatatcctttaaaaaatcaacaatttttattcaaattttcttttgtgttaccaatgtgataattttaagtttcttttatttatttatttttttacagacaaagtcttgctcagttgcccaagctggagtgtagtagcccaatcatagctcacggcagcctcagtcctcccacctcagcttcctgaatagctgggattacaggtgcatgccaccatgcctggctaacttttctagtgttttaaagatgggggtcctgccatgttgctcaggctggtcttgaactaccgggctcctccctcagccacccaagtagctgggactacaggcatgtgccactgtgcccatcctttcttttaatttataagttccccttctctttttttcctggggttttgccgaagaaattggattatttttcttttcttttttttttttttgagacagagtctcgctctgttgcccaggctggagtgcagtggtgtgatcttggctcactgcaagctctgcttcccggattcacgccattctgcctcagtctcccgagtagctgggactacaggtgcctgccaccacacccggctaattttttgtatctttagtagagacggggtttcactgtgttagccaggatggtctcgatctcctgacctcatgatccgcccaccttggcctcccaaagtgttgggattatagccgtgagccatcatgtccagccccagaaattggattatttttcctgggagtattataccactctctgggaattttcagttgtattcccctggtgtacttaacatcttcctctgccctctctatttcctgtaaattggtggtttatacttaattagtatatacttaattcaatttaggttcaattttttggcccaactacttcacaggtggtgggtgctgtgctctccctgaggaggcacatggtatttccttgtctctggtgtttatagtcatgctgttcagtgtctaggttcagtaattcgttatggatggtgaaatggtggtattctaattatattgttccctggtcatttattagctgaaatatttctataaagagaaacttcccctcatctactgtttcgttaccccgtgatatggttggtatagaaaagtcaggataaatgcttgatttattctctttgtcagctttcaaaatagtaggttgaccacagagcgttttcggttatgcaatttctcttaaaaatccagagctccagtttctcttgagaaaccagaagacctggcagtgatgcctccattccagtgtggcagcagtcacttgcagttgtgtggcattgctgctttggatggtctgtgtgtcttcctgtcccctgcacggtcctcttcactgcccattgcttacatttgactcatttcatacagttgcattgcctgcttggctcccactggcagatgtttgcaatcttacatgtaaaatccctaacctggggttagtgcctagtgcctgctcagtaatgtttgttttcttcctgctatactttgttatacctgcgtaactcagtattttatgtgctttatgttgcatgactgaaataatgtttccttttaaaactcctcacttttaactaaagtagttaaatatttcaaaactactcgcttttgcatcaatgtaatgttttaaaacatctataatacctgggtttgttattttatttaaataactttatttccttgcctcccttttggggttggatgctccttcggtgtggtcaaaaccaaaggtatgtttcttggtttttttgccaacccctcctcatttcttccatgtgtcaaacttatgcccaattcttcgaggccaggcacgcttaggcagtcttatgggtcagatgcatcagttatgtcattgcagtgatacttgcaacatctctgagacccacactcttatttccccttttacagttggagaaactgaagtttgaatggcttgttctctaggctacatagcaagtaatttacagagcttgcatctgaatgactccaaagctcctgctctttctgctgctatctactgccccaggttagatttttctcctaccgtgtgcatgtcaggagggtgtaataattacaacatagtcacccattgctcagttacgtgacagacccccaagctaaagattttacatgtatcatctgatttaatcctataacactaggagataggtcctttttactgacagagaaactgagctcagaggctttatcttgcctcaggacacacatgtagtaagtagcaaaggtaggatttgaactcatgtctgtctgactcttgagtagtcattaatttacattgttgctgtgtaatctagatgaagaggcagaaatgaatatgaatggaaaaatacatacaagtgcagggtgccaggtgggaagcatcagatgagtgactttgaatgttgggttagttcagggatagaacaagaactacaatttgctgaagttctcctgttcatcctcctgtccacccagtgaggttggtaatgatttcctcagtaagttaagagacatctgaaatgcaaacacaggtttctgtgattaaaaaaaaaacaacttaagctataagatacctagaaaaagtgaacagcttgatttattttacaatgtgaacagatttgtgtagcttacacccattatcaagaaacagaatattgccagcactttgaaatcctccttgtgctcccttccaggaggatagccactaaggctctttgggttgtttgtcttaaagccttatagtgtcatggctaagagctagggcttggtaatctggcctgttgccagttcttttactagctctgtgatcttgggcaacttagcccctgagtttcatctgtaaaatgcagttaaaaatagttcctacctcatgggtttattatgtattatacatactaagtaccgtaaaacaatgcatggaaaactgcttggcatgatgcacatgctcaaagttagctaatgttaatatgaatcctcagcggaagaaggggtagttggggaggtgtttttgttttaggagacagggtctcactctgtcactcaggctggagtgcaatggcacggtcatagttcattgaagcctcgaactcctgggctcaaatggtcctcccacctcagcctcctaagtagctggactataagtacctgccaccatgcccagctaattaaaaaaaaaaatgtagaaatggggtcttgctgtgttgcccggactggtctcaaacttttggcctcaagtgatcctcccaaagtgctgggattacagatgtgagccactgcttccagcccagttaggcttttgatgggagaaatgtactcagaagtatactacagaaaaggcttagaccaatattggagcagagagggcattcctgtggagtgaggagcttgtgttgaggtccttggagaggcatttatgccgcgtatttgggaaccatgcgtaagagcagtttgtctgcagtggtgcaggacgtaaacacagggcacttgtggaagtaagttgggagggcttggcaggttttagaagttgattgtggagggcagctgagtgccaggctaagatatttggactcttcctctattgtaccacagagatgttgaaggcttcggaatgtgtatgttttggagggtaggtagcatatccaacagtgttttaagatatgattctagctgcatgtgtaggaacattgacagcaggagtgacaaagactggaggcacaaaggtaattgtgccaggcacagtgatatgcgcccatagtcccaactactccggaagctgtggtgggaggattgcttgggcacaggagtttggggctatagtgtgctatgctgatcaggtgtctgcactaaattcagcatcaggccaggcactgtggcttgtgcctataattccagcactttgagaggctgaggtaggcagctcgcttgagctcaggagttggagaccagcctgggcaacatgacgaaaccccatctctacaaaaaatacaataattagccgggcatggtactgcatgcctgagtcccagctacctgggagactaaggcaggaagattgcttgagcccgggagtttgaggccacagtgaactatgaacatgtcactgcactccagcctgggcaatagagtgagaccctatctcaaaaaaaaaaaaaaaaaaaaaagttcaacatcaatatggtgacctcccaggagcaggagaccactaggttgcctaaggagaggtaaatcggcccaggtcagaaaaagagcaggccaaaattcccatgccgatgtgtagtgggctaacacttgtgaagccactgtgctccaccctgggcaacatagcaagacctcatttctaaaaaaacataagaagaagatgatggttacaaggtgagaagactggtgaatttgggattaaaccaaatctctaggactgatagtttccctttatttcctagttgtcaggccctatgctggatgtctttgcatacgtaatcttattaaatccccacaacagttcagcagatagacactgttttctgttctatggataaagaaaacgagaccttagaaaaggtaatgtaatttgttcaggatgacacagtgaataaacggtagagcccgtttcctaacccagatctataccactacaaaacccagtctctgccactacatcagggcttcacatactgtacccatcagaacctgaggtgctgcttgagagccactcaatcataaactttaaaggtgggcctaggaaatgccctagatgattgataatacactgaaatttgagaaccactcagcccaccatgctgtctctctagtggttttagcattcccataattaccccagagtcctccaccccacagagttttcatagaggtgatgagcctgtttcttgggctcagcaacagtttttggctgacagcaacagactatgactgagtgtgggcttcagacccctgctcttcaaagtgtagtttagagcccagccactcatccaggccgggaagcttgcttaaaatgcaggtacttaggccctaccctattgaactagaatctgcatttttttttttttttcttgagacggagtttcactcttgttgcccaggctggagtgtagcggcacgatctcaatcccagctcaccacaacctctgcctcccagttttaagcgattcttctgcctctgcctccctagtaactgggattatgccaccacgcccagctaattttgtattttcagtagagacggggtttctccatgttggtcatgctggtcttgaactcccgacctcagatgatccgcctgcttcggcctcctagagtgctgggattacaggcgtgagccaccgcgcccagccggaatctgcattttaacagcattcctccagtgatttagagtctgtgaatggctgctctaaagcataagtttgaagtgtgaggggactataataaagttatttcattaggtttctgcagcctgtaaataaagactaatgcaaagaagaaagaccatggaaggaagccttttatttattgaatgcctgctgcgtgtctgatgtttttggtactttatttcatttatcctcataagaaccctgtgaagtagtcattatccccattaaactgatgaggaaactgacactctgagaagttaagtacttagcccaagatcacacggctactgagtgccttagctaggaatcaagtgtaaatctgtctgacttcaaaacccatgcgtgctctttacagcctaccacattgactcccaggcagccagcaggaaatgaaggaattcgttttctttttttctttttctttttttttttttttttgagacaagagtcttgctctgtcacccaggctggagtacagtggcgcgatctccgctcactgcaacctccacctcacgggttcaagcagttctctgccacagcctcctgagtagctgggattacaagcacccaccaccacgcctggctaatttttgtatttttagtagagacggggtttcaccatcttggccaggctggtcttgaagtcttgaactcctgacctcgtgatccacccgccttagcctcccaaagttctgggattacaggcgtgagccaccatacccagccaggaattagttttcttccctattggtgtgtgttctttcatctagctgtagaatccaatcacctggaacagtgcataagagtcctgcagtttgggagtgataaaaatagaacaggttctgtgctaacagctcttctctgtggtgttttggtcagcctttccacttgagcaagcctgacctccaaattgtttacccaggttaatttcaacagcaatgagaaagattggcagaaagcactctctagatgtacggccacagtgccagcctggtttttcattgtcagggctcctgacattcactgattttgcaaagtacagaattttggttttttgggtttgtttgtttgtttgagacgtagtcttgcttcttcgcccgggctggatctcggctcgccgcaacttccaccttctgggttcaagcaattctcctgcctcagcctcccaagtagctgggattacaggcacgtgccagcacgcccagctaatttttgtattcttagtagagatggggtttcaccatgttggccaggctagtctcgaactcctgacttccggtgatccacccgcctcggcctcccaaagtgctgggattacaggtgtgagccactgcgcccaacccagagtacagagtttttttttgttgctgtttttttgtgagatggagtcttgctctgtctccaggctggagtgcaatggcgcagtctcagctcactgcaacctccaactcctgggttcaagcgattcccctgcctcagcctcctgagtagctgggactacaggcatgcgccaccatgcccggctaatttttttatattttagtagagacggggtttcaccatgttggccaggatggtctcaatctcctgaccttgtgatccacccgccttggcctcccaaagtgctgggattacaggcgtgagccactgcacccggccaagtacagtttttaatgccttctcactagattccattttgctatgaagtcatttctttgctttaactgaattggtccatgaatcacaaaccagccctatctatgtaccttttattgtgtgcacctaagcatgcacctaagaaaactcccaattacataaaaattagccaggcacgtggcttgtgcctgcaatcccagctactgggaggctgaggcaggagaatcacctgagcccagggagttcgtggctgcagtgagccgtgatcgtgccactgcactccagcctgggtgatagagtgagactctgtctcaaaaaaaaagaaagaaagaaagaaaagaaaactcccagtgaactgatttgttggaatcgggatctaaacctgcttagtttataaaacaattgaacggaaaaagctaaaattgagctccttgaactgattatattccttgtaaattctgcattctttttttcccactgcaaagccagtgttgagctgtctagggtctcttcctgttctaattctgcattctcatgtataattcaccaaatataagctctttaagtacatagtctatgccttttattcatctgtttcccaggctcccgacagggttcttgggaaaggcattagtaaatgttttctttttgtatgaatgaatataggattaggacaggggttatggtaacagccagtgcccactgagcgcttactatatgccagggcctgcatatactgaattctgtataatcttctcatcaacccagtgatacagatactattaccatctccattttacttagaggaaatttgaaacctagaaaggtgaagtgacatcttaagtcaattttacataatggttagtggacctggagtctgcaaaccagcagtttaactctcaagcctgtgctcttgaccaaaacactataatgcctcctaaaactagtatgtaagtgcttattatttgccaagtgctctttgtatatatctcagctaatcctcacagctaccttctgagatggagccttttttgccttcattttaaacagataaggaaactgaaaagtgaggtggccaccatagtacagctacttagtgacagggaaggaggaaaacccagttctgcctgggggcaaactgctcctagttgcctccctgacccagtagctgtagtacatgacaattgtacattcatccctttggcaaatgtttattcagcacatgttatgtgccaggtgttgtaccaagtgcattatatacatgatctcatttaaacctcacagcaaccatgtgaagtgttggtactatttttattctcttttttttttttttttttttttgagacgaagtctcactgtcacccaggctggagctggagtgctgtggtgcaatctcagctcactgcagcctctgcctaccagattcaaataattctcctacctcagcctcctgagtagctgcaattccaggcaagcgccaccacacccagctaatttttgtatttttagtagagacggggtttccccatgttggtcaggctggtctcgaacttctgacctcgtgatccgcccacctcagcctcccaaagtgctggggttataggcgtgagccaccatgcccagcaagtcttcccatttataatggggaaactgaaacttatgtgtcactagtgtgttgagtggaaatagtgataattaatatttatgactccttcctgtgtgctagttgtactgttttaagtgctttacatatattatttcatgtaattcttaccataaccctataatcagtatatgttagaatgtaatataaggtacttttatccccattacaggtaaggaagtaggcatttgcccatgtttacatagccagtaagtggcagggccaggttcacacctaggcagtctgactccacagcctgtaatgtaattgaatcttggtttttgtcttcctctctgtaggcacccagattggctgaaaacttctgtgtctgccatttagctactggggacatgctgagggccatggtggcttctggctcagagctaggaaaaaagctgaaggcaactatggatgctgggaaactggtaggtttggtggtaccaatgagtgttgatattcctcagaatctagatctgcactgtccaatatggtagccaccagccacaggtggctatttagattaatttaattaatgtaaaaatcagttcctcagttgcactagccatatttcaagtatttaccagccaacgctgatacagaactttccatcatcaaacaaaattctgttgaacaaccatgtgctagagggtgttttaacaaactggcagattataggaaattttttttcttttttttttgacaaagtctcgctctgtcgcccaggctggagtgcagtggcgcagtcttggctcactgcaacctccacctcctgggttcaagcgattcttgtacctcagcctcccgagtagctaggattacaggcacctgccaccatgcctggctaatttttatgtttttagtagagatggggtttcaccatgttggccaggctggtctcaaactcctgacctcaggtgatccaccctccttggcctcccaaagtgctgggattacaggcgtgagccaccgcacttggccttgtaagactttttagagtgcaagttattttgtttgttctgaatttatggcactcattcatagtattcttgaagtttttctgtgctggtgtgttttgttatatacctaaattttagagccagaaatgaaactgctgtccctaggccagaactcagagatgtattcaagagaggatttaggaagtcacagaagtgttttttaacctgctttatggctctgtgtgctgtttctgtaacaaagcaattacttcgcagttgtgacaaaggtaatccttcttatctggggacgataattgcattttctctctttttttttgttctgagacccaggctggtgtgcagtggtgcaatcatggcttactacagcctcgacctcctgggctcaagtgatcctcccacttcggcctgatgagtagctagggttacaggcacacacctccatgccctgctacttttgttgttgttgttgttgttgttgttgttgttgtagagatggagtctcactgtgttgcccacactggttttgaactgagctaaacccaggagcagtcctcctgccccagcctctctaagtgctgggattacaggtgtgagctgccatgcccagccacattttctccttctttaggccagttgacctgattggacaaatacaatctattattttctggcactaatcaaagattgctagattaattataactgagttattctggaacttggcctctgagaatcaccttcagaagtcattttgtgcttggtcttctggtctttttttatcttagaatgttggttggggaaggagctggactttgctttaatcctcaagttaccttctgttaggctttgagattctgtagctgtatcaaatgatacctctgcctgcccatttctatctagttttcccttcatgtaattgaatctctgagtcaaaccagaaagctagatattttggactttgagttttgacagaagactctgtactaagaaaaaattgagatgtggcaatgagattgcttatctccaaccttcacttagttgcagagtgtgtactttgtccccaagttcacagttagcaccaagaaataaaagcattagctgccaagatgggcaggcttcactacaggctggagacttttctttctataacagcccaagagaaaaaccagtttctgaaaactgggagaagtccttattggggttttagagagactcagaagtatattggcttagggctggacatggtggctcactcctgtaatactaacactttgggaggctgagacaggcagatcacttgaggtcaccagttcgagaccagcctggccaacatggtgaaaccccgtctctattaaaaatacaaaaaattagctgggcatggtcgtgtgcgcctgtagtcccagctgtttgggaggctgaggcacttgaatcacctgaacctggaaggtggaggttgcagtgaggggagattgtgccactgtactccagcctgggcaacagaatgagactgtctcaaaaaaaaaaaaaaaaaaaaaaaagtgagggaagagtgttggcttggctcttcagttccttggttctgacccaatcttgccaattcagtgaacttctctgtttcctcatgtccaggatggcccagatgtgtaaccaagtacacacatcagtcacgttactgttagcctaatgacagctgtggaacagggaaagctgatgcctgtgttttggtcaaccccattctctcctggcactctctcaggtggtctgtcagccatttgtcctcacatttcctgtgccttgaggatcactgattgctgataagctgttatctgacagtttggactctggactctagtggcaggagggaccttcaggacctaagatacaaagctctcctggtgaagtaacaagtaatggaatctgtcttccctcacccagatttttgggatacaggagaatttcaagagacgagagtgtgtatttggcaaccacagagataaaattatgaaactggatcttccaaatggagccatttcacgtttgcttttatttttgcttctttgggtccaagaaaacttgctgtttagtaataaggttatatacacaaacttttggctgtggagttgggctaatgtcagtcacctaggtaatggatttaaacccaaggctattttgttcctaacttccaggtgagtgatgaaatggtagtggagctcattgagaagaatttggagacccccttgtgcaaaaatggttttcttctggatggcttccctcggactgtgaggcaggcagaaatggtgggtagcttagtttttatattactactgcatgaaaccaaattcttgtcctttgtctttcttaattcctttgaaggagatgggtctaaccaagctctggtagcttaggtgggccacacattcttttacagctcgatgacctcatggagaagaggaaagagaagcttgattctgtgattgaattcagcatcccagactctctgctgatccgaagaatcacaggaaggtatttgtcccttgaaggtcccttttcatgcttctcagagctttctcaaactctgagaattgctcttgcctaatcccggccatgaagcttagtgccatttcaacatggattgattttatttggtgacatccgctgaagtggtgagatgggatcgggatatggaaagaagagcaagggatttgaagtcagacagcatctcattcttgtcactttttttttttagatgggagtctaactctgtcgcccaggctggagtgcagtggcgcagtctcggctcactgcaacctccacttcctgggttcaagcagttctcctacctcaacctcccaagtagctgggattataggtgtctgccaccagggctggctaatttttttgtatttttagtagagatggagtttcaccatgttggcccggctggttttgaactgacctcaagtgatccgcctgcctcggcctcccaaagtgctaggattacacgcttgagccactgtgcctggctcttattgcttttttttttttgagacagagtcttactctgtcacccaggctggagtgcagtggcgcgatcttggctcactgcaacctctgcctccccggttcaagtaattctcctgtctcagcctcccgagtaactcggactacaggcatgtaccaccacgcccagctaatttttgtagttttagtagagacaggtcttcaccatgttggccatgctggtctcaaacttctgacctcaagcaatccacctgccttggcctcccaaagtgctgggattacaggcttgagccactgtgcctggcctcttgtcactttttaactgtgaccctaggcacatttcttaacctctctgaggctgtttccttatatgtagaagggggttgataacacctgctttgagaagctatttcacgtgttaggtaacataaaatgcatagttcaaagccttgcctatattaggtgcttaagaaatgttaatgtctttacatgtgtatctcctccattttagtgctccttaaatctgatttcagctggagttgccatactttgctgtagactttttattgtaaaaataatataaccatctgtacaaagtttagaaaatggaggaagaatttgctcatagtacagccactttgtgtgtgtgtgtgtgtgtgtgtgtgtgtgtgtgtgtgtgttttaacatgtttgtttctctgtaatagcattgaacacagaaatgcctctgcttctggacacgtttgttctgacagaccaacactgctttagcctacagttgtctctaccctgtttcactaatcactgccatctgctttgtgccttccagaagtatgacagaagctttcaactgcaaatggaccctccattcccttctttattgtgggctgtagcttttttatgtctttgtcattttaatggtgtctcaggaaagtggtcagccaaccatcttgaaccagacatccatgaccattacttttaattgctgtgtaatatttcacagtaggttaaccattgtttacttatttccttattgttgtacatttatgtttcttccagttagccactgttaaaatgatactatggccatcataatgcatgtaaatttttggattagggaaaaaatgttttcttatttcagacattattactttgatttcctaatgaggttgaacatcttttccatgtgtttgtagtccataccttcaagaagagacaaacatgtgaatagacagcacagggttagcactattatcctggaaagcgatatgaaatacagtggactctaccttatattcattttcttttcaaatgtccaggttacatgtctccggctattccataggctcctttaatgcaggaacttctgtttctttgtatccccactgggcacagagtagacaaagttgatgtaggtcgagaagcagtagggttaacagtaaagacatcactaggcctggggtctcttaggcactaagcacgtattagcagaatcaggtgatactggagacctttgattctatgggcccagcttcctgagtacctgcttcctgcatagcacagtactagaccctgggagcagaggaccacgagaggctctaggataaccatatagtgatgcccatctctgacctcagagagtcatatatgaaacttgggctgttcagtgtagtaggaagtccaagaagaaagcctggggacagggaagaaaggctgcctaggatagagataacattaaactcttcctcgatgaagagtatttcagagagcctttcccagaagggaggagaagccggaatgattatgggttggactttcgctgaggctagtagcagacgtgtctgcccagtggtctggggggcaggaaggtagaaggaatgctgttgagaagagctttactggggagatctgccaaaccaaagagggtagacttgacggagttcaggactcatgagatagtcttgagccactgggtattgtggcaaaaacagtattctaagaacattagcttggtcctggtgtacaaggtaaattacggcaaggagaaacagataaggataccatctaggagcctgtttatgatccacatgatgtggtggagatttctaactgaggttgggtgggagagaacagagagattctgaagaacaaacagcaggattgctgtaaagggtgaaagagagaagattcattccctccatttggaagtaggtggttagtgtgacttcctcacagagagaaggacccccgtcctcacagagcatgtcactgctgaaggtgtttttccaagtttacccaacagatgagtggcagggttagccctggaagcctgctttctgcctcgtagtccaaaatgttgatggttagaagaaaatgaggcaggaaccagtcagtttaatatggatctttttcttttctgtttttttttgttgttgtcattgttgttgtttttgagacagagtctcactctgttgcccaggttggtcacagatgtcggctgtttgaagatgctggggaatgcaccccggacctcacacaggatctttttcaagtctgagatgatatggacccattgtaacaatcttctgaattagctctgacctcacttctagtaattttgagtcattgttctgtttcttgaatatgaatagttggtggttgtggtttttgtttttaacttattcaatattggctctctcaaatcctaattatcctaccagttggctctccggtattatcttaatacctggtaccatcccaattttgtggatgagaaaacaagtgtttaaagtgtcgcactgaatgttgggcgcagtggttcatgcctgtgatcccagcatttggtagggacctaaacaggaggattacttgaggccaggagtttcagaccagcttgagcaacatagcaagacctcgtctctactataaagcaaaaaaaaagttagccaggtgtggcagtgtgcacctgcggtggtggtcccagctacttgggagtctgaggtgggaggcctgcttgagctagggaggtcgaggctgcactgagccatgattaggccactggactccagcctgggtgacaaagcaaaaccctatctcaaaaaaataaaaataaagtatcacactcacggtagcagtgattgtagattcccagtcctgatgatacctccaagccacgctcagtggctcatggagctattttggttggtacttgagagcaatcccattttgagaacttggagagtggggtttctttcatttaccttctgtggaatgagccttgtattgttttaaaaagtggtatttgtgaatggcaaaagagcagtgtgtgggagtcatatttgttgcagcctggctgctatgtgccctgtgctctctagaaggtaaaaaaatatcctggtccgtatctcatgcccctagcccctcccaaagttgctgcagctgagcccagcagcctgctctctcctttccctgggtctcccagtggatgccatttctgaatgaatgcatcagaggaatccttccaggcactcaaataatggaaggtgcaacctcacagtacatgactgcagtcacaggaacctttactcctctgtccagttggccttccatatccatggttccctcatctacggattcaagcatttgtggattaaaaatattcagaacaaaaccaccaataaatataacccaggaaagctgaagaaaagaaaaaataatacaaattttaaaattcagtatatcaattctttacatggcatttacattgtattaggtatacataatctagaggtgatttaaagtatgcaagacaaccagcctgggcaacatagtgagacctcatctctacaaaaaattaaaaaactagaccgggcgcggtggctcacacctgtaatcctaacactttgggaggccgaggtgggtggatcacgaggtcaggagttcgagaccagcctggccaacatggtgaaaccccgtctctactaaaaatacaaaaaattagccgggcgtggtggcaggcatctgtaatcccagctactcaggaggctgaggcaggagaattgcttgaacctgggaggcagaggttgcagtgagccgagaccatgacactgcactccagcctgggcaacagaatgagactctgtctcaaaaaataataataaaataaaataaattaattaaataaaataaaagaattagccaggcatggtggcgcatgcttgtagtcagctactccagagactgaggcgggagggtcacttgagcccagtagtttgtggttacagtgaactatggtcattgccattgcactccagcctggacaacagagcaagaccatgtctcaaaaaataaaataaatagaccaggcgcagtggctcacacctgtaatcccagcacttcggaaggctgaggcaggtggatcacgaggtcaggagatcgagaccatcctggctaacacggtgaaaccccgtttctactaaatatacaaaaaattagccaggcttggtggtgggcgcctgtagtcccagctacttgggaggctgaggcaggagaatggcgtgaacccaggaggcggagcttgcagtgagcagagaccgcgccactgtattccaacctgggtgacagagggagactctgtctcaaaaataaaataaaaataaaagtacacaggaggatatgcataggttatatggaaatgctgtaccattttatatcagggacttgagcatctatggattttggtatccacagagggggctcctggaaccaatccccccatggataccaagggatgactctatagcttattttctctactgtcacctccctcctgcccataacccagtgccactttatgccaaatggaccatcttgtccccccaaaatatgctgtgattaacaaaaaagaaagtagcacattttacagaggtgctacttcaatagtctaaatagaattgaatagaatttttatttattttatttttttgagacagtcttgctctgtcactcaggctggagtgcagtggtatgatctcggttcactgcaacctccacccccaggttcaagcgatcctcctgcctcagcctcccaagtagctgggattacaggtgcctgccacccagctaaatttttcatatttttagtagaaacggggtttcgccacgttggtcaggctggtctcgaactcctgacctcaggtgatctgcccccctcagcctcccaaagtgttgggatcacaggcataagctgctgggcccggcccaaatattgctatgcctgccaaatggtgaaaaatattagggagctctagtctaatagaccttcatgagaaaagcaaccattagttaaataagcaaacaaacacttggttggcagagaattgagaaaccacagaagtgaagcaaggcctggctgctgagcagagcttggcctgcctcctttccttaggtttctaggctcctgtggtgtggccattcccagtcaggaacatgggcttgttgtctgtagggactcagcacagatgcagctgcccactatacattcagtgccaaataaatgcctgttcttgagctctatattccatgacttgtttaataagtcatttttcccgattacttgaatattgctccataagggttaggctatcttttatctgtgtgattgaaaagatgtgttccattatctggcagtgtttgcatccatgggaattatttttcctgttagtaccttcctggttttgtaaccaaactaggttagaaaatagagttcatttctttgtcctctgtcccccatagcactttgtacaaatctctgttaaaggattatcacgtttgttatttatttccacatttgtctctcccactaagcactacttgtgagcagggatcattactcattgctttgtagcttctgaattcagcttaaggcttgaatggaatacttattaatgtttgttaagtaaatgggtgaacagaatggatggctgtgtgagaccagcaccagagttccttctctcaagtcctgaattaggtagttatgccagcagtttgctcttcagccagatactcataataatgtttggtcaaaatagaaaatatactctgccgctggcataagctctcctggaagcccagttatttagctggattttctgctgggtgctgggtccttgcatccagcgtccctatctctgcttgtcattctggagccccctagagtggagtgcaggcgcgtactgtcagttaacctaactcatattcatttgctgtctttcaggctgattcaccccaagagtggccgttcctaccacgaggagttcaaccctccaaaagagcccatgaaagatgacgtatgtaaactcaggacaaaaaatttccttttctttccttcccctttcttcactgtttttctttttcctttattctttccatcttccttttatttctaccaatattactaacttagtcatgaaaaataacactatcaagtaaatcacatggcctgtgtcagatctattcagtgtctcctcaggtggtttattgcttggcctcaaggttgcttccagtggtgctagctttttgcagtgcccagattgtacctgtcttctgtcaagagcagccccttttctggcatcatggccacctaagtgatcagctaatcaggagaagctttcttaaaagcctacaattggagagtgggaagagtgtggcactgaagagaagtttgatgaccagtcctccagaaaaatattctttttatagttattgctgctgtactgtgtcctggggtttcatacatggtcactgcaccatttgccataaagagtctatatggtttgttttaaagcatgcaggcaacagtaagaatttcctgggtttacctttgtcctatgaaacaagttcatcaggtcattcaggttctataaatacaggttccagagccgttatggcaacttagtcacattttgcaaagttgctaattctaccattgaaagttcttattttacttgccacttttagaatgttgatgggtgacactctagtaaatacactaaatatttaagcaactaagattacaattgctaatgtatctttgattttgatgtattctggtcttaggggcctttttgacttccttacttttgaccctagaagtgtttatcttggaagctgaatcgcctgagcacaaagatgagaaagtcattgcctatcttcccctcatgagcccctttcctcacagttggtgtttctgacaaactctctgacttctgttcaccagctgctctgctcctgggagtagcaaagttcttcactggagagggtctggattgcctgtctttgtctctgatgggctttgggaacagacagcatcctgggcagaatggtcccatctcaaatctgcatctggcatggaataagaaaaccttgctaacagtcccagcctttcattgctgtcttcctgttctcagatcaccggggaacccttgatccgtcgatcagatgataatgaaaaggccttgaaaatccgcctgcaagcctaccacactcaaaccaccccactcatagagtactacaggaaacgggggatccactccgccatcgatgcatcccagacccccgatgtcgtgttcgcaagcatcctagcagccttctccaaagccacatgtaaagacttggttatgtttatctaatgttgggtccaagaaggaatttctttccatccctgtgaggcaatgggtgggaatgataggacaggcaaagagaagcttcctcaggctagcaaaaatatcatttgatgtattgattaaaaaagcacttgcttgatgtatctttggcgtgtgtgctactctcatctgtgtgtatgtgtgttgtgtgtgtgtgtgtgtgcatgcacatatgtgttcactctgctactttgtaagttttaggctaggttgctttaccagctgtttacttcttttttgttgttgttttgagacaaggtttcgctctgccaccctggctggagtgcagtggcgtgatcttggctcacggcaacctctgcctcctggggctcaagcaattatcccacctcagcctcctgagcagctgggactacaggtgcatgccacaacacctggctgatatttgtattttttgtagagacaggattttgccaagttgcccaggctggtcttgaactcctaggcttaagcaatccacccaccttggcctcctgaagtgccaggatcacagacgtgagccactacacccagcccagctgtttacttctttaaccatacttttgattttattttttgaccaaaatgaactaacccaggtaatcttccagggaccgcaattccagaacctcatagtatttcttccatttccagcagctgattagaagtccaggatcatgtgaagtcaggcagggtcacagttcctgatggcacattatggacagagaattccattttgttttctaacccatgatgaaaacccacgtgagtcagtgtgtgaacagggatcattaattttttccccctaggtggaaggaaaaaggcacttactttgcaggttacagaaattactgggagaggatatcgtcataaaaagagccaggccaaattggaatatttttgtgatctgcatcatgatgctgaaaatagcaattatttgggaattgggtttgaaaactgaattgttgccagagaattaaaccaggtgaaaggtccttttgaattcagattgtcttctgaacatccaggctgatcatctgagagcagtcaaatctacttccccaaaaagagaccagggtaggtttatttgcttttatttttaatgtttgcctgtgtttccaagtgtgaacaaaacagtgtgtgatctattcttggattcattttgatcagtatttattcaaacccagtctctctccaggacataaaactgaaatcagatatgttctttttaagcccaaaccctctcctttctagatccaacccttcacccctaattttatgatggctatagccatggacttccccaagaaaagatcacccagaaataagaccacctgtgacagttaccagcttttattcataaccttagcttcccaactattgagcattttctaaggtccctgctgtcttttggtctctggtttgatttgtggcaaacagatgaagtaacagactgctatgaaggaccacaaaaacggcagcctctggaaaaaccattagaaagtcagtggcagatccagtaaataatatcgccagcctcagcataatctgctgctgactcgattcagtggactctaaagtgcccagcctcctgacctgagctctcctgccatctgtgagactaccagaggtcttatctgctgtccacatggcaactgggcatgagtacctggccaccttgcttccctctttgcctggtccaagtgagtgtctgctgcctctgtcctgccttgttttcctggctctaaaccaactccacccactcttaatggaaactcagtctggctttgtgtgtttctgggaagcacatgacttctgggaatgggcaaggaagaggagtgaaacaaaaactgtcagctatgtgtgcctggtctgggatccttctctgggtgacagtggcatcatgaatcttagaatcagctcccctttaactagggacaattgtaagcacttggcctcaaagttgaggttcttgaatgtttgctaattttatgtgcatgatccttgcccaaatatttgtcatccgtccacatagattcacgtgtgcatacaacatgtacaagtaatatttgggctgcccataagaactggaagattcatagggaatgcatatacccttctcagtatggttaggattctgtttttgcttcatttaattccagagttcctcagcctcagcaggttctgcttttacctgtcacagaaatgtccagtgtttaatgcatttggttgctggggcttacatgccagcctcctctgatatgtacttggtttttaaaaacccattttgttctctcttgtttcctctctatttcagcctagtatcagaaggccaggcgagactgcaacactgctcatcaccccgcggcgtgatccctgctcttaggtgctgggcagaggggaagggtggtcagggtgaggatggtgagggagggctggtgaggggctcagaggaatacttggaacaacagcagtgttattgtagtgtggcagtttcttttatacataggtgagagtttttaaagtgtaagggaaaaattaattttttaaaaaacaccatgcttggagggtgggggtagaaatagacacaatattatttctaaggaatcgggttttcatttactctggactggtgaaaatattttttaaagccagtgctctaagacctcagcttttatctcagaaccccatgggttccagaccaagagtacaggaaatcaaattgttgtcctgtctgtctatagcttggaacagggagctttgattactgactccggttccacacactgtaagatcaaaaaaccatctccacatttgaaagagatgtaaggtgtattcatagggatggtggctcaacaaatcaagcaaactggaatcaaggggagggggaagggaatgaaatggaaagggaggctgattcccttcccctgacttaccactaatttactaggctacctactttcatgagtaacctctcacagctacccagcacatgccacaatcctatgctcttgccttcttttatctgcactgtgtgaagggactcttttaaataaatgagcaagtgtcctaagctatgtcatccaaagattgtcctttccattctcaaatcctgtgactgggatcactcaacagcactgtgatgtattattttcaatgaggtgcctttcttaactgaccaaatgctgccttgtttggcccctaaatcaataaaatatgttaaaatttgtatcccctgttgtggcattttttttagataatctaagctagaaaaatgacattgaattctggacctggctggaaggaaaagaagccctttcttgtcgctggcagctgtgtggtagggaggtccaagtatgtgcatatgagataagcctgcaacctcttgaccttcagctcctatgcaggcttctcttgagcccagagacaaggcagcttggtctagtggagatagcactgtgcttggagttcaggggacctaggacaaatcccagccagttagttattcactgtgctcctgtttcctcagctgaaaaaggaagttggttatgccaccttcttggccttaatggcattaaatgaaatttataggaagaaggtttttgctcagtacctggcatgcaacagacattggataaatgttagttggatccagatatacacagaaagatatctgcttcctgccaggctggataactgttgaatggacacttgtccatagtctaga

SEQ ID NO: 37115 - DNA, 19264 bp, Homo sapiens
tcgtcgctccgtggagcctcctcctctcgcgagaggcgcaaggcgtggagtcgacggctggagagaagccgggagcgagcccaggcggcaggtgagagtggtgggggccagctgagcgccagagctccctcaactgtcccctcccggcccaccctcgttcccacatcctctcattttctcttcccaccccgttcctcgatgggaacgcagccacggccgccccgctgaaagccccggctggtttattcctgagaagtcggtgtgaggggccagggccggccctaacctccctggggtcctgactgggaatttctgccgttccccggctgcctcgtcccttgcgcagccggccctactctgaggccccggggacaccacgctgaggagaaacggctccgagcttgggatcggggagacctggttctgagacccggtcctaccagtagccaatcgttgtgaccttgggcctcagtccccgtgacgttttggtccctgggggttcctggcagcaaagcacgaaagccttggagtcggggggtacctgagctcacgattgtaatttcgaacctgcaacttgtccgaacccccagcgtgttgagttgatataattaagtatccagatcggaaggatgcttgttactagaacagacagctaggcctttgtccagaaggattgattgagtgggtctgggtgtggtccaggaatctcattttaaccactccctcgggtgatttgtaggatctgcaagttcgggaaaggctggtgcccttcattctgacattactgagtgccaagctctggatggctcaaggaggtcacggtctagccactaacagagcacttcacgggggtgtcatcagagaaggcttagtaggaagaagtaaacggtttttgggctaagagtaactgacgacaagagcatgtgattctgtcgattttgtgtttgcagtcagaccccatcattgtgtctgttaaagttgtgctttgcacaccccttgtcaaatctagtcttttcagaatatccggctcccccctgcacgggtgcggggaagacctcctaagccaaaacttaccccaaaggttaaaattttagatccatatttctggttttaggtaaaacactcctctccataaggatttgtttctgagttctatccatccatctttgaatgagcctttcctgtggaaactaacatttgggtatcctttctgaaaccctaattcctgacacacgccaaatgcctggagacgttcctgtttcattgttgattctcactttttaaaaaaaattctgggccaggctcatgcctgtaatcccagcactttgggaggctgcggcgtgtggatcacttgagctcaggagttcgagaccagcctgggcaacatggcgaaaccgcatctctacaaagaatacaaaaattagctgggtgtggtggtgggtgcctgtaatcccagctatttgggaggctgaggcgggagaatcgcttgaaccccggagtcggaggttgcagtgagccaagattgtgccattgcactccagcctgggcaacagagcaagactctgccaaaaaaaaaaaaaaaaaaaaaaaaaaaaaaacctctaaggtcttagtctaagtgtctagacagagcgttctcttgagggcagggaacaagtgtcttcttgtctgtctcccgtgtagggacaggcacatagtaggtttcttaggtctcatttgcaggttgtaattgtgccttcctaccattctgctaaagctggcagggaaactgaggcccagagaggggcaatggctgacttggattgcacagcaggctggttaggcccacttggtactggtcacccagaggccaggcagtgacatgtatgtgcacaagagcttcagttagttaattttatgtttttaatttaatttttttttattttgagatggagtctcactctgtctccctggctggagtgcagtggcaagatcttggtccactacaacgtccgcctcctgagttcaagcaattctgcctacctcagtctaccaagtagctgggattacaggtgcacgccaccatgcccagctaatctttgtatttttagtagagacgggttttctccatgttggccaggctggtcttgaactcctgacctcaggtgatccacttgcttcagcctcccaaagtgtgggattacaggtgtgagtcactgcacccagcccagttagttaattttaattaggattttcctttctgataactgtcagtattcttggaactcttttatgcacccgagttaaagaattttttgaactgaagcccaaacttcagtgttattttttgcttttgtcccctttcaccagaagagagaccaaatgcctcaagatttgatgcttactgggcacctaaaaaacagtctgttctcagacatccgcttttactgcctgccagtaacattttagaagggccatgcacatgtgtgtgcctcagtcagagttggagaggtacccaacaagctcagtgacgtgacaatgatgctacctcttattatgaaactgggtcctgactcacagcttctaagcatgttgtcttagatactggacactttttccttacgggtttttttgttttaaaagacaaattcacaacagcaacataaaattctgatgatgaaaagtatcacactttggctttagatatttaaaagaatattatctcctattttatttgaaaaatgctgactgaaagtagtggctatgcctgttttttgagggttgatgtttaatgaatgtagttcataagctcctcttgccataagattagttttgggagatacggaacgcaaagcattttacattcttctaatttactgacacagtcccactggagtactgtccaaagatcataaagcgcagctcttacactaattctaacaatgaaaaagcaggttcccatcactccctggagtgtcctcctatcaggcatggctaaggagaagcagggttttataggactgcttgaagcaaaggcaggtaaactagccacagagaagtggaagcccagagttctagaacattactttacagagctctgtgtgccagagcctgccgagtgccttgcttatttttatcttctcatttgcttcttacagcagcctcgcaaaatatgaggtttttatccctactttactgatgagaaaacaaattcaaagagtctagtaacttatccatggtcatgtgcccataagatccagtggtaaatagaaccctaggtcatctgcactcaaaacctgtgccctataaaagcctccgtaaatgttgctgaaaaggtctagacatttggcttgttttctctagctaataagtaagcttttgcccttcgtttcctttatgagggtttttctgtaagtacagtgcaaagttgtggtagtctagtaggtggggtctttttcatccctttctattgtcccaaggaagaacctattccaacatcattctagaaacaggtcattttttttttcttataacttaatgcccagcaatccatactcccatcttgcctggctggttcttaaatgggagattgatcccatattgcacaccttgaagtttgcaagggttcttcctcgacatcatgtgccagttaaaagtttcagttcttgattgtgtgctgtttagggatttaaaaaccaaaattggccaggcacggtggctcatgtctgtaatcccagcactttgggaggccgaggtgggcagatcacttgaggtcaggagtttgagaatagcctggccaacaactctgttgctactaaaaatacagaaattagccaggtgtggtggcgtccacctgtaattccagctacttgggaggctgaggcatgagaattgcttgaacgctgaaggcggaggttgcactgagttgagattgtgccactgcattccagcctgggtgacggagtgagactctgtctcaaaaaacagaacaaacaaacaaaaacaccacagaattagctggatgccgtggctcacacctgtaatctcatcactttgggaggctgaggcgggtggatcacctgaggctgggagttcaagaccagcctgaccaacatggagaaaccccgtctactaaaaaaatacaaaagtagacgggcatggtggtgcacgcctgtaatcccagctactcaggaaactgaggcgtgagaatcgcttgaacccgggaggcagaggttgtggtgagccaagattacactccagcctggacaacaagagtgaaactctgtcctccccaccacccccgcaaaaaaaaaaaaaaaacaaaaccagaattattgtctttttaattatttttttttctttttttttttccatttttacttgccctctgtcattaaggaaaacagagttaaatgactaaagaatcctacttgtctgataacacttagcatccttttaggggcgcttgcagttggatcatatggaaggagctagataaaaggcatgatgaggggaaaatgcaaagggttttcatagaataaggagggatcactttggaatggtgggagatacaggtagagccagattatggaggccgtggatccagaaggccaattgacatcagtctagcaaataaaacctttagtaactcctttaggaaaagagtgacaaatcaaagtgctatagtatttaatgcttgagtgttaaatatttaacatcctgagtatgttttgtaggcaaagaggagagttacttgaagtgaactttggtttttttgagacagggtctggaatgtagtggcacaatcttggctcactgcagcctcaacctcctgggctcaagcagtcctaccacctcaggccctctcctccaccccagtagctgggactacataagattactacataagactaccatagattctgtcaccacgcccagctaatttttgtatttttagtagagatggggtttcaccacgtcgcccaggctggtcttgaactcctggactcaagggatccacctgcctcgccttcccaaggtgctgggataataggcatgagccaccacgcccagctataattttttattttttatttatttatttattttgagacggagtctcgctctgtcaccaggctggagtgcagcggcacgatcttggctcactgcaacctccatctcccaggttcaagcgattctccttcctcagcctcgtgagtagctgggattacaggcatgcaccaccacacccagctaatttttgtatttttagtagagatggggtttcaccatgttggccaggctggtctcaaactcctgggctcaggcaattcgcctggctcggcttcctaaagtgctgaaattacaggtgtgagccactgtgcccagccgaagtcaacattttaaaagaaacaagagtgtagtgacttcgcttgaattcagtctgtatctgtggtggcatgattgccactgagttggccacctctgcagaagtctgaagtgttcaacataaaactaatccattttgactcctctaccacaaattgtttgtttcatttatttgagctattttaaattggaaactggtgtcattaatgtttaagaaagaaaggagaaactgagtagagtactatctcttgacctaatttctttgtgagcatattatatactcacctaagtatcaagtggaagaggaagttgatccctggagggaaatttccataggttaaaagcatgggatttacagtcagatgaatttgggttcaaatcccagctctcactttatccatgtagcactcactagctgtgtgacttgggcaacgtaaattgcctcagtttccagactgtaaaatggtaataatatctagtttaaggctgttctgagattcagttgagataatgtttagaagatgctttgaacaatgtagctaatattaaatggtacagacatagtaagtattcttgatcactgcagattcagtggaattaaattttcatattttgatgaaagggaaaataaccagtattcagtttgcaaatttaaatgtgttgtttctttttaaaaacattgaatctgtggttgggttatttctgtcaatttatttgccttccttgccaagtcacactttgcctaattgatgtcctgtgtgttttccattccgttcatgctgaattatcttaggtcaaagaggaaatcatctttctgcctccaaccttcttacttgcctctaatcccctttcttgactcttccaagtcaggattctcaccaaggaagctatctgccttctttgggaatgttgggcttatgaagacttgagataatggggttcatgtattcagactctttagcatatacagtagagtttctaatgttgtcagcattccctagtgggcggttacaagttaggttgggattctaatcatattttatgatatctcacagattaaattgcactttgtctctgcccagtcttgattcccttttggccagcagtttttaggtctgtcagtactgcactgcaagaatggcagattttgggatctctgctggccagtttgtggcagtggtctgggataagtcatccccagtggaggctctgaaaggtctggtggataagcttcaagcgttaaccggcaatgagggccgcgtgtctgtggaaaacatcaagcagctgttgcaatgtaagtacccacccacgttgtctttatgaggctggaggggtttccatgggagtgttgcatttctgtggttccttgatatctgagttttcatttagggtggcatgtgatagtggtggctggtcaccctgttgtttttcagttgagatatatcggaggaaccacccccaataattcaacgtaggttcttttctattttccctaagtgtcggctggtctgagaaataaagggaaagagtacaaaagagagaaattttaaagctgggtgtccgggggagacatcacatgtcggcgggttccgtgatgcccctcaagccgcaaaaccagcaagtttttattagtgattttcaaaggggagggagtgtacgaatagggtgtgggtcacagagatcacatgcttcacaaggcaataaaataaggcaaacgggggcagagcgagatcacaggactggggcgaaattaaaattgctaataaagtttcgggcacgcattgtcatagataacatcttatcaggagacagggtttgaaagcagacagctggtctgactaaaatttactgggtgggaatttcctcgtcctaacaggcctgggagtgctacgggagaccagggcttatttcatcccttatctgcaaccatataagacagacatcccagagtggccattttagagacctccccctaggaacgcattctctttctcagggctgttccttgctgagaaaaagaattcagtgatatttctcctattcacttttgtaagaagagaaatatggctctgttccgcctggctctcaggcagtcagacctgatggttatctcccttgttccctgaacatcgctgttatcctgttcttttttcaaggtgcgcagatgtcgtattgtttaaatgcacatgctttatgaacaatttgtgcagttaacgcaatcatcacagggttctgaggcaacatacatcctcagcttatgaagatgacgggattaagagattaaagtaaagacaggcataggaaatcacaagagtattgactgaggaagtgataaatgtccatgaaatcttcacaatttatattcagagattgcagtaaagacaggcgtaagaaattataaaagtattaatttggggaactaataaatgttcatgaaatcttcacaatttgtgtacttttgccatggcttcagccggtccctccgtttggggtccctcacttcctgcagcagagcttaggagtgtagttgatgatttccataagtatgttctttcttggtagctattccatgtttttttaaaacacttactattcatccagcttcttggatggatatcgagtggtgtccattctctcagggtgaggtctgtagcttttgttgggggttggaagggaccaggagattatcccaggctcaggagattgctaattagagtcctcttcttttcagctgcccacaaagaatccagctttgacattattttgtcaggtttagtcccaggaagcaccactctgcacagtgctgagattttggctgaaatcgcccggatccttcggcctggtggatgtctttttctgaaggagccagtagagacagctgtaggtaaggagatcttcacttggaaaacatgtttgacagggttgagtcttagagtatgtgtgctgcatctccgtgagcaggaggtatcattgggagatcagtattcctgtagcaaaaccttttccttggggataaattattgttaaaatctgaagcaacatatctggagaaattgtaatctttggctgactcattatgtaataaaatagaaggaaactgccatctaaaaatgggtccttttgcaggtgaataaactttgatatgttcataatatggaaagtgatgcagcaataaaaatgaactagctaactatatgtacatcagcttggatggatatcaagggaagtagctgagtgaaaaaagccaatctcaaaaggctctgtactgtacaaatccattcatatgctcgaaataacaaaattgtggcggtggagatcagagtttgccagaggttagaagtgggaggaaagggttggtggagctataaaggggtagtatgagggttcctgtggtgatagaacaattctgtgttctgaatgtcgtggtggttacacaaatctacacatataataaaattacatagaactatatagcccccttctgccaaacgagtacatataaaagaaatgaaatctgaaaaagttatgtggaccatcaatatcaatttcccggtcttcatatcatgctataattgggtaagatgttaactgtggggagggacgaagtgaagacctccttaatatacagaacttttttttgttttttccaacttcctgtgaatctatagttatttcaaaattaaaagtttaaaaatagtggccgaaccctgggaatgatgtggtaattattgattcatgtgaaactaatgacagtgttcatgaagtaaaaacttttttgatcggtggtatagctgtcagagtgattcaagtctggatttttaatatttttcactagactttcagtcaaaacataaccatttcatcaaatagaataatagaaatgaaagtattttgaaatgtataaaggtgttcattgtttatttggaaatagaactttgtgttatgtgtagtataaatcagcattctttgctgggaatttaaaccttacatgactaaatgtagtgtcttagaactatacagagataaaaaaggaactattcagaaggaatacttgtgtttctgtgcactttgcagttcataagcctcttttcatagtcattatctcacaacctctggaaggggtttcaagaagcagagagtgataaaaaaacaataataatggaattataacatttaagagcttaggtaaaaacacttcgaacaacaaaaaggatttgtcaaattaaaatagtatcgctatggccaggcacagtggctcacacctgtaatcccggcagtttgagaggctggggcaggcaggttgcttgagtccaggagttcgagaccagcctgggcaacatggcgaaaccccgtctctacaaaaaatacaaaaattagcccagtgtggtagtgcacacctataaccccagctacttggtgggggctgaggcaggaagattgcttgaacctgggaggtcgaggctgcaatgagctgagatcatgccaccgcactccagcctgggtgacaaagtgagaccctgtctcaaaaataataataataataataataataaaataatatcactaaaatatatatacaattgtcctcatcttacaatggagttacatcctgataaatactattaagatgaaaatgcatgtaattcatctaacctactaaacacaattgcttaggttagcctagcctaccttaaacacgcttaggacacttgcgttagcctacagttgggcagaatcatctaacacaaagcctgtttataataaagtgcttagtatctcatgtaatttactgaaaactgaagtatacagtttctactgaatgagtattactttcatactatcataaaagttgaaaaattataggtagaaccatcattaagtcaaggaccatctgtacattaaacagaataggttattattttttttttgttttttctttgagatcaagtctcactctgttgtgcaggcaagagtgcagtggtgcaatctcggctcactgcaacctccgcctcccaggttcaagcgattctcgtgccttagcttcccaagtaggtgggattacaggcgtgtgccaccacgcctggctattttttttgtgtgtatttttagtagagacgggattttgctatgttggccccagattggtcttgaactcctggccccaagtgatctgtccacctcagcctcccaaagtgctgggattacagacatgagccaccacgcccacctggttattattgtttgaatgcctgcgaacccatataggattgagcctttattatttttcctactttgaactataaagctattaattgggattttccttttggcagataacaatagcaaagtgaagacagcatctaagctgtgttcagccctgactctttctggtcttgtggaagtgaaagaggtacgtttgtagacaactttctttgctgccctgcaggtgaggtaatcagtattgcttagaactaggaaacaagaaatgctgtgcatgtaagatacatgatgcttcaaaggacaaaacttgggagaatcggccgggtgtggtggctcacgtctgtaatcccagcactttgggaggccgaggtgggtggatcacgagctcaggagatcgagaccatcctggctaacacagtgaaaccccgtctctactaaaaatacaaaaaaattagtcgggcctggtggcagacgcctgtagtcccagccactcaggaggctgaggcaggagaatggcgtcaacctgagaggcggagcttgcagtgagccgagatcacgccactgccctccagcctgggcgacagagcgagactctgtctcaaaaaaaacaaaacaaaacaaaaaaaaacttttgagaataaccaacttcaaagagactcagcttggcccatgtgggctggggcttgttcttgtctccttggtactagtttagtggtggtgacagctgaggggcatgagcagcagctctgctgcttccaacacccacctctcagtagacccgaatcctaggcctgggtgaacactgccatctagttcagcctcacatttttggtgggaggctggaataggttagagggcaaagttccttttctgacaattcagtggaaatgtttaaattaagcagaagtatttatatttctacactctttgatcttaaaattttcttggatgtgggagaggtaaatgttacagcatgatagctgttgtgcctgttatttcttacataatgtagggccttaaattctttgttttttaattttttttcttgtttttggagacagtctcgctctgttgcccaggctggagtgcagtgacacgatctctgcttactgcatcatccgcctcctgggttcaagcaattctcctgcctgagcctcccgagtagctgggattacaggcgtgcgccaccacacctggctaattttttgtatttttagtacagatggggtttcgctatgttggccaggccgttctctaactcctgacctcaggtgatctacccaccttggccttccaaagtgctggtattacaggcgtgagccaggccttagattctttatgccaggccttagattctttatgccaaccctttcttatttttccttttagcttaaggttttctgtgcttgattttaaaataaggaatgtgtattaggccattcttctgttcctataaaggaatacctaagactgaataatttataaagacaagaggtttaattggctcactgttctgcagactgtacaggaagcacgggcctgcaactgcttggcttctagggaggcctcaatgaacttttactcgtggcagaaggtgaagcaggagcaggcacatcacatggcaaaagcaggatcaagaaagagaggaagagtcggggtggggaaggtgccatactttacaaccaccacatctcatgagaattcagatggtgctaaaccattcatgagaaatctgcccccatgatccagtcacctctcaccaggccccacctccaacattggggattacagttcaacatgagatttagaggggacacatatccaaactatatcagactcctcataaaaattcactttacaccaaagcatacagaatataaagtgacatcccacttcttgctcacacttccctccccagaggaagccaccaatgcctttttgtatgtccgttcagaccttttcctatgtatttacaagcatctacatgcacatacttttttaaaaatgtaaataagatcataagtatacattgttcaatcaccttttttcccacccttagatatcatagacacttacctacttcagtgtatttcccttcattcatattaatgatgtaatagtattccatacaatagatggactgtgatttatgtaaccagtctataattattggacatagaggtggcaccctgaccctttttttctacctttactctctgctactttatcccaaggaacatagaaaggattttcctccccctttttcttttgggatataaatttctgctgtcttcattgtgggcattctttcctgttacacagtaggaccacatctggttcattttcataattgtattacatcccaaataactagtatatgcctcatccctaatgttttttaagtacttttacattttccaaggggtaggctccaagtaaacatgcagacaaaggttatactctagggttctgatcagtgagaaactgaatgtgaggcataaagtgttatctgttaccatccactgttacatccttaatgcacagaaatgagtctttgactcctgtgtaggtagacatagtaaaccattttacagaggagggtgaactaatccttttgatgtcttgaattctagctgcagcgggagcccctaacccctgaggaagtacagtctgttcgagaacaccttggtcatgaaagtgacaacctgctgtttgttcagatcacaggcaaaaaaccaaactttgaagtgggttcttctaggcagcttaagctttccatcaccaagaagtcttctccttcaggtaaggctggcctagggacattcttctgtttgaatgggcttagagggacatgttagaaattgagccagcaataaatgagatggtgatatttttagaggattagtcctttgatttctgccatttccacaaagaagaatacttaatgtactattatcatgggcatattaggatccaaaactgaaataatacataggtattatctagttcagctccttcttctgcaccagaagataccgaggcctcctaattttacaggactgagtcacacagtttaattaatgaggtccttccaggtcccagaattaacgtttctcctcagaagacctcacagtgtagtggtaatggtgtatgagagtgccctgttcctgttctcatgtgcttttttccccatgccaggaaaatcagctgttcttactttgaggatgctaagacacttataaaactatatttcttctgactagaaaattgtgtacaagcacacgcgtgcacgcacgcgcacgcacacacacacacacacacagctccatcctcatccttcctatccctatttttaaatgcctgaattgacccagctgtgaggtatgcagacattaacagatatttactggtacattcccacttgtacggttttgactgtctaacctaaatcttcaagaaatcctttggaatctaacctttcgattcatggttccagaatgggtaggaatagcttagaacagttggccttgtggaaggtatgagcatccagctgtgacaatgatcactagagggtactcttaccccaagggcctgcgaggatttgcccacactgcatccgagcctcagctctctgcctcttccttgcattctcctgactagacagagaaccaggaagtgtgaggtttgtctgccactgatggtgttaccttgccaccagcagctctagagcctattttcttgtatgtagcaggtttacatgaggctaaagctctgctatttttgaaggttttgacacatttctcatttaatcctcaaaacacctgcagtaacataggaagtacaatttaacttcatgttatagaatggaaactaaggtatcgaggaggaagcaatatggaatggaggttaaaagcatcagacaggctttgcagcctgtggaaccagcctaagtgtctaaacctgtttcctcagcggtaaaagtaggatgacagatagttacctcataaggttgtcagcagaattaagttagataatgtatataagtgcttaatatggtgcctggtgcaaagcaagagcttagcaaatggtgacttctgtaactatcagcaagtggttggcccaaggtcagacctctcagaggggtagagctggactgtgaacccacatcttctgcctcccaggccagtgtgttctcttctacacagcaggaagcatttatgtatgtttgtaattaatagtttctgactgtgtttatggagttttttcttttattgcttggactcagtgaaacctgctgtggaccctgctgctgccaagctgtggaccctctcagccaacgatatggaggacgacagcatggtgagctggcagcattgtcacttgattgctttctttcaggccccagtttgggtgtgaacagctatagtgacctttctggacttgtaggtgtgaacgtatttaaagcccagatttgtgactatgcctgtcacatctttgatttagaaggaaactccatgttggtggctttttttttggagacagtctcgctctcttgcccaagctggagtgcaatggcacaatctcggcttactgcaatctctgctcccgggttcaagcgattctcatgtttcagcctcccaagtagctatgattacaggcatgtgccaccacacctggccaatttttgcgtttttagcagagacggggtttcaccatgttggccagactggtcgcaaaactcctgacctcaagtgatctgcccgcctcggcctcccaaagtgctgggattacaggtgtgagccactgcgcttggccatgttggtggcattttaaattttttagcatctctttttccccacataatttcttgttctcacttcatacgatatgttgaaaactcttgtgggcatgtgtaaacctgaaaagattttgtcagcttaaatagttttattggcacctttgggcaagttgctgactgttccatgctttaaaaagcactattttctatctttggccatgtctgtaataaagttcttcatttctacacctctactattgaagttagagtagtgagcaaaataagtgaggttcatgctctcatagggtttacagactaagtgtctacacatttacaaagaattacataaaggtatatataattatttgatttttatctgggattatgtaaaagatattttattccctttttcacgtgactcttcataaacacttctctctttctctgttctgcctgttccctcccttctccccactcctgcccccaacccccaacatgtgtatattctctacacattgctggccagtcatacagctttttctcatgtaaatttgtttctaattcctttgcatcctagtgcatcttctgtggatgtagtttaactcaccgttggcctcttgagcatgtggtcaggttgaacatgatgatcaaccaaaaggaggacagggtggacaccttctttaccctggactccaagtttcctctcgaagcctgcagtcactttagcttttcattagcagagaccacgactgtatcactcattgctttgaacactctccaggatctcattgactcagatgagctgctggatccagaagatttgaagaagccagatccagcttccctgcgggctgcttcttgtggggaagggaaaaagaggaaggcctgtaagaactggtgagtgctggggtgactggagcctgccatgctgcctccagtggcttcatgctgaagacatcgcggtgctgtactatttttagaacatacattttccaggctgggcaacacagggagaccatctctgcaaataattaaaaaaaaaaaaaaattagccaggcatggtggtatgtacctgtggtcccagctacttgggaggcaaaggcaggaggatcacttgagcctgggaggtcgaggctgcagtgagccgtaattgtgccatgtatctaatttcactctccctcaaaaccctaccagtaagccactattgtgccactgcactccagcatgggcatcagagcgagaccttggtgtcttcacatttgtttttataaatggatgggaaggattgtagaaagttaatcagtgatgttcatcatcagcgttaatcatcagtgttttttaaatgtaaaagctgccagcatttacaaatcaggaaatttcaagtgaaaacacagatttttttcccttctgttcttgaatttggaaaatatggcaatctgggtccactttccccagcatgataaccagctgaagcttgagtagtggctgccctctgtagacagagcacacacggtacttccctcatcctcctcccacttctgtctccctcagcagcctctcatattgctgctgtctgcctggcctataggcttctgagttatgacactggtgtgaagagaaaaggcttaaagcacattttggcactgttaggatttgggatttctgggtggtgacaattctcgttcattagttactgattttcccgcagcacctgtggccttgccgaagaactggaaaaagagaagtcaagggaacagatgagctcccaacccaagtcagcttgtggaaacgtaaatatcaggatcattcctcagcattcacaaacccccagggggattagaccttcttctaaactaaacacagacaagctccacctcaaatattttagtaacagacgaatgcgtgagcacacgaacgtaggtagtaatggggagagaggctgtctcctgagagtgagagtgggttagcgtgcttgtgctggtcagggagggtcttgttgctttttatttttggcccatttctttgtacttcagagtgggacctgatggttagacagttagctaaagttggttgtgttttgaactgcatagaatatagaactatggccgggcgcagtggctcacgtgtgtaattccagctatgccagaggctgaggcgggagaatcacttgaacctgggaggtggagtgagctgagatcgcaccactgcactccagcctgggtgacagagggagactccatctcaaaaaaaaaaaaaggccgggtgcggtggctcacgcctgtaatcccagcactttgggaggccaaggagggcggatcacgaggtcaggagatcgagaccatcctggctaacatggtgaaaccccgtctctactaaaaatacaaaaaaatttgccgggcatggtagcgggcgcctgtagtcccagctacttgggaggctgaggcaggagaatggcgggaacccaggaggcgaagcttgcagtgagctgagatcgcgccactgcactccagcctgggtgacagagggagactccatctcaaaaacaaaaaaaaaagaactatggcctcctagggaacttttcatgactatagtttttcacgaaaccagaaatcttgaaaactcttagtattttggtctcaattggacctgcaaacatagccatttccttcaggccactgtggccacattatgaaattaggcatttctttcttctggctggtatgcctgggataagctgacccttggcttccccattctctctctccagtgctacctgggcgatgccttccgctgtgccagctgcccctaccttgggatgccagccttcaaacctggggaaaaggtgcttctgagtgatagcaatcttcatgatgcctaggaggttcctgacatgggacccatctgctcctccagccaactcctgtccctcacatcccaccatggtggctcctcccacctcctctggatttgttcactctgagatctgtttgcagagtgggtgcttagcagacagagtgaagctggctggggggcacagtggtgtgtagtgctgctgtgtatcaaaagaccaaggtattatgggacctggtttcagaatgggatgggtttcttcacctcatgttaagagaagggagtgtgtcctgaagaagcccttcttctgatgttaaaatgctgaccagaacgctcttgagcccaggcatcgttgagcattaacactctgtgacagagctgcagacccctgccttgagtctcatctcagcaatgctgccaccctcttgtctttcagagttgttagtttactccattctttgtgacacgagtcaagtggctcacaacctcctcagggcaccagaggactcactcactggttgctgtgatgatatccagtgtccctctgcccccttccatccccaaccacatttgactgtagcattgcatctgtgtcctgttgtcatttatgttaaccttcaggtattaaacttgctgcatatcttgacatatcttgagattctgcatgtcttgtaaagagaggggatgtgcatttgtgtgtgatgttggatagtcatccacgctcagtttggaccattggaggaacttagtgtcacgcacaaatggggctattcctacgcttagaatagggcttgtctgcccactttagaagagtccaggttggtgagcatttagagggaagcagggcagaactctgaacgacaatacgtctctctgagcagagacccctttgttcttgttatccacccatatggacttggaatcaatcttgccaaatatttggagagattgtgtggatttaagagacctggatttttatattttaccagtaaataaaagttttcattgatatctgtccttgaaacttga

SEQ ID NO: 37116 - DNA, 2423 bp, Homo sapiens
agcactctgcgcgcccgctcttctgctgctgtttgtctacttcctcctgcttccccgccgccgccgccgccatcatgagggaaatcgtgcacttgcaggccgggcagtgcggcaaccaaatcggcgccaaggtaagttgccggggcgctggggccaggcgggcctgccgggcggtgtgggcgggcggccggggaagatggcggcagcagcggccgggcggcgcccccgcattgcggccgccgggccccctccgcggggaattggccgagccgggcgaccgaagcccccaggaacccggcggccagggcgcgcggggcgggggaggggcggggagggccgggctgccgcgcccgtccggggcggggctgcctccctgcgcaccggccgcggtgactcagccccggcccgcccgggcccgcccgcgtcccttgtagttttgggaggtgatcagcgatgagcacggcatcgaccccacgggcacctaccacggggacagcgacctgcagctggaacgcatcaacgtgtactacaatgaggccaccggtgaggccccggccccttccccgaccgccctccggggaccccgcggcccctgccttggctgacgccctcccgtccccgcaggcggcaagtacgtgccccgcgccgtgctcgtggatctggagcccggcaccatggactccgtgcgctcggggcccttcgggcagatcttccggccggacaacttcgttttcggtgagccgtggctggggactgggcggcggctcaaaggtcaaggggctgctccaagggcaccgccgtgggaactgcgcagccggggcccctggacgccctcctcttctctgagccactcaatcccctctactaaatcggctttgggagcaaggtccagctgtctgccgaggcgaggagccgccacacacgtaatctccctgcagggagctgagctggggcagtggctgttcctctgtccttgggaattggcagtggcccccccggggaggggtttgttaagctgtcaggtttggcccctgacttaattcgtagcagggcaggctgccgtcttttggctttgaagggtccgtttgctctacctccagggtgaattctgtggtcagctcacaccatgtcactcggcttttttcgcatggcggtgaccagtagtgctgtctacctggctgacaaatgattagctgtgttctctcacaggtcagagtggtgctgggaacaactgggccaaggggcactacacagaaggcgcggagctggtggactcggtgctggatgttgtgagaaaggaggctgagagctgtgactgcctgcagggtttccagctgacccactccctgggtggggggactgggtctgggatgggtaccctcctcatcagcaagatccgggaggagtacccagacaggatcatgaacacgtttagtgtggtgccttcgcccaaagtgtcagacacagtggtggagccctacaacgccaccctctcagtccaccagctcgtagaaaacacagacgagacctactgcattgataacgaagctctctacgacatttgcttcagaaccctaaagctgaccacgcccacctatggtgacctgaaccacctggtgtctgctaccatgagtggggtcaccacctgcctgcgcttcccaggccagctcaatgctgacctgcggaagctggctgtgaacatggtcccgtttccccggctgcacttcttcatgcccggctttgccccactgaccagccggggcagccagcagtaccgggcgctgaccgtgcccgagctcacccagcagatgtttgatgccaagaacatgatggctgcctgcgacccccgccatggccgctacctgacggttgccgccgtgttcaggggccgcatgtccatgaaggaggtggatgagcaaatgcttaatgtccaaaacaaaaacagcagctattttgttgagtggatccccaacaatgtgaaaacggctgtctgtgacatcccacctcgggggctaaaaatgtccgccaccttcattggcaacagcacggccatccaggagctgttcaagcgcatctccgagcagttcacggccatgttccggcgcaaggccttcctgcactggtacacgggcgagggcatggacgagatggagttcaccgaggccgagagcaacatgaatgacctggtgtccgagtaccagcagtaccaggatgccacagccgaggaggagggcgagttcgaggaggaggctgaggaggaggtggcctagagccttcagtcactggggaaagcagggaagcagtgtgaactctttattcactcccagcctgtcctgtggcctgtcccactgtgtgcacttgctgttttccctgtccacatccatgctgtacagacaccaccattaaagcattttcatagtgtg

SEQ ID NO: 37117 - DNA, 5370 bp, Homo sapiens
gctgggcgcgggcggcggcggcccggaggagaacgggcggagggcgcgggccgaccgggcgcaccgaccatggcctccaaatgccccaagtgcgacaagaccgtgtacttcggtgagtgcgtgcccgctcccggcccgctcggtgcatcccgccgcccttcgcggccagtcccgcgccgcagagccgcggcgtaactcggggtgcgcccggccccggccccggaccgaggatgcgcgtcccggaggctggctggccgcgctgcccaagcggctaaagccaaagggtggggctgcgcgaaagcgggggcggtcacgcccgaaccccgaagcggcttgtgggggcggggcagggaccacccgggcggggcttgtggtgccccgggatgaggccagtgtttgggggagcgctcggggatccgcggacgcatcccggttcctcggacggcgccgggcggggcggggcagggcgtggctgtacgccccgggtgcgtcccgcgcgctcccgtgggcctgggccctttctcctggaccccctacacccgcttcccccgggaacaagtggccgggaacagtgacccccagctcccactccgggctccgctgagctgggctgggccaggtttggactctgtcgggattcagtccaagcgggggcgaccttggcctctgcctcctgcttgtcccgacgcattcccttggcgccagttcccccaggagtttcacacgggggtagggtgggggcgggtgtgacacgcgagttcccgcgaacgtgagagggaccttgtgctcaagcagcccaggtgtccaggatccctgcctcctcaaggtcagaacagccctggacaggatgcaggtggtggcgggaagagggatgtctcgcaaggcggccctcggtctagcccctccggcaggcgcgctccccccgtctgggcttactcactctctgggcctgggtgcgcccttcctacccccttcctcctggctgattcgctgcccagctttctccagggtggtaaggtccctgcccacctacccaccagctgctgcacgaaggggggcagacttagtgaagcagagaggagggccgggaccaacagggcgcctgccctggtcgccccatacccagaatgcggccaggctgcagggaaggccgccactgggcttccccggctcacaggctggagggggttgaggggaggttgtattttgcccgtcccagaggggagggaccggatttggcctggagtgcttctggcgtggctgggagccgaggggcttccggctgcctctcctggagcccgctcagccctcagtctctgtcccagcgagggctgtctctgtaaggcttagggtgggagacggtccccagggcccttctgcagtccaactgcccatgactttaccccaggccgggccaggccagcctggggctctccagggtctcggccaacagtcctgtggacagcccggaaaggcctgcctgcctggcccgcccagcctctcagcggaaaacaaaggcgcttcagacccggctggcttctgtcctgcctgggaggcactgtgagggcgagggtccagaatcctgcccaccctcacaccaggctgcccccgcagctcatacctgagtagaacccaggctgggatgtcggagcacattgaggaggccaccccagagcccatgcagccagggtgggcagctggttttcttctgagccattagacccaatcgattctgtgttcccaactcggacccgtaatgtgtggccattgacccacccagtgggtctgagggccagttccctgcccccacttggcccacgtcccagagctggccagagcacagtgctggcagccctgggctgcagctgccacggccgatagccaccgagacttccttgctgctgctgggacacgcctgcccaccgtgcagccagcccctgcctgccctggtgtgtcccagcttccttgagtggagtggttctggtcagagggctctaagctggtgcagccttgtggttgggctggtgtcctggaggctggccctggccatgcccagagggttgtaccagggccacggagagccagtattcacagccctctacctagtaggccacctgggggatcccatctcactgccaggagcagcacccttgggcctctcagagtgggcttcgccctagccagatgcccctccccgatatctgccagacaaagggggctgggccacttgctgagaaagggagctgggagagccactggtcctcggccacctgaggggcttggccagattctgccgggcagggtgggcccagcctgcatgctccctccccccagggcctgcagcttgtccccttcccttcagaattccggctctgctgggcccttcctgcccctccccacctcttcctgcctggctccctagggaggcccctgcttccatccactgggaagcagtccagtagccccagtgtgggggtgggaggcagtggcagagggtcccggaccctcagcagctgccctcagatcttccatgccagtggcagccaggggcattacggcggggggagagctcagggtttaggacgaggaatccacagacagatgagggtcccgcctggaggacccacggggacggggcctggccttcccatgagggagctggaggttctggggctgcacctttgactcagcagcggggtgctgccagccccatcagggcccagttggtggggatcaggggcgtgtcagtgcgaggcaggtgtgagagggagagcagcatgtgttgaagcaggtgcactgcagaggcaggtgtgtgagtgtaagagaagtgtttgagggaatgacaggtgggggagatgcatatgtgtggggggaggcaggtgtgtggggggaagcgggtgtgtgtctgaggaagcgggtgtgtgtggggggaagcgggtgtgtggaggcgggcgtgtgggggaggcgggtgtgtgtgtgagaggaaggtgtgtgggaggaggcagatttgtggggggaggcgggcgtgtgggggaggcgggtgtgaggcgggtgtccgggaggcaggtgttggagcgcgggcaggtgttggagcgcgggcaggtgttggagcgcgggcaggtgttggagcgcgggcaggtgttggagcgcgggcaggctcgagcacaggccccttcaccgcaggcactgaggggactaacagggcagccccgggccccttctcaaaggcggctctagcggggttccagggctgggggcgctgagacccagagggagaacagggcctgggggcgacgggctcctccgggtctcagaaggaggggcagggcccgccaggtggaaggaaggcgcctgggagacctcctgaaagtggggacccccggagcgcgtgggggtggtggctgccaggtgggggcggagggggtgcggggcgcgccccggccctgacccccctgccgcccctcccgctcagccgagaaggtgagctccctggggaaggactggcacaagttctgcctcaagtgcgagcgctgcagcaagacgctgacgcccgggggccacgccgaggtgagccccactgcgcggcgcgggcgggggcgggggtcgcgactcccgccaccctcaggcagggtcctgacccgcgcccctctgcgcagcatgacgggaagccgttctgccacaagccgtgctacgccaccctgttcggacccaaaggtgagctccggctgccctcggcctgccctgggacctgctgggaggggcgtggcgctggcgctggggagggctgggggtcccggccgccgtggatccccgcccagagtccctgccaccctggaaagcctagtgccccccagtccccagcgggccgttttctgagatgcccggtggccgcggcccccaccccacgtacccccgccccacgtacccccacccgcaggcgtgaacatcgggggcgcgggctcctacatctacgagaagcccctggcggaggggccgcaggtcaccggccccatcgaggtccccgcggcccgagcagaggagcggaaggcgagcggccccccgaaggggcccagcagaggtgggctgggcgcgggctggggctgggggttgtgggcacgcgcgggctggggctgggggttgtgggcacccccggccccgccccgccctgactcgtgcgccccacagcctccagtgtcaccactttcaccggggagcccaacacgtgcccgcgctgcagcaagaaggtgtacttcggtgagtgcgcgcccgggccccggacccccgcccccgcccccgccccggggctcggcctcactcctccccctttccagctgagaaggtgacgtctctgggcaaggattggcaccggccctgcctgcgctgcgagcgctgcgggaagacactgacccccggcgggcacgcggaggtgaggggagtgcaacggggcttgggggccgggcaggggcgcggggtcggggggatgagggtgagaggcgcgcctagaggggatggggggtggtgcttctgggagctgcgctgccctctcccccacggcgagccggcctgcacgttctggaagcctccaggtgatgggtcgggggagtctgtggactcctccctcagcacccaccttctgccccagcacgacggccagccctactgccacaagccctgctatggaatcctcttcggacccaagggtgagtgtagccagggtggtccacgatgtcttccctgccctccccttccctccactgttcccccgacccaccccagcggcctccctccacaggagtgaacaccggtgcggtgggcagctacatctatgaccgggaccccgaaggcaaggtccagccctaggctacagcggctctcatgatgtgggctcacctgcgccccagaccctgcaggggcccccctgcttggctctgctgggagagtgctcagccgcccagtcctgcctgcaagcccagggcgagtattggaggaggggcagccacgggcagagcaccatgcccatccccgagtctctggtgtgtctgccccctctggcatcctctgggcgtcccatgatcccttctgtgtctgcgtgtccgaatccccgtgtgaccctgtcccagcattttcccgccgaccctgcgtgtccccgtggcgctgtccgctctccctctcctgctgcccacccacctgccagtgttatttatgctcccttcgtgggtgatggccacgccctcaccatgtccctggcagagggcttccctccgggatcccctgcctggtgcccacactgcctcgcaagcgctcgccaccctcacgtggctcacctgctgttgagccttgtgctgtcaataaacggtttgaggattgcag

SEQ ID NO: 37118 - DNA, 3004 bp, Homo sapiens
tagttccgtcgcagccgggatttgggtcgcagttcttgtttgtggatcgctgtgatcgtcacttggtgagtagcgggctgctgggctggccggggctttcgtggccgccgggccgctcggtgggacggaggcgtgtggagagaccgccaagggctgtagtctgggtccgcgagcaaggttgccctgaactgggggttggggggagcgcagcaaaatggcggctgttcccgagtcttgaatggaagacgcttgtgaggcgggctgtgaggtcgttgaaacaaggtggggggcatggtgggcggcaagaacccaaggtcttgaggccttcgctaatgcgggaaagctcttattcgggtgagatgggctggggcaccatctggggaccctgacgtgaagtttgtcactgactggagaactcggtttgtcgtctgttgcgggggcggcagttatggcggtgccgttgggcagtgcacccgtacctttgggagcgcgcgccctcgtcgtgtcgtgacgtcacccgttctgttggcttataatgcagggtggggccacctgccggtaggtgtgcggtaggcttttctccgtcgcaggacgcagggttcgggcctagggtaggctctcctgaatcgacaggcgccggacctctggtgaggggagggataagtgaggcgtcagtttctctggtcggttttatgtacctatcttcttaagtagctgaagctccggttttgaactatgcgctcggggttggcgagtgtgttttgtgaagttttttaggcaccttttgaaatgtaatcatttgggtcaatatgtaattttcagtgttagactagtaaattgtccgctaaattctggccgtttttggcttttttgttagacaatgcagatcttcgtgaagactctgactggtaagaccatcaccctcgaggttgagcccagtgacaccatcgagaatgtcaaggcaaagatccaagataaggaaggcatccctcctgaccagcagaggctgatctttgctggaaaacagctggaagatgggcgcaccctgtctgactacaacatccagaaagagtccaccctgcacctggtgctccgtctcagaggtgggatgcaaatcttcgtgaagacactcactggcaagaccatcacccttgaggtcgagcccagtgacaccatcgagaacgtcaaagcaaagatccaggacaaggaaggcattcctcctgaccagcagaggttgatctttgccggaaagcagctggaagatgggcgcaccctgtctgactacaacatccagaaagagtctaccctgcacctggtgctccgtctcagaggtgggatgcagatcttcgtgaagaccctgactggtaagaccatcaccctcgaggtggagcccagtgacaccatcgagaatgtcaaggcaaagatccaagataaggaaggcattccttctgatcagcagaggttgatctttgccggaaaacagctggaagatggtcgtaccctgtctgactacaacatccagaaagagtccaccttgcacctggtactccgtctcagaggtgggatgcaaatcttcgtgaagacactcactggcaagaccatcacccttgaggtcgagcccagtgacactatcgagaacgtcaaagcaaagatccaagacaaggaaggcattcctcctgaccagcagaggttgatctttgccggaaagcagctggaagatgggcgcaccctgtctgactacaacatccagaaagagtctaccctgcacctggtgctccgtctcagaggtgggatgcagatcttcgtgaagaccctgactggtaagaccatcactctcgaagtggagccgagtgacaccattgagaatgtcaaggcaaagatccaagacaaggaaggcatccctcctgaccagcagaggttgatctttgccggaaaacagctggaagatggtcgtaccctgtctgactacaacatccagaaagagtccaccttgcacctggtgctccgtctcagaggtgggatgcagatcttcgtgaagaccctgactggtaagaccatcactctcgaggtggagccgagtgacaccattgagaatgtcaaggcaaagatccaagacaaggaaggcatccctcctgaccagcagaggttgatctttgctgggaaacagctggaagatggacgcaccctgtctgactacaacatccagaaagagtccaccctgcacctggtgctccgtcttagaggtgggatgcagatcttcgtgaagaccctgactggtaagaccatcactctcgaagtggagccgagtgacaccattgagaatgtcaaggcaaagatccaagacaaggaaggcatccctcctgaccagcagaggttgatctttgctgggaaacagctggaagatggacgcaccctgtctgactacaacatccagaaagagtccaccctgcacctggtgctccgtcttagaggtgggatgcagatcttcgtgaagaccctgactggtaagaccatcactctcgaagtggagccgagtgacaccattgagaatgtcaaggcaaagatccaagacaaggaaggcatccctcctgaccagcagaggttgatctttgctgggaaacagctggaagatggacgcaccctgtctgactacaacatccagaaagagtccaccctgcacctggtgctccgtctcagaggtgggatgcaaatcttcgtgaagaccctgactggtaagaccatcaccctcgaggtggagcccagtgacaccatcgagaatgtcaaggcaaagatccaagataaggaaggcatccctcctgatcagcagaggttgatctttgctgggaaacagctggaagatggacgcaccctgtctgactacaacatccagaaagagtccactctgcacttggtcctgcgcttgagggggggtgtctaagtttccccttttaaggtttcaacaaatttcattgcactttcctttcaataaagttgttgcattccc

SEQ ID NO: 37119 - DNA, 25667 bp, Homo sapiens; identical to SEQ ID NO: 36975

SEQ ID NO: 37120 - DNA, 8641 bp, Homo sapiens
agccgcgcgctcgctcgcaggagggtgggtagtttgcccagcgtaggggggctgggcccataaaagaggaagtgcacttaagacacggccccgctggacgctgttagaaaccgtcctggctgggaaggcaagaggtgtgtgactggacaagacttgtttctggcggtcagtcttgccatcctcacagaggttggcggcccgagagagtgtgaggcagaggcggggagtggcaagggagtgaccatctcggggaacgaaggagtaaacgcggtgatgggacgcacggaaacgggagtggagaaagtcatggagagaaccctaggcggggcggtccccgcggaaaggcggctgctccagggtctccgcacccaagtaggagctggcaggcccggccccgccccgcaggccccaccccgggccccgcccccgaggcttaagccgcgccgccgcctgcgcggagccccactgcgaagcccagctgcgcgcgccttgggattgactgtccacgctcgcccggctcgtccgacgcgccctccgccagccgacagacacagccgcacgcactgccgtgttctccctgcggctcggtgagcctggccccagccctgcgccctttgcgccccccacgcttgttctgcgtgcgctgcccgctcttccatttaccttctctcccacccaagtttgtactcttttctttctctcggttttattttttgtttttgtttgtttgtttgagacaggctttcgctctgtctcccaggctggagtgcagtggcgcgatctcggctcactgcagcctccacctcccaggttcaagcgatccgcctgccgagtagctgggattacaggcgcccgccaccacgcctggctaatttttgtgttttgtagagatggggtttcgccatgttggccaggctggcctcgaactgctgagctcaagcaatccgcccgcctcggcctcacaaagtcctagaattttaggcatgagcctccgggtccggcctgtgctaatcctttctgtccttggttctttatttctcttctctctttttcttagtcccttttgttctttccctctcccgttcagttggctgtcgtttgagcctccaccttttcactccctcctttccaccacgatgccgagccctgccttggatggggaccatcagcgatgaccacaatgacctctcccttaccaggcagctccaggcagtgttcctgcaccgcctttcccagggcttgggggctttttctagtgggctttgagctgctcaatctggcctctgcagggccggctcccagcccttccaacctcctcacagcccgacctgggacctagccaattcccggagagtctctgtcccatcgtgaccccctcacaactctcccactcaccaaagtctgatgactgtgctagggggtgcttatatagagtactgagtgttacaaaagcagaagtctggatgagaaccaatttgtgatattaagcaggtggggtgggggtggggagtgtacctaggttcattttccgccctgcttttcccctttccagtgtgtgcacttaaccagtccctgggccctgttccccatccccctccaaggcatggattgggtgggcttgtgtgtcttggggcaggtggccctttctaaactctctgcctttgctcacccacaggacacatagtatgaccattaggtgtttcgtctcccacccattttctatggaaaaccaaggggatcgggccatgatagccactggcagctttgaagaacgggacacctttagagaagcttgatcttggaggcctcaccgtgagaccttacaaagccgggtaagagtccagtccaaggaagaggtctcttgctgcctcctaaccctgtggtctaggggcaggagtcagcagggcattaacaaaaataattaccatccccacccccgacagtgaagtggctctttccagttcacagagcactctcacacctccccgctctcattctggcccttcagctgactcggacaagccaaggatcttggtccccattttataaaggagaaaactgaggcccacgtgtaacagtgattggccccaagtcatcccgggagccagcagaagagctaggacaggaacctattgttctaacttcatattgatgctagcttttgactatccctgaaaccgagattggtaatcagcccggctctgaaactggttatttgctggggactgtaaaataggattaactatttctagtcctgcattttaattgctgttagtagggccatcttacccaccctctgaaggacctgacttggcaagcccaaggcaacattcagaatatggcagctgaacctctgtgcacttgtctttgggcagcagctgggtcttattcttctctggccttcacaacatcctgcaacccagctcaaggtcaggaatgtgacagactcatgtcatcatatctctgatgcccagagaagggataccatttgcctgagccttctcagtactgtttaatcagcctgtgagaactttccttgtgaaaggccctgtctgtgcctggggctgataaaacagcaagaacgaactgaggagctgggcagcagtgcaaagcaaatactaccagctttggtgcctgtaagtgtggctcttactcatctcacatggaaataagggcagccaccttgcagggctgctctgaggattgagctaatacagtgccctgggcgttggggtggggaaagttgtggagcacctcctgggggaagggggtgtcagagcagggaatctggggagtccgagggcaccttcatcaacccaatctgtcatttgagcaccagtcttcactgagcctcgtgggcaagctggagggaaacaggaataaggtcaggccctgttctataggtcccagtgtagttgctatggtgagtatcttcatttccctgcttgccccagccacctggagtgagaagcccaagaggaagctgggtgagctgtttgtttccatgggtctctgtgttcacagctgactcccttcaccagccagccctttcacctgagccccagcaacaaaggcagtcaggcggggctcaaagcagctgctccaatgaagtcaaagaaataagctcaggggaagaagcaggtcaccctcccccactagggtgctgggctcacttcctcctggggcagtggaggagggtgtggttccaactcagaacaaaatggggcttttggtttactttatcactcttcacagctctgacctggacccctcatccctgcctgtcttgtggtgtaagtgcggatccccctaagttggaggaaaggaaactggcccaaacaaaaaggagagcagttttctctgcatcacatggtaggccaggaggagtctaatgccccagagtttactctcagcccccaaaatcacctagctaaatgttaccttatctaagaagtccttaggttttttggggtttgttttttttttttttgagacaaggtctcactctctcacccagactggagcacagtggcacaatcacagctcactgcagcctcaacctcctgggctcaagcaatcgtcccaagtagctgggactataggcctgcaccaccatgtccagctaatttatttttatttatattttttagacagggtctcattatgttgccctggctggtcttgaactcctgggttcaagcagtcctcccacctctgcctcccaaagtgctaggtttttttttgtttgtttgtctgttttttgaaacagagtcttgctctgtcgcctaggctggagtgcagtggcacgatctcagctactgcaacctccacctcctgggttcaagtgattctcctgcctcagcctcctaagtagttgggaatacaggcgtgtgccaacacacccagctcatttttgtatttttagcggagatggggttttgccatgttggccaagctggtctcaaactcctgacctcaggtgattcgcccgcctcagcctcccaaagtgctgggtttacaggcgtgagccaccacacccagcccaagaagtcttttctgatcacccactcttccttctctcccaatggcattagttgttccctcctttgcattttgagagtatgtcctgtaagccccaaatgcagcttgaatcatctgcccatccaccccctgtgcccaacagtaagcctcctctagagtagatactatctcctgcatctcagtgaaccactgcccagcaaagcagtcttgctaaaacaatgactctagagatcctaagctgtgtgagagctggaggagagaattagactgatggtctgggaagggattgaattagtcatcttgtaccttttcttcttgacttaagttccagacctgtagcaaccattcctgcttagacatccagaacataagcctatgggtctgtgcctgttgggtcttagtctgggtgaaacttttctctacttctgtcagctctccagatgaaccacagaagcaggaatgtgggcatcatcagtgaaatctctgcatacagcagacaaagggctggtccagtggctgtttatgaggcagcgctaggagagctctgatccagactctccctgcagtgaaagggagggagcccttcatgaagtattgactgcttgagcaggaattgcttcaccagcacctaactgagtgcctctcgagctcacatcggttttccctcatgaggccacttggagtcttgctgagggacttggttctattagggaaggtgagtttggggatggtgagcagggagggcctggggacattgtggctaatggggcttttctcctcttggcttagattccggcagagttcctctatctcgtcttgttgctgattaaaggtgcccctgtctccagtttttctccatctcctgggacgtagcaggaaatcagcatcatggttgggttcaaggccacagatgtgccccctactgccactgtgaagtttcttggggctggcacagctgcctgcatcgcagatctcatcacctttcctctggatactgctaaagtccggttacaggtgaggggatgaagcctgggagtcttgatggtgtctactctgttccctccccaaagacacagacccctcaagggccagtgtttggagcatcgagatgactggaggtgggaagggcaacatgcttatccctgtagctaccctgtcttggccttgcagatccaaggagaaagtcaggggccagtgcgcgctacagccagcgcccagtaccgcggtgtgatgggcaccattctgaccatggtgcgtactgagggcccccgaagcctctacaatgggctggttgccggcctgcagcgccaaatgagctttgcctctgtccgcatcggcctgtatgattctgtcaaacagttctacaccaagggctctgagcgtgagtatggagcaagggtgtaggccccttggcccttttttctcagtgatgattgatcttagttcattcagccatatagttttttaggccccacgatccctaggaagatcaggggaacagagaactggaaggggccctggtcctccacatagttcctaagcacctgggctataccaggctctgagcagggcgtcatcccatcacagtcttcaacaccaccttgggagtaggtagtatcatcccagtgttatagaagaagagactgaggtgggaaggcagtgggtagagtggggacttggccaggggcacacagtagagagccagaaaacacacagtagagagccaggacactcgtctctaaggccagcgttcttccctttcacctccttagtatgccatgccaaccctccattttacacatgacgaaacagagccccagacaaaaggttgtctttcccagatcacatggcaggaagaagtaaagctgacctgagatcccaagtcttaggaatcccagtcctcagaaagccacttctctctgagccttggttttcacatttgtcagatggaaatgattgtgatttctcagggctgttgagcaggtaaatgaaaatgttttatgaaagaaagcaccaagtttcattttggtcttagcccttgctatgtccctagcaagaagtagatattcatagggatattttgtttgatgtgaggagttcttacagcaagagcttgtagaaggccaaaagcttctggattctattcccaaaagcaggagatgacagtgacagggtggttttggtgaggagagatgaggtagaaaatgagtgcaagcccgctggccactgaccccatggctcgcccacagatgccagcattgggagccgcctcctagcaggcagcaccacaggtgccctggctgtggctgtggcccagcccacggatgtggtaaaggtccgattccaagctcaggcccgggctggaggtggtcggagataccaaagcaccgtcaatgcctacaagaccattgcccgagaggaagggttccggggcctctggaaaggtgtgtaccagttgttttcccttccccttttcctcctccccgatactctggtctcacccaggatcttcctcctcctacagggacctctcccaatgttgctcgtaatgccattgtcaactgtgctgagctggtgacctatgacctcatcaaggatgccctcctgaaagccaacctcatgacaggtgagtcatgaggtagacggtgctgggtctcacccttcccccatgccaggagcaggtgcgggggtctagctgacaccagaagaccacatcttttcatcctatttgccctttgcagggagagtaagatatctcttacttgccatattgaagccaattgggatgaagctcccactttgcacattgaggaactgaggctagattggcaaaatgactctttcaggtcctcagaagatgtctcagctggagtccctgtctgtttttgtttttttgtttgtttgttttttgttttttttgagatagagtctcactctgttacccgtgtaatctcagctcactgcaaccttctcctcctgggttcaagcgattcttgtgcctcagcctcccgagtagctgggatgacaggtgtgcaccagcacactggctaatttttgtatttttagtagagatggagtttcaccatgttagccaggctggtctcgaactcctggcctcaagtgatctgcccaccttggcctcccaatgtgctgggattacaggtgtgagcctctgcgccccatcctcttgtttgttttttgagacagggtcttgctcggttgcccaggctggagtgcagtggggtgattaatggctcattgcagcctcgacctccctgactcaagcaatcctcccacctcagcctcctgagtagctggggctgactacaggcatgcacactgtgcctggctaatttttgtattttgtagagacagggtttttgccatgttacccagtctggtcttgaactcctgggctcaagtgatccacccacctcggcctccaaaagaagtcctggattacaggcatgagacattgtgcccagcctctctgtctctttaaaatcatgaaaactcgtagctacttaagtaattctcctgccttctggaatgatgggtgaagatcttgactgccttgcctgctcctccttggcagatgacctcccttgccacttcacttctgcctttggggcaggcttctgcaccactgtcatcgcctcccctgtagacgtggtcaagacgagatacatgaactctgccctgggccagtacagtagcgctggccactgtgcccttaccatgctccagaaggaggggccccgagccttctacaaagggtgagcctctggtcctccccacccagttcaggcctcttggctatgcatgtctattgtgggtgggagagaaccacctggaagtgagtagcagccaagtgtgactatttctgatcctggtcctggcatttcaccagcattcacctatccccttaattccttcctcccagaattgctaccatcactgtttattaggtgttaaatggagactcaaagggaattcatgcttatagccaagcagctgtgagctcagttcattgagtcctcccagcctcctttgggacagagcaactgggttggattgaataccaggcccagtgagggaagtgggaggtggaggtgcccccatgacctgtgatttttctcctctaggttcatgccctcctttctccgcttgggttcctggaacgtggtgatgttcgtcacctatgagcagctgaaacgagccctcatggctgcctgcacttcccgagaggctcccttctgagcctctcctgctgctgacctgatcacctctggctttgtctctagccgggccatgctttccttttcttccttctttctcttccctccttcccttctctccttccctctttccccacctcttccttccgctcctttacctaccaccttccctctttctacattctcatctactcattgtctcagtgctggtggagttgacatttgacagtgtgggaggcctcgtaccagccaggatcccaagcgtcccgtcccttggaaagttcagccagaatcttcgtcctgcccccgacagcccagcctagcccacttgtcatccataaagcaagctcaaccttggcgtc

SEQ ID NO: 37121 - DNA, 25976 bp, Homo sapiens
aaagcgagagtgagtgggaccggaggggcggggcatcatatgggcggggctgaggcgaggccccggcggccatcttgagccccgccttttacttcggcccgcttcttctggtcactccgccaccgtaggtaagactgggttcgggtagaggcctggacgttgtcagccttcctgcggctgcggcacggctaggcgtgatcggggcggacgccgagtcctgcggtgcaggtatccgcaggcacgagcgcagagacggcgaccctgggccttgggcgccaccatccatgacaggaggccaaggaccttttcccgtgacccggagcctcgcctctaatcccttttccttctctgagcctccaacctagtgtaacccggggcgagcgcccgtttacctactgcccgctacatttgtacagctttttcctgttcagaaagactttcctagacccgcagccaccgcgcgaaaatgtgaagtagatgtgtacgcattttaaggagggagctggcctcaacgcgttactagcggccgccggcgcctggttcgggggagtgtggacctgctgctctaggcagcgtccgcgtcggggcacgagccaatggcgcggtcaggagcactcacctgatggtgccgaggggagcacgtgtctttggagtttgacaaaatctgttcgggtcgtaaaatgctctcagagcgctgtgggggactggaagtcatttctgatggggtcattagggaaatgggattgagcgcacctggaaggagagggcattcaggttgcaggaaaaataatagctcatgtttgtgtgtgtggtagaagcagcattttaagcactacgtgaattaactcatttaattcccagagcaaccctatcaaattgatatatattactgtatacccattttgcagatgggcaaatgaggcatagattagcttgcccagtgtcatgtagtaataagtggtgaagtcagggtttgaacccggagggtctggccccaaaacctgctctgaaaccattgtaccgtggcattgagtaaagccacccgatagcaacatccaggccatcctagaattatgcatagttgagtttaactaacaaaatagggagtgagaccagaaaaataatctgggaccaaattatagaccatatttagagccatgtgaaggtgtttggcgtttatagatgctatattttttttaaaaaattttccccagagtttaatagaaatccttacctaggcaagccatgtgaatttttatgaaggaaaagagacccagcctaggcagcatggcaaaacctcctctacaaaaaattacctgggcatggtggtgccacctgtggtcccaactactccagaggctgaggcgggaggatcacctgagcccgggggccgagatgattgcagtgagccgagatcaggccactgcactccaatctgggccacagagtttgaccctgtctcaaaaaaaaaaaaaagaagaaaaaaaagactgtgtttgcacacaggtagagtgtgactgaagtttatatggagttttattcatctattttttcagtgatcctgcatggttttaattttatgaaattttaatggcattaaacttgaagaaaattgtacaattaacatggtcttccatttcagtgactttctggttctcagcgactggcctaacagcgaaagggattagtagtctccacctgcagcagccagggggtgatgaggcagttctcatctgctcattattgtgagctggcgaactgcgtttttacatatgactaatggatacttaacactactgaaatacacacttaggaatggttaagatagtaaatattatgtatgtgtttttatcacagtttttaaaatactaaataaaaatgactaacaattccacgtaggccgtattaggctgcagatgagctgttggtagggatccgttgaccagtaaattaagtggattaaaaccctaggctttcatgcaggattgatcgtagtgggatgtattaggaagaaaggaagaggctaagttttaatttcttatatataattaggatgatggcagtgggaattcaaaaagaaggtaactttgaggcatctcaaatgtagattaggcaagacaggcatgagtctgaaaaagagaggcaatgaaaagaggaatggtttgaaggtgagatgcagaagcttaattttaggtgtggtaagttttaatagctggtgacatgtcttggtagaagagtccagcaagaaatgtcattatgggtactaatgcttgagaaagattggttatagagatgcagatttagattatttcacccagaaaatgtagttgaaatttagggaatgaggtttagggaaagagtgtgaagaaaaaagaaaagggaggtgggaggagacagagtgaaagggaagaagccagatcctgagttttcactgagaagaggatttgaacaacacagtggtggtcaacagcagttattggaactgtagattgttggttttgggaacacctgtctaggttgttaagagccagtggaataggacatcctggaaatgaagaaacatcaaaatccaaggaatctgagagaatgggaacaaaaaaacacatgtagagatttatggaaaacttgagacacaggggaagaaggataaaaatagaactcagatttctggaggtggatgacatttaactttaataagtaaagggccctgtctctacaaaaaattaaaaaaaaaaatattccagtgtggtacgcacctgtagtcctagctgctcaggaggctgaggtaggagaacacttgaagcttggagttctaggttacactgagtcatgattatgcaactgtactacaacctgggccacacagccaagaccccatctccaaaaaataaaaaataaagggaagaacagtaaggtttgacctttaggggaatggatgtattatgcactgagagaccctttcttctccaaagaatgttgatgttcactaacatttgggaaaaattgtgtaactcccactggcactgtgaaattgtttttctgtttttgttgttgttgttgttgttgttgttttttggaggggaaggaggaagggtgttgtttggttttttggtattccaccctactctgtcaccctatttctcccacaaaatctgttctagaacctaaatatatatttgttctagagcctaaatgaaatctaccagataagtgacatgatatatactatgtaagtttccatatatatttttcttactgaatatcagtcacttcatcgttcataagcccacttttcttatacatcctttctagtcaccctagtagtagtccttcagtcctcatctcttcccttctttctccccatgttacaagttcgacttacaactgagccagatagatccatcttcctctacttacctagtccccactcttattttcttcactcaggagttgactacatctcatgcttcgaaattacacttgaaaactttgtttattgatttaaaaagataaaaaactttcatagtacttttacttcagcagatggttttgaccaagtaccaacaagctttatggcaaaataggtattaaggtggcctgtggcaaataattagattatgggcaattaaggtaattaagtggtgatgtggtatcccatcagggtgtacagtcatttacctcaaaagaagaaaacatctctattgagaatgcatatgcatataaaagctctgtataacctttgctgtgaaaagtatatcccatttgtaaaccattggtgtttttttcagaatcgcctaccatttggtgcaagcaaaaagcaatcagcaattggacaggtaaacttgttttattgtttatatgttactctgaacattgaatgaaaataccactaatagcttgttttaaaacgtgctatttttcacatagaaaaattctattgaaaaatataaccacctattataatgtatcagatatcatagtatatcacagtatgtcatatctagttcttagtttatgtcatatttcttgttaagcctaacatatttttttgatttgtaattaaagatagtttctaaaatggtgggtagaaaaaatactttaaaagctttgttttttaaaaaatattctaccaacttttaaaaagtgttttaatcttgtttcttctggccaaatgaaaagcatttgattttgaattttaagagcagagaaaactgacaacttgaggtttattaaaatagacgaatagcaaagatacagactcctatgtaccagatacgtgctcagtgtaccatcttttgcaaagtggatatagtcctttctaagtttaagaaaatctggtttccttgtggaataatggagcaaataaattttatttgttggtctcatatatatgtattaatatattaaaattagtatctctctctataagttcattatttaagataggattgttaacagtagctaaagttaatattcagtaactaataacatctcatgggagtttattgtttaagaattaatcttttatagattaaaagcataaaactgagcagatggtaatttctttgtgtacagttgtaatatcataattctatagaatcagttatcttaaagtgtcttaaaaaatgagtatttaaagaacctctagagagtcaggacagcatagcagttaagagtagggcttctgatgtcagacttctgggttcaaatcccagtcttccaaaataaaactatttgggtttattgaagaaattagagataagattgaaactaattttttaaagtattttataaagacatttccaaaattagctttttaagattattgttatacatctttgaaagagtaatcctaaagctccagctgattagcatgtagtagtgcatttctctgagaagatcaccagggtggtaatacctgttcctgatatctaaagctttttcttcaatatgtaggacttactgccttatattctaatacagtgtttctaggaatagaaagggaatctttctttgagaggtacatgtcagaatcagtgtggtttccctttgcttaataggcatttatgataaagatagttttccaacttttttcctgtatttatcattaaaagcaataaaatatgtcattttacatgtaagtttaaaattatttttacatgaaaacaaaagatttgttggacagaaaagaagttaacaggcttgttttacttattggtttgttttaaaaggagaaataaatgttgatcttaaagtttcatatcactttctcttaaaaattcatgggatgagtaattggatctggtttagtgtctagaaaaatgtgtatcacaccgtaagtgttcagtaatgttacatattattattaccaaaatcattatcacatctttcttccattttaaaatcaactataatcagtcataccaattccttgactactttgttgcagttgataggcagactattaacaatttttaatcttctaaactaaggtaattaattggtaacttatgtattttctgcctcttttaaaaataatttggggcagtccaccacaacgaaaaaacttgttaataaattagtaatgatataccaaagtatgaaagcttttaaaagtgagtaacaagtgtaaatgcatgtatgagcgttaatcagtttcttaatattatttactggagaaaaatgtgaaaaaaaaattctaagtagaaaatagttgtatgttcagataatttatctgaaggcaattagttttgtttcaagtttttcagtaactaattctctggaaattaatgagattactctttactaataggaaaagaatggcattgaagcagatttccagcaacaagtgctttgggggattgcagaaagtttttgaacatgacaggtaactattaagaagatataattttagatacctcattctgttggattattttgttctattttaaaaccaatctttatctagatattatagtacctcattttacttttaaacttgcttactctctttctgtggttatgtatttgacaattctaccagacttaattaactgtggatgtgattgtgtgaggtagagccttaacagagaagtatcttcaagctttgacatgatgctcttctgaaactttatgaaaatgcttatgttgccagtaaaaattctgaaaacattttctttgaggatctctaagtgtaggaaaaacacctggactttttgagaaagatggcacactaaacacatgcatttgcttccgctgcctccaaaactctgactaacatggcattaagtaaagagattaaacacacacgcacacatacatatacctataaaggcataaagaagcaggagacaggagctaagaataacattttagaagcaggaatacaaatggagaggtagtacctgacttagtaaaacctagaaagctacattctaaacataagcaagaaaacctgagaaatgacacaatttatttaaagccatagtaattggaggcaccagggacccctgaaaataaggataaaagttgagcttagaaaaaagattaattgaaagtctgtttttaaaaggagatagatctgagagtgtcccagctttatggactgcctcttcctaactctgggaaagattggaggtaagttctctagagaaagtaaactgtttgtactggggaataccagacacaattagtgggattgtgatactgcaaatagattaagcaaaagtttgcacactgagtttcttccactagctttcaaaatttggggacttagtcttatatcctttagaagaatttctttgtggggagtttgagtagcccaaaggaagagatttcaagatactgagatttgccaacaaagtaacctaaccagaccttacagtaaagcaatgattgacaactccacctgtaggcacagtgctttcaactagatttttagtgtttctctcttaaataggagtggacagctaaagatcactagacatttgtataaagtctttaatttgatatgaacttctcttcatatcaaagtataaaagatattgacctcttgacttcataggatgctattaaaaaatattcaagtacatggccaggtgtggtgacttacacctgtaatactaacactttgggaggccaaggcaggcagatcacctgaggtcaggagttcgagaccaacctggccaacatggtgaaaccctgtctctactgaaaaaaaaaaaatatatatatatatatatgtacaaaaattagccaggcatggttatgcacacctgtagtcccagctacttaggaggctgaggcaggagaattgcttgaacctgggaggcagaggttgcagtgagctaagatggcaccactgcactccagcctgggcgacaagagcgaaactctgtctcaaaaaacataaaataaaaaaatcctcaactacaaaaaagcctagacatttaaattttggtagtagaaatgacaaaactcaatagaatggttagttgaacattctagaaagtaaaataagataaaagtgataaatcagaaaggacaacaaaattagaggactagtccaaaaatccaacattaaaagttaggaattttggaaaatagaacagaaatagaggtatagatataaataataaataattcaagaattcccagaactgaagttgccagatttaaaaagttgtctagtacaatggatgaaaatagatctacaccaacaacatagtaaagttttagagtgttgggaacaaagaaaattctcaaacattgagaaaaagagaaagtagattaagaatttttcaaaggtttaggtcagctcaacggtattactagaactaagaaggcagagcagcagtgctttcaggattctgaaggataacttctatgtccaaccatattgtcaattaagtgagagtagaatgaagatgttttcatatatgaaaggtctcaaagtgtatttcccatgcacttttggaagcaactgaataatatgcttcaccaaaatgagggactaaagcaagatagctgaaggcataagatccaagaaaacagatcagaggagaaagagtttccagatgagtggagctatattaaggcagcaactagaaagcagcaggtcaaaagttggagatggtagccagtaattacatgtagccatttacatcaaattagctaattaataaaacttcagtcccactagccacatttcaggtgctcagtagtcacatgaccagaagctgttgtactggacaatacatagatagaacatttttattaatatcactgtagaaagttctgttcggcagtactggtctgaaggggtttttttaatgtagatgaaattgatagaactgactgtattagagaggaaatttatgaaaccaatcagggttgggggagtttggtattgaattagtgatacatgcagagtgaccacacaaatatctgtgcatgagattgtattcttttggtaattgagcaacatcttaatgacatgatagggacagaggtttcagaagattgcttgataatcctgttgtgttttttttttttttttttgcttttacataagtgttaatcataccactgttgaacatactttagacctgatttattccacaactgcttgagaaaggtcctcttttaaaaattttgttgtaataacaaaacaacatgaaatataccctcttaacaaatgtttaagtgtgcaagaaaggtcttaaggcaccaaccattctgtaacaagattatgttctcttgattttacgtattgataacagatatccctgcattgaatatggatttgatatagtattataatgaaagtaaatgtttcagcttccctaacaaaagttgaaaacctaaaaacaaatgtcagaaattttttgtgccgtcagtcatcaacaagaaaagttgcttagaataatgtggaaaaagaaaatcaccaatatgcagagaatggaaaggagcatacagaaaacttcccatgatggggcctttgtgggagtctattcctaacaaggaaggataaccagtaacaaaaaggagagaattaccagctcaatgaaaacaaaaaaaactgaaagaaaaaggaaagtaatgctaatatactacatggcttatctctgaatagcatttataacttcttaatattgattaaccaaaattatatgtgatacgatagtggaaggagaaatgtaggggcatgcagagagcaaagacagggagctgaaagttaactaaaatccttctataatgggaagccaatagataataactaaaaactgaaaaatctagaagcagtaataaagtcatattatgtagatagggacataaataccagaaaaatcaactaaaagaggtaaattaattatctctggaatatggaaaatgagaaggttggagagttttttatatatttagtttttatatatatttagtttttcataacagtgtgtggaagtatttactatttagttacagtttactttaaactatgtacttacataactttgataaaaagataggtgtttactctgaagtagtaagagtttacttccatttatatgatgttttaaataaacccatgagagatcactgttgcatgaattactgtttactggaaaaacgcctgtggttttaatcaaaattgtcttttctagttgcattaatagtgattgtgataaaatattagtgatgaaagagcgaattaaggatgtgttgcattttagtgcctatgaacaaatatgtaagatctcaagaattcatttttttatgaaagatgatttgtcatttcatacatttctttagaaacaaaaactattttttaataaatgccacaatgaattacatttattttttcacttattttgcccagaatgacagtgccatgcaaagtataggctcaggttggtttagatcagtatgctaaattgaccacattctttctttaagggacaagtatattcgttaaatgttagtggaaccacttattttgaacattaaataacttattttggacctttagtatatatcttactttttatatagtgcataattattttgtttctgtattgattaatgaggggcattaatattttgttgttgtttttgttaaaactagtgttgaactaaactgcaaaatgaaatttgctgtctacttaccaccaaaggcagaaacaggaaagtgccctgcactgtattggctctcaggtaagtattatgcatttgagttttataaagtcgtttctattttctttttaactggcttatcttacccttttattttaacttggtaggctttttgagccatttatgaaagactttaaggacctgtcatagtctactctgttacttttatcctcagaataatttcagacctactgaattatatttatttcatatatttttctaatagaccaagtaatttagcagagaatgtaaagttctgtactcaatagcaagggcttagaaaacttatttacttaatttggacctacccaagcatttctggagtttatagagactttactagtccattagaacaatattaggtgaaatcaggacaccaagatactctaattagaaaccagctattgtaaaaagtcaaataacttacagtgttctctaaaatattttaactggactccatagagcttctctgacaacaatctggaaagtcacaaaagaacgctaaggcttctcttaatcagtgtttcatattaactactgtagaatagattgtgaagagtaagattttgacacctgcagttttgaaacctctatgctaacttttctttcacaagacgctggtacttcatcttcagaagcaaacataaggagagaatcctagcaactaaattgtgtcacagagtactattttaattttgtttccttcaaattggttcctgtaactttgatttaacaaatcctccctcatgtgtgtttcatcaaggacaagtcccaaataccagtctttgaaaatgagaataaatatttcatcttaaagggtaaagattaagtgcatatctgactttaactcaagaaaacatttctgtgattgaatgaagagcactgattttgctagaagagcattaggtattgctaaaagcaagagcaacaaaattagttatttaattgtcttagaaaatataatattgtatagctaaaaatgatcttagaaatcatgtaatccctagaaagaaaatgaggcccagtgaagctaaatattgtccagggtcacacgctaatgtggagttgaacaagttttctgactcacagtccagagctgtatttagttttttctcctgttgtttttgcgttttgtttctggtgaggggtactatagtcatatctcttggctaaacaataataaccagaagccctgaggcattgtgtcataggtactctaataatagggccctaagttttaactaaaattgaatctagcaagacatatctgagctttacaagtataaaatacagaatttttgtttgtttacatcaaatgacaggacagtttccttagtgagatgctgaagaacagatagaccttggaaattaaggcttgattttctgagtaaaggtaagattgcctgaccagtgcacgtgagaaatggtgacaaaaaaatttcagaaggtttacttcccagcaagtctaaggaaaacaatgacagaaagattacacaattattatatagctaaaatagagaaattagctgaaatcaaaacagccaaactgaaatcttaaaagatagttcatgtgtagtgatttgtatctttcccaagtgaaggtgaccattgaaacagccctttattagctgtgtacccaatagaattgaaaacatgtccatacagaaacttgcacatgaatgttcatggcacactattataatagccaaaaagtataaacaaaccaaatctctctcaactggtgaaatgatcaataaaatcgattgctagttcattcctcaccattctcacatcattgtagtattagatacctatagtaaaagaattaagtcatctcctctatcatgactgaaaagcatggagctaggaaaaataacagaaacttctaaaaactgaggctaaaactcaatttaaggatggcatatggtcaccattactctctttttagttcagtgaagaatacaaagatgattaagctaaattttgttgctgagaactatctgtatgtaaaaaaaagtatttgtattatgaagaccatagtatttgcttatttactgtgaatatgttttggtgcagaaatagtgcgatgtttaattagcatatttgataacacttcactggggttgttttaatattgggcttatgcaccatattgtcactctacagtttgaaaatttctgaattcccaaacactcctggtccaaaggattttagtaattgaaactttagtagtgattttaaaaggatagttatgggatcacttaacctaacacagttcttaggttaatactattacaaattttgtgaaaaagtgaattttagtgtcttactcaaaattgtttctaaagcaaaaaaaataataataccaaatgagcttgttttcctgtattataaacagtttaaagcttataaaccattcacaatatagcatgagataatttatttttaataatttcaacttttattttagattaaaggggtacacgtgcaggtttgttatatgagcgtattgcgtgacatggaggtttggggtatgaaagataccatcacccgggtagtgaacatagtacctaactggtagtttttcagcccttgtccgtctccgtctccccctgctctaatagtccccagtattaatggtgcacatcttcatgtccatgtgtgcccaataacaatattttttatcttcaggtttaacttgcacagagcaaaattttatatcaaaatctggttatcatcagtctgcttcagaacatggtcttgttgtcattgctccagataccagccctcgtaagtgtttgtggtctagatatcctttgtaaaaatctaaatctttaagactggtataaagtggtatgatatatacattatacaattcattttatatttttgctgttatctctattaacctttcaagtggcatcatgactccaaaataccatgctgtacattttcctcattgaattttactcatgacatggcctttatgaaagaggatagttttgctattcccattgtacagattaagatacttcaaagcagagattgagcaactcaattcatatatcatgttggcactactgtcaaaatactaatgtgtaatgcataggaaattatttttctattccagaggtatactgtcttgttgcatgataattacatcttttttcatctctgttaacatcaaccatacagttaaacaagtattagttttaatataaatgatttgaatatttacattagagaaatgaaaatatcaactacgtgagactcaatgcatcagacagttaaaacttgttttatgactctagaagtttcaggaaatggaatttaaatggcagtaaaactagggaagttatatggctggcctggcaagtagtatatttcctttcacaggccatattatacaaaaacaatgcatatctggttagaaatataacaacagatttaattcaaaataatatcaaaaatataaaatacgaaaatagatatataaaagggaaactaaaattttgttatcataaacgaagactttaataaatgggaaaatgctgtgtttctagatggataaaatgaatcttacgacaaggtcatgtctccaaattactctacgtgttactgtaattctattcaaaatcccaatggttggctttttaaccacatgcaagtatataaaataaaatgtaacaagttaaaaagaaacataagaaaattccagtggaggttggatagataggaaaaatgtgatggaaagcatattagaaaacattttcagttcaagatagtaagttgagcacaagcatctgcctccccactcctgtgtaaagagaatttaaaaagtgctgatagtgagagagggtcatcagggaagggatcacaacacatttctgaaagataaaaagaggatataagtcctttttgacaggtaaaccagagtaaggaaacatatgttcagagtacataagaaacttcatcaacaaagaaagttagtgtatcttaccttggcagctgaatactccagcttggaaggtcattttttacctcattggccagaacgagtcgcagggccccattcaagggcaagaggagcaggaagtataatcctatcatgtgctccaaaaggcagagagctcacaacatttggtgaacagttcccatgcaaatggacttgcagattcatctgaaagtgtgttattaaacatgggccattactacagagcagatgaaaccacaagattgtttcttgataggtggctgcaatattaaaggtgaagatgagagctgggactttggcactggtgctggattttatgttgatgccactgaagatccttggaaaaccaactacagaatgtactcttatgtcacagaggaggtaatttaatttgtattgtaattattaattgatgactgccaagagtttgattttgaacacaaagtccttacaatcctgaggattttaaactagggtataaaagttactagtaaaaattccaaagtttgctagtactatagttctatttactgcaatttaaattaacactaagtacaattaaagaatataatcattatattgagacctgtttatactacccagaataaccaagaaaatggtatatgaaaaaaacctttaatttgcctggcagctggttcatttggatgtattttatagtgataagccaaggcttagttagaaaacataagtggtaaagcattacctctattaataatatttgtatgctgcttatgcattttctgaattttatatgattttcattgttactatgtatatcataaaaacttagaaacaatagtgtaagtttttaattacccataattctgttacccccccaaaacacttatgttttggtatgttccagactgtttctatgactagttttcacgtaattctaaacttttttattttcttcttctttttaagttacatataaaaatattttctagtgttattctgattttaataattgtgtaatattctgtcatatgccataattgactttttcctcttatagaatacttatggttttgtatatgtttttaccctaataaatattactgcattgattatatttgtgcataatgttttctccctaaggacttttccttagaatatattccaaaaagtgaaattactaggtcaaaacttaaaagcattttaaaggttctttctgcatcaccttcctaaagtgttttctaagaagtctgtaccatatattttccagggatatattaataatcatggtctgcctgaggatttagttttgttttgttttcattgttactagttcaaaccattgtaagactatgatttggcagtattgattgtgtaattattttctgtaactttgaaatgtctgaacttattttctttgatatcttttgtcacactattaaattttttctagcttccccaactcataaatgccaattttccagtggatccccaaaggatgtctatttttggccactccatgggaggtcatggagctctgatctgtgctttgaaaaatcctggaaaatacaaagtaagattatctaaacttctagtgataaatatttctcttgaataacataatattaggaaccttcaaagagtaaaattacaatattgttagtattggaactaaacttttctagtgttgagaactttggggtgtttgaagggtgggtatttaatttgaccatagagtgtatgctgcagaatcagacgcataggaattcagcaagagtgctttcttattggcctactggaagtattataaaatgtagcttctcctttaattgtttttattccaactatagttttgaacacactttttttctgtaaaggttattattactgattaatgttatagtggcaggatctatcatttatattcttaccagggatgtctttgtaaagttgactttgattttctgaggtaaaagatatgatttgtagaagcttaagaattgtgttcttaatgcctctaatgaaaattgaaatgcagcttgattaaaaaacatcactctcagcctttcccagagtcaaatttgaataactaccatatgtagtatgtcatactgtgcagaacagcatgttacaagagttgaataaggaagtgttaaagcaactagcatcttaaaatttcttctgcctttaaatttacagggctgttcatgcccttaaaattggtttaattcatttcctcctcttaggaagaacttgattattttaggtgtgctactgagaaatgaaaacatttctcataacagtttctttctgtggcatcaaatattttgtttttggtacgctttattatcaagttttattaattcatggcctgacagtgggctttctaagtaagcacttttatttccattttttaaggcagtctatcatgtctgaggtagaaaagcaaacttagttgatttttttgtcctttaaaaaagctagtagataccactaaacatttacattgatgagtactctgaagttgagagatcccatctctgcatctcatccagtgaaaaagaacattgtatagaacacagagttgtattaaaaattctgtcatattgaaatgcattgctcactgctttgttggtactgtttaagagaaatgtgtcagatttagtaacatgttcactaaggtaagcatgaactgttttatatcactatagattaattttcagtgctaaaaaagcagaaacgctgaacatagacttctgtttgtatcttaaattgcaatgtattgttttgcattattttagcaactatacttattagctctcttaatagaatacacaaaagatgtattatggaaaggcctgcaatctaagccagcaatatatcaaaaggaaaattgttcacagggttttcatggcaagtcagaatttttaagcaagttgcaagtaacttctatatttttaagtaagttgcaaatatctattcatatttaatttagcaaaatataacttgtttttaaatttcttttgtttctgaagtctgtgtcagcatttgctccaatttgcaaccctgtactctgtccctggggcaaaaaagcctttagtggatatttgggaacagatcaaagtaaatggaaggtaggtactgaatggctgtcttaatactcattcttaagtttcaagtttgtttaaaaggttggacatatattatattcctaccctgctcatgttagggctctagagctgagacaaattagcaaaagatatatatatatcgatatatatatcaatatatgagatatatattattatatatattattttatatatattattatatatattattttatatatatatatatataaatcaacaaaaaaccctactttctaattgtattgaatcatggcagatattctggggctatattttttttctactaatggttaatttatatttttatttctaaattaacatcacttctaaattaaccaaaaaataccacatattacaggttgagcatccctaatctaaaaataccatatattacaggttgagcatccctaatctaaaaattcaaaatgctacaatgggtatttccttggagcattacctttaagcgtcatgtgggtactcaaaacgtttcagattttggagcatttctgattttggatttttggattagggatgttcaacctgtgttactaaatttagacttgcctcttattaactatgtgctcagttgtgtaatagaagcaaagaagcctggctttttaaattactttgttttcaaaatttagcatttcagatctcgattttaaattccagacacgagtctttaaaaatagatattctgttatgtacatttatgtgaatattcccacagcaagattgctttttcaagcatgcaaacaggtgctttcaagtggaaataaaaatgaccctttttcctgagagccatgttactcttgtgcagaaatgggccatttacaaactctgccaagagtttgaatactttgcaaatgaactcatcatgatgtgtattgttaacaagcagaaaatacttgaatgggtaaaaaatgcaacttctttgtcttaaagtatttaaagtatagttctgtgttcagggttcattcctacatgaacccctattttatgtaaggatgattattgaaattccaacacattttatttaaggatgattactgaaattctaactaattaaagggttcatcctttagtaactagattacagttttgtttaggcttgaatttttactatgtttgaagaatgctagaaatgatttaggattaggtcctttgagaactgacattgcatgtacatcagtgttttgagtcttcatctggtgcaaagtctatgctaggttctgagctgttttgtcacgaaaatggtgaccctttcacatccaccaggggcttatggtctaatagaagaattgggtaaaagaccaactaattggagggtgaaggtgagaggtagaggtacaggtaacctaaaaaggaatctagatatgtacttttctccaagtgacagtagattttactgtcttaattatgttgtatttagggtattatttaatttacgattgaaatcaggaaaccatgtagaattatgaaatcatagaatttagaactaactagtcagactttataggtcctctcccactctaagatgaaaggaaatagaaccttcaaaagcaggatacttagaggacaaatcttttcgtggttgtttgtcttggtcaatgtataaagttgtggttaatgaatatatatgaataagaatatttcgaggtggatgataaaacataaaattgtaactagtggcagctcctcagagaataaatttgagatgatgttgatatgattcagatgattcacaccaggtgtttctgaaagcttatgtagatagcagaggtttggtgctgttcaacagcaaaaaagaaggctgaatgtgtttatgtctggaattacagccataaagaagagacataaaaaaaaagattatctgaaatagagaatatttggaaaaagatcatggagttagaagaagcttctagtttccaatttgtggaaggagttacaaaggaaaaaaaatcatgttcttgctggagccaagaggagattaagaatattaaaggtttagaaggaaaaaggccattttcttaagaatccctgagatatgggattcttgccactagtctaggactgcttgaaagtagggaagagactattattagaaaatagaattccgaagaccttgtaaataaaagcctggcaagtcagattttgaaccaacttaaaagcatatttctgatttaatcagcctaagagcttaaataactttaaatttctgtttggtactagtatagtatatcctgaagagtatctttgaatttatttttcaatgttacttctctttttacaggcttatgatgctacccaccttgtgaaatcctatccaggatctcagctggacatactaattgatcaagggaaagatgaccagtttcttttagatggacagttactccctgataacttcatagctgcctgtacagaaaagaaaatccccgttgtttttcgattgcaagaggcaagtattaggaaactttagcttgatctagataatgtaactatgaaaaattaggattctgtgatattttcttaactttattttagaatataaaatgctacttctagtaagtttttaattatattcagacacttgaagtgaaaacctgcctataaaattaattatatctaacactaaatttgatagaaataggaaagcttttggcagtgaaaaatattgttttccatcaaaccagtaaataacaagatttttaatgcttgaatgatgattaatcttcagcattagcagatacttctttctttacacatggacctttgctgcagtagaataaaaaggacaaacttctacctaaattactccttattttatgtatatattttagcctcagaagttaagtattatttatcacacatgtgctttatattatttgactttcatattaatctattcattgtgctacttgatatttctagttgtttaagaataattactgaatcccaatgggcttgcaagttttttttaactaaaatatttttgaccgtccactactcacctaactctatatatgctaccatagtcctaattaaggaagttctgcttttatttttaagaaaaattcataagcttcagaatataatttaaaatattttagagtgaaaaatgagcactgaaaattatacatggtcatgatttttaaataaatttttatccatgtttaaggataatgtgtcaggcacattgatctaaaatgtaattacgatggtaaatgttcaaatctagatcagtgtgtaatgtggtacattagtttgtaaaatgctttcacagcattaactcattgttaattcttataccgccaaatgagatatcatttctttcctatccatctgttttacaaatgaggagacaggctcagagaagtaacctacttatctaaggccacatagctagtaagtggtggaaccagaactggaactaaggccatttaactgcaaatactgacctcctgtcatttatcaagccattttcagacggcatgatattctcctgaggagcaaaggaatggaattagagctagcacaaggagaaattgtgcatagcttgctgcctacgtaacttatgcagaagatctgagcagtcttcctgtttttagggatattttgcacatgtgaactatatagtgagaaaatgtcaaaaactaatacatgatatactgtttgtctcttagtgtccatccttgagtaatagaattttgttttagatttatttgaacatttaccatcacaattaaattttaggtcaacaaccagccttgagaaatccaaataccaatttgactataaatatagtaatacgtttaactgcaataactatagctataagtgcgtaccaaaccatgttttttccaaatgaccttaatttcttggcactacccatgttggatacctcatttgcttccccaaagactgggcccaaaatttctgttgtttctacaatgattctgcctgccaacaaagtctgaaaatctcaagtttgttataaaaacagcacagttagaacatgatgacattcctggagggaaaaataagtccacttatttgtttctaaaatgcctgtatcccaagcaactagaacacatagttggctatacttaatgaggagtcaagacaaaccattcaattcttctaaaaaagtaagaaagtattcaaagcaccagagtcacaatgttgagctcaggtgcaattttctattcactttacttccagcatggtcgggttaagagtggactacatagcttgaagcggatttcgttgagattcgttgtaattgaatcaacaactgaatgagcatgcctaagtagtggctccagagagtctgctttcagattttcttgccagctttgacccaagattaccctgggtctgcgagttttatcacctgctttatcatttgattacaagtatagtataactgtatttccttgtgggatagaagctgtaaaaaataagctgaaaataataggggatatatataaataaacgatctgagaaagaataaagaaaataattacaatcatgcacatgatttactcaacttcattcttttacctctttttaatggtgttaaatgctcacaatttatatttatactctgtcgaatgtcaaaaaaaattttttagagagaggggttagtgcatcggggatatttatttggttattattttatataattttttctttttctattttggcttcagggaatctaaattgaaaaaaaaatactaggtagcagaattctgatatctagtgtacagagatcaaatcttagtctgaaaaagaagggcctagtatgtcttatctttagttattggagttacacagtgagaaaaaaaaatttagtgacctaatactgtgaagaagtttccagaaatagtaatctctttttgtggaatagaaggagaggctatactacctccttaagtctcaggacctttttgaagattgagaggctgttttagcctctgcatctgcctgctagagaagagtaagaacatggcagagaatcccagaaatgtagagctctctcattcatctctgtatcccatgcttatttagcataggtatctagcacagagactctcaatacttgttaaatgaatacagtgcaaagtcttcctccttatacactgaagagatttaataacctggggattcttatccaagcttttctaattgggtctggaaaatatataagaaaacactgcctgttaggataaacatccatcatagctgctggagcactgctccctttttgagagctgagtgaagaatgaaagaatgaaaggtgttcatttatttttatactccaggagtcaagagttttgctaccaaggattttccatttaaagtgtgaggtagaggagaaaagtccccttcaagtgtcactaaacataggcatttgcacaagctgcttaacatatcataccaactcattcatcaaagaatttaattaaagaagccatccccatttaataagactgataaatagaaaccctcgtcagggatgatacaattagctcgaattgtgtaacttcagcaggataccaattgttcaaatgtattctattgcctttttgttgacattttttaaaattcttgggccctcaatggcaggcattttcttctttctcatataggtgaatctttatcattatggaacttatggtcatttgttttggattttagatgtcttgtcttgcaatatattcctgggtttaccttgggacttctctaataataatgatggctattcatatgtgtctgatggctcttaacacacaagaaactaaggataaaaatatggcatactcagtcacattggaacttggtcacacaagtcttttgagatatctgtttccctgcatctgtacccattttctatcagatccatcttttgatctgtgaaaaatggcagataatacttggtacattttacaggtttggtggcctaaaactccaggcctgtttaacttcttaacaattcaagaattatatggatggaaaatgtttttctttacatttctttctttatataggaaactgtaatttagctctaaattcaactagccagctgggactagtctaatcattgagagacatgacaccaagtaattccgaggctcagctttaatcttgacaacattcctgtcacattcacttccatgatagaagacagattgctttagaagacttaagttaccttgaccttaaactagaactttttattaacagctgttcccaagataaacatttaatacctctctggaagggagagattgagaacatttactgattcatcaaaaccttggggatttccttgttctctgaagcgtcagtgatatttttattagctctatttttatttcttaggtgcttagaaaaattcccatcttttcccatcagtgaccattcactagttcaaaatgggaaaaacaaaatctttgttagactttcatttctttcggtttattcaaccttgtattttaattgtagatagggataaattatctggtgtttgatacccttagaaagttcttcccacctggagtgtaaattagtttaaccattgtagaagatagtgtggtgattccgcagacctagaggcagaaatgccatttgacccagcaatcctattactaggtgtatacccaaaggaatataaatcattctgttataaagatacaagcacacatatgttcactacagtactattcaatactattcaatagcaaagacatggaatcaacccaagtacccatcggtgatagactaaataaagaaaatgtggtacatatgcaccatggaatactgtacagccataaaaaggaatgagatcatgtcctttgcagggacatggatggagttggaagccattatcctcaacaaactaatgcaggaatagaaaaccaaacaccaggccaggcgcagtggctcacgcctgtaatcccagcactttgggaggctaaggtggacggatcacaaggtcaggagatcgagaccatcctggctaacatggcgaaaccccgtctctactaaaaatacaaaaaattagctgggcatggtggcatgcacctgtagtcccagctagtcgggaggctgaggcaggagaatcgcttgaacccgggatgtggaggttgcagtgagccaagatcatgcactccagcatgggtgacagagtgagactccgtctcaaaaaaaaaaaagaccaaacaccacatgctctcacttataagcaggagctgaatggtgagaacacatggatatatggaggggaacaacccacactggggcctgccaaagggcgatgggagttggggaaagcatcaggaagaacagctgatggatgctcggcttaatacctaggtgatggcttgatctgagcagcaaaccaccatggcacacgtttacttatgtaactgcatatccagcacatgtactcctgaacttaaaagttgaacaacaaaaaaagaaggaaaatgcgttaataccttattgtaattattttttttttggaagactattttttatattcagaagaagtgtcagagtcagcagaaagggattatttctccatttacctacaacaatggttttaaatgactggatagatagaaatctctttcaacttaactgcttagcacattgcatttttctctgtttcatgttagttttccaaaggattactgactttttacctaatttgctaagggatgtcaggccttaatgacatatttcccctcacataaagatacaacatgcttttactgtgtaggaggaattgttaacaggatttatgatggctgtgtttgacttcccaacaatgatagaacatttgggcatttttatgttctttttctatattgtttgtgtgcttattttgtgttttaatagtcactgtcttactgatgtgctgcatttgtgaattgaaatgtcttgcccatgtttctaagatctctaaatcctgattcttttcatcttggttgatatgacagtgtcatatcaactgacactgtcaattgatagtgtcattttcaatgacagtgtctactctgcatatttaatgcactctacagtgttgatatgacatgtctactctgcatatttaattaatgtgttacttccactctttacatattaatggcagcatttagaagttaggctatgtttagaagctaggcagaatgtttagttttccttcacatttttgctgctcttttaatgtacagtgaaaatgttaaagtacaaggatgacaaccttgattttattataaaccttcctcatacttccttaatgttatgactatttgtaagcaaattaaacgaccttagagatatatttaatgttcctaatactgatgttcctgaatggtagataaatgtcttatcatctctttatcttctagggttatgatcatagctactacttcattgcaacctttattactgaccacatcagacatcatgctaaatacctgaatgcatgaaaaaactccaaataagagaatctcttcaggattataaaagttgtaaaatgcaactgtattgctgagcaaaaaaaaaaaaaattcaaaacattggattttatagtgctaaaagggctttattctatagttgaatcacctctgaataaagatataaaacct

SEQ ID NO: 37122 - DNA, 99294 bp, Homo sapiens
gccaaacaaaagaggacagcacttccggtcacgccatcgttgctgccttcttcgtcaaggtgagtgtaaagaaggggacttggtaattctcacaaataaatccccatacactccagggaaacctccttttgtgcctcaacgtggggtggaaaggagaattcatccccgcgtgcgttgtatgaaggatgcttctgacgcctgtggttctgatcgcctcgctatctcctcccttctcctccggagatggggggcccgctcctgcctcacctcctcactctggtggtccctttaaccgcttgactcctggtcatgcttcacctctcctctttatcccgtatcctcttctctggtctgagccagcgtcattccctctaccacaggtcactcctacctcctacctctcacctccgccttctgccccccatcctgttaacctgcgactctttgcgagccccttcctaccctctgttttactccccctgctggcctttggtctttcctgttcccctcccgcggagaccagtaaattacgtactttgcaacagtaggtgtgacttcaaggtcaaggcttttttttttttttttttttggttcttttaaagtataagcaaagaagcagaaaccttagagccctaagaggcataggcacttgtccaaatgatgttcttttttttttttttttttaactctaaacaaaattacacatcatttagatactattgcacaggtttcagtcttctacacattgcatttatttttttatgttgccatagaattgaatcctcagattttggggggcaaacatagtggattatacctgtaacctggtttcagcttcagcgtaagctttcccatcccctgtaaaacttctcttagcagtgaaatggttgacaggaatggcatccagtcacaaatttattactttatatgagttgagtttattatgcaatttcttttctggtctctgatagcaacattaaacagcaagctgacattttgcagacgaagactttttctgagagctttgcaagtattacacaatctatttgttgcaatgtgaaatgtacttttctattacatttgttaccatgtcaaatttatcttgtgagaacattagttattaaataataatcacagtaccgaaatgatcattaaatttatgctgagaatcagagttttccaggctctatcaggatctaacgaggaatttaaccaaagttctctttgaataagcagtggactccttcctgtgtgttatgcttgccagactaaggggtgattatcttttctaggccatgtatagtttttatttaagaataaacaatgaggcagagcttttgtgacaccaaaacacttaggaaagagtattgctgatgtctctttatactctattcaaatcattattacacagcatttaaatatcacacttgtttcaacccactgtgcatccatccattcattcaataattttttattgaataatttttatttgccagacagtgttctcagcactggagatacaacagtggataacaaaaacaaagtcttttaaactatagctgggagacagacaataacttaatatataaacaatatatattggcaagtggcactggtgttaaatgaacgaaacaaaaaaatacatgaagaaataaaaaagaaaaaaacaaaaaaagaaataaatatgtaataggttgtaatgtggacgggttctactattttagataggatgggcaggaaggcttcactggtaaggtgatatttgagcaggaacctgaaggaactgagggcacacactatgcagatattaatgggaaaacaggatttatgtcatagtctttgcatttgttcactctgtttcctaacccgcggccaccttcccattcccctagtggtcacttttctgcatagcattaattcaacgctctgcatactcaaataacctgatccattcacattaatttctcatattctcttcctcctggctagcttcttgctaccatttaggcgacttgtcagcctctttaggaagacatatcactatctccatattcacctcatcctcagtttgttgattgctggtgcattgtgtgctatcctacaggatatttgattatctctctcgctgctcttaccactttgtgttcataatatgttgtccataaatatttggtacggtaaagtgaaatgaattcagtgcttgtttataaaagataaaacttttaaatatggctttccccctaatgttcaacactattctctaaggtcagtattatcattgtcattttactaatgctaaaaccaagactaggaggtatgtagtaacttgctaaactgtggtacagtttatggagttaaggtttttcaggcactcagtcctggtctggttctctctatctgtttcttaatgagaaataaaaaatatacagaatattttattattttataagacaatccgggtatagaaattttattttttgtgcttctttcacaacttagatcatatcaggtgcttgaattactccctaattataaatattaagctctgagaggcatgaataatgcctctttttaccagaatatttttaaataaaaaattaaacaagcagaagttgaaagaagagtacaatgaaaacttttatattctggacctagattcaacaactgttaacctttgccatattagctcactctctctattactcactctctttctccatgcatccatccatccatccatccgtccatccgtccatccatccatttatccatccatctatctatttttttatctattttggctgaaccatttgacacttgcaggcattattttaagtaaatgtaaatacatgcagaaaagtgcacattgtcctaagtgtacagctcaaagcattttcttttcttttcttttttttttttttttttttttttttttgatggagtcttgctctgtcccccaggctggagtgcagtggtgaaatcttggctcactgcaacctccacctcctgggttccaacgactctcctgcctcaggctcccgagtagctgggattacaggcacatgccaccatgcctggctaacttttttacttttagtagagacggggtttcaccatgttggccaagctggtctcgaactcctgacctcgtgatccacccgcctgggcctcccaaagtgctgggattacaggcgtgagccaccgcgcccggccagctcaaagcattctcacaaagtgaactcggctgtgtaaccagcatcaagatcgggaaattttgaaagcccctaaatgtatcccttatttgttactattccaaattaatcacaatcctgtcctctgtcattgtataataataattttgtctgtttttaaactttaaaaagtaacacagtttgtgttaattttttggcttgaggatttgtttttgagattcatccatattattgagtgtagtagtaattcctctattttcattgctattccattgtatgaatgtaccacaatgtagttatccttttattgtagatgacatttttgttgttttcattttcagcttgcaaatagtattgtgagcattctagtacatgtcttttggtgatatattcacacatttctgttggacatatacctaagagtagaattgctgaatcacaggttatgtataagattaattttagtaaatactgccagccagctttccaaggtgattgtacgagaagactcctaacataatttttttttttttttgagacaaagtcttgctctgtcgcccaggttggagtgcagtggcgtgatctcagctcactgcaaccttcgcctcccgggttcaagtgattcttctgcctcagcctcccgagtagctgggattacaggtgaccaccactacgcccagctaattttttgtatttttagtagagatggggtttcaccatgttggccaggctggtctcgaactcctgacctcgtgattctccagcctccacctcccaaagtgctgggattacaggcctgagccactgcacctggccagaaatttttcagagtggaagttgctctagaatatagccaacacttgcctttgtcttggtagctattctaatggttatgaatggtatctcactgtggttttatttcgcatttctctgatgatggacctttccataagtttgttagtcttttggatattttttatgaggtgcctgttcaaatcttttgactactttttctcctgggctaacttttttttattgatttataggagctctttctatattaaggatgtgaatgctttgtcagatatatgtattacaaatctcagtggcttgtatcttcagtctcttcatggtgtcttttgatgaactgaatatctgaattctaatatcattccgttcattattttttttcatttatggttagtgcttctttgtactgattaggaaacttttatatttcccaaggccatgaagatagtttcctaggctgtgttattgtttaacctttcatatttatgtttataatctgtaattgatttttgtgtatattgtcagtatgggtatatgtaaaggccctttttttgttgttgaagtgacattcagtcaaccccaaaccacttattgaaaagatcattctttcccttttgtagtgccatccttttcattaactcaaatatataaatcaataatttgatatagttctgaattctgttcagtttggtttgtctatccttgtatgaataccactgtcttaattaatgtaacttcacaacatgccttatgtatggttatgtgagtcttacacttttgttctttttcttcaataatgccttggttattcctggtctttttccttatacgttttagagctagtcaatttctacaaacattcttcttggcattctgattgagataccatctaacagatcagtttagggagcagatatcatggcacgtcacccttaaatatctcagcattcatctcctaatattagcattactttgtagtaattaattaccattatctcactaaggaaaattaatgattccctaatatcaacaaatacctaatcttttcaaatttattttcctcaataagcctttgtaagctggtatttaaaactatcatccaacctagattaatgtattgttaagtttttggggattttattggtgttattttctctcctttgttgaacttgtgaatatttatatatttagtacttttcaatccattgcagtcattatttcttctgttgttccaactgtccaatcatgtcaagtgggagcccattcacattcacattggcttctgtgtcttttctcttttgttacatacattttcaaatatattcaaagtagaaaatagtaaaataggctgtgcatggtgactcacccctgtaatcccagcactttgggaggccgaggtgggaggacaacttgagcccaggagttttagaccagcctgggcaacaaagtgagaccccatctccacaaaaaatttaaaaattagctggacatggtggcatgtgcttgtagtcccagctacttgggaggctgaggggggaggatcgcttgagctggggagtttgaggctgaagacagctgtgattgcaccagtgcactccagcctgggcgacagagtgagaccctgccttagaaaaaaaaatagtaaaataaacatgaatgtatccattccccagcttcaataattaacaacattttgccaaaactggcaagttttgttttatctattctcacccatttttttccacatcccagatatgtcattacacaggtgaataactcagtatgtatctctaattcataggtgcattaagtaaccaccacgtcattattatacttagtaagataaataataatttctttcttttttctcttttttgagacggagtcttgctctgtgcctggtgaattgtcttaaagttatagttatacagtagctttgttaagtcagtatccaaacaaggaccatttattgccaatggatgtttttctcttaagccttataaagcccttgcatagtcccctttttattttattttattttattttttttttgagacggagtctcgctctgtcgcccaggctagagtgcagtggcgcgatctctgctcactgcaatctccgcctgccgggttcacgccattcttctgcctcaggctcccgagtagctgggactacaggcccctgccaccatgcctggctaattttttgtatttttagtagagacggggtttcactgtgttagccaggatggtctcgacctcctgactttgtgatccacccgcctctgcctcccagagtgctgggattaattacaggcgtgagccaccgcgcccggccccttagtctcctttttgaaagatcgttgattaattcaagaaactacgtcattagttctatagactgtctcatctggatttagatgattgcttccttgaggtggcatttattttgttttctcatcctcgtgtttcctatttactgacatttagagctagaggcttgattagattcaattttgattattttttaagagaaagactcattttaggcagtgctgtttactttctattgtattttatcatgtctaattttatcttttttttaattgatgctgggattgatttgtcatttcagggtgtttgtcgggctgatctctccattgtagcttttcccaccaacctttcttctgttggttttagcagccattgatgataattgcctagattcattatttctgtagaggttgaaaaatggtgatatttaattctttcaatctttctgcattattaactggaattactttataaagaagactttttccttatcagctattttttgtcctgaagtatatttcataataatcaagataaatgatgctgccgctgctgctttttttcatttatcagtgttcatagtaatgagttggtttcttagcaaccgccactgttttctttaatatcattaagaattcatggatttttatgtattttaagtgtatcaacccattgtggtcattttttaatgcttaaacagtgtcatcttataaattaggagccccttctgttttcacttctatgttttttttcacattatctcgttagtctttgttggcgtccttgctttttggcataagctattttaggctcatcatgtacactccctgccccacccctggaattagccattttacaaggaactatgtaatttttcagtgaaccttggtatttagaaactaagatgggaatactcaggggattattattttaaaagtcatgctacctgatctttagttgtgctcttttccctgctattgtgaatacattggaatgactcttgcagcattttattgaaaattcgctaaacatggctttcatttgtttatgtagtcattcattcagccaaaatttatagaatgcttactatcatgtatctggtcttatgctgggcacagggaatgtgagggtaaacctgactggtctcctgtccttggagaagactcattctagtgtggatatgagcaaatacgcagtgtctaaagagcagtgaacagtactgtgttcatactctttagacactgagcatactctgggcataggcaaatgggctataggagcacagagaggacatcccaaaatgctttggaaagggaagataatgcttgatactggtgagtaaatgaggtatgaaggtagaagagtaatgaagagtgttccattcagcaaactggaagaagtaggggggaatcttgatatagtcaaggaaaggcatatatgtagttggttatgatgggaacataattgtgtaagtttttcagttttcagaagattgacaaaatagtctatttaccacagacatgaagatgtaaaatgttgtatgtatgtgttgttgatttttattttaaatctgataatgaaataatccaaattctaattaaaattagtatttaatgtacttcttggacctgatcatattttttagttatttcattaatgttaaagcatagttacagttaggagatgtctatttcgtgttttagttcactgcttctttattttttactattattttgctttatacgtgttaagaatctgaattttcaagatatgacattaaaaatagtggcatatttattgtggctcttcatctcccttcattctttggctgctatttgtgtcaacccgtttaataccataattacagccccttacatactcacaaggcaaagttgttccagaaaacatgtcatctctctttattaccaattggacattatactatacctgttacattttacagcatgttgcacctgaggctatccatctgacagatactgcatgaatagtatgttaaacacaggtttgtggtttaccggagtgctatggtttaccagttgggaattttgggaccgtgagtgtgggagaatcactaggcttaggaaggaaccacatctcatatgtggccaggaggtgaaggggtgttctagaaatcattgaagaatgtggggaagcttattttttaagggggattctagaggtcacaaagaaaagattccaggtgggaaggagagcagtgaaacagtagattaaaggggaagtgggagtagattactacttttcattctctctatttgtcttctttattataagaataatatgttcccagagtcctgaaaggcaagaagtatgagtgaacaagcggggagtcagagaaggtgagaaaggaaaacatacactgtctgagaacgtcagatgtgatgggagagcagtggggggaagatagattgcaagccttaggatggattgataagtcttagaaaagacagatcattaattaattaatcagtcaattaactaaaaacatactgatgactagctggataatgagaacatgtaattgacttaaacatgttttcaactgagtgaggtagacatagacattgcaacagcggtgctatgctagaggagagaccaaggtgtggtgctggcagtagagacatagaggaaggacctctaacctaccttaagggctcagagaaggcttcctagaagagaccatattaagtgcacatgtaccctaaaacttaaagtataataataaaaataaataaataaataaataaataaaaaactgaattttgacaaaaaaaagctgtgagtgggaccagagagcaagtggtcattggtcatttagacgatgtaaagtagctgactggatatgccatttagccttgagcttgaaagtacctaaaataatgggcaatttagaggttactctgtggtctagtaaagctaaggaaaaggggcaaatggaaaggaatagttttataaatggtgtccccattctcccagcccatggcaaccactaatatactctctgtctctctgaatttccctattctgaacatttcatataactagagtcttgaaatatgtggccttctgtgtctcacttcttccagttagcatagtgttttcaaagtttatccatattatagcatgtcttagtatttccattccttttcatggctgaaagatattccattgtatgagtataccaccttttatgtattcattcatcagattgtagatggacagatgagttgtttctactttttggctattatgaataatgctgctgtgaacttctggtatacgtttttgtgcaaacatatgttcttctcatttctctggggtatatgcctaggagtgaaattgatagtaactctatacttaactctttgaagaactgccaaactcttttccaaaatggctctaccacttaaattcccaccaggaatgtataaggttccaatttctccacatccttgctaacacttgttgttttcctttttttttttttttaaattacaaccatcttagtgagtatatataataaagaatctcacttaatttttaaaatataatatttaaccgctgacatctttttttttttttttttttgaggcagactttcactcttgttgcccaggctggagtgcaatggtgccatctcagctcaccacagcctccacctcccgggtttaaccgattctcctgccttagcctcctgagtagctgggattacaggcatgtgccaccatgcctggctaattttgtatttttaatagagacggggtttctccatgttggtcaggctggtctcgaacttccgacctcaggtgacccacccgcctctgcctcccaaagtgctgggattacaggtgtgagccaccatgttctgctaactgctgacatcttttaagcctcacctctccctcttcattttctgctccacaactgggcaagttaattagaaagcatgagtgcttcatcctttggagctagcaagagattcaaaccatgcaagtgtcttcctgaatgtaagaaccctcactcctgcctcatcctttaaccacagtaaaaactcaatttagtttcctttccttgctttttctaacctgcttaggagacttgccttgctgtccccagaaatgcattgtttatgtaagtaagtagtaaacattttcataccctctttgtgtgtgaggtgttatcaatctgaacactggaatcaaaatttgggtggggtccctccttcttctgcaggatggcaagaacaattggcacagtgagcttggtgctcagataatgacagccatcatggggggaagggagtatctttccttaattgctttggctcactaattggttctgatggcaagcataaacattgagcctgcaagggtagctagttttttagttgtactgtgctgtgttgtattgttgactcctgtagaacctctcttacagatttagctaacttggaagtttaggtaatttaatggacattgaggaacagtagtatgggatccttaaagtagccctggatcatgtgtctcagcccagacctatttgtgtgtcttaacgtaaagctgtgactgatgctaggctcaggaggaaaaccatgtctatgactagctggttttgtgtctcaattaggctctgaccctgacagctgactgcccattgggtggtcgctcttgagagcagtcatcagggagtgaaaaaaagagagagaaaagagaaaagaaacagctattatgtggcttgctggggtctggacttcgaagcacaaatgactcactagaacccttaaatacctccgttgttatggctgttgctgctgctgctgccgctgccgctgctgctaccgccgccgccgctgccgctgccactgccgccaccaccacctgtgcttctgttgcaacaaagatcctgatcttcaggattatagggaaaaacattagtggcacccctgtagcatggagaaaggggtaattcaaacccataaagctcctagtcctttaatcttatatgaccaccattgcctttggggaggccccttacagtgacagtgctgatttgagactttctgcaggaagacatttataaatatgagcaggttagggaccccgcagaaatatatccagtaacaacagcaacaaaaaaacaagtacagtcatgtacagcattatgatgttttggtcaatgacagatcacatatgaggacggtggtctcataagactataatggagccgaaaaattcctgtcatctagtgatgtcatagctgttgtaacattgtagtgcaatgcgttactcacgtatttatggtgatgttggtgtaaagaagcctgtagtaccagtcatataaaactagaacaagtaccattatatatggtacataatacttgataatgataaaaaaacagctaggtgtggtggctcacgcctgtaatcccagcactttgggaggccgaggcaggcagatcacttgaagtcaggagtttgagaccagtctggccaacagggtgaaaacctctctcttaaaaaaaaaaaaaaaaaaaaaaagaaattagctgggcgtggtgacgcacgcctgtggtcccaggtactctggaggctgaggcatgagaatcgcttgaacctggggggcagagcttgcagtgacccaagattgtgccactgcactccagcctgggtgacagagtgagaccctgtctcaaaaaaaaaagatgaaaaacaaccatgtttatgtatttactataccataatttttatcagtattttaaaatgtagtctttctacctattaaaaaaaaagttaactataaaagagccacagacaggtccttcaggaggtattccaggagaaggcattgttataggagatgacagctccatgtgtgttattgcccctgaagaacttccggtgggacaagatgtggaggtggaagacagtgatattggtgatcctgactgtgtagggttaggctaatttgtgtgtatcttagtttttaagaaaaaagtttaagaaataaaaaattttaaacaaataagcttatagaataataatataaagaaagtatttctgtatagctgtataatttttttttttttttaagatggagttttgcttttgttgcccaggttggagtgcaacggtgcaatctcggctcactgtaacctccgcctcccgggttcaagcgattctcctgcctcagcctccggagttctgggattttaggcgtgtgccaccatgcccggctaattttgtatttttagtagagacggggtttctccatgttggtcaggctggtgtcgaattcctgacctcaggtgatccgcgcatctcggcttcccaaagtgctgggattacagatgtgagccactgtgcccggccatgtgtttgtgttttaaaagctaaacatcattacaaaagagtcaaaaagctttacaaaattttaaaaagtttataagtaaaaagttatagaaagctaagcttaatttattattgaaagaaatgtttaaaaaatgattttagtgtagcctaagtgtactaaagtgcacattagtgtacagtaatgtcctaggccttcacattcactcaccactcattcactgacccacccagaacaacttccagtcctgcaagctttattcatggtaagtgcccagtacaagtgtaccatattttgtctttttttttttttgagatggagtttgactcttgtagcccaggctggaatgcaatggtgcgatctctgctcactgtaacctcctcctcccaggttcaagtgatttctcctgcctcgccctcccgagtagctgggattacagatgcctgctaccatgcccggctaatttttgtatttttaatagagatggggtttcaccatgttggccaggctggtctcgaactcttggcctcaagtgatctgcctgcctgtgcctcccaaagtgctgggattacaagcgtgagccaccgcgcctggccatatttttgtcttttataccatatttttactgtaccttttctatgtttaggtaggtttagatacacagatacaaaaatacacagatacacaaattgtgttaaaattgcctacagtattcagtacagtaacctgctgtactggtgtgtagtctaggagcaatagtccataccatataacacaggtgtgtagtagtgtataccatctaggtttgtgtaagtacactctgtgatattcgcacaacagtgatgaaatcacctaatgacacatggcatttctcagaatgtatctccattgctaagtgacacgattgtaaaagaaagaaaaaaaaaaaacagatatgagaggcagaggaaacaaacagaaacggagatccacaatttgacccaattagaatccagaatttatggaaaaattttactaaaagagcaaaaagataaaagggtgctgattggtgttgaaatgcagtgggtggcaaaacttcatgaccttaattactactggggctcaaattggttattatgtcaggatcccactatatttaatcaaggtgcctcctgtaatctaaggggagttcctgaacaggaaagagataaacaagtatacctcacattaactatcagaactattgccttgcctgaattcctcacatttgtaccattcattgccttaaaatatcccatagtgggtatgagcactctgatccaatgagtgataaaattaagtatttggcacatgtgaatccgtttgacaatgtgagatcccaaggactatacccccagttaaaataggttaatacagcccactgtaaattagaataagtctacaaatatggaaacccatgatacaaggcctatttggtgaaagggtgattatccccatgtcttctccattaacaacccaatttggcttgttcttaaacttcaaatgaatggcacctaatggtggattaccataacgctaatgttgtggtcccacacattaaggtccccatacccaatattgttgacattactgactccatccggtctgtgactggtaaatattttgctattatagatttggctaatgtgttctattcactgcctatttcaacagcctttcagcctcagtttgccttcacctctgaagggacacaataaacatgtacctggctactcatgggatacctccacagttttgccattgtacactatctttgctggcaagatcttaactgtaccgagctttttctagatgtacaggtgtgatgttacattgatgacatccttccctgaggagatttatttgacacactcattcaggaaatacagatactcacaaaattgctcataaaatggtatggctgttgtgccacacgtagtgcaaggccctaccacttttcaatacctacacattatttgctaaactgaagaccattctgtctctgacactgtcagaaaagcagctattgaccctgtcagcacccacaacttcttttaggttcatttgtgttctggagacaaaacattcctcttttataaattttattgaagcccatttacgctatttcttacaaatcagttcatcttgaatgggggtcccctccaacaagaggttctagaatctgtcaaaattgcaatatgacactaatgacaattagtcactaacgacaatatcgttagtgaccccagatgcgcttcaccatagaggttttagcaacttcctcatttctccctctggaacatccatcattgccataagttgccaagggtttctgaggcaagagactgtcatccttggacctgttttatacaccattagagtgacaattgctagctgcatagtggactgtcttagaaatagaggctatcacaatccctcagcctgtgaccctccatatccagctgcctattgtgccttcggtcatggaagccatggcactacaagctgggcatggctactgaggcctctttgctacaagatggagaaaaacctgggtcttctgtcatataccacttggaggaaggggtagcctcccgtctttagttccttgctaaataccatggtgttgggggacccatcacccctctcccagaccctgtggctacctgcagagccccttgagatcaaatggagtgaaaaacaatggtttgtacaatttatggatgataccacaagcattgtatacaatggagtttgctggagagcttatgcgtttcatcctttaaccatgatgcttctgataaggacaggaacacaggtgtcagtacagttggccaaacttcaggcattcaccttagcactgtatgccctagccaacaattggccccatctgcacatttttacaggttcttgagccactgcctaagagttgccccatttggggaaagaactctgagaatctctaacctcacagatacccaaaatgtaaatcaagttaacacatttatcttcacatagtgaaggtcaaacataaggtctcaccaagagactccttattttccttcagaatttgaggcatcattgatagtgatgaaggcactcatttcatttcttagaatatacagtcctgggcttaatgaaggaatacaacaaaacatttactttctttacagacttcattctgaaggacttacagagcaccatactggcttcattaaacaaatgtatatttgattaaatgaacatggcacatttcagtcattagacaaacatcaggggtgaattgtaagattctgactctattttttcaagtttgctgactttttttttaagcttcaccttcttcccctctgccccacatcgggacaaattgataagaagctctggttgctccctccttgggggtcaggaaaagattcaaaccatggaagctccttcatgtgtataggaagccttacactgggccctaaccacaacgaaaacccaagcttgtctcctttccttgttctgtcaagccgtttcttacctgcttgggaagcctgaccttctccaccaagaaaatcttcatttaggtaagtattaaactttcttgtaccatcttggtgtgtgtaaccagtctcaacgtctaacctaagtttgggatgggggtcccttcttcctcttcacagtgtcaagtagtacctgattgaggttcttatttgcatttccctaatgactaatgatgttgaacgtatttccatgtccttatcggctatttgtatatcttctttagagaaatatctattcaagtcccttctttttaaattacattatttatatttttaattgtttagtcatatgactttttatgtattgtgggtattaggtccctaacagatacatgattttcaattgttgtcttccattttatgggttgtcttttcactttcttgatagtgtcttttgagtacaaaagtttttcattttagtgaagtccaagctgtctaatttttcttttatagcttgtgtttttgtgtcttatataaaaattgttacctaatcaagttcacagtgatttacacctatgctttcttctgtgagttttataattttagcttctacatgtaaatctttgatctcttttgagtttatttttgtatgtggtgtgagataggggtccagtttcatttgcatatagatatccagttgtcctggcaccattgtttgagagactatacttggcactcttgtcaaaagtcaattcaccataaatataagggtttatatctacactctcaattctgttcatcagtctatatgtctacaattattctagtaccttagaatcttagtaactgaagccttgtagtaagttttgatattgggaagtatgactcctccaactttgttccacgttttcaaaaggtgttttgaccattttgagttacttccattttagtattaattttagggtcagcttgtctgtttctgcacagaaggtatttagaatttcaataggaatttcagtgaatctatagatcagtttggagagtattgccatcttaacaatattaaatcttacaattaatgaaaccaagtgttttcccatttttaaaggtcttaaatttctttcagcaatattttgtagttttcagtgtacaagttgtggtcccacacattaaggtccccatacccagtattgttgacaagtctttcacctccttggctaaatttattcctaagtgttgaatttttcttttatgctactgtaaatggacttgttttcttttttaagttttattttatgtttaattgatacacaataattctatttatttatggggtacagtgtgatgtttcaatagatgtatacattgtgcagtgatcaaatcagggtatttagcatattatcacctcaaacatttatcatttccttgtggtaagaacactcaaaatccttcaactagttattttgaaatgtataacgcaatattgttaattatagtcattctactgttcaatagaacaacagaacttgttgctcctatttaactgtaattttgtaccctttaactagtctttctgcctctcttccaccccactttttccctctactctcctcagcctctggtaaccactattctaatctgtacttctatgagatcagcttttttaagattccacaaatgagtgagatcatgtgctgtttgtctttttgtgcctggcttatttcgcttagacttgttttcttaattttatttttggatttttcattgcaaggtagaactacaattgatttttgtttatgatcttgtaacctgcagctgtgctgaactcatttataagttctagtagtttttagtggattccttagaatttttacattcgagatcatgacatccacaaatagagatagttgtacttcttcctttataacttaagtgcctttcattgtgttttcttttaaaattgcccttgttagaatcttcagtacattgttgaagtggagagagtagacatccttgtctttttcgtgattttagagggaaagcttttgatcattaattatttattgatattattattattattagagacagggtctccctctgtcacccaggctggagtacagtggtgcaatctctgctcactgcagcctcgacctcccgggttcaagtgatcctcctgcctcagccccccaagtagctgagactacaggcacatgccaccttgccggatagtttttgtattttttgtagagactgggtttcgccatgttgcccaggctggtctcaaacacctggactcaagcaacctgcccgccttggcctcccaaagtgctaggattacaggcgtgagccactgtgcctgggcctgatctttaattattaagtatggtgtttctgtgactttttcctagatgccattatcaggttgaagaaatttccttctgttcctagtttaagggttttttttatgaaaagttatcgggcttaatcaaaggctttttctatatccattgagatggtcatgtggttttcattttttatgctgttagtatagtgtattacactgcttttcatatatttatccagctttttatttctggaatagatctcagtcatggtgtggagttctttttaatacgtgtcagaatttggtttgcttgtattttgttgaggattattgtgcttatattcataagggatattggtctgtaggtttcttttcttgtaatgcctctgtctggttttgctatcagaacaatactggcctcacagaataagttaggaagtgttccctcgtcttccctccttttaaggagtttgtgtagaatttagcagtgaagccgtcttggccttggcttttatttgtgggtagtgttttgattactaattcaatgtcttcacttgttataggtttctttatcttatctatttcttcctaagtcagattcagtagtttttgtttttctaggagtttgttttatttaagttaatctgattttttgccatacacttatttatagcatttttttataagattggaagtaatattccctctttcatttcttattctagtaatttgagtcttctatcctttttcttgtcattctggttaagggtttgtcaattttgttgatcttttggaagtaccaacttttattttcattgatggctctctattatttttcgattctctatgtcatttatttactccttggtctttgtattatttccttccttctgtttgctttgagtttagttttctttttatagttaattaagatgaaaagctagggtcattgttttagatctttcttgtttttcatatatttatccagctttttatttctagaatagatctcagtcatggtgtggagttctttttatacgtgtctgaatttggtttgctagtattttgttgaggattattgtgtttatattcataagggatattgtaatatagttattacaactataaattttcatcaataaaaaatactgctttcactgcatctcatatgttttggtaggttgtgtttaagttttcattaatttcaaagaactctctcatttcctgtgtagattcttatttgacctttggcttatttagaggtgtgttgtttaatttctacttttgaattactttacaaaatatctttctgttactgatttctaatttaattccattgtggttggtgaagatactttttattatttcagtccgttttatggagacttgttttatgatctaacatatggtctatcttcgatgagaatatttaatatgcatttgagaagaatgtgtattcatctgttactgggttaagtgttctatagtgtctattaggtgcagtcttctttttccttgttgatctcctgtctgattgtttttatctgttattgaaagtgggatattgaggcagccagaatatgttattgaattgttcatttctctcttcagttctgtcagtttttggaatctgttggtagatgaatgtaagtttatcatagttatatttttgtgatggattggcagcttaaagattgcaaaatgttattctttgtctgttttaccaatatttgttttaaagtctattttgtctgctattagtataaccactcctactcttttttgggtaatgtttatatggtatctctttttccattcttttacgttaaacttatttgtgcctttgaatctaaaatcattctcttgaagataatgtatagttgggccataactttttttgtcgatttaactagtctctctctttattggagagttcaatccattcacatttagtgcagttactcttcaggtagaatttacatgtgtgttttgttatctgtcctccttatgtcttatgtcacttttgtttttctattcttacattactgctttcatttgtcttaaatattttccactgtgccatttcaattcccttgttgtttctttgctatatattttggtattttttttttagttcattctttggagattaccattaacatctcaattgatgagaatctagttcagatttatatgaacttactgtcctagaatacaaaagctttgcttctttaatagcactgtaaccttctttatgttgttagtgtcacaaattacgtctttttgcactgtgtgtccatcaacgtagatttataattattgtggtagtcatgttttaagtcagactggaaaacataggaattgcaaattttaaaaaagcaacaactatatttatactgtttttaatatttacctatgtagttacctttaccagtgtactttatttcatcttatgatttcacgttactatctagtgtcctttcctttcagactgaaggacttcctttagtattgctcatagggcatctgccagctacttgatatctctttcagttttgtttatctgataatgtcccattttctccttcacttttgaaggatagttttacttcctttattagatatagaattcttgattgcagttttttttctttctgtaacttgaatatgtcttcccactgctttttggccatgacttctgaggagaagtcaactgttaaacttctgttttcttgtttgtgaagagttgtttttctcttattgctctttgggattttctccttgtttttggctttcagtatttttattatgatgtgcctatgtgtatatacttctcatttttcctacttggtgtttgtttgctttttagaatgtgtatgtaaacattttttcatcaaatttgtgatgctttcagctgtaatttgttcaaatatcttcttcctcttttctattttcttctctgattcccattatatgtattttggttgctagatgatttcttacaagtttctgaggctgtgtttatattgtctctgtgtgtgtgtgtgtgtgtgtgtgtgtgtctgtatatatatatatacacatacatatatacacgtatgtatatatacacatatatatacgtatatatacgtacatatatgtatatatacatatatatatatgcacagacacacacagtctcagaaacctgtgtgtgtgtgtgtgtgtgtgtgtgtgtgtgtgtgtgtaaaatttctgttcctcagactggatgatctgaattggactatcttgctgactatttttttctatcagtgtaaatctgctcttgagcccctctaatgaatttttcgtatctgttactttatatttgtagggggcttgaaggatttaggggcttatcaaagaaagacatatgtctatgaggtggcagtatcacacacaagctttattgggagatgtgttgacaggcttgcatgttggggaagtctctcacagtaggagcctgtccagaggccatggcttgggagttgctactctgaaggggaagaggccatggaatttccagagagggagattgtagaggggacttgacttacatgtttaggtgatggctactcagcagcacagtggggagtctctgggtcagagagagctctaaagggcaacaatgtgtcaaaagacaaaattacaacaaatttagtttaaagatctcacttggccgtatttgtgattctagaatcaggcaacactattccacaaaatagaatacttgttcaaatgagctgagagcagaagaggttgacttcgtagaggagaagggctgaagaagcaaagaacaaagtgtatttattgtatgtgtaaccactaaagtatctactcagtagcttagccatcattggataaagatttccttaaatgcctgggaccaataaattgcatcatctttaacaaagggatctgtatacatcttggggcatgcaacacttagccaggcagtttacaaccgtacattagccttcacttcctgattgcaaagagccgaaaagtcagttagaagtgagagtttatggccttctcaggtgtttcctgagcatgcacacagccctatacatgcagatggtcttctatattccctagaaaatatcagaactcttcaaatcccctattgatagcttattcctcagcttttcctttcattctttttatttagtttattgtttgctccaagtgttatcatttgtggaggggcttttagtatgggttttgcactgaatcaaacataaaccttttaagtagcgtcttctggggaaccaacagacaggacaaataatgacagttctttagaactgaagctttgggagttgatgccactgctaaacagctgagccagctaatgtagttctttgacagcacagaaatgtagggagaaatgagcagcccctggctgaaatgccgcagactctccttgttcttacttagttctgtagattttgttgccgttgatcaatccccagagactttaggtgattggctttgcttgttttgaccagttttattagatgtctctttggggaggagatttcactgagctcctcacatagccattccagaattcccataagtttggtgttgtatctaaaacctcattgctaaagcctaaggtcatgcaagttttctgttttcttctagaagttttataattttctgttttatatttagattcgtgatccattttgaattaattttcatgtgaagtgtgaggtttgtgtcataattttattttgcacatggattccagttgtttcagcaccattttttttggcaaagattgtccttctccattgaattacctttatgcttatgtaaaaaaaaatcagttgactaaatgaaataaactgattaaaaaataggcaaaagacctgaacaaagacacctcaccaaagaaaatatacagataatatataagcatgtgcaaagatgctcaacagcatatgttattaggaaattgtaagttaaaaaagataccactacacatttattagaatgttccaaatccaaaacactaagaacatcacatactggtggaaagatgaagcgacaggagctctcattctttcctggtgggaatacaaaatggtatagccactttggaaaacagtttgacagtttcttacaaaactaaatgtagtcttaccatatgatccagcgattgcgttccttgatatttactcaaatgggttgaaaacttatgtctacacaaaactctgcacataaatgtttatagtagctttattcctaattgccaaaatgtagaaacaatcaagatgtcctttagtaggtgaatggataaattgtagtgcgtccagacgatggagtttagtgccaaaaaagggctatgaaaagccttttcaagccatgaaaagatatggtggaatcatatgtgcatattactgagttttaaaataagccagtctgaaaaggctgcatatcccagctactcagaggctgaggtgggaggatggctttagcctgggaggcagaggttgcagtgagctgagattgcacagcaccccagcctggacaacagagcgagtccctgtctcaaaaaaacaaagaaaaaaaaaagaaagaaaaggctacatactgtatgattccaagtatttgacattctggaaaaggcaaaactatggagacagtaaaaagatcagtggcttccagggtttgggggttgggaatggatgaatagacggagcacatgggatttttagggcagtgaatctactctgtatggtactataatagtggatacatgtgtttatacatttgtgaaaacctatagaatgtacaacactgagagtaaaccccaatgtaaactatgaactttaggtgagaacgatatgtcaatataggtccatcaattataacaaatatacatacccttctggtgggagattttcatagtgagggtggttgtgcatatacgggagcagagagtatgtgaggaatctctaccttggactcagtttttatgtgaacctaaagcttatctaaaaactaaagtcaattttttaaaagtcaactgaaaaaaagaaatgcttctctctcccacaccttgccccaatcctcaggcaataataaatggttttgcggtatcaaaaaaaatctgtgattgtatttgtgtggatctatttatggcctccctattctgttctgttgatctatgtgtcatttcttttgctaatactatggcaccttgattactatagacttacactgcgacttgaaatcggataacatgagtcctctaacttggttttcctttttcagagttgtgatagctgttaggtcatttgccttttcatgtatattttttagattcagtttagctatgtctacaaaatgcttgctaaaattttgattggaattgtgtttatatggctttaattgagcattttatctctctctttgcatatcatttatacttgtttttcttaactttttagtggttaccctagttttcacagtacacatttttaatctaagtctttcaaatactattgtattgcttcctgtgtagtgtaggtaccttataagagttatcccccgtttctcccttgctttctttttgacattgctgtcatccctttcacttacttatatgctacagtcatttcatacattgtagtgtttttactttatacacagttacctcctagattgattaagaaaaataaaaagttttatattacttatatttatttttctctgactttctttatgaagattcaagtttctgacatgttgttttttttttgtgcctggagaacttcttttgacatttcttgcaggacatgtcagcttatggtatccagcagtttctctaccatgtaaacaaatcataagtgctagatcttcctgtctctccaaatgttcaagtggtgatttcccatgtggcctcagttctctgatgatttttaaaaagttattgattttcattttgtctagcttttcggtcttgtaagggcaggagtgacatcttcccagttctttacaatttggagctacaattagaggtgctcacatatgtatttttaaatttttcttgtggatatgttgccaaaaacagtaaaaagaaaacaggtgaaattaattttaataaagtattttattaaacccaaacaacaaaaataacattttaacatgtagtctgtataaaaatacttaagagctattccacattaaaaaaaaaactcttctaaatatcatatggattttttctacttgtatcacatctcactttgaactattgcatttcacgttatcagtaacccaatgcggtttgtggctattgcattgggcagcacatgtccaaagagaatatgtagaaagagaaggaaggagagttgaggatgaacttttggggatacagttaggtattaagcagaggaagagaggcctaaagacagagaaagaaaagtcagagaaaaattgaagacagcaaaagtataactgaaacaaagggaagaatatgtttcaaggaaaaataagtattcaaatagtgtcaaatgtggcgaggagctcagggtagatatggagtagatatgggaattgacaaatggaaaagaatagagaatacagaaatagaccagtgtgtttgtgtatgtgtgtgtgtgtgtgtgtatatgtatatatatgtgaaattagtaaatgaaagaggtgtcaacataaattaatagagcagagtatatcattcaatacatggtgatgggacaattgattatccatatagaataaaataaaataccaacaccaaaaacaaaccattaattttttatagattataaacccaattatgaaaagcaaaactttaatttttaaaaaaaaaaattaggggactgtttattatctcagggaagggaagggttgttgaaacagaatgtataaagaatgcctataaatcaatgataaaccatccaatccgaaaaatgggcaaagttatgaacaggtaatttataaaaaaggaaatacagaagtccaataaatacattgaaatgtggtcaattgcactaataacaaggacaagggactgaaaatcaaaataatgaaatgtcacttttaacatatcaggtaaaaattttattgtttgacaatacctggtattggcgtggttgtagggaaacagtagtcttcatatatggctgatgtgggtggaaagaaatacaatcacattcaaatgaaattaattgtcaaggatctagtaaaattgtagatgggcatttccttctgttgcaacatttccaattctaggagacatggaagaaaacattgcggtattacgtgatattgtgaaaaactggaaataaactaaattccccaactgttccaaattaataggggaatgatcaataactcatcagtcatcatctattcatacagtgcaatttaatatggcagtgaaaatgaagaaatcacatcaatatatatcagtgtcatcttaaaaacataatgctgattgagaaaagtgagttacagaacaatcacataatataccatttatataaacttaaaacatacaaaaatactatatattgctcatagatacagatgtgtttgaaaatgtatgtataaagaaggaatagaaatgatgcacaccatatcaaatttggttgcctctggggagaggaaaggataatggctaggggtgggtttaaagagtacttcatctttatctagaatgtttagtttatttcataaaatagatgaagcaagtgtgactacatttttaaaaatgttagcaattgttaattctgggtggatattctatattattctatatttttgagatatttccaaaataacaccaataccaattaaagtttataggagatgaggaaagaggaaaaaaaaaaaaggtagtacctggagaaagatgcagaaatctggaggagaaattactttcaaggtggtaaaaactcaaatagatttaactactggtgggaaggagcctagggagagggagtggttcaaagtacaggtgtaaggagagatgattaaagtaccaggacccagcttgtgaggagtgaagcacagccattttccccaactgatctatcatgtatttgtcacctaaggcaaaaatgtatttcttaactgatacagctatttgtaataaggtttcatatgctgtctcctttgtgttttatatatttatttatttatttactgagacagagtctcactctgtcaccaggctggagtgcagtggcacgatctcagctcactacaacctctgcttccctggttcaagagattctcctgcctcagcttcccaagtagccgggactacaggcgcgtgccaccacgcccagctaatttttgtatttttagtagagacagggtttcaccatgttggccagggtcttgatctcttgacctcatgatccaccttcctcggccttccaaagtgctgggattacaggcgtgagccactgcacccggccttcttggtgttttatatatgataactacatatcaagcaactgttattcccaatcttgacttgaaaaagtaacaaaatgttcctaacaaagttacactgagatgcaagtacagtgttttctgacatagctcttgcaaaaaatattggcaataaatgtatttaaaaataattttaggctggaggcagtggcttaagcctataatcccagcacttggggaggccaaggcaggtggattacctgagcccaggagttcaagaccagcctgggcaacacagggagaccccatctctacaaaaaaataaaagaattagtcaggcatggtggtgtgcacctgtggtcctagctactcaggaggctgaggtgggaggatcacttgagcccaggaagtgaaggctgcagtgagctgtgatctcaccactggactccagcctgggcgacagagtcagttgctgcctcagaaattaaattaaattataaataaataaatacataataattttaatgattaagaaaatttcaggaattagtaagttcccaatattgttgtttgggcattggaagcaatgtactatgaatctttaaattttccaaatacagagtttccaaaagataaatggacatcctcactgggctctatgggtaacttccttttcatcttctcccactttgcaggctaaacaggcactctgcacttttttcctttttaaagaaattatttttatttctaattattatggctatataatagttgtatatatttatggcatacatgggatgttttgatacaagcatataatgtgtcatgatgaagttagtgtttatcatttgtgttaggaacattccaattccactctgttagttattttatttttattttattattcttacttttttgaaagaagatctcactctgtcacccaggctggagtgcagtggtgcgcaggcggttcactgcagctccgccttccgggctcaggttcctcccacctcagcctcctgagtagctgggactataggcgcgcaccaccacacctggctaatttttgtatttttagtagggatggggtttcaccatgttgcccaggctggtctcgaactcctacgctcaagggatctgcccaccttggcctcccaaagtcctgggattacaggcatgagccactgcactcgatctcctttagttatttttaaatatgcgataaattattgttaactatagtcaccctattgtgctactgaatactagatcttattcattctatctaactgtatttttgtacccattaaccactcccactttatctctccctctctgctactcttagcctctggtaaccatcattctactctctccatgagttcagttttttttttagcttccacatatgaatgcaaacatgtgatatttatctttttgactccacttcttttttcccatccaggctccatggaggggaaagagaagggaaaaggtagacaagaaagattggaaacttggtcttgaccctgctactcacgagccttaatgtgtcttcttacctcttcttttcctcacctgccaaaacctctgcagccctacttctgcatgcctccccaccttcactcttcaggaattactaggaagttctactcatactgggagtcaaatgggatatcaaggagataggtaggagaatcagcagtactaccagggatatagcactggaagataggttcttagcatctcagtgttagcccccttttattaatttctcataaaagcacattgttttattagtggtctttatctacaatagtattggaaaatttcagcaccaacataggtcaagcaatcttatgtagtccaacgtaagtacctaactaccatttatggcattttctttttttaaatggaaaactgttttgtaatgcaattttcttataaatggtagtttggggctacatttaattcatgaaagttagtaagaaagtagaagaagaataaaagtttgagttgacaaatcccatatgtgaatcctttgaaatgtttattaaactaaagcattatattgtggttagatttcaggaggtaaaaagtggtagaaattactttatttagttttttttttttctacaggaataaggtagtggaattgctctctgataccctaagtcagtcaaccagtctctcccaccccacacacatacatttagttttttctatatttctcaaatgtgaggtacctttaatttcttaaaaaatcttagtaagtgtgctgttgctgaatcaattttttttacattaagtactacagggtttcatctgtcattactttttgtgctaatcattttgtaacttttatctgaataattcaatacttgtaactaaattatgtttgaagattcttaatctatataggataaaacttgttttattacatttcatttattagtgttactcatattagtaaagtgtctactttttctctatggttgtcagaagctggagaacaccaagtaatttaagatttatttgatttgagactttaccatcgtcaggatatttaaagatatttaactagggacagtatatgtgttaaaagctgacttctactttataaaatcacgaaatattaaaatatgcagaaaagtgtaaataataaaacaatgaacacttttgcatttattgcctaactcaatacatttagaaaatcgcaatgcaattgaagccccctgtatgaacccccaatcacatcctactcctttccctctacatgttgccattatcttcaattcagtatttatcattcctctgcatgtcttttgattttcctacttatataaatatcacttgaaatatatgaaattattttgcttttttgaacattatatggtagaaatatatgcattcttctacaaacttgcttttttattgttcatcatggtatttgtaagactcattgatgaatgtaaaactcatgcatctatttataatcccgtataaaatcataattaaaagtctcactccattttttaatgtttgactgctgacagctttgaagtcttatctctccctcttctccctctgtcccacatctgggcaagataagaaagccaagatgctgcattccttaccaccagtgtaaagttcaaaccacaggtgagaatcctcattccagccccacccctaaccaccataaaaacccaagccaatcttctgtccttgctctatcaagccatttttggatgtgtctgagagccacccctgctctctgcagaaagcctcattatgtgagtaatcagcttttttatgaatattggtgtgtgtttgtttggtatcattggtgttgacatttaaaccaaattttgaactggagtccatcctgtccttgtggagtattcaaaaaattatttcagtgttcttttgttaatggatattaggttgtttccttttttttatagttgaaaacactgtttctatggatactttttattttttcttattgatttgtagaagttacatttatattctggatatggattccttgttagtgttgcaaatatctgctctcagtccgtagttagtctttttaccttaatggtttcttttgtagtacagaggtgatgaattttgatataaattttgatcaaatctaccagtctatttatgattgatctttgtatctttaagaaatatttctctgatttggagactataaaaatgctcttctaaatgttctaaaacctttaaagttgatttttcccatttaggactttgatctatttattttttgttgtataaattatttcctttcttgtaatgtctgtctggttttcgtatcaggatcatgctggcctcatagaatgagttaggaagtatttgctattcttgaattttctggaaaagtttgtgtagaactggtattatttcttttttaaatgttggtagaatttgcttgtgaagtcgtctgactctttaaaatttcgttgtgggaaggttatacagatgctccttgatttacaatggtgttaaatcccaataaagctgtttaagttgaaaatactgtaagttgaaagtgcatttaatacacttatcctagcaaacattgtagcttagcttagcctaccttaaacatgcttagaacacttaatattagcctacagttcggcaaaatcatctaacacggagcttcttttataataaattacatgaatatctcatgtaatttattgaatactgtgctgaaagtgaaaagcagaatggttgtattggtactcaaagtatattttttatggaatgtatattgcttttgtgtcatcgtaaagttgaaagatcataagttgaaccatcataagttgggaattgtctgtactactaatttagtttctttgttcctttgttactaatgtgtctttttgtttttcctggattgtttccagagtttttaaaaaaatctcttaatcagattgattgtgatgagccttgtagtttccttcatgtttcttttgcaccaaatttgttgatattttttgatttggaagttaaaattatcgctaaaataatggcaaaacccacaattaatagtaacatttgaagaaacagtggctaagaattttagctgccttcctctcccgggactctgagcttcatctccttacctcaggggatctgccaggtgaaaagtattaatacttctctcatccgctttggggactttacctgtgtattaagttgcttgccattgttcaacagtccactgatatttttcatacttcaaaaaaattcttttctgtttcattttggatgatttttatttccattttttcaaattctttaatctttccttttccatagtttaatatgtcatttatccaatttgtcgtatttttaagctcagatattattatttacatctctaaaattttaatttgggcgtctttgttacagttttccatgcctctacttaactttgtaaatgaatagattatgtcataactttttaaatgtccttgtctggtaactctaacatctgcatcaattcttggttggtttcaatttattgatttttttttttttttattttgtaatttcaagcttctttgcattgctggtgatgtttgtttacattcaagccttgtggattttaccttgttggatgctagatatttttatataactaaaaatttcttgagctttattctggaatgtgataaaactacatggaaacagtttgatccttttatgtcttgcttttaagattgattaggtggaaccagggtggtgctcagtctacggaaaattattccttgctggctgttggtaacaggtgctgttcctgtctcagtgtaagtgatgaaaactgttctttctagtgatttcaaatggttctttcccctgccttgggtagttgcctctgtatacactaatgtgtactctgttttttttttttttgagatggagtctcgctctgtctcccaggctggagtgcagtggcacgatctcagctcactgcaacctctgcctcccgggttttacgccattctcctgcctcagcctcccgagtagctgggactacaggcatgcaccacctacgcccggctagttttttttgtatttttagtagagatgggggtttcaccatgttagccaggatggtctcgaactcctgatcttgtgatccgcccgcctcggcctcccaaagtgctgggattacaagtatgagccaccgcgcctggcaatgtatacgctgttgaatactcaatggagcctttgcagatctcaggagttctttttctgcactgtttccccattctgctaactattacctgcagattttagctgccttcttctcactggactctgagctttgtctccttacctcaggggatctgccaggttctgactcagttattacccttgcctgtggcatgatctgaaaattctctcagggaagtacgctggggcatttatagggtcaccttgtttctttaccatttctcaaggattattggccctcactacctgatatctattgttgtgagaataatttgctttttaatttttcaacaagttgggtaaatggtccctgttattccatcttgcccagaagtgcaagttcagctgagagtttaaaaagtgttaagattctcataagttttttatgtagggaatcttatcaactctaaatattaacaattccctttattcatttctaatccttactctcttctgctttctccttttccttcttcctcttacttcctcccacacctctggatagggccttcagtataatgaatgaaagggatgatagcagtgattcctgactcccattattaaagggggaacacatttctaatgtcattatttgttttttacaatgaagcctttgtgctcttctttcacatcagtttacaagtgctgtttgacaagaatttcctgtaagcccttaagttattgagtaacagtttagtgcttaagttaactgtcaaacaacatttattatatgccatctttcaaagtacttacctatattaacgcatgagaggcccaaaacaaacataagaggtaggtactgttattatccccacttcacatatgagagacggtgaggttaaatacatttcctaaggttgcacataataaatggtgaagctgagattcgagtctaagaaacctggcactagagcccaggctgcttctgcactgtatttctctgctcttaactaatatgagagtattaaatgcaattgtcagttggttcatttaaatgaccacaaagacatttctagcacttagtgttcacatttcaattatttatgccagccaagtaaccactatcaacaaaagttacaaacagtagatatttcactataggaaaagatgggagtaaaattgtagccctcttagcaggttggttttgaggaatttaacttactagattcaagttacgtgattcctgctatcccatgagttttgttggctgcaggccagggattggctgtttactactttccgctgtctcagtgctgtaataccctggcctaatggctctaattaactccatatatttgttccagaaagatgaagaggttctgtatagttaagaatcaataaaatacaaattgttgcttaggaaaccccgtgtactcttagtgtcagtaattaactttttttctggagaagtttaagaaacaggcccaagccattcaatagccatttgtgaagctgatatttaaagaaatgtagatgctgcattagaatctttaggcatctacaccaagaatgcagtgattccatcacaaaaatttcttttctttcctattggcagattataggaataaagtatttctgatttaactaactcaggtaccagggaatatttgggcaaattagtacatctcttgttttgttttttaaaattttttcataaaatccagatcctgcacaataataaatctcttaatttattagtagctgctttcttaaaaggatttatgaacataactttctgctttactaatacagagctgaagcagacttaggaccgatgagaagaatgtaaactaaaaatcatgtctttatgaaaataggaatttcttcctaagatctgggtgaggtttctcagtggcatacattgacctcagtggtcaggatacaaaactcacacagacgataaagctgacgaagtggaggaaattggcttgcaaacacttggagaaatcacttcaaagtaaaaccactttcaaattgctttttttttctgactatggaatagtgtttagcatgtttcagcaaaagtctgcacaacaatacactagatataaattttaaaagacaaatagcatcacagagcgacactcagggagagatctatttctgtagagtataagtggcttaagaacctaaatgtggatattttaaaattaaaaaaatcaaacctcttccactttggagattatttatgtgaaggtttcttatggccattcctctgccagagctctctagaagagcagagtgtttcttaattttattccagtcagattcactactattcgaacatttatcccaaatacttatactctcaatacttaaatttatctcaatctatcaagtctcactgcttctccttttctttttattctccacatatttaaagttactagtgtgtccacattagcagaattccttgtgtccaggaagatgtgtcttctgtgtactaaaaagcaatatcctcctgtcctatgtgtacagaaatggatccaggcagaaacctttgagtagtcaactgcatgagcagcttcagatccatgacaagtccttcccttcctgttccatacctgctcttttgttctaagagaaaactgttttataagaaaatatgtatgcttctgtctctattattatataaaattcagccttcctccatttctgccagaaaaaaatatgttctttaagcttgcatttttttctataatcttaataaaattttagaacttagccttaaaaattcaaggctcataattgacaaaatgagtcttcatgcctatagctgcaaagggatacatgccatcttgtattataaaaccaattccatgaatcttatttgatatagaaatcaatatgtctgcaaatatttttatctggttttcttttgctgcatggagatttgtgtgaatatacagaactgttaccaacctgtggtcttcttggttaatagaaatctgtccttcaaatttttcatgtcaacaaatggagtcctgtaagacaatggttctcaaaatgtggtccagggagccctgggtgtccatgtgaccctttcaaggccttttcaagattgaaactattttcaataacgctaatacattcgctttcaaaatttcattatcttgcagtgttacagtggattttaaaaagagactttctgttgtgagatatcataacagattgggtgaggaatcagatatgagaatttagttgtcagctattaagtcaaacattaaagagatttgcagaattgtaaatcagtgccactcttcccactatttgttttattttggaaaatacagttattcttcataagataggttatttatattaacatgtaatgagttttgttattatttaaaagtaagtgaataaatatttaaatttctaatacactaaatatggatagatagaacccacatgaaccaaggccttttggggtcctcaaaaaaattttttcggagtataaaaggctctgcaaaacaaaaagtttgagaaccgctgctcaagattccaaagacttttttttttaaattttattattattatattttaagttttagggtacatgtgcacaacgtgtagattagttacatatgtatacatgtgccatgttggtgtgctgcacccattaactcgtcatttagcattaggtatatctcctaatgctatccctccccccttcccccaccccacaacggtccccagagtgtgatgttccccttcctgtgtccatgtgttctcattgttcaattcccacctatgagtgagaacatgtggtgtttggttttttgtccttgcgatagtttactgagaatgatgatttccaatttcatccatgtccctacaaaggacatgagctcatcattttttatggctgcatagtattccatggtgtatatgtgccacattttcttaatccagtctatcattgttggacatttgggttggttccaagtctttgctattgtgaatagtgctgcaataaacatacatgtgcatgtgtctttatagcagcatgatttatagtcctttgagtatatacccagtaatgggatggctgggtcaaatggtatttctagttctagatccctgaggaattgccacactgacttccacaatggttgaactagtttacagtgccaccaacagtgtaaaagtgttcctatttctccacatcctctccagcacctgttgtttcctgactttttaatgatcgccattctaactggtgtgagatggtatctcattgtggttttgatttgcatttctctgatggccagtgatgatgagcatttcttcatgtgtgttttggctgcataaatgtcttcttttgagaagtgtctgttcatatccttcgcccactttttgatggggttgtttgtttttttcttgtaaatttgtttgagttcattgtagattctggatattagccctttgtcagatgagtaggttgcaaaaattttctcccattctgtagggtgcctgttcactctgatggtggtttcttttgctgtgcagaagctctttagtttaattagatcccatttgtcaattttggcttttgttgccattgcttttggtgttttagacatgaagtccttgcccatgcctatgtcctgaatggtattgcctaagttttcttctagggtttttatggttttaggtctaacatgtaagtctttaatccatcttgaattagtttttgtataaggtgtaaggaagggatccagtttcagctttctacatatggctagccagttttcccagcaccatttattaaatagggaatcctttccccattgcttgtttttgtcaggtttgtcaaagatcagatagttgtagatatgtggcattatttctgagggctctgttctgttccattggtctatatctctgttttggtaccagtaccgtgctgttttggttactgtagccttgtagtatagtttaaagtcaggtagcgtgatgcctccagctttattcttttggcttaggattgaattggcaatgcgggctcttttttggttccatatgaacttgaaagtagttttttccaattctgtgaagaaagtcaagattccaaagactttagaaactgttgccatgtcctctgagaaaagcttcagaagaaaaacctatagttctcattggttgtcttaattgatgatttgttaccctagtaataatgttgtaatgaacttacatgtattctcaaacagtgcagatacttttggtgttttcttctctacctcattcatggaggagcaaataaaaacttacaagcctgttagttttgtaatatatttgaagagcctttgtttatttagtttaacactgtactatgtgacacattaatagaagagtttccggtttgttggtgaggtagtcagtttttagtagtaggaaaagctttattttcaacattgtgatttggggactttgttgtttgaatgctttggtttgctccactttctcatgtcttttttctcaccttctacatgtagtatacttgctatagctttaagttccaattgcatatcttctttatgtaaaatgatataatcttgagtcctgctaagttaggtgggccaagggagaaaaggcaatgagcagaggccccaaaatgttaatggtgttcctatgagatgaggtcaggctatcagaagctcatacagctgtagacactttaaagacatcacttctctttattcttagtggattttatattttgagtatgatttgacgttcttttaatgtgccaacaatattagataccactttattaattaattatttataagatggggtatcactctgacacccaggctggggtgcagtggagtggtcttggctcactgcatcctccacctccgaggctcaagcgatcctcccacctcaactccctgagtagctgggaccacaggtgcgcaccaccatggctggctaattttttttttttttttatgtttggtaaaaatggggtttcaccatgttgcccaggctggtctctaactcctgagttcaagtgatccacccgcctcagcctcccagagttctgggattataggcatgtgccactacacccagctaggtgtcacattattaaacatgcttgaagtaataacttctggccttataaagagtttttataagtctccttttgagggctttattttcttggagaaggctttgttgccaatgtttgttgtcaattgaacacattaactgttgcttctcctttcttagacatgagccagggtgtgacttctcattctgcccctttccaggttcccagattgtttttgtggtaagctcaataatgtcccctaaaggtgttcacattctgaaccccagaacttgtcagtatgttaatttacatgttacaagggacttgcagatatgattaagactttgaaatgaggggattatcctggattattaggatgggcccaatgtgatacaagggtccttataagatggagacaggggaattagagttatagagtgaagatgtaagactgacaagtggtcagagaggagagaagatgctatcttgatggctttgaagatggaggaagggactgtgatcccaggaatggaaacagcctctagaaaatggaaaggaccagtaaatagcatctcacctagagcctccagaagaaacgaacctcactaacagcttaattttaaaccagggaagtaaatttttagactttttacctccagaattataagatgataaattcatattgttttagctactaagtttttggtaatttttttatattagcagtaagaaaccaacacagattttggtacctggaagtagagtgctgctgtaccaagcacctaaaaatgtggaagtggctttggaattgggtaatggttgagaatggaaaaattttgagaatacgtggaagaattttgagaatgattgaggatggagaattttgagaagtgtgatagaaaaagcctatatttctttgaattctttgaattgttagtagaaacatagatgttaaacattctaatagtgagggcccagaaggaagtgaggcacatatcagagaaaacctatattatcctaaagaaaatctgtatcagcttgttaaaaatacagacattaaaaaagcttcatgtgaaggcagatatgtagactttaaaggtattgctggtgacagcacagaaggaaataaggaacattttattgctcctctcttagatatgagccagcatgtgacttctccctctgcccctttccaggttcccaaattgtttctatggtaagttgaataatggccccctaaagatgttcacattctaatccccagaactgaagaaaagaagatccttactatatagtggcagaaagcttagctgaatgtggcttacagttttgtagtaagcagacattgtaagcaataagcttggatatttagctgagatttccaagcaaagtgttaaaagtatggctagcttcttctcgatgctcattaaaatgtgacaagaatgagagaaattgaaggaagaactgttaagcaaaaatgaactaggacttgatagtttgggaaattctcagcctatccagactgcaaatgatgttaaaatttggagattcacagtcaggaaagcttactatggagagaaagccaaagcaggcagtgtggcatcttctcttctctctgatctctgcagcatcttctcttctctctgatctcagtcacacacaaaggtgtgactggacagccttttgctactgccttggaagagggctttgtgaagagattaggcatgcatctcataaatcctctaagccaggaatagagatggaattatccaggatagatatctggaggaagtccttgtctaatggagtgaatactgagacatacacaagagacccacaaggcattttagaaggttgtagcagcagaaacactaccagcttggactgaaagggacagagagagaatggaatgaaagaaggctgttggacttctaaaattctacaggcagaagacaggctgataaaaatatttagcagtaggctgggcgtggtggcacatgcctgtaatcccagcgctttgggaggttgaggcaggaggaacacgaggtcaagagatcgagaccatcctggccaacacagtgaaaccccgtctctaccaaaaatacaaaaattagttgggcatggtggtgcgtgcctgtagtcccagctactcaggaggctgaggcaggagaatcgcttgaacgcaggagaatcgcttgaacccaggaggcggaggttgcagtgagcaaagatcacaccactgcactccagcctggcgacagagtgagactctgtctcaaaaacaagcaacaaaacaaaacaaacaaacaaaaaatttagctgtaaatacatgctaccttttatgaaaaagaatgactctgaaggtggaatgagcctgggtccagagggtagacccttgagccacagaggatatttttaggcctttagcctaatggagtatgactggttagattttaaaattgcttgggactggtagctctttttttctctttcgtttttctcccattttggatgggaatgcctgtaactatcaaactatgcctgtttcacctttgtattttgggagcagataattcgttttgcagtttaacaggtccactgatggaggtgaatttttccccaggatcctttatatctagagcctcacccatacctaaatgagatgacttacatgatgagatttgagacttttgagctgatgagacttacatgagattttggacttgatcctgtaatgggttgagacttttcagatcttggtatgaaatgaatatattttctatgtggatctgatgtgaatgttttgttttgttttgttttggagacagggtctcactctgtcacccaggctggagtgcagtggcgtgaccatggctcactgcagcctctatctcccaagttcaggtgatcttcccatctcagcctcccgagtagctggtactacaggtgcataccaccacgcccgggtaatttttgtactttttgtagagatgggtttttgtcatgttgcccaggctggtcttgaattcctgagctcaagtgatccacacacctcagcctctcaaagcgctgggattacaggcatgagccaccgtgcccggcccgatgtgaatctttgggggccagagagtggactatcataggctgaataatggcctccaaagatgtccacattctaatccctgaaacttgtgaatatatgaccttacacgatgaaaagagactttgcagatatgattaagttaaggatagatattaaggtggggagattatcctgtattacccaatgtagtcgcaaagttccttataagggaggcaggagatttggagtcagaaagggaagatacaaggttggaagcagagatcagagagaagagaagatgctgcagtgcctactttgaagatggaagatggagccacgagccaaggaatgtaggtagactgtggaagctagaaactgcagggaactggattttccccaaaagcctccagaagtaatgctctgtattgacaccttaattttagcccagtgaaacagattttgcatttctgactatattagttcattctcgcactggtatagagaaatgcctgagactgggtaatttacaaagaaaagaggtttaattggctcacagttctgcaggctgtacaggaaacatagcagcttctgcttctggggaggcctcagaaaacttaacaatcatggcagaaggcatgtcttacgtggccggagcaggtggaagagagagagggggaaggtactatacacttttaaaacaaccagatcttgtgataactcattcactcattatcacaagaacagcaccaagtggatggtgctaaaccattcatgagaactccactctatgatccaaccacctcccatcaggccccacctccaacattggggattataattgaacatgagatttgggtgggaacagagatccaaaccgtatcagtgactttcacaactataagaaaatacatttgtattgttttaagcaactaagtttgtcataatttgttatagcagcaacaggatgattacaacttcttaaacaaacaaatatgtatctgtttaaaatgttgattatcaaatacatcaaacctatagaaaagaatcagaaaataacagggattcactatccagattaaaataaacattttaccacactttatttcaatgtcttgttaaaaagaaataaagtgtacaaatacaccttcagctcactctcatcccatttcccttgtttcctctgtaaaagtaaccattattctgagattggtatgtatccttttgggtcacgtttttggacatatacccctaaaatacatatagtattgttttctacgttctaaaatattgtataaatgctatcatactgtacctgttatttaactccttattcatcaacatgtttttagatttattgagttcatttttaactgctatatagtattgttgcagaattttgctccttagttcagctagaactgggttcttgtcacaagaccaggaaggattaggaacatggatacattgaagggtgaggggaatggaatttattgggtgaaaaggaaaaaaaaaaatcagcaaggggatcctgccagcagcaggctcccatctcacagattgaatgccaggccaccacacaggaaccgaagatgaagaggccaggctcctccccactgcaaagagtgaacttcccatggctccaccccattctcccagtgggcaaactagtcggagattctccgggggaccctcctcctatctctttctcctgcatttatcagtattacattttgtggtgtttatctttccattcctgatatgtcatataccaaatatggacatttacttgttgccagttttttcaatattacaatgctgaaatgagcattcttgtacaaatttcctgtgtacgtgtgcaagattttctctagaataggtatctagaagaggaattactgtatagtaagttatgtacatcttcagttagctagatgttgaaaaattgtggctgtgacactttaatttcaatttgtctccctatattttcagcactttgtattgttggacttttaaatttttgtcagtattatgggtgtgaaatggtatctaactttaatgtctcagataaactagggggatttgacatcttttcatatattgactggccattcttttttcatcttctgtgatttgccactttacatcctcttcctattgtgttgggtcttttttatatacctgcaagacttgttgttatatatttatatacaatggatatttatgttgattttacagtttataatatcttctagtctgcggcctgtcttttccatctgcttattgtgtattttaaccaagaccaccctcaggcttgatgatttgctagaaggattcacagaacttacaaaagctgttatactcatggttacaatttattaggatgtgtgacggtgcatgtgaagtgttgtcagccagggaagcatacctgaaccttggtgtcccgggcttttaaaattgggaatcagtcacataagaatgcagcacttgcatgactagccttagttactgagactacagcctcccctcacccataaagcacaaaaacaggcacttaccacaaatcacagcatttgcacaaactatctgatcataatggtactgtatggcccaaggcctcaggcatatgaaaacaacgtgaagcaaaatatgccggtggcttgagaactcatctcccaggaattgggcaagggccagccactcctggagacaggactttcctgagaatttgcagggtttgggggtttttgagttaaccctttcctgcacaggaggtatatattttaatagtcacatttatcttccttttccttcatgttgtactttttctgttttttatttcttttttttctctttttttttcttgcttccagtgggattaagatcttttctgttttttttttcatctcgtttaaggaattcttccttaccttgatgtcataaagatattctactataaattctcatgtaaaattttatagtttccttttcacaatttagctctgtggtccacttggaatttctttttgtagaaaagaaattctattagaagaatgtagggatgtaaggatcttacttaatttttttctgaatgattaatgagtggttccaggactattaattattctgttatttctgcacagatttataatgttatctcagtcgtataccaatttcctatatatatgtgtgtctgcttctaggctttctattctgttccattggttcgtttgtctatttctgtagctttataatgcatcttaatatttggtagggaaaggcctcttattcctctccctcaaaaatatgttcttttcatatgagtttaaggtcagcttactttaaatcttaaggtctgtaagaaacattgagatttgattagagctgcattttgtttatagattagagacagaactggcatctttacaaaaatgaaggtggttcatctctccctttatataggtgtttttcattattttgagaaagttttataagtttttttataagtatctaattcatagtttgctagatatatttttgtgtgcctattgctctcatgaatatttctaaattacattttgttattggttgtgccaggtgtataggaatgcttgattctggtatattgttgttaaatccatccaccttgctgacctctctctctaagtccaattatttgtttatatattttgctagggttttatataaatattatataaaacatgcttaaaagtacatgaaccataactatagagctaaatgaaatgtcacaaagtgtttttggtttatttatgtaatttgtgaataatttttttcccttttccttataccgccagaatttgatgtctttctatgtaaaataaaatagaatttcttttctgaaataatctctttttttttagacagagtcttgctctgtcgcccaggctggagtgcagtggcatgatctcggctcactgcaacctctgcctctgaggttcaagcaattcccctgcctagctgggactacaggtgcgcaacaccacgcctgtttaactttttatatttttagtagagatggggttttgccatgttggccaggctggtctcaaactcctggcctcaagtgatctgcccacctcgacctcccaaagtgctgggattacagacgtgaggcactgcgcccggcctgaaacaattttatttaagcacctgaggaggctcacgctctagtgagctgtgttggatgtgtcaatgcttttcaacttatcaaagaaaggaaattaccagtatttggaaattccaacagaacttaacaaaagggcctacagagtggtgatttcagttagttgaccacagtccaggatttggttctgagcatttgtgaaatgttgaaacaagacttggtggtaaacaaatacaaattaatttactgagactaacatagatacgggtacagagagaaaaacacacacatcatactaatgtattatttccactggtcaacacactcaggccttttatccagggcatgtcagtttcagtattgaggtacatgggaagtcaaactaagaaaacaaaatgctggctgggcgcagtggctcacacctttaataccagcactttgggaggccaaggcaggcacatcacctgaggtcaggagtttgagaccagcctggccaacatgatgaaaccctgtctctaccaaaaatacaaaaaattagccaggcatggtggcaggtgcctgtaatcccagctactcgggaggctgaggtaggagatttgcttgaacccgggaggtggaggttgcagtgagctgagatggtgccattgcactccagcctgggcgacaagagtgaaactccatctcaaaaacaaacaaacaaaaaaaagagaaagcaaaattctgtttactgtgacctagcactaaagcaaaggaaagtaaggaatcttgtaaacgtggaatcctttgtattaaggaatatattcagttactctgccttctctttatcacaccccaagcagtttgagaggcagcaagatgcagtggaaaagtactgggtttgataactgattgacagggatttgaatcctagctctttgtggatggaccttaggcaagttactgcacttaacttctcagagtttccattttctcactgttgaaatagaaatcatgacattgttaatttaaaagaaatacagcatctcaaagtaattattatagagtaaatccagcagaatcacaggcttgcatttgcttatccaggcctgtgagtaaagaagaaagtgccagtcaatgattatgcctaatttgccggaataaatcctagtaccagtctgtttccaagtacaagtagtccccgcttatcctccagggatacattccaagaccttcagtggatgcctgaaactgttgacagtactgaaccctatacatacactgtttttttcctatacataatgtacctgtaaattaggcacagttaacaacaataactaataatgaaatagaaagattataacaatagactgtaataacagttatggtaatgtggtctctttctctcttttctctcaaaatatcttattgcaccatacttaccttcttgtgatgttgagagatgataacctagccagctactagatgactcatagacagggagcatctatagcacagatacgctagacaaagggaggattcatggcccaggtggtacagccagagatttcatcatgctattcaggacagtgtgcaatttagaatatatgaattgtttatttctggaatttcccatttaatatttttggactgtagtttactgcaggtaactgaaactgcagaaagtgaaaccacagataagggggtactgctgtatagagatggcaactacaactttactaccagatgtattagtttcctattactgctgtagtaaattatgacaaacgtagtttaaaccacacacttttaatgttacaattctggaggttagtggtcctaaaatcaaggtgttggcagggctacccttcccttagggaccgctagaaaataatctgtcttcttgctttttccagtttctaaaggccacctaccttccttggctcctgctccctttctccatcttcagacataacagcaaagcattttcagctctctgactctgacctgctcccgttgccatctctcctctgactctgatcctcctgcctccttataaggatcccagtaattacactgggctcaccaagataatccaggataatctcttcatctcagaatcttaactcagtcacatctgcaaagcccatttgccatgtaaggtaacatcttcacaagggttgggatttgaacatcttgggaggaccattattctgcttaccacaccaggttaatgaattaccaagtaaaatacctaattagaattacacatctcttttgtaggttattttcactgaaacaggcattaatttctaaagttgtaggagtcataaaatggctttatttagacaatacttccaaggaaagatttgtattaacagagaatagaactagttggtaacagttacaaatattctcaaatcaccatattgcaaaggggaacaagatttacattcttgttaaagttctcaatttaatgcctttttaaattcagattatttgaaattattgtgcagcaaaatggtttccacgcctccacagcagcaggggagcgggcacagagccttcatatctttctgagtttccttttgttaattctgaagatttgcatttgtaaagctaggctctggaatttcttagctagttttaaataaaaaacatgtctgggtcctcgttatgctggcagaaatggagaaaaagctgaaaggattttattaccaatgaaattctatattttgtgccttgtaaagtagttgtgaagatttaatgtgaccacttacaagccctgactactgcttgatgaatgagagcagtttgagtctcttaccttcttttttgtactttccgcccttttgtatcttcctgctgagctcagataatttcgtcttacctgtctttaaatttaaattctctacttaatcttctaattaaagctatcccttgagtttttaattttgagtactgtattttttttctaaatgtttgattaggttcaattatggtctgccatttgttatggcttcctgttgcttggtaagatcttcaagttttttatttatctctttatgcatagtaaacatagtcgtcttatagtttgtgtttgataatcctattgtttaaagtctttttgtgaacatttctgttgtcagctgatcctgctgatttgcttctttatctaattcaaggctcaaggttcccagggcaagttatgtgatccaaatctgagctgcaaaactggcctgcttccattcaccctcccctttagggggtagccctttgaggtcccagctcattgttgggaatgtctcctcttagttttcccacttagtgtagctctgggttttaatctcttatctcttttgcctttcaaggcagccaaaatgaaagctgaaatttttggaatagacaaatgcccttaggacagaagttgcttcactgctctatttacctctaggttccccatttcccaggaatgttgccctagtgtttccatactgccattttattgtttttaagtaggtgttactacttttctttcatcaagatttttaaaatttgttttcaacctgatgattggtccaaataatgtggcaggcaatcatcagaactagaaacatttcttataactccttgctacattttctttgagattagatttaggctcagaacttcattatcttttgggttttgtttcttctgttttatagaggacacatctgatgctcagaaaagtacaaatacttgctcaaggtcacatagcaagtaagtggtaatattgggctttgaacccagctctgtccaaccctgaaacctacactgtgtcagtttttgttcctgggttctggaacttctttcttttaggaagcaggtaaatgactcgtgattttcttccttgagttttatctctcaaggtcaagaccatctatctccctgtctcttggaagcacacacagttctgtgcttttttcacaaggtccttgtcctgtttctaagacgtcctgataaataagtatccctttctaccacccaccttgtacctttcagaactgaattcagggacattcagtatccaactgtaaccataaagtttgatttccttttcaactgcagtattttcctcaaaagacctagatgaattccctgctgaatttggaaagagctaaggacaaagtgacccgggaagcaatccttttagatgaaaggaggagggagaatgatacaagtaggggttagagaacttacagtttagttgtatagtggtgggatagttgaagattttggattggtgaatgcccacaaggcaccttgtcatggtgacaaatacaggagctttggagccagacccacttcagctgaatatcagttcacctacatattaactctaaaatgttgggcaagtcagcttccctctcttgaccatcagtttcttcatccacaaacttggaataataatagcaaactttcaaggtttccgtgtgaaataccaatgatgtatttcagtgaagtgtttgtgtttggtgcatgcttactaaatggttgtggtagttattattattgttgtccccctcaaacttttcatctggtgggtgccctaagaccaggcaggagagttcatttttcatttgtgtgtatgcccagttactcctctctcctctgttgcatcatcttcttcagtctcctgaagatctcttaccgtctacgttcttcccaatccttgctttcctctcctagttctacacagtcaacacctcctttgttcagataatcttcccatttccctactcaatttaatctcttttcattgcctctgcattgtcctccagataaaccagtcatcctcatatcactttgtttcttcatgtccctctctccctgatttgggaggccaccccaaagtgagacatatcactgggtctcagcaggccttaatttctcagctgattctctgtcttattttgtcagcttcttttcattaagtaaaagttatgtttttctgtgtattattttttaagctgtttagttatggatatcttccttttttacgtattttacattataaaagtagagacatgctcattttgaagattttagagaacaacaaaactttattaggaaggaaataaaagtgacccacagttttattaactagagataaatactattcagtaattgatatatttcttttcagtatatacagttttgtatcatttgctaggactgtgtaccacagtctgggtggcttaaacaatagaaatttattttttcccaattctggaggctagacgtctgagatcaaggtgctggcagggttggtttcttctcaggcctctctccttggcatgtagatggccgtcttctccttcctgtgtcctcacatggttttccttctctgtatatctctgtctttatctcctcttctttttattttatttttgcaattctcctgcctcagtctcctgagtagctgggattgcaggtgcccaccaccatgcccggctaatttttgtgtttttagtagagacgggttttcaccatgttggccaggctggtctcaaactcctgacctcaaatgatctgcccgcctcggcctcccaaagtgctaggattacaggcatgagcccccgcaccgggcttatctcctcttcttataaggacaccaggcatgttggattagaactctaatgatgtcattttaatttaactacctaactagacactaatgatgtcatttttaatttaactacctttttaaagatcttgtctccagtgtagtcacgttctgaggtactaggggttgggacttcaccgtatgaattttgaggggacacagttcagcccataacacctgctttcttctctaaaagttatcttttaagaattcccacttgtcgataacaattctttgacaatagttctgatgactacataatatcccatcattaaaatataccacaatttacttaatcaatttcatattcttggacctttcaggtgttttcattttttcactaatataaatgcttccataagtagttttgtacatggatgtttggatatctgactatttgtttggaatagattgcttgaagagtgattattgggtcaaaaggtatgactattctctggtttttaattacatactgcaaaattgttttccagaaaattgtactaatttacattcataccaggaaggagaatagtcagttaggcattcatataagctgctggtgggaatgagaaaggaaaaataaactctcatggttgtttcactttacattaattgatgactaacaaaatggaatatttcatgtatttattaatctgtttgcatttccttttttgtgaactgttactcatgttctttgcccatttatgtatgtgagtctatcattttaggtgataagattatgatttagagtgagttctactctaaagagggaaatttcagaaaaagtgaaattccaaagaatgttatggatccagaatccaaggactattggtctgagtctcttctttggagaagacttggcatgtgatgacatataggtaaaggaatggctgcaggaaagcttggcagggaagagttgaatgtattccttacgcagggaaatttgttacaggcacagtactgccacttatactactgaagagaaaggctgtgagtgaattaactgaggaaaggcaagctagatgcatattatatatgggaatcttctaggaaaaaaagcacagagatatgattcacatgaccataactcttgcaaaggttttagaatttgtgagacactggggaggttctcatggggaaaagtcttatgtatgtgattaatgtcaaaaagccctttgtcagtgttcaagggaggtacctcagagtactcatgataaagagaaaccctatgaatgctgtgaatgtagtgaatataaagaaatttttaatcatgatgccagtcttacttaccatctgaggactcacacctgagaattcattgatttgttatggccataagaatgtggaaaggcaggacatgattctctttcaacaccagaaatttcatagggtagaaaaactttcccaatgctggacaaattgcagtgggtgatgaagctttttgaatcatgcaaaagtttatactggacagaatccctatgagtgtactgactgtgggaaaggcctcaagacaaactcagactgttttttttaacatgagagaattcatagtggagaacaaccctatgctcataatgcatgtggaaaggctttcagatccagctcagactttactaaacatgagagaattcatagtggaaagtaaccttatgcaatgatgaatgtgggaaagggtatctggagataacagaccttcaaaaacattagaaaatttatagcggagatggaaagagatcctttcagtgtaatgaatatggaaatgtttttaatctagagctcaaattttatttgtcatcaaagataatcttttacaatgaatatacaaaaacctccaaacagaaatcaatccttgttcatcatctgcagattcatagtggacagacactctgtacctgtaatgaataagccttcaattagaggctaagtcttattcattatcagaggattcataaaggcatcaccttctatgtacgtaaaaaattatgggtatgctttcagcaggatatcagccttatttgatattggcaagtctatagcgagttcgcttaaatgcagtgagtgtggaaaggccttcaatctgaagtttaatcttactcagcatcagaaaatacagagtggcaggaatcttattaatgtaatgtgtgtgggaaagtctttatgagaaaatcacgtcttggtaaaaatgaaaaaaagattctttgtaaaagttaaaatagttaccacataattacacgcctgccagtgtgccaagcactacaagaactttacattgtttaatcatttttttacaataatcatacaatgtagaaatcctcgttgttttacacacacatgaagaaaccaaagaaatgaggtggaaaaacttccccaagatcacatactagtcactggaagagccagggtttgagtcctagagagtttaattgttctgggtttatagtggcaatatgtaaatcttcaaggatgtgttagtctttattcattattaagaaattccttcagaaatcaggattcactcttcagtgagtattgggagccttcagtcagttttggaattagagactctacattgggttctatcaaatttagtaaggactataaagactttatcatatttatattatccctttgaatagggattacttccaatcttgaaagatttcattaataacaaaattctgttctcaaatgctcaccctaaccactttctgtggtgtagacaacgtggagtgggatggaaagcacaggctctgggattggccaggatagcttcaccatcaggaacaaggtagagttacccagttcttaaaaagattgagtaggaatggagaggacagatgtggtgagagcttcaggaacagagtcaggtcattctaggaattataaccaaacaagccaaaataaagtagaattcagcctataaggaagtggagaagctagggtatgtggcatgattttctccccagatggatttagctataggttgcttgtgtatcacccagtattcagaggaacttgaatttgaaattgcttcaggaatatgcagtactctagcactgagtcaaaaataagcgtgactttcagaaactcaaggtataagaaatattaataaattgattttctaccttctcacttcaaggaggcagtgtgctacaccagaaagtattcaggatctaccttcaggtataactgggtttatttgccagcttaaccaccttctagctgtgtgactttagttatattaataaatctctttgagtctcaccttgctcattttttttttaggtcaggatataatactgtaccaagttgtaaggattctagataaagggtataaagtgtctagtatggcgcctggcatgtagtacatacctaataaatatgttattgaaatatattattgttggttctgcaaggatcttaacactctataatagacctctccaaccccagttggggaatgaatgtgttacacttgtgttgtgatagtattaatcactttagattatggggcttctgctggcttatatggtacctttgtgtgaattgtaaaataatacctcttcctcaaaagactttcttaccacttgctagaaaattgtcataataaacacagatatctttgatggtcataatgtgaatggtattctgcagaatcatgcggcccacaatttgcaaaacctgaagttggtaggctgaataaatggccccccaaaactgtctgcattttaatctctagaacctgtgaatatatattacctgaaatggtaaaagggacttcggcagatgtgatcaaattaaggattttgagatgcagggataatactggattattagggtgggcccaatgtaatcacaaggatccttataagagagaggcaggaggaccagacttatagagagagaatgtgaggactaaaggagaggtcagagagggaagaagatgctatgctgctggctttgaatttggagaaaggagccatgaacaaagaactgcctgggaggcagaggttgcagtgagctgagatcatgcaactgcactccaacctgggcaacagagtgagattctgtctcaaaaaagaaagaaagaaagaaagatcctgtgggtaggagtgtgatggatagccgggtgcattggctcacatctgtaatcccagcactttggaaggccgaggcgggcagatcatttgaggtcaggagttccagaccatcctggccaacactgtgaaaccctgtctctactacaaatacaaaattagccaggcatggtggtgcacatctgtagtcccagctacttgggaggctgaggcaggagaatcgcttgaacctgggagggggaggttgcagtgagctgagatcacgccactgcactccagcctgagtgacagagtgagactccgtctcaaaaagaaaagaaaaaaaggagtgtgatggatagattggaaaagagaactgggtgcagggagaccagttaggaggctatttataaagtagatactgaaatctgggttaaggcagtgggaatgaaatgagaataccatatatgcaataaatttggaacttggtcactgactagatatagggggactgacggagaagaaggaatcaaggatgatgcccagttgtctttctgccttggatggttaacaagttgcaaaaaccattcatggagaactcagaataaggagcaggtttgtggggaaagaatgacctttgcagtgtccaagaggaattattcagtaggtagtccggaattcattctgctgctgtgaagcaagtagggttacagatagaaatcagatagaaatttggtagtcatcaaatacagaagtggtggttttaattgaagtatcaatgagattgccccgggagagggtggtgtggagtgagaaaaaaaaaagacccaaggcagaatctcagaaacctaggcattttgagggaagacaaagctgagaatcagcagaagaaaggtaggagggggaccagaggagatacagcattcttgttctgccctcttgtggcaagctgagtgtgtcccagcataaatcttccctctcttgtcttcagtcttccaggtctctgactcataattccattcccaccctacctgggagaatggagctgccaggtcttctcatggtcatttctcaaatgtaaagctcctcttcgattatttctacaattcaagagcaatttggaccccacccccatgttgcaaaagaataaaaagcaaacagtggggcggggcttcagtttccacatttatatgctccaccatcttttgatctattctattggcctcattaattttagtacatctcaactctcatcatatcccttcgctccctttataattaaaagacattttattttgaatttttttattatagtaaatatactgtatattatagcaagacctatgtatggcttaaaaaagaaataacaaaaaatagcagtattagcttcactttttttcaccaccagacttgaacacttgaaggctagaatgcaaattagccaactttgaaatctacttcttttggtttttatctaaataccattatttcatgagttacctatttcagatattagctgttgacttcccattatggtagatgaagatttaattcactttttctccctcaattaccttctctattcttttagtatagctatagcatactttctggttaatgatgtttatactattgtgattgtgcaaacattgttcactaaagagacaggtagtgaattgtgtctatgtttctgttttgaacacatttgtatcatttctagagttataattcccttttatctgtgtatttttatatatttatatttgaggcagagtcttgccctgtcacccaggctatagtgcaatagtgcgatcttggctcactgcaacctctgcctcctgggttcaagcaattttcctgcctcagcctccaggcagctgggattacaggcgcccaccatatctggctaatttttttgtatttttagtagagatgggggttcaccatgttggccaggctggtttcgaactcctgacctcaagtgatctgctcgccttggcctcccaaaatatccttattttttctgttagctctatcatatgtctatttttgtgtaactgctaaaaaacgtcagagtattcagaatatttattttctagaaatcccctttgtagagccttctctcttgatccagtctgggctgttttcaatcctgaaagcttttgggatttccactttatccctaatattctaaactttcatgatgatgtgtggatatttgtatatctgttgtcctagatacctggtaggtagactctttcagtttgtatgtttttgtacttggactctggaaagttttattatttcttggatactttgtgagctccataaggacacatttttatctattttatttatttctgtttttccagtgcctaaaatagtgcctgatacatgatagacatttatttgttgaatgaattactatttacatttaaaataataaaaatgaaataatgcctccagacccaccgaccaggacaagaaatagaacattatcagtactttagtgccctatccaatcacaccttcctgtccgcctccacctagagataatactaccctgatttttgtattaacaatttctttggttttcgtatatttttatcacttgtatatatgtttttaaacaacatattgtttagttttgaaaaaatggaaaagcgaacacaaacctagttgtacgagaaaagggtactgttgcccctgttagatagtctcccaggaaaacagaggttctgcgtcaaaaactgattttagcttctctgagaactgtaaagccatttctgggataattagtgaatgaggtcatgaaatttactgttactgatgaaagtcctatctgtctaatttaatttttctattgcaggtgacattttctctcttttcagctctcagagttatagttgacaaaaattatacgtattcaaggtgtatacatattcaaagtgatattttgatataaatatacattgggaaatgatttctacagtcaagctaattaacatatccatcaactcacagttaccttttttgtgggaatacttaagatctactctcttaatgaatttcaagtatgtaatacattattactaactatattcaccatgctgtacattagatctccagaacttactcatcttacaaccacaagtttgtatcctttgaccatctctccacttcccccacacactggctgaccttgggtaaccacccatccactctctgtttctatgagttcaactttttaaagattcagcatataagtgagatgatgcagtatttgtctttccgtgtttggcttatatcacttagcatagtgtcctccaggttcatctgtgttgttgcaaatggcaggatttcctttatcaagggtgaacaatattccattgtgtgtgtgtatgtatgtgtgtgtgtgtatacacacaatttcttaatgcatctgttgcagacacttagattgttttcatattgtaactattgctaaaaatgcagcaatgaacaggggagttcagatgcttctttaagatagtgattttatctcctttggatatacacccagaagtggaattgctggatcatatgttcaattcttaattttgggggggaacctccatactgtttctgctagtgactgtaccactttatactctcaccaacaatgtataaaggttcactttttgccactttttgccaacacttgttatcatttgactttttgataataactatcataacaagtgtgagatgttatctcattgtggttttaatttgcatttccttgaagattagaaatgtttaacactttcaatatacctgttgggcatttgtatgtcttccttggaaaaaatgtctattcaggtcctttgcccatttttaaattgggttatttgtgtgtgtttttttttaactactgagttaactatgtgagttccttatatattttgtatattaaccccttatcagatatatggtttgtgtatattttctcctaatctgtgggttgccttttcattttgttgattgtttcccttgctgtgtagaaactttgtagtttgatgtagtcccacttgtttatgtttgcttttgttacctgcctttttggtgtaataacaaaaaaatcattgtcatgttcaatgtgaaggaccttttccgatgttttcttctagaagttgtatgttttaggacttgcatttaaatctctaatccaatttccaatttgagttgaggggtgtgagagagagagagagagagtgtgtgtgtgtgtgtgtgtgtgtgtaagataatgatccaatttcatttttttctgcaatggacattcagtttttccaacaccatttgttgaagaaactatcctttccacattatgtattcttgatgcctttgtcaaagattagttgactgtatatgcatggatttgtttctgggctattttatttatttgtctatgtgtctgtttttatgccagtaccatgttgttttgattactatagctttgtaacgtaatgtgaaatcaggaagtatgatgcctctgactttgttcttcttattcaagattgcttttagttattaataggggttttattgaatctgcagattgctttagttagtacggacattttgacaatattgattcttccaatccatgaacacagaatacttttcaatttatttgtgtctttttcaatttcttccattattgttttgtagttttcagtgtacagatcttttacctccttggttaaatttattcctaagtattttattggttttgatgttattataaatgggattattttcttaatttcccttttggattatttattgttagtacatagaaatattattgatttttctatgctgatagtatattatgtaacttaattcatttattagttctaatagtttgttttatggagtccttaggtttttctgtatatacgattatgtcatctgcaaacagatataatttcacttcttcctttccaatttggatgcattttatttccttttcttgactaattgctctggttagggcctccagtactatgatgaatagaaatggtgagagtgggcatccttgtcttgttcatgatcttagaggaaaagcttacaacttttcaacattgagtatgttgttagccatgggcttgtgatatacggcctttactgcctttgggtacattcctcttatacctaatttgttgagagtttttatcattgaagatttctaaattttgtttctctttctctttaagattgtaattttttttcttgtttccttgaattcaagaatttaatcagggtatcctgagtatatcttagaatgtaagctccacaaagacagggatttttgtctgttttgttcactgatatatcccaagtgcctagaataatgctggctatgtaataagtcctcattagatgagttgattaaattaatgtatgaatgcataaattgatgaatggatggatgaacaggtactcaatcttgtctggaattcaggtagccctttctttagctcagggaaattttcttctatcatttagttaaatattgcctttcttccttctatttcttttctcctttaactccccatccatctcccatattcacattttaggttcattgacactatcctctagataccttgtcttgtatctcattgtatctattgctttttgggtttttttgctcagtgccttgatataaatcttgcacttaattttctagtcaagtaattcagggctcatcattgacatcatttttcattttattgtttaattggaatttgatacagtttggatttgtgtccccacctaaatctcatgttgaattgtgatccctaatttgggagagaggcctggtgggaggtaattggatcaagagggcagatttcccccttgctgttctcatgatagtgagttctcacgagatctggttgtttaaaagtgtgtagcacctccacccttctctctcttcctcctgctctggccatgtaagatgtgcctgcttcactttcaccttctgccatgattgtgagtttcctgaggcctccccagccaagcttcctatacagcctgtggaaccataaactaattaaacctcttttctttataaattatgcagtctcaggaatttccttatagcagtgtgagaacagactaatatagaatttgtttttaaagctttgagctctagaaagtttttgtgtgtatatgctgcattttcctcaggtgttcttattactttttagtcagtttttacatatcttgtctaatagctttgttttatttctctctgactgctgaaactttttaatgtttgtttttatgaatgatcactttgtgggccttgatgtagattggaatgtatttgagtcagtactgctagaatatcaactatgtgcagatatgaatggtgttactatggaaacgaggtcacatgtgagttctgatcttcacactgccttatttccagcgaaaagttgccatttctttagaacactgattgtccccggataaaactgtgaacattccaatatttaggcctagtcaccttggacacaaattgcactctgaaatattgttctttcactgagagcagacaagcacagtatttaagtttatatgcaaggtctcaaaagctaacacaaagctagctagcaaaaagaaaaaagaaagagctaaaatgactgttagatgtaattctacataacctgtttttaacaagagcattctataagactaaattctaaattttttcatcaaagggtgtttttctactcctgattaattttcacctactgtaccatggtaactctacccattcagaatttgaattcctagttcagggaaaggaggaatctggggtagtggcaatgcaatatccttgtttagacttgatgttaatttgtatcagtgtttgctggtaatgctaatcaaaaacaaactccacctagaaacctgttagtggtaaaacatggataacaccagtaaagagaatttatatgatttcattgatccattgtgtggagctgtgagggatcaataaataacattcatctttcctgactaggttcagaaccaattgaaattgaaagatgtaggaatccgataaatggaactcaaaacatcatctttattactgataacacttcagagaatatggctttaatgtggacttcctaatattggaccccagaattaagcagatttacctaaaccaccataagcaatggtgaaaaaccacaagactctgggccaaaagtgggccacttgatgcatgatatgttttctgtaagcatgtagatgaagggcagagagcaagagcctaagccaagctgtattagtcagggttctctagagggacagaactatatatacacataaaaataaaggggagcttattaagtattaacttacacgatcacaaggtctcacaataggctatcggcaagctgaggagcaagaagagccaatccgagtcccaaaactgaagaacttggagtctgatgttcaagggcaggaagcatccagcacgagagaaagatgtaggctgggaggctaggtcagtctctccttctcacgtttttctgcctgctttatattcgctggcagctgattagattgtgcccaccagttgaagggtatatctgccttccccagcccgctgactcaaatgttaatctcttttggcaacaccctcacagacacacccaggatcaatactttgtatccttcaattcaatcaagttgatactcagtattaaccatcacacaagcatactcagatgtttcttccaaacatactagtcacataactcattccttcttctgtggacagaaaagcaggagtgttagtctatttgaagttcttccacttagaaacatgagaagtaaagattaagtgttccctctaacatagctcagtgatgtattcagtattgccatgtgcttgaacttgtctatctcttcaggaccaaaaatatcataattttgctgtgacacgaaaggtattaggatattttaggaagactgtagtacaaatagctcaattacagaatatcatgttaatgacatatcaatagaatatttaaaactccatctaaatgctataacaaaacatgaagaaatgcttcttaaaggcagatgtaccaaaaggaatccattcaccactctctaccaatgggaacatcaaacattgtacctttagagcatggtatatttctccacttaacacctactagaactctgcagtgaggcttcaagtgagaaacttctctgttatatctgggttgatgtaagatccacatatcaggaaagtaagtgtgtgtgtgtgtttgtgtgtgtgtgtgtatgagagaataagataggagtgggggacaagaagggagaggagaggaaataaaagaaggaaaatgagatatcagggaatgagcaccacaagtgtaaaatcctaagtgatgtgggtcatgtgtttgatggagagatagggagagagtattgtgtggtagtggggtagtggaggtatgtggccaaggtatgtgtgataatggtgtcaatggggacagtgtaaggatggtatgaaatcactgtgatcatgaagacagaggcaatgtgagtgacagtaacaggaagagatcagaatgtatgtgacagttgtagttatggtcacagtgtatgtgaaagacaagaattgtgcatgtgtgtgaatatggttgtgtgagaaagtggggagggagaggacaggataatgggacactgggatcattgtgtgtgtgaaaatgtggatgggacatgttgatgtagagggaggttggaatggggcaggtgtaatgtcattatggaagataggtacatgatggaagtgagaaggctggtgtatgtctgtgtgtctatgtgtgctggggaaaatgagaagtgtgtctctttgtgaggacagatggatacagtgagcatgggtaatcacagtcaatgaaaatgtgataatttggagtgggaaaatcatgagtgtctgaatagggttgttgaataaagtatatgatgggaaaatgcaaagagtttctgagtgccagtgaggaatggggaatatatgtgagtgagagcagagttgatgtggttattggttgtgagtatgtatgaaatggaggtggtatgagaatgtgtggaaggagatttggaggatgatacaagtttgataatggagatgtggactgtgtgtatgatagtgggtgtggctagacactgcgtaatggtgtagtgtagggattgagtaattggggtgtgactatatgaatgatggggatggtgtgtatgataatggggattgatttaagttagtggtatttgacagtgggtgtcgtgggtaccatatctgttctggtctaaagacattttatttatgatagtacaggataggacagagtatgtgtggaaatgggagtgatagagacagtgtacatgttagtgggcatattaatccattttcacactgctataaagagatacctgagactggacaatttattaaaaagaaagagggtttagggtgctggtattgcaggtgtgaaccactgcccttggcctggaagatctccatttttatgattttttttcatttttaatttttttttaagagacagggtatccgccgggtgcggtggcttatgcctgtgattccagcagtttgggaggccgaggcaggcgaatcgcttgagctcaggagtttgagatcagcctgggcaacatggtaaaaccctgtctctacaaaaataatgcaaaaattagaccggtgtggtggcgggtacctgtggtcccagtgcctgggaggctgaggcgggagaattgcttgaacccaggaggcggagattgcagtgagccgagatcgtgccactgaactccagcctgggtgacagagtgagaccctgtctcaaaatgaaacaaaacaaaaagagacggagtcttgccctggcgcccaggctggggtgcagtggtgctatcatagctcactgcagcctaaactcctggggtcaggggatccttctgcctcagcctcctgagtagctgagactaggagggtgagccaccgtgctgggctaggatctccatttttagacactttatctcagtgtattcaaaatatggttcttggacaagtgtgggttggtgatctggtctgccatgaactgagcctaagtgtttggcaaattttactgcaattttagagtgattttatttatgttgaatcaataatttaaaaagtgaggcttgtattttgtattctataatttactgtaatatcattttttctagaaacagactcttatttcacaaaagtattggttgaaacgaattaaagtgaacaaaaaaccaactggttttgcacaagtagtttgaaatatattgctctatcttactcaaaattgatgcgtatgtgatttctttttctataatgtgaagttttttttgttgttgttctttggggatcttgtgctctactcctaaaatattaatgtcatgcaggattccagaattgttttgttttgttccagatatttgccttgcgtatataaagatgtggtcattctttgcatgctctttccccagagacacatgtaaatggagttgtaatttcctgttggtaaacagcaagtatttaaatttagaatcaggtggtaaggttgatatgtagaagggtaatacattggattgccttcaaagtgatatcttttccagttaactgttaactcactaatttactgtttttcttttctttcttatgcttcatgaatttatgtgtcatctgtacaggggccatgtgctaatctctgcacggttccaattttagtgtttgtgctgccaaagcaagcacggcttttcttaatcctatcaaatattacatggtatgttaaaacagtatagatctggcttaaggtatttcatggatgacaaatggacctcatgttatagaggaatgaaagatataaattaataaaacatgatcatgataagaataaaaccaaactaaatctcctctccagtgcttggcagcacactcccggagagggttcaggctgtatgtggccccccagcaggtgctcagagatggcttaatggcctcggtgacaacaggagcccagactgcataagactctgcctctgcagatgcagaacagtaggggcctctgatgtgcttgaacatctgttttggatctccatttctcctcaagaagagactcctttttaaaaattattttttttgaagctgcattacttactgatttccagagtcgttttacacctgcccttctcaagggaatattttgggcataatcttttttttttttttaattatactaagttatagggtacatgtgcacaacgtgcaggtttgttacttatgtatacatgtgccatgttggtgtgctgcacccattaactcgtcatttacattaggtatatctcctaatgctatccctccccccttcccccaccccacaacaggccctggtgtgtgatgttccccttcctgtgtccaagtgttctcattgttcagttcccacctatgagtgagaatatgcggtgtttggttttttgtccttgcaatagtttgctgagaatgatggtgtccagcttcatccatgtccctacaaaggacatgaactcatcattttttatggctgcatagtattccatggtgtatatgtgccacattgtcttaatccagtctatcattgatggacatttgggttggttccaagtctttgctattgtgaatagtgccacaataaacatacatgtgcatgtgtctttatagcagcatgatttatggaatcctttgagtatatacctagtaatgggatggctgggtcaaatggtatttctagttctagatccctgaggaatcgccacaccgacttctacagtggttgaactagtttccagtgccaccaacagtgtaaaagtgttcctatttctccacatcctctccagcatctgttgtttcctgactttttaatgattgccattctaactggtgtgagatggtatctcattgtggttttgatttgcatttctctgatggccagtgatgatgagcatttttttaatgtgttttttggctgcataaatgtcttcctttgaaaagtgtctgttcatatccttcgcccactttttgatggggttgtttgtttttttcttgtaaatttgtttgagttcattgtagattctggatattagccctttgtcagatgagtaggttgcaaaaattttctcccattctgtaggttgcctgttcactctggtggtagtttcttttgctgtgcagaagctctttagtttaattagatcccatttgtcaattttggcttttgttgccattgcttttggtgttttagacatgaagtccttgttgggcataatcttttaatctttctggaaagctaacaaaacattatctatgccaggctttccaccaggcacaccccattctttccatcacagtgctttttaaaggactttatcatttgttctctgggttcatttaactcttaacttacaccgatttagcatctttgctatatttcctttcttatttcattctttatatgttatgttacatttctgtttgagtctttacagtatcttctttcttaccaacttgtctttctagaatattttcacaattaatgttttggtttgctttgaggtaggcgatcagcaggacttgttttctgagcactggtcaggaccctgtctatctaaatgatatgtagcaaagaaactggccaaagccatgtaggaccagcaattataatgcacttgcgtaagacacttctaccactaccatgacagtttacaaatgccatggcaatgacctggaagttaccttatataattctgggaactctcttccctttttccataaagtttgtgaataacccatcccttatttagcaaataattaagaatgggtataaatataggtagccagcaatccacaagtgctactctggaccaatctgcctctggggtggccctgctctgtctatggagcagtcacttggctgtacactgttgctcaaataaacttgctttctttcattgtcaaaaaaaaaaaaataaataaaaaaataaaaagaaagagggtttaattgactcacagttctgcatggcttgggagggctcaggaaacttacaatcttggtggaaggggaagaggcacatcttgcatggcagcaggtgaaagagagtgagcaagagtagggaaaactgccttataaaaccatcagatctcatgagcactcactatcatgagaacagggtaagggaaaatgactccatgatccagtcacctcccaccgggtccctcccttgacatgtggggattatgaggattacaatttgagatgggatttgggtggggacacagagccaaaccatatcagcaggattgaaaggtaaagtgtgaatatgatagtttggagaactgggacaatatgtggagataatacttataagtcatagtcatgatcatgagtcagagagagtcatgtgaatgagatagtgtgttagactgtgtgtgtgtgtgtgtgtgtgagagagagagagagagagagagagaagttggggtaggggcatgtcatgttttaggatgggtatttggaatatcatttggatatgagtaacaaggacctaaaaatgagttgcttaaaataattaggggatatcttttccttacctgaaacaagcccaggacctccacaattttatcaatgtctcagtccccttatatatttttttgttccttggtccttggtatatagctctcatcttccaggtaccttctggttgaaggatgcctgctgcaactctggccatcatttctatgtttcaggtagaaagaatgaggaagaggagagggcaaaaataccttgtcagtggaattagtctccttatacagagctttcccaaaaatcctatccagttactgccaaatacatctcatgggaaagaactgtgacacatagccaccactatctgtagctgagagaacatggtaagaaaaaacagtttcttagtaaggaaaaggagatgttggtaggatatcaccagtagagaaggagaggttgaagatttgcgagagggagtataattaatagatgaaaatcacgatggtgctagatacagatgggatatgactggcagagtttgagatgctggaggatatcatggtaagcaaaaatagacatattgtctctgccctcatgaagctactgtcttgtgaagaagacagtaatcgcagactcaaatatttgtgaagttgtcactctggtaagtgctatggaggggaagtacatggttctgtgaataggttaaaagagggctttacctaatcagggaagtaaaagcagggaggaagtaatgatggagatgaaaccagaagacagattcagaattgattggttgaaggatctgtggatgggatggggtaaaagtgtttccagaagaggaaacagcatgaacaaagggacttatgctctgttgtcttttaaaatgtattttatttcacttagaatcttttccattatgtcttcaagttcactaatctttagtaattaatatcatctagcatttttttcttctcaaatattacagtttttatatctagatatatgacttggaccttattaaatagatctcatgtttttacttaacatgaccattctttcctctaagtttttggacacatggaaatagttataatggcttttaatgtgcttatctgctaattataacatctattaaatatttaagttctgggtaagtttggattgattgatttttctcctcaagatgggtcctatttttctgcttcttggtatgcctggtttttttttaattcgatgccaggcaatgtaaattttacctttcggtaaaattttggtgaaattttttcttttggtgctagatatttttatattcctacaaagctacctgagctttgttctgaaatgcacttctttggaaacagttagatctttttgagtcttgcttttatgatttgttaggcaggaccacagcagttttttgcataaagctaattatccctgactgatgaggcaagacccctctgagtatcccatgccaatgaattaggaagttttccactttagctggtgagaacagcatggtccccagacctgttggagcttctggcacttgttccctttaatcctttcaggtgactctttccccagcctcaggcaatttccttttatgaattcactgatcagtactctgtcaaatacttaatggcaatccttcaaagatctccagtgttctccctgtgtaactctctctttttgggtactctgctctgtgaactctagctaccttggtctttctggtctctcatctctgtcactccaattcaaggaatcccctggattctgactacattctcccttgttgctccacaaactggaacctctcaagcagtaagtgctcacttcttttttcctcatctctcagggattactcttcttcattgcctaatgttcagtgtcttcaaaaaccattatttcatattttatgtccatttttaagtgttttttgtcaggttggagggcaaaatcctgtctccagcttgcctcttaggaagttatatggtggagacctgttagataattattttcttttcttttacagttgtttgaccttctcactactgccaagtatcacaaatgagtgacagttataatttttttatcaaatgagaaaagcctgagaataagaaatgtattcaaaatcagggatttgaggaacaatttgggtcacaggggaatgtggccatatattacaaggataactcctcatgactctaaccacaaggaacttctgagcataaagacaagttagaaaaggagattaaccttctttcaaaggatagatgtttaaggcttggggtagatattcacaggattggttcccagccagggggcttccaagactatagtaagtgttagagtaattgtgctctaatctcagacatcctacgggaggatgaaaccatacataggacaaacccacacccacacccatagtgtgggtcacatgaccatagcttcagaccaatttcagagactataaatcagcacgaaaaggccatgatggtgagaaaatgtgtgaagagcattgaagagcctttggccaagcttcagatcttattaacatcaaataattcattagcagagataaactctatgaatgtagtgatcatggatggtctttctttctttttttttttttcttttcacattcagttgactttgtggatggtctttcaaccagagttcaaatgtcattcattattgttaaacacatactgaagccatagaaatgcagtcagtggaaaaaagccttcaggaacaaatcaaacctgagtaatcatgagaaatttcaacctggagagaaactgttgaatatacaaaatgtgatactccactctgttcttatcccatgcagactcccccaatctgtgtaagtgattcctttggatccctcctcacatggctttggtgagggagttgcatgcccctctccttcctcaagaaaaaggaaaacactcttccccaagccaaggactcacaacactgtaaattcttatctaattctttctagctttctgagtacatatgggctgaaaaggaatggaatgaataccagtagcatgactagtatgctctccccatgtaaggcccgtaggattgtgttcagatctcctgggatgttctttttagaatgtggaggcactgggtacctttttcttttcttttcttttcttttctttttaaaggctatatggctttaaccaaaattctgaggaaagtgtgaaagttccattcaataacctgctaaatttatattatcttttctcatttaatattacaatagaagcatgcttctgccattaaaaacatctgaatcggattttttatcactttcaatttaaagcatagtcttcaaaggtaaattactaagaaagtatagatattttttaggctctaaatatacgtttctgaattgttttctagtaaaaggaatatttgtttggcttttcaatagcaaaggacatcctcagcattttttttaatggagaaaatgatagtggaaaagaaagtcatagattgcattttttcctagatcaggaattcataaataagactaagaggcaagacaccaaccaaaaaaagcatttgcaacaagtgtgacagatacaaggttaataaccttaatgtacaaagaattctcacagcaaaatacaaatgattaagaaacgctgagagtatcttcccatcattaataataataataaatacagtttgaatcaattaaatgtcattttgtctgtcaaaatggcaaagatattttcaaagcaaatgttcagcactgttaagggtatgtgagaagtcttctgcattgctagtgttgacaaaaacctttctagaaagcaatttggtattattgaataacggccttaaaatagttcatacccgtttgaactagtaattccatttctaataatataccataaagaaataattggaggtatgcacagaggtttgttgggggaaaatcaccacaatgataatctagtgaacaaaaataaatggaaacaagatttttgttatttggtcaagtaggtaagttcatatgatgggatattacacgttatcataaagaattttgcaaagactttttaatgtcatagaaaatgttatgccaagataattgtgataaaacattatatacaaaaagaatctcagatgtagtatattaattacaactgtgcatgtatgtgtgtgatgttagacttggtatggaccattttcccaatgtttttcagatgatttttcttttataaaatgaaatcaggaaatgtcatactatgtagctgaactcatatgacttttctgagtccagctatatatctattttaattgttgttaatgttccatgattcccaaattaagtggtttatgaggtttatattgatgctgaacattgaggacacatatggcactaaatcatatcccaggtgtctgagagcattcagatatgtcttgaaattttccagtgcaaatcaaagagggactctatgtcacaagataccagaagctcacatggtaaggtcatctgatgcagtatcaaacaaatatccccaaactgtgcattgaggttctacttgcaggcttcctccccttgtctcttctgataaccttctgcttattaatggaatgtgagttgctgtggtgatgggggtgaggaattaactggaagggaattgtgcaatatgaaggaaggtgtaatctatttaagtctgtaagagattacaagtcaccaagaaagcctgcgatggtgagaaaatgtgtgaagagcattgaagagcctttagccaagcttcagatcttattaacatcaaaattcattagcagtgatgaactctatgaatgtagtaatcatggatggtcgttcaagcagagtttggatgttattcattattgttaaatacatactgaagccataggaacgcatttgatataatcctaagatgtcactttgcctgctcttatgatgcaaattggcaccagaaatccagccaactttattaaaattgtggaaatctgactggactcagatccattaatccttgaaagcaggtaatacatgtatttttgccatcattatttctccagcacttatcacaatgtgtagcactttactaggtatacttttaaaatgttttaaaattcttatacatatataaataaagaagataaaatcaagttgactcaagtctagaaaacatggatgagggatttaagaattctaaagtgtttattctgaggcaccatattgctttatgtttggaggctcagtgtatattatcaatgtagaggcttcaagagggacccattatttcatatggttattctatcctttacttaggggtgttataatctcatgctatgattttgtttttattatattttgctttaaagtactatgtctgatattaatacatcatctttttattatttgcatgtaataacttattccatccatttattttcatctttgctgtatctttatgtttaagatatttctcttgttaattgcatgtagctgcctttataatggaaagatacataaatttcctttaattacagcatcctcaaatattctgtaattggagatttgatttcctctttgaaggaaagcttcatttattccttctccagtgctctccctttctttatgtacttccaagtttctgccctatatcattttctttctgcccgaagaaaatcttctaatatttcttgcagggcaggtctgttggtgatcaattcattctgtttttgttcatctgagaatgtctttatttctcctttactttttttttcttctcctttacttttgaaagatcttttcctatatgtagaaatctagggtggtagtcatttttcttttaacactttaaatatttcactttactcttgttgcttgcatggtttctgatgaaagctgctagaattattattcttattctattataagtaagatatttggtgttctctgagcttcctggatctgtaatttggtgtctgtcattaattttggaaaattcttagccattattacttgatatttcttctgctgtattctctttctcttctccatctgatgttccagttatgcatatgtgactccagatttgcctatccatcaagattttagggtgatgatttgccctgaaatttcatttctctgacaggtccaaaaaagtgattgatttttagtttgtccaggttttttttctggttgttggtgcctccagcctcacattgattctgtggtggaagaaaagcatggggaagcaaagagtcagtagatattgtgggttccttaaaaaggaggaaccataagccccatattttagggatgggaagaaatgccaggtaggtttgcaagatccttaagcaatgtgttcttttgtctcaccttctggctaaggccagagaggacaagactacaaaatagaattgtctgcgtggtgtctataattatttggagcctcttcatgtggtttccctcagctcagggtatttacaggagtatatgtgagacaaagacagcctcacggaggttaatagacctcagcatatcataggaacagtagaatgttttccatgtatatgagtgatatatgatacccaaagagatagttggacccaaagcagctttacagtaaagaaggaagctcactcaacagctacctgcttggacagacattgatgaacaaatatgacatgtatgccagcatggatacatgatacccaacatatgttacccatcctgatgttttgacactatttaacatccctagaacttaaatacaaccccaaagcagagagtgagagggggactccatactgctggagattaagtttccaccactcagtagaatgggaacttgacatataatttatgttgagttgcagagaaaataacttacatttcctgcataccggagtttgtcagataatacccatacctgcagaataatcattaacagaaagtgggtgataaacactgagtatctcaaacaaatttatctactcaaaacatggggtatgtggctcttatagtagaaaaccacggtggtcttatctcaaggccagagtgagatgtgagaaatgacctctggcattttggtgggtaccaacataaagagaacagggaatctgaggagagcaaaggacaacttctctgcagaacgaaatcactgtcattggtgaggtgtgattctacttcatttcttcatcttcctgtccctgtccctcttacttcaaatacttctcttttctccctggttatttcctctactccctccttcctcttttttatccctctccttgtttatttttcatccctccttatctattccttaacctcttgtcttagtcagttcgggctgctgtaactgactaccatagactgggtggcttaaacaatagaaatatacttctcaccattctggaggctgggaagtccaagacaaaggcactggcagatctgctgtctgttgagggccctctttttcctggtttgcagatagccatcttctcgttgtgtcctcacaaggtggagagcagaccgaggaagcaagctttctcccttctcttcttataaggtcattaatctcattatgagggctctacccatatgaccttattacctcccaaagtccccatctccaatacagtcacactgaggatttaggtttcaacatctgaatttggtggggccacaaacattttgtccataccacccctctatctactcctgcctccctctcatgctcttccaccttacatcctcttctctttcctcttgctttttctttttcttttcttttctttttttttttgagatggagtttcgctctcgttgcccaggctggagtgcaatggtaagatcttggctcactgcaacctccgcctcctgggtagaagcgatattcctgcctcagcctcctgagtagctgggattacaggcacttgccaccatgaccagctaattttttgtattttcagtagagacggggtttcaccatgttggccaggctggtctcgaactcctgacctcaggtgatctacctgcctcagcctcccaaagtgctgggattacaggcatgaaccattgcacctggcctcctcttgctttttctacttcaacttagtatctgttctttctccattatcttatttttccttatcttcctaattccatttacttccagctgctattttcattcatcttttcttattcctattatattctttcttcttttcttcttccctctcttcctcctcaattcctttctttcctacttgaccttctttctcatttctcccactcttcatgctcccatctaacaagatagtggaaaagagagaaaaaggtaatagaatgcaataaaaatgtacttaaaatggtaacaggaataggtgatgggtttgactggggaataaggcagagagaggcattatgaataacccaaagtaaaatagggagaaaaagaggctattaaatatgattttttaaaactacttatcaaaaagccataattattctgataggcaaaatggtaaagtcacttcaggaaaaagaaagggatgttacttatttagattattactcagtattgctcttgatgttttagcaactcagagaagaccaccaaataagtgctattcatattgtaaaagaagtgatcaaattatttctttttcttatagtgtgattgtacattaagaaatcacaatagatttttaaaaaaataaaatactagaattgaggacttctacttccagaaagaagtagtaaacagggtagatgtattttccctattcatctctggaaaaaatatataaacaaaacataagaagacccagaaagttgaaaagaagatgatgtattctctagggaacttggaaccaaggaatcaacatggaggtaagttccctgtgttttctttttgctgcatacatcctagaccagatgctagagaaactggcaaactggaaacaccaaagggcacagacaaaaaaaaaaaaaaaagcttcaatgtaaatccactctttcttcacctaaagaacagacagcttagtaaggcaattattttttacttttatttttttttgagacggagtctcactcttgttgtccaggctggagtgcagtggtgcgatcttggctcactgcaacctccgcctcccgggttcaagcgattctcctgcctcagcctcctgagtagctggaattacaggcacgtgccaccacgcccggctaatttttgtatttttagtagagacgggattttgccatgttgtccaggctggtctctaactcgtgacctcaggtgatccgcctgcctcagcctcccaaagtgctgggattacaggcgtgagccactgcacctggctgacaaaattttttaaacaatgaccgctctattgtagctaaataccagagaagactatacctctacccctactagcaaaggccaactagagagacttccacccttgccagcctgtaataagacctctagttccctgatagagtggtaagatgaatggggagtgggaacattctagtcccctcagttagtagagactatgtggggagcctagatttccacccctaatgagtgataatgaggtgcctctcccctaacaaatggtgtggtatcaagaggaagcctaatgaagagtcaggtttttatcaccacccaacagtaacaatgatacctgtctatcagtggtctcaatggaggccatttggagagaagtaactgggcacccagtctctcccaagcagagtggtactggtaaaagctggaactgtcacttagcccatggtgacaggaagctcctcaaccccaggtatcagtggaatctgagtatggaacctggacttccacctacatgtggtaaaacagaagatttaaataagacccagatcttcataacataatatgcaaaaatatccaggattcaactgaaaatcacttgtcatagtgagaactgtaataatcacaacttgagtgacaaaagacggtcaacacacatcaacatcaagatggcacagttattagaatcatctgacaaagatttttaaacagccgtcctaaaaatgtttcagtgagcaattgtgaacatgcttagaacaaatgaaaaaaaggatgtcttagcaaagaaattggaaatctctaaaagaaatcagagatataaagaaaaattaataggaaattttaaaactgaaaattttaatacatggactttaaaaaacaaacctcagtagatgaactcaacagcaaaataaaaataacagaagaattaatcagggaacttgaagatagaacaatagaaattattcagtctgaatgacagagaaaaatatactgaaaaacaaaacaacaacaacaaaaaacagagccttaggcacttgttggactattacaaaagatttaaatatgtgtcattgtaatcacagaagagagagagaagaggtactgaaaaagtgttgagagatacaatggctgaaaatgtcccaaatttgggggtgggggagacaatcccacagattgagtgattcaagaagctgagcaaccccccaagaagatacggtcaaagaaaccactttcaaacttctgaaagcttaagacagaacaaaaaatcttgaaacccaccagagcaaaatgacaccttacctatagagaataccaaagcaatgacagacagaagctctctcattagataccatagaggccacaatatttttcaagtgctgcaagaaaagactcattaacctggaattaaatacccaatgaaaataaaatacccaatgaaaataaaatatcctttagtaatgaagagtaaatcaagacatttccagaagaaggaaaactaagaatttgtttctagcctacctatcctaaaataatggccaaaggaagttcttataaaagaaattaagaattctaacaattgttcaaagaaggatgaacagcatttctacacaatctcatccagaaaataagaggaaacaacttccattaattctatgaagtcagtcttaccctcatcccgaaaccaaagtacacgaaagaaacttacacattaatatgtctcacgaacatagacgcaaaagtctttaacagaatattagtaagtcaaatccagtgttgtagaaaacgttatacaccatgaccaagtggaatttattccatgtacggttcagcatccataaatccagcaatgtaatccattatatcaacaggctaaagaataaaagccattatcatattgattgacaaagaaaaagcattttagaaaatccaacagttcatttttgctaaaaactgtcagcaacccactaatagagagtaacttcctcaatttgattttttaagatatgcactaaaccttcacctggcatcagacttaatggtgagagactgaatttctccttgccatcaggaacaaggtaagtatttgcactcaccactgctatcaaaatagtattgggttgctggatcatatgacagttctgtttttagttttttgaggaacctctatactgtttctaaagtggctgtattaatttacattccaaaaaaaatgtatgagtgttcctctttctccacatccttgccaacatccattactttttgtctttttggtaatagccattattaactggagagaaattatatctctttgtggttttgatttatatttctctaatgactagtgatggtgagcattttaaaaatatattcccttggtcatttgtatgccttttgagaattatctattcaggtcatttacccatttttaaattggagtatttgcggagtgtgtatgtgtgtgtgtgtttctattgagttattggagttccttatatattctggttattaaattccttgtcagttgaatagtttgcaaatattttctcccatcctgtaggttttctcttcactttgttgattgtttcctttgctgtgcagaagctttttagcttgatgtgatcccatttgttcattttttctttgtttgaggtgcttttgaggtcttactaaaaaaatctttgcccaaaccaatcccggggcacttccctaatgttttcttccagtactttaatagttataggtcttatatttaagtctttaacccattctgacttgatttttgtatatggtgagagataggtccaaaagaaagaaaaatcaatatatcaaagagataactggattcttgtgtttattgtagcactattcacaatgccgagatagggaatcaacctaagggtccatcagtggatgaatggataaagaaaatatggtatatatgcacaatgaaatattattcagccataaaaataaggagagcctgtcatttgcagcaacatggatggaactggaggacattatattaagtgaaataagctagacacagaaagacaaatattacatattctcacttatatgcaggagctaaggaaaatttgatttcatggaagtagagagtagagtgatgattaccagaggctgagaagggtggggggtggggagcttaaagaggggttgtttaaggggtacaaaaatacagttagatagtaggaataagacttagtagtcagtagcacaatacagtgactatagttaacaatcatttattgtatgtttcaaaataactaggggagtggatttggaacgttcccaatacaaagaaatgataaatgtttgaggtgatggatatctcagttaccctgatgagatcattatacaagatcataccctgatgagatcattatacatcatatacatgtatcaaagtatcacatgtaacccatgaatatatacaacaaatatgtatccataaaaattaaaaattaaaggtaaatctaagcatgcttcttaaaaaacaaagcacaacaaaaagcaaaataataatggaaattctagccagctcagtaaagaaagaaaagcaatacagatcagaaaggaagaaataaaactcactatttccagatgtcatgatagtatatgtagaaattcccaaaatctacaaaaaaaaagaaaaaatctcctagaactaataagtgagtttagcaggtcacagggtacaaggtcaacttaccaatatcaattttatttctatatcctagcaatgagcacgtggaaattaaaaatagaatactgggctgggcacagtggctcacacttgtaatcccagcactttgggaggctgaggcgggagcaatcacttcagctcaggagttcgaaaccagcctaggcaacatagggagaccacatctctacaaaaattcaaataattaactgggcatggtgtcacgcacctgtggtcccagctacttgggaggctgaagtgggaggatcgcttgagcccaagagttgaaggctgcagtaagccatgatcgcaccattgcactccagcctcagcaacagaacaaggccctgtctcaaaacaaagaagaaaaaaaagagaatacaatgactcaaaaaaaaaaaaaaaaggtgaaatacgtgtaaattgacaaaacatatgcaatatttctatactaaaaactacaacgttagtgaagaaattaaagaagagcaaaataaatggagaagcacatatcgtcacattcatggattgtaagaatcaatgtaaaaaatgatattaattttccctaaattgatacacagtttaagtgcagttcctatcaaaatccctgcaagatgttttgtagctataaataagattatcccaaaatatatggaaagacaaaagaaccagaataatacataaaataattttgaaaaagaaagataaagtgggagaaatcattctattcaaatttgagactactgactattataatcaagactgtaggatttgatagatgaacagacacagaaaatagaatagaacagagaactcagaaattgcctcacaaatatgccagctgattttcgacaaaggtacaaaaacaattcaaaggaagaaggatcaccctttaatcaccctgtactggcctgactggatatccatagctctgacacccgcccccctgccccctccccgctgccaaatgaacttcagcttaaacttcacacctcattaaaacttaatctcaaatggatgacagacatcaatgtaaaaattaaaaccataaaacttttagaagatattgtaggagaaaattgtgaggtactagggcttgttgaagagttcttagaaatgaaataaaacccacaatccataaaaggaaaaaaaaaaaccaataaattgaatttcttcaaaatttcccctgcaaaagtctctgcaatctgggagaaagtatttgcaaaccatatatctgacaaaagactcatacataaaatacatgaactctcaatattcaacagtaaaagagaaaagaaagaaaacaatgcaattaagggtaatgggggctgggaaggaggtggggatggttaatgggtacaaaaaatacttagaaacaatggataagacctactacttgatagcacaatagggtgactatagttaattgtacattttaaagtaacatagtgtaattgggttgtttgtaactcaaaggataaatgcttgaggggatggattctcagtgatgtgcttattttacattgcattcctgtatcaaaacgtctcatgtaccccatgaatatatatacctactatgtacccacaaaatttttttaattaaaaaataggtaaaaggcatgaagaggcatttaatcaaagaggatatatggatggcagaaaagcacatgtaaagatgttcaacatcattagccattagggaaatgcaaattaaaaccacagtaagatattactacacacctatggccaaaatatactgacaccagcagatgctagcaaggatttggagaaactgtatccttcacacatagctggtgggaatgtcaaatggtatgatcactctaggaaagtttggtaatttcttgtaaaactaacatgcacttactatataccccaacaattgcactcttgggtacttatcccagagaattgggaacttaggttcacacagatacttgtacacaaatgtgtgtagcagcttcattcacagtagcccaaaactggaaatgacccagatgtctttcagtgggtgaatggttaaaccaactgttgtagcacctctataccatgtaatagtactcaacaataaaacaagaaactctgatacacaagacaactgggatgcatctcacaggcattatgctgagtgtgaaaaaagccaatctcaaaatgtgacatattgtatgattacattttcatgacctcttgaaatgataaaattatagagatggagaacacattagtggctgccaggggttagggatgggggcggtggaggagggttggttgtgactataatggggtagtaagagggaaatctttgtggtgatgaaatagttctgtgtcttgattgctgtggtgtttgtagagacttccacatgtgataaggtgatatagaactatatacacatattgtaccaatgtcagtgtcttggttttgattttgtactgcagttacacagatgtaaccattggggaagcagataaagggtacatagaacctcactgtactatcctcgcaattccctgtgtatctgtaattatttcaaaataaaaagtttaaaaagttttttaaaagcagaattaataaaatattacctaaaagcagtagggcatcagttatatttcaaaaatcatgtcatagggccgggcatggtggctcatgcctgtaatcctaacactttgggaggctgaggtgggtggatcacctgaggtcaggagttctacaccagcctggccaacatggtgaaaccccatctctcctgaaaatagaaaaattatccgggcgtggtggtgggtgcctgtaatcccagttactcgggaggctctagcaggagaatcacttgaacctgggaggtggaggttgtagtgagctgagatcatgccactgcactccagcctgagtgaaagagtgagactctgtctcaaaaaaaaaaaaaaaaaaaaaaaaagccatatgtattagctggttggataccattgctgccgctactgaacagtggacaccggatgttagccctgccactaatgctgcccctagaaactggattttcttgtggctgctgctcccaccaccacaactatggtggtgaattccatcactgcatatttgaatcactcctttgaaacaaagtgttaggtctaagttgtaactgcagtgaaagggttgtactcagcaggtctgcaatgttcaaaccctatgctttccaaaaaaaggtcttttgcaaagaatgctttggctcttgaccagctcttgggagataatctgtaagcccttggaagtatcctgcctgatcagagtgtctttgtttactgtggccttggcccacactggatagtttgtgctaacagtgtgatttgtggtgtgagccttgggctgagagatactagtttaacctctgcatggactagagactgaataactaaggtcaaccacacaggtgctccatgcctatctgactgaaccccaaaaacaactctgggcaccaaggcttgggtgaacttccctggttgacagtatttcatacatgttttcacacatcattgttgggggaattaagcactggccatacaactccattgggagagtacaactgaaaagtcgtgcctggtctctcctgaatttttccctatgcactttttacttttgctgattttaatctgtatcctttcactgtaataaacaatagccataacactttttctgagttctccgaatccttctagcaaatcattgaatctgaggatggtcttcaggagcttgccacactggtaaatcctagatcacattctcttagctgccaagggcatgtgaagaagtgaatatctggcctttgtggcttttgcacttggaactgttaagtaagaatatatatgaccttactaaaatgttaaaaatcgaaatacatctggccccaagggttttcagtaaggatctataacgctatataaagaactcctaaaagtcagtaagacagacaacccaaatgaaaaacaggtaaaatatacaagcatattacaaaataaatctaatatgttcattaatgtataaaaatgtgttctaccacattgcttatcagaaatataaattaaaaccataaggagataccaataaatacacataagattggcaaaaaaaaaaaaaaaaaggaaaagtcttgtagagtatgtcagtcttactcctgggcttctggtgtcacggaaataaagacaaacattaattattaaagtataagaatacatgtacaagtatttttattgcaatgttgttgtattgccacgctccccacaaaaatcctgaaactaaaatggattccatccatgggggaatggttaaatacattgtggtacattcttaccatggaatattatgcagtcatttaaaagaacgaatcacaggtagactgttgtcaaataagataattcagacacataaaagttcatgtaatcttaaatttgtaaaaataaaaaacaacttttgagtatggaaggatatcaaatggtgttaaaaacaagtgtttggcaggtgaaggtagaattgaaaggaagtgggaagcagtaaggaaaagaatgcaatttaaggtctggcatatataacacatcatttatgtaacaacatatatgtgtgtaaagtatgaaaaggtagcaccaaatctaagcaattgtccaaggtgatgagatttagtgatgtttatttaatttctaaaatatttaggcagtgtttgaatgtatagtgatgagtgtgcattatttgtataatgaggaaaaataagtgaattgatcacaggaaaaattgcctctcaggtttcttgctttagcaatgggatggagagtgcgattcattcatttaacaaatatttattgaggatataaaaatgtgccaggcatggttctaggtgctggggaaacaacaatgaataaaacaaaaatctgtctccctaagaggtttacactctaaatgggggagaaaggcataactagaggagaaacactgtgttggtgggaaggaggaggcgtatgaaggaatcggtttgggacctgttaatttagagaatactgagagatatccatttggagaagtgaggtaggtagttactatggatctagaattcataggccaagtcatgaccgaagatacagatatggaaacagatagcatagaaaatggtgtttctgacctcctttcctgagtctgatcacgtctcactgcagacactttacagaggaagtgctgaggaaaaacaggcagctgacagaggaggttgctatgcaacagatgaggaaagtcatccagccaggcagaactgatgttggcccttggggaccaaatgctgcagtccttcctagcattagcttcctttcatgttcaggcttctggcatgagttgatgccagaacaaatgtgaactgcacaaagatctgtcttgaattttggaactgtaccagtttaatttgagtcacctcacatctgtatttaattttctgcctttttgagtttctccagttatcctggaagcatagcagcgtgtgtgtccttgggtaggacccacttgctgtgcattccactttgcacattgagaaaccaggcccagagaattgagtgacccgtgcgggctcacacagctcgagacagacaggctgggcactccattcctggaattctgaagcccagcccagtttctctccataaaaccacagctgccccaggccccagccctgaaaggaaccagggcttgccatggctcagacacacaggtctgattgtcctggctgctccagtgggcaccaggaaggcctcagggacagtgtgattgtatccctgataaggaagaggcctgatgttctgagcacagagtggaccccaaggagcaattcccacgcctggatggacccacacagggcagggggagggtgggggcctctgcttgtgtcctcctgaatgcagagcatgagcttgggcctcctagaacacaaactttgcttgtttggtacaaatggggtgccgtggtctgttgctcaaatggaggagggaggggtacccttagtccccaggccagcatgagcagaatgtgggctttggagtcaggaagacccagacccaaattttgcattttgtttcctggctctgtggccttgtctagttcatgcaatgtatctgtgcctcagcttcctgatctgcaaaataggggtgctgacatccacttcccagggctgctgtgacaggaagacaagccccagcacaaatcctgctgtgatgtacaagctgtgcccttccctcctttcctcccccaacacacacaaaatgagtccatcaccggagctgcagaaagaaagggaagaaactaacgttctttctgcgtctgggagcttgtgggggcgggcagggggtgagggagaaatcatggagtcacgtggcagccacagacttactactactactttgttagctccaatagtgtatcctctcaggccattccgtttcctcagcagaggtctaacacttgttgcaattagagaccccaaacagagacctaagcatgctggacaagggggtggagatgcaagccggcctgacaggaggggccttgaataggggagggacggaatagagacgcattgcggaaaaggtagggggccggtgtgtggggcaaggggtgggaccaagaggcacagcgcatctgtgggggagggggcgtagaggaaggggaggtgctgttgtatagtgtcgacctggttggtggtggggtggtgtgttggcaaagggggcgggaccgccttccagcgcacatgcgcatcatggtctccaggacgaagcttttgttgggaaagcaggcgggactgactttggctcttcagtgtttgcgcatgcgcgtaacgtcctgaggcggtgggtggtatattaggcgaagaggcggggtcgcccaagctgccgcgctggcattttctcctggacaaggagagagtgcggctgctgagagccgagcccagcaatcccgatcctctgagtcgtgaagaagggaggcagcgagggggttggggttggggcctgaggcaaggtgagaattagcccccagactgggcatctgccccctggtgcgggcccccatttttttttatcccgatcccttcaccctggattctgaatccccttccaccccccaaaccccaattcaatgcccctcccgatccttcctgattcaaaacccctgtccgatccctcccatcgttcgaaatcctcagattccttgacctcgatctgtactgttagatgattcctcctgactcaaaacctccatgcaacttcccaaatgcgaatcccaacccaaccgcacccccgctccgaattcagaactcatctgcttcccgatccccatttgaagcttcgccctgtcagtagcttctcggggttcagaacctccatctggacgcccattcacttttaccgctccgatccgttcctcctcacattcaccttatccgcccgcacagtcagaccacagtcacccccctcccaattaggtccttcgtatttgccctctgtagtataacgccctgcccctctcccacagcccccaggctccgctcttgccagagggacaggagccatggctcagaaaatggactgtggtgcgggcctcctcggcttccaggtgagatctccactccccaccccaccatttccccagccgacagtcacccctccccgcgggcctctttggtctcccaaacgccgggatccggtttgaccctatttagtgactagactccgtgggcttttcgaattcccatcgtttatcgaagggggggaggggcgtctcttttcagccatcagtccctgctcagagagaggggagaccctgttagtagtcagggcaatctgcccagagaatgcggggtgggtaaggaaccatttttttttttttccagaatcctgacgcttgtagagcagtctgtcaccccctcccccagcctcctgcctccaccctccctctttctgcattccccactctgtgcgaccccccttattctcaactccgcgatccgcctgccgtcctgagctgctactgcacgcctcttggagcgtccccggctcctgttcgtgcccactttccgcataccgccccacccctcattttgcccttgccctacttcacccctgccacatgtttagtacccgcctggtcccccatcgcccctcgcgggccccctagatctctgcctcagcccccctgtttttgcacccaccgcccgcctgcagctccgctgctgcgctgccacccgggctccctattcccaccccacctcctgcctcagaggcccagagatttaattttttcccccctgtgtttgcaggctgaggcctccgtagaagacagcgccttgcttatgcagaccttgatggaggccatccagatctcagaggctccacctactaaccaggccaccgcagctgctagtccccagagttcacagcccccaactgccaatgagatggctgacattcaggtttcagcagctgccgctaggcctaagtcagcctttaaagtccagaatgccaccacaaaaggcccaaatggtgtctatgatttctctcaggctcataatgccaaggatgtgcccaacacgcagcccaaggcagcctttaagtcccaaaatgctaccccaaagggtccaaatgctgcctatgatttttcccaggcagcaaccactggtgagttagctgctaacaagtctgagatggccttcaaggcccagaatgccactactaaagtgggcccaaatgccacctacaatttctctcagtctctcaatgccaatgacctggccaacagcaggcctaagacccctttcaaggcttggaatgataccactaaggccccaacagctgatacccagacccagaatgtaaatcaggccaaaatggccacttcccaggctgacatagagaccgacccaggtatctctgaacctgacggtgcaactgcacagacatcagcagatggttcccaggctcagaatctggagtcccggacaataattcggggcaagaggacccgcaaggtgagatctctgctaacttcattttgctttggggctgtctcctttcttctctgagggtgttcatttgttctaaacaaaacaatgtatgtaactgtattcagctaggctatagggcatttgaagagaatgtttattcctgtcctccggatgttcacaaactgatggggagataatacatggacacaaataatatatacaacctgtatgtaattcagtttacattttgttatgttagtaaccaccatgtgttaagccttgagctaggcacattcacacaggttgtctcattaaaccttaaaggcacctcctaccaggtagggatcatagtgccaattttacaaagaaggaaattaagtgccagagaggtgaagtgacttgagtgatttgttcagggtggtacaggcagaaccagtggtggacataggaagaggagaagcctcaggccccatctttgggttgctcctggcctggctcggagatgaaactcctgcctggaagacagtgaaagacaaacccaggactcagggtgaccaatggctagtgggtcaggctgtcactacaggtgagggtttagagggcattcctggaatagataaggtgaggacacagaacccactggtgattctgaacttctctctgatgatgcagattaataacttgaatgttgaagagaacagcagtggggatcagaggcgggccccactggctgcagggacctggaggtctgcaccagttccagtgaccactcagaacccacctggcgcaccccccaatgtgctctggcagacgccattggcttggcagaacccctcaggctggcaaaaccagacagccaggcagaccccaccagcacgtcagagccctccagctaggcagaccccaccagcctggcagaacccagtcgcttggcagaacccagtgatttggccaaacccagtaatctggcagaacccagtgatctggccaaaccccattgtctggcccggccctgttgtctggccgaatccactggcctggcagaatccacctggatggcagactccacctggatggcagaccccaccgggctggcagggtcctccagactggcaaggtcctcctgactggccgctaccacccgactggccactgccacctgattggccacttcccactgactggccactaccacctgactggatccccgctgattggccaattccacctgactggcagaacctgcgcccctcgcctaacctgcgcccttctcccaactcgcgtgcctcacagaacccaggtgctgcacagccccgagatgtggcccttcttcaggaaagagtaagagctgtaactccccagtcacttttcccctctcttgctcttttctttgtcatcctctcatctgtaattcaaccaagtttttttgtaaatattttataagtttaatgatttcctttttccctcccaggcaaataagttggtcaagtacttgatgcttaaggactacacaaaggtgcccatcaagcgctcaggtatgcatccagtgtcccctccccaagctctgcccttcccttcactccatgctctgtcagcattcttctgcttgtagctctgcccttcccttcactccatgctctgtcggcattcttctgcttgtatgacccttccccttctatcccctcctttccatggttggctctttccacccttgaggaccttgactgtgctacccccagcagggctggcaaagggactgctgctctgtggcccccgctcggctcagatggctccctcctctctcctacagaaatgctgagagatatcatccgtgaatacactgatgtttatccagaaatcattgaacgtgcatgctttgtcctagagaaggtgagaaggcagccctggggtacaggaataatggggaaagtcttgatttcaaagattcatggggttcctactgggagtttagggcaagtctcagggagatgagtgtctgcctatgggtagcttatgctagatgttgtaatttcatagtctgttttcttgcccctgtagaaatttgggattcaactgaaagaaattgacaaagaagaacacctgtatattctcatcagtacccccgagtccctggctggcatactgggaacgtaagatgggaaagaaggtggaacatggcctttctcagtggtgctttttttctaggagtttcacgtagatcagggtccagggttcagggtcacatagcaggtcatgggcagagctggggtataattctcccctagctgaggaatattggggaggctagatgggcaagctggttggggtctctcatgcaaatggctactgaaaatatattctttctatattcccttaggaccaaagacacacccaagctcggtctcctcttggtgattctgggtgtcatcttcatgaatggcaaccgtgccagtgagggtgagtggctggacctgcagctgggggttggccacagcctgatttccatgcttattttccgtcccttgtctccccttgcctcccattgcagctgtcctctgggaggcactacgcaagatgggactgcgtcctgggtatgattgggctctctcatctcttgcctgtttgtgccatcctttggcaacagtggatggtcccaggattgcattaacctgggggtctggagggtttggtttggggatgttcagagcccaaagatgtgacctgggtggatggggaaacagttctgaactctctgcctcttttctcatctctgacctctgttctggaaagctctttgggcatggtaatagcctctgattgtgggtttcctttttttaccttcagggtgagacatcccctccttggagatctaaggaaacttctcacctatgagtttgtaaagcagaagtaagtgatgcctaaggggcttttcctgcttcttatgattctgcctgtgtgctggtcagctttagaaagcccttcctggctggatacaatggctcatgcctgtaatcccagtactttgggaggctcaggtgggcagatcgcttgagcccaggagttcaagaccagcctgggcaacataacgaaaccccatctctacaaaaaaatacaaaaattagccaggcgtggtgacatgcacctgtagtcccagctacttgggaggctgaggtaggggagaatcatctgagcccaggaagttgaggctgcagtgagctgtgatcatgccactgcactccaacctgggcaacagagtgagaccctgtctcaaaaaaaataaaagaaagcccttctcaagctcgtttcttacactatacttgtgcatatgtgtttctgtgcatacagaaacacttatgtcctcaggagtatttattgcatatactcctcatggttaaattctttattttttatttttttattttttgagacggagtttcgctcttgttgcccaggctggagtgcaatggcgtgatctcggctcaccgcaacctctgcctcctgggttcaagctattctcctgcctcagcctcttgagtagctgggattacaggcatgtgccaccacgcccacctaattttgtcttcttagtagagacggtgtttctccatgttaggctggtctcaaactcccgacttcaggtgatctgcctgccttggcctccagaagtgctgagattacaggcgtgagcgaccgtaccgggcgaattcttttgtttgtttttttcgagactgagtctcactctgttgcccatgctggagtgcagtggtgcaatcttggctcgcttgaacttccacctcccaggttcaagcaattcttgtgcctcagcctcccgagtaactggaacttcaggtgcgtgccaccgtgcccggctgtttttgtatttttagtagagatggggcttcaccacgttggccaggctggtctcaaactcctgacctgaagcaatccacccacctctgcctcccaaagtgctgggattacaggtgtgagccaccacacccggccagaatttttctaatttttctacttttctaagcagttgtcttgcaagtgaagcccatccaccatccccacagtagacattcccaaggctgggccaggctgacacttttgcactgcattgtactcatttcaatggacctctgtggctcactgacaagattacaagaatctggagctagagctcaggcagaaggagtgaaaggaaatgttgtcctttctgtgaccctatacaagcctcgcctgcatctctagtgagtgcttagcgttctagtgcaggaatttaaggcttgatgattaaggggtaaataccctgatggtgttcaggaatgagcccaagggggagttgctatctgaaatctgttaaaaaatgtaagattatttttcattagtggactaccattctgcctgggtaggtagacacaaagactgttttgctctttcagatacctggactacagacgagtgcccaacagcaaccccccggagtatgagttcctctggggcctccgttcctaccatgagactagcaagatgaaagtgctgagattcattgcagaggtaatggaggaactgttccagcattgataggtcaagggatgaagtatagctggctgggaaaggcccagggtaggaatgagatcctaggtgtggcaggtggtaggtgccgcattgctggtggtatttgttgttgctgttaggtaaacttaacatgtattaggtgctaacatatgttaatatattagctaatacaattatgagtttgttttgggtttttttttaggtttttaaagtatttttattttttcccaactttactaaattataattgacaaaaattgtatatatttgtggtgtacaatgtaatttttaagtattttgttttatttatttatttatttgttttctcccgagatggagttttgctgtgttgcccaggctagagtgcagtggcgcaatcttggctcactgcaacctctgcctcccaggttaaagcgattcttgtgcctcagcctcccaagtatctgggattacaggcacgtgccaccaccatgcctggctaaatttttatttttctattagagacagggttttgccatgttagccaggctggtctcaaactcctgacctcaagtgatctgcctgcctcagcctcccaaagtgttgggattacaggcgtgagccaccgtacccggcccattcatttatttttaactgactaataaaaaatatacatatttatggggtacagtatgatgttttgataatacatgtacattgcagaatgattacatcaagctagttaactctccatagcctcatatacttgacattttttttgtgatgagaacatttaaaatgtactcttttagcaattttaaataaacgacacattattattaactatagtcgtcatgctatacggttgatctccagaacatattcttcctatctaaatgaaactttgtaccttttaaccgatatctccctatccctcctgaccccaggccctggaaactaccattctactctctgcttctatgagttagacgtttttagattccatgtataagtgaggtcatgcagtatttgtctttctgtgtctggcttatttcacttagcataatgtcatccagcatcatctatgttgttgcaaatggcagaatttccttctttttaaaggctgaatagtattccattgtgtgtgtgtgtatcacattgtccttatccattcatccactgatggacaggtaggttgattccatatcttggctattgtaaatggattttgttttgttttctattcctcatctcaggttcagaaaagagaccctcgtgactggactgcacagttcatggaggctgcagatgaggccttggatgctctggatgctgctgcagctgaggccgaagcccgggctgaagcaagaacccgcatgggaattggagatgaggctgtgtctgggccctggagctgggatgacattgagtttgagctgctgacctgggatgaggaaggagattttggagatccctggtccagaattccatttaccttctgggccagataccaccagaatgcccgctccagattccctcagacctttgccggtcccattattggtcctggtggtacagccagtgccaacttcgctgccaactttggtgccattggtttcttctgggttgagtgagatgttgggtaggtacatcactttggattgggcagttagggtctctgggggatatagggtccatggggttgtatttatgtgcatgagctagaagtattaggaaactcattgtagggagatgaggaaagtatggggcagcactctttggtatgtatattccttattatttgatatatatcattgatttttttacttcttctttcttatgttcacagatattgctatcaatcgcagtagtctttcccctgtgtgaggctgaagcctcagattccttctaaacacagctatctagagagccacatcctgttgactgaaagtggcatgcaagataaatttatttgctgttccttgtctactgctttttttccccttgtgtgctgtcaagttttggtatcagaaataaacattgaaattgcaaagtg

SEQ ID NO: 37123 - DNA, 80423 bp, Homo sapiens; identical to SEQ ID NO: 37070

SEQ ID NO: 37124 - DNA, 344497 bp, Homo sapiens; identical to SEQ ID NO: 36659

SEQ ID NO: 37125 - DNA, 18536 bp, Homo sapiens
ggcgctgggcagtgtggaggtcgttggagtcacttccccgtcaccagctcctgtgcctgccagtcggtgcccctcccgctccagccatgctctccgccctcgcccggcctgccagcgctgctctccgccgcagcttcagcacctcggcccaggtaggccagacgaggggcggcctgcaggcggaggccccccggcccgggccacgtgcgtccccggttcgcgggcagctctgaccctctccaggccagcctggaccgcagggatgcccggcactggctggagactgtggcgcccggggcaggccctgacactggcctggaggtgcgggggagaaagccggggaaaagggggcgaggtagtcccgctccagggccggtccatttgtcagggttcccccaggtctcccagatttcccagaggacctgctcttggcttgcacgccttcaaggttgggaaaccagggctctgcatctgaaagtaaacttacgtttttttctgcagcgttccattgctttgacgtagctaatctccttgcagcatccgtgtgagttgtgcgtgaataaaagaaatcgtatacttcctaattccatagtatggacaaaccgaggctagagaactgggccagggttacagtcatttggccagaggattagaattcagcgcttctgacctgaagacggcttcctcttaacctttttggaggatctctcctgctgtgggcggactgagcctgccgccaggtgtcttaacagtgcttgacttggcccgcgaccacttaagcctaggagcctaggctatttttagccatcttctagaatggtggttcttaaactctgcagtgtgtcagaatcaccagaaagctaataaaaaacagacgtctgggttcattgaagaagcttaagactgcgggggggggggggggggtccgcatttttaccaggtgaatctaattaaacctaattttgagaacccaggaggtgctcgcattgccttttaattacgacgcccaagagggaggtaattttaaaggggaatccaaatttatcatcgaagttctcgagtttcctgtacatccagttcatttgaaaaataaatacaaatgctcctggattgatggctacttcccatacccatcgcaagttggtaatatcctaagtcaaaaggcgagtttaactttgtgtattttcaacttgcaatgggttcccacaggcaaccccattgtaagttgaatgtaccaaatgcttttgcgctgcggtgaagtgggggcccagctgtatacagataagtacattaagtacctgtgcttgccaacaactatgctgggtgctgcaggggataccaagataagtgagaagtgacacttgatatgggacaggaatgagtaaacttaggacaggtggaagcgatgaaggtcttagggaatgagtaaacttaggacaggtggaggcgatgaaggtcttagggaatgagtaaacaggacaggagggatgaggtgtgggggaggggcagccaaccaaagagaggacaggggtgtccagggagaggttgagttttggtaggaccttcagatatccgacatatttattgagctaggtactggaaatacagcggtgaacaaaacacagaagtccctgctctcacggaaattactagatattttacttattgccccactcattataaagtatcttaaaatagtgatgaacatgcaagaaaaatggggattgtagggtgcttgtgttagggaagagggtaccaattttatttactttttttgatgcagtgcctcgccctgtcgacaggctggagtgcagtggcgtgatctcggttcactgcagcctccacctcccaggttggagcgattctcctgcctcagcctcccgaatagctgggactacaggcgcgcaccaccgtgcccagctaatttttgtgtttttagtagagatggggtttcaccatgttggccaggatggacctgacagagtcccactctgttgcccaggatggagtgcagtggcgccatcttggctcactgcaaccaactcttgggctcaagctatcctcctgcctcatcctcccgagtaggtgggaatcacaggcaagggctacgacagctgggtaatttttgtagttttagtagagatggggtttcaccatgttggccaggctggtctcaaactcctggccttaagtgatccaccctccttggcctcccaaagtgctgggattacaggcgtgagccaccactcccagccgagggtagcagttttacatcagccagggtaggcctcacgcagagtgagatgtttgagtaaagtctgaaggaagcagagatcacatcatatggaaagagtattgcaggtaagggatatgtctcaggatgtagctgagagcccttggagaagcatggggcatgccttgaaggtttgagaaaatgaggctagggtagttccagagaaggcagtggaggtaacagaacaggccttgtaaaactttggtattttctcagaaatggggcggccagttgagggttttcagctgcgtaatgacttgctcttccttccattttaacaagatggtcttaggagtgagagaaaggtaggttaggagttcattgtggttatctaggtgcaggtggtaagaaatgattgaattctgggtattcattgatggtaccagaaggatttgctgatgtgtgattagataaggggtcggggatgacaccaaggttttgggccttggagttgggctgaaataggcaagacttatagaagagagtgggtttaaccagggagaagatatcaggagttcagtttttatttatttactgagagtctcgctctgttgcccaggctggagtacagtggcgtgatctcggctcactgcagcctccgcctcctgggttcaagtggttctctcacctcagcctcctgagtagctgggattacaggtgctgccaccacgcccaactaatttttttttgtattttcagtagagatggggtttcgccatgttggccaggctggtctcaaactcctgacctcaggtgatccacctgtcttggcctcccaaggtactgggattatagacgtgagccaccacacccggccaggatctcagtttttcatatgttcaatttaaaatgcctgttgggcatacaagcgacattgttgagaaggcagctgatgaaagcagaaagaaagatgggcttgagcccatggtgcagtggtctccagactttggattttttttttttttttttttgagacggagttccgctcttgttgcccaggctggagtgcaatggtgcgatctcagctcaccgcaacctccgcctcccaggttcaagccattctcctgcctcagccttccgagtagctgggattacaggcatgcgccaccatgcctggctaattttgtatttttagtagagacagggtttctccatgttggtcaggctggtctcaaactcccgacctcaggtgatgcgcccatctcagcctcccaaagtgctaggattaaacgcgtgagccaccacgcctagctggatcctgtatctttaacagtaaaagcgtaggaagcacatagccccaatgtatttacttataggtatatgtactaatatatacattacaatataaactcaagtagaaattttaaaacaaaccataacacgttataaagtgttaaaacttataaatgaaggcagtgttaacatatgtcggttttcaacacagttgccaagcagtgtgctgttgatagccactctgccacccagcaaaggtcagcgggtctggaagacagctctttgacaaggagatcatgatctaacctccgggccaccaaagattttcatctcattgcaaagcatgtaaagattatactacttaaggattgtggttttgtaaaaattaagttggtgacatcctgtaatatacaaacagtgacatcaccttgacaaagtgaaagcaaagaaaccagtgaggcagtcttcttcccctccctcccccatgttgtgttcaccttatgtacacatgggacccatccatttaagcaccctagcgagggcacaggtcggtccatttcttggtagagattaattctttgttagataaagatagagacagtctgggcatggtagcttacacctataatcccagcacttgagctcagaagtttgagaccagcctgggcagtgtggcaaaacctcatttctacaaaatgagtggtgtgtacctgtagtcccagctacagctaaggtggggaggatggcttgaaccgaaaatgcagaggttgcagtgagccaagatcgcaccactgcactccagcctgggtgagagagggagaccctatctcaaaaaaaaaaaaaaaaaaaaagatacactcattgcagcagtttcatcctccaccctggtgggattgtcttggccactcccctgtggaaccactgccctggctgagtgatggaggcatgaaagctttggaagatttttttttttttttttttgagatagactgttggtctgtcacccaggctggagtgcagtggtgtgatctcctcctgggttcaagcgattctcctgtctcagccttctgagtagctaggattaccggtgcgcgccaccatgtctggctaattttttttattattagtagagatggggttttgccatgttggccaagctggtctcaaagtcctgacttaaggtgatccacctcggcctctcagagtgctgggattacaggtgtgagccaccacgcccagcccagaagatatttttttaaagagatggaatcttgctctgtttcccaggctggaatgcaatggcgccatcatggctcacggcagcctcaactcctgggctcaagtgatcctcccacctcagccttctgagtagctgggactacaggtgcataccaccatgccagcctgagcacgagagtgaaatgattaagactttgattttgggaaagcatgctttggaggtgttgctgagtacctaagttagataacggaatagaatgaagaggaggagcgggttgggagggtggttgagctgccaagttcttcatgtcctgacttgatgtctctgataagaaggaggtggcagaagatggttctagaagtttacatttagtgaacacaagtgccatttgggaccagggatggagggaggggggcaggataaatggacagttgagtttgtggaacccatggaacgcctaacagaactgggaatgcagagctgggatttgggagtccctgagactcacacaagatgtgggagtgagagctgaagatccagaagtgggtgaggctgagcctgcccgacctcaggttctgagcgggtctgacaggttcaagtttccaggcagccaggggttcacctttaaagcaccaacttgaaactcaaaaacctgtttgaattcaaatgttggttgtatatgcttccacagtttaatttcctgagcagaaacccactgggtaagcgtcttgattcggattttggtttgttgggttttggtttctgataaccaaagcctgttattagctggcctcagctactgtagaagactgtgcagtgatgctgtcaggccccagatgaccacacacggtgccgagagttcccgtgtctgccactttgtttgcctcttccctcactggtagctgcctgcctgcctgcctgccagggatcggctgtgcttctcatttgtgagtttagatcagaaacaagctccctgggtatggctgtaattttggtcagaccttgagtgagacctagaggggaagagtgccttcgaataacgggagtgattgctggatgcggggccgggtcactttcaccccatcactttcctaactgttccaagctgaaatgcccagggccagctgctactttgctgcctgttcttctgattagcctggtatgaaacagtgattctcaaactgtttggtatcaaaatcatctggggaaaatggcaaaaatgccaaggcctaagccccatcccgcttccaggagcctagtcctgagtgggcttcattagctcagcaggtggctctgatgcacacctaggctggagaaccagtgtgagatactggagcccgagatgacagatctgactcaccaggagggttggagtctttcgcaacgtacgtaaccccttccacctcttgttaggcagctccttgtcctgcctgaggctccagccacaagtttgctgcctggatgaatcttctctgattccccacccctgcagggagttgattgccgcaaccccatctgccctcttgcacaaggggcttctgtgacagtgttctccctgctcctaatgcatctcattacctgtctcctacagagccagcagggatcttcctgcaacctcagttaccgggagggcctgttgctaggcactcagtgtgtgtttatagtttataaagctgcaggttgaagggaaggctgctgttaccagtccagctgcctgatggagtccagcttgttcttcatctttcaggagggttttgaagtaccctgagtatcacagactctacagacataaattctccccatttgaaagtggacctttggaatgaaggtcctgaattcttccagaatgagactgttacaaatacaatgattgtatcttgctttggcaactgcagtaaaaagaggcccagtgcaacattataggataccatgtgaatccttttcatgctcatttcctcctaagagtcctttctctgtgcctctttttagaacaatgctaaagtagctgtgctaggggcctctggaggcatcgggcagccactttcacttctcctgaagaacagccccttggtgagccgcctgaccctctatgatatcgcgcacacacccggagtggccgcagatctgagccacatcgagaccaaagccgctgtgaaaggtactgggcgcgctgaccctggagacttgcttcctgtccccagtaggccaggattcgagttttgagtaagattcttagatgaaactaaatgtttagagacgggggtttctctgttttaaatttaaattttacaagtgattacacccttttagacttggcgtctataaaaattgaaacagcggtgtcttttagaaatgtgaggtagcctaatcatcccattttctactttttctaatttgaaaagtagtatgaggatggggaagagggaagtgtcagcaacctctggtgaggatttggggacagtaaggtggtggtctcagctgcgggccaccttccctccaccccagggttatcttgccagcttctcaaaaagcacggcctctttgggaaacctccccgtctgtggaaggcagtgtcggatattcagtaaatgttgtctggaaaatgattcactggacttagtgcagtggcttatacctgtaatcccagcactttgggaggccaagtcaggaggattgcttgagtccaggagttcaagaccagcccaggcaacatggcgagacccctatctcaacaaaaagtccaaaaattagctgggcgtgatagtgcacacctgtggtcccagctacttgggaggctgaggtgggaggattacttgagctcaggaggttgaggctacagtgagccctgattacaccactgcacttcagcctaggtgagatagtgagacactgtttccaaaaaaaaaaaaaaaaatttcataaatatgcatatttatatatgctgcttatttaaccttcacaatgtatcaacatttttgcatgtcaccaaattttttttttttttttgagaccatgtcttcctctgtgtcccagatggaatacagtggcacaatcttggcttactgcaacctccccatcttgggttcaagtgattctcctgcctcaacctcccgagtagctgggaccacaggtgtgcaacaccatgcccagctaatttttgtgtttttagtagagatggggtttcaccatgttggccaggctggtctagaactcctgacctcaaatgatccacctacctcggcctcccaaagtgctgggattacaggcatgagcaactgcgcccagcccgaattcttgataaaattattcttaaagctgtaatttatcatttatgatagctctgctgttgaccattggctgtttcctgtttgcttctgtaaatataaatatattaatgtaagttgcagtacgtatctttatctttacatcttgttgaagtcttagagttctaaacacagaattagtaggtatgaatatttcaaagcttttactataaagttccaaattgctgtccagaaagattctactgatttctttcccctctgacagcgtatgcgataccgtgtctgatggtgtttacatgagtcttaagttggtgtgaacagctggggaggctgcctggcaaattttatgttcgtgcaccttccagagttctctgaatgggttgcccattttcttttgggctgtatattcgggttaagaaggctcctgcattaaggaaaaagtcaagatcgaagcagattttggatattgtagcaaatttccctgaaatctttgaaaacatactttttccttcagatgataggagtaaacgaaatagtaatatttagagtctttcagcacaggacgttttctttcctggccttcagtgccttctgatcaaggagtttgggctggcacagtgggtcactcctgtaatcccagtactttgggaggccaaggtgggtggatcacttgagttcaagagttcaaaaccagccttgccaacctggtgaaaccccttctctactaaaaatacaaaaattagccaaatgtggtggaccatgcctgtaatcccagctactgaggaggctgaaacaggagaatcacatgaagccgggaggtggaggttgcagtgagccaagatcacaccactgcactccagcctgggtgacagagcaagactccctctcaaaaaaaaaaaaaaggagttttcatcaggattgtggtgatggggaatgagcagctcctctcattctaactggaggccaagtgtgacttacaatgctcacgagtaggatgaagacaagcagtggctcagttcgcttttgtggaaacctggagggctgacccattctagctggggcctgggcaaggagaggctggggaaagcagggtagaaggggagggttcctgccacgggaattgtcagctcgcagggcagtagtcgtcaacagaaggaagtcacgttacaggcagggcttctagcctttctcgaggccattagttggccttaaggccagggctgaactttccaggcctctctgaatcagaaacggtgacatttctcttgtggggtgtttgttctaggctacctcggacctgaacagctgcctgactgcctgaaaggttgtgatgtggtagttattccggctggagtccccagaaagccaggtttgtgtttgaaagccttgtctggtacctccccacgtgaagatgtggggattaaatccatttcctattaaaaatggatttaatctggttgctttgttgtaggaaaaatgtcaccagctcccctttcctgtggggtaaaggtcacatctctttgttggcctgggatcaaagtcgtcttgccgttcccctgtgcctctgtgcacggacgcccttccctcttctcagtcccactctaccttgggggttcttaataaacctcgacggtccttctcagatgttgtcctcccctgctccacccatgcagacctcgcttctggcactcatcatgctggatcatttaccctgcaagagggactgacttgaaacggggaccttgagtggctaaatttcctgtaacagctggcgctcagcacatgctgcctgtctggaaatttgtggtgttctctgttaacatctcatattggatcatttccaggcatgacccgggacgacctgttcaacaccaatgccacgattgtggccaccctgaccgctgcctgtgcccagcactgcccggaagccatgatctgcgtcattgccaatccggtgagtgtggcagcacccggctcttgcagctatggcaggtgtttaggtgctgacagtgcgtgaaaagctcacggtttgcagcaaaggctgctgatgtgctggggggatggggggatacacagatgaaggggctgaaatggagaggtcgggtgcactaagcagaggcccgtccgtgcacttcctaaggactccttccagcatgaactgaatgagggttgtcacagccagccttgtgctgtgggcagaccacgtctctctctgctttagtttccccacctgaagagaagtccattctcaaggctcctttcagccgtgattgtggtggtctcttgattccctttttgacacagtagctcctacttagccggaaaagtatgttccaagagcccagtaggtgcctgaaccctgaaccctgtatataccatgtgtatactgaaccctgtatataccatgtgttttcctaggcatgcacacctgtgataagttaatgcataaactaggcacagtaagagattaacaacaacaactcatagtaaaacaatcacaacaagatactataataaaagttatttctttccctttagtcaggaacttccaccttctcgcttaagggaagtacttaatggcttctctggtttctgtttctccaaattgccagcatcactactcttgcgctttggggccattgtaaagtaaaataaggcaactggaacacaagcatcatgatccctcaacagctgatctgataaccaaaatggctcctaagtgactcaggcaggtggtgtagacgcatgggtatgctgggcaaagggttgacccctgtcctgggcgggatggagccagagttcatcctgctactcaggatggcatgcagtttttttgtttgtttgtttttggctctgtcgcccaggccagtgtgcagtggtgcgaccttggcttactgcagcctctgcctcccaggttcaagcgattcttctgcctcagcctcctgagtagctgggattacaggtgcatgccactatgcccagctaatttttgtacttttagtagagacaggatttcgccatgttggtgaggctggtctcaaacaaccaacctcaggtgatcctcccgcctcactctcccagagtgctgggattacaggcatgagccactgcgcccagccagtttaaaacccatgaattctttatttctgaaatcttccgtgtaataatttcagacctcaactgactgctggtaattaacacagcagaaagtgaaaccatggataaggtgggactatctgcattctactcaggatttccattcctggtcccctgttgtccccatttcctcattcacacacagtcgcggacacacacacagccaccccaggccccactcactggtttttgcaggtagctgcttactctcggaaacgttgagtgctgcgtcctcactgagagggcggccatggttccccagcttgacctgcagggccttgtgctcatttaacagcagccacctcactgctccttcctggcggagcctgggtcctggtgtctgaggatgaggatcaattggggtgaaggggcagggaccatgatgtcactgagaggcatggatgccagcaggcatgcagagctcgtgctcctggcctctaagggtcctgcgttccccagaagctcctcagggtggtgggtcacaaatagagagctgctattccctttgttggggagctaaccagtgcctaatagaaacctggccattctgtcatcttctggcgtcccgggtgacgtgttcagcactcgccgtgtgtgaagtcatttagtatttatgacttcatgaggttgtcgtttcccccacttacagaagaaaaaaacgggtcccagggagttagggtgacctgcccagggtcatagcacagagggactgagctgccagtggacctgcttccttggagcacacagccgctgtgcactgctgtcccatcaggagtggccctgcagctgtgagtcccggccgagcagaaggtgatccatggaggcatcatcacacatttcagttgatagctgaagggccaccaagggaagaagcatcctctacagcaaagggtttctttgttcacatggtgcggcctgtcctttctggcaggtggcttgccagtacagagttatcagacagggcagtttaatgtggcatctttggactagttagacctttgggaaggtctgacaaaaagcccttttcctgctgtggcttggccctgctctcggaacccagggcaagccatgcctgtctgttggatgtcctaggttaattccaccatccccatcacagcagaagttttcaagaagcatggagtgtacaaccccaacaaaatcttcggcgtgacgaccctggacatcgtcagagccaacacctttgttgcagagctgaaggtaagggcggcgtgggtgttgctcaggtgacctttctgaacttctcccgccacccgtgctcatttacgggcgtggaagacatgaaggcatgcccaggtcacgtgtcactttggggttttaaatgtttttagagctcgccctcttgatggaagcagcccctgtgtttcctgtgggttccaggcactcggcccaacaggcatctactctggccagtgtctgtctcccggctctcgctgtcttccttctcgccaagagcactgtgggttcacaccttctttgggcttctcagtggctggacttggacggggctcccccagtcctcccctttctccttgcccctgaaaactggtcctgggaggatttacctgttggccactagataaagggtgggaaaattagcaaacatgaagaactgaggaaagtgccagaagtcctgaggtatcagaattgttgttggccctggtccctggcactgacttttttgggttgcccgtggtagctcaccctggagagtccaggcctggccaggtgcctgaccctagggccgctggacggagactgagctgctgggtgtggcttgagctcggcttggtttggtgccagtgccgggcctggagtccttagtgctttgcacagcctgctttcgacttgcttccattgtggagccagcagaaccacttcctttggccccaaaaagtatttctcttgagcttcaggcctttttgttctgatggcagattggaggttatacgtgcggcatggtaggaagtgcacccgcagcacccttggcctccgttttactcccgagtgacaggcacatctgcttctgaggagttagagatgccccactgtaacagacatggcagcacgtacccgagggcctggtagtgggactctgttacaggtgtgggggtcacagagtttcaaaaggcatggccccaggccttagagttccatggaatgggagagacacttgaatcgaagagacagtttaagcctggcacagtggctcacggctgtcatcccagcactttgggaggctgaggtgggatggttgcttgaacccaggagttcaagactgcaatgagctgtgattgcgccactgcgctccagcctgcgtgacagagcaagaccctgtctctttaaaaaaaaaaaaaaaacagtttgagtgagcaggtgagcgcaggtgtatgtccagaggcccccgggattgccgcagtacggaagtggacacaacaggcaggatcccacctcccacctccagaggcgcagcccctggcgtcctggaggcaacagagttcattctcgtgggctctcagggctgggcacaccccaggccctagtcctgccctgcaccatagctgccactagctacatttggctatttatggttaaataacattaaaactatatccctctgccacacaaaccacatttaagatgctccatggccacatatggctcctctgtcctcacagaaagtcctgttaggcagtcctatctcagccttgaagcttcactgttagagttggggacagggtaccttggcccttgggagatcccgtcccccacctccaacagtgaagtggactgtcattacccctggctgcctgacattctggaaatttcctggatcatatcaagaatgcatatcaatccttaaacttccgatggctggttcctccctcatcctctcacccaccatattccctttcaacgtggctccaggacctcccaggccaatgccttgttcccgtttgctgcaaagtcgccttgtcccccgtcttagcatgcaccattggaacatacatttctaggagtcttgtatttgagggcaagcctctggaaagcagggctgtgtcccttcagccccacgtccctggtgaccgtgcagtgcccgcacgtgtgtgcttatacaccaccaagctaagcctctcggatctttggctcccggctccatgaagctgatcctacttttcccgtgcgtgaggctgatcctccctctcccagaccaggctcattttccaacctaggactgggctcttcagtggccatggccatcggggcaggtggctgttccctcgctaccattactcccaccaggttattgtccgttttaagaaatacttggttcagccgggcgcagtggtgcatgcctggaatcccagcactttgggaagccaacgcaggaggatggcttgagcccgggagttcaggaccagcctgggcaacatggcaacaccccatctgtacaaaacatttaaaaaacatagattgggtgtggaggtgtttggtacttgggaggctgaggtgggaggatcattgagtccaggaggcagaggttgcagccatccaagattgtgccactacactccagcctgggggatagagaccctgtctcaaaaaataaaacaaaaacctggttcacagattcttgggggtgtggtacctccagtttaagaaatgaggcagccttgaactgtgctgtttggagccataggagtcagtttgttctttctgtcccaatcactgtttgaggtggcagacttctaactcatgggtatcctggaatggatttgaattttgttctgtggggcctgaagaaaagggaacttggattgttctgtgtagggaggagtctgggcttgtgcatggggagtggagccggctctgggaaagaggatgccaggcccggggggggcctccacaggaggcagcatcctcccatgcccatccacagtgggcacaaatgctcactatgaaggaaggacttgcgatggcctcgccagacggcggcaagccctcacggcacctgctggcgctcatgctcagccttttggggcaccgtggcaggagatccaagcgcagcaggggctggacagggcctcctcctagctggctctgttccaccctgagttctggggggcttttccagtgttggggctgtgggcagctgtgacatgttttacagtgaaagagcttgttaactcatccagcttcatactttggtcaccagggtttggatccagctcgagtcaacgtccctgtcattggtggccatgctgggaagaccatcatccccctgatctctcaggtacacgcatatgaccctgtgaggggcttcgaggtcaggattccctttaccaggccctgctttgaggtgatcccggtagactggagaaggcctggccacgtgccaggttttggaagggctcctgttgtaggcagccccgcccctctgctgcagggcggtgtcagtcctggagcgaatgtgggtggaagctgctcagggcccagctccagcacgcaaggagaaccactgttgggaacctcaccgggttactggttaggccggagcgggcgaggtgcttttttcaaaaatgagtccagggctggacacagtggctcatacctgtaatcccagcatttgggaggccaaagcgggaggattgcttgagcctgggaggttgaggctgcagcgagctatgatgcaccactgaagcctgggcgacagagccagaccctggcctcaaaaaacaaatgagtaggggactcaccacacttcccaacagagttgatttcacttcgtcttttttttttttatctttttattattatttttttgctgctccttgtggagcagggctaccccataggcagtgtgcccagaatagcatgtcatttttctataaaggttttctttttcttctttatagaaaacctttcccatgccctggtgatgggagggagaggagaggtcgggaatagtgggggtgggaggcagtgggtctggggtcatgggccggaagccactcactgatcccatggcttggcttgcagtgcacccccaaggtggactttccccaggaccagctgacagcactcactgggcggatccaggaggccggcacggaggtggtcaaggctaaagccggagcaggtagagtctcaggcagccccggggctgggtgccagtgaggccctgcgagagctcagggttggggagaaatgctgcttgtccctgggcatggacgatccttttcagtgttgatttgcagttgcctggtggaaaatccctgtgtgagagggcagctcggcctgctttgtggggttgagagtcatttttgagggtggcagagtcaattctacaccattcatgtataagtaacaagaaatcggggtgctgactgaaattctccactgtcaggctggaaggtgtgcaggtgtcttggctggcggggccggctcacctgggcgtcacgtttgtggcaccagccaggctgacctgtctgtgcccccctaggctctgccaccctctccatggcgtatgccggcgcccgctttgtcttctcccttgtggatgcaatgaatggaaaggaaggtgttgtggaatgttccttcgttaagtcacaggaaacggaatgtacctacttctccacaccgctgctgcttggggtacgtatccaggcgtgggtccttctgactgtggaataagggggcgttccctttgcttaagcctcaggagctctccctggccctttatgcagtaagctcatgtgcctgcctggcgagtgctgttgttttcaagggtggacgcacacccgagaaaaaagagctgggaggatcacagactgtgaagggtgaacctcccagcaagtgggtctccttccctgcagtttgacagcgggtgcccagcagctgcaggagtattgactgataagacactccatctccaggcagcccagggaggcctccctaccccgcctgaacacctccctgtcgctccttgttcatcttgttctgactgcggggggcggccaggcccaattcctcttcgagagtgtgccccatccagacagcctgagtcttcagcaaacagaaacccttaggtcttactcataccccctcaagccgagtttccatttctcacctgtgggcagaaatgaggcagatgtgtggttgccttcatcacgtggccagaaagtaatatggctcactgggccaccccaggacctttctcagagatgctccgatacagaaagatccttcagctatggccccaggccttggtgagagacaggcactcgatggtatagttctgtccccatgtcggtgcaggtgtatggaatggcagggcctgcaggtgagacgcacccggttctcataggcccttgagccaggggaagcagtaggagggaattgagttgaggtgaggactgaggctgttgccacacaaactgtgctcagtttctgcaggtgagacggtggcagagatgcctgtttttgccaatgtcagacatttacctacttagtgacacctgattcaggtgactgtgacaatgttttcagtcctttaccaacctgcggggagagacaagaacccagaaacaggctctgttggggagaatacggtgaagtgttcctgatgattgagttcctggcgtccaggtgcttgtcgcattgtcctcgtgttcacgaaggtggatggtgcttgttttatagctaaggaaacacatttggaaggtcagtcattgtccagggtacctgcctagacaatcacagtgctgggacccctgcctggcaccctctggctctgagcctcgcactcctgaccgcagctcagtcccacccacctgctcagcaaggcgtccccagcaaggcacccagaacccgcatgtgtagagagactcctcggcagggctgatggagcgacaggtcggggtttctctaacaagcactttcctggaaacttcattttaacatgttcccatctccctcagaaaaagggcatcgagaagaacctgggcatcggcaaagtctcctcttttgaggagaagatgatctcggatgccatccccgagctgaaggcctccatcaagaagggggaagatttcgtgaagaccctgaagtgagccgctgtgacgggtggccagtttccttaatttatgaaggcatcatgtcactgcaaagccgttgcagataaactttgtattttaatttgctttggtgatgattactgtattgacatcatcatgccttccaaattgtgggtggctctgtgggcgcatcaataaaagccgtccttgattttatttttcaaggtcccttctgt

SEQ ID NO: 37126 - DNA, 26942 bp, Homo sapiens; identical to SEQ ID NO: 36970

SEQ ID NO: 37127 - DNA, 32783 bp, Homo sapiens
agcagtccccggtgtcggggcaggaggcacgcgcgcggctgaggcgaggtcgctcggcgcagctgttgcggggccatggcggggaccgcgctcaagaggctgatggccgagtacaaacgtgagtctggggacccgggccgtcagcagcgtcccgcgttcctgctcccgggcccgcgtcgtccggcggggctggggcagggagcctggcgggggagccgggcccggggcctccaccgtgagcccccctgtgggtcccgcggagtgccgcgccctgcgcccgctgcccactctcacgcgtgaagtcgtgaagagaagccttcccagcatcagtaaaggcagcgccggcgccgtgttagttgagagcacacacagttgagtctttgcgggcttgtttttttctcttctattttttcttttcttggcagccttgagaacgtgcagtgagagcttgaggaagaaggcctgacttgctgctgcggaattaggagggaaaagtgtatgcgttaaaaggggaaaggctcgttggtggagctttgaaaggtcagattttggctttccctctaatgaaggaaaagggtttttgaacagtgccacctgtcactcctcctaggtagtgttgaggaaacctcttgagtgctttcctacccggtaaattagatatttctaatgtctgaggagagcgaagggagaaatgagaacctaggaacactcggcattccatcgttttacaccgaatgcccgcttggaagaactgctgcgagaagtcttggaataccattgtgttgaaagcgccaggagcctgagtcgccgatggagacgagatagtagccggctaagagcagggcctgagttcagacccggcctctctgcttgttagctctttgaccttgttcctctctctgtctctgcagtttccttgtcttaaaaggttaaacttgatactgcaggtgaagtgcttagcaaaatacctgatgtgtaacccttaataaagttagctgctgcttttgtaattagattgaggataattttggaagaaagttaagctaaaagaatgaatgtgagaaaaaaaataagtggtgaatatacatgtagcttgatttcgtaaaactattggtgacaccgcccagtaagagttgatgtttggcttaagcagaccaaaacgttgcaaatacaggctcactcacgtatggtcattcttcccttggtatctggaggggattggttccaggccccgctgcagataccagaatcctcggatgctcaagtccctactataaggtggcgtggtatttgcatttaatgtatgcatagcctctcataacttttaaatcatctcaaggttacttatagtacctaatgcaatgtaagtgctgcacaaatagttacactgattttttttacttgtatttttaaatcgtcattttttattgttatttttttcaaatattttgtattcctggttggtcgaatccatggatatgcagccgcagatacacagggcctcctgtaaacgttcaaataacgctcgccacctagtgtctgctaaagcagaacataaaggcacacctcagtttcccgcgcgctttgctttattgagcttcacttcgcagatcttgcattttttacaagtttacaagttttttacaagcaaccctgcatggaagcaagtctgttggcaccatttttgctcgcttcgtgtctctctcttacattttaatctattactgtgatctatgatcagtaatctttgatgttactattgtaattattttggggcatcacaaactatgcccataaaagatggtagtcctaataaatgttgtgtgtgcttcactgactggctgtttccccatctctctcccggcctctctcttccctgagacaaaacaacattgaaattaggccaatagtaactgtacagtgggctcaagtgttgaagtgaagagttgcactctacccacttcaaatcaaaagctagaaatgattaagtttagtgaggaaggaatgttgaaagtcaagataggctgaaagctgggtctcttgttagccaagttgtgaatgcaaaggaaaagttcttaaaggaaattagaagtgctgctctgttgaacacaatgaatgataaagtgaaaaagccttactgctgatatggagaaagttttagtggtttggatagaagatcaaaccagccataacattcctttaagccaaagcctaatccagagcaaggtcctaactcttcagttttatgaaggctgagagcagtgaggaagctgcagaagaaaaattgggagctaacagaggttggttcatgagattgaagtaaataacctgtctccataacagaaaagcacaaggtgaagcagcaaggtctccagaagatctagctaagatcaagatgaaagtggctcctaaattaagcaatagatttacaaggtacgtaaaatagccttatacggtattgggaggagatgatgccatatacaacgtaaacagctagagagaagtcaatgactggcttcaaaggacagggcgactcttgttaggggctaatgtcggtcactttaagttgactgagttgaagccagttctcatttatcattcagaaaatcttagggcccttaaaaattatgctaaatctactctgagctctagagatggaaaaacaacctggatgacagcacatctgtgtacagcatggtttactgaatataagcccactgttgagacctactgctcagaaaaaaagattatcttcaaaatactattcctgacagtgcacctggtcactcaagagctctgatggagaggtataaggagataaatgtttttgtgcctgctaacacaacaccaattctgcagcccatggatccgggagcacttttgacttatttaagaaatacatttcataaggccatagctgccatgaaaagtgatttctttgatggatctgggcaaagaaaatcaaaagtcttctggaaaggatttatcattctagatggcattaagaacatctgtgattcatgggaggtcaccatatcaacaacaggcgtttgaaaaagttgatttcaatgctcatggatgactttaaggggaggaagcaactgcaggtgtggtagaaatggcaagggaactggaattagaggtggagcctgaagatgtcactcagttgctacaatctcatgatcaaacttgaacagatggggagttgagtcttacagatgagcaaagaagtgattcttgagatggaatctactcctggtgaaaatgctgtgaacattgttgaaatgacaaaagattgagactattccataaatttagttgataaagcagccgcagggtttgagggtattgactccagttttgactgaagttccactgtgggtaaagtgctgtcaaacaacatcacagactacagagcaatcttttgtgaaagtaagagtcagtccctgtggcaaacttaattgttgtcttattttcagaaactaccacagccactcctgccttcagcaactaccaccctgatcagtcagcagtcatcaatatccgggcaagactgcaccggcaaaaagattatgacctgctgaaggctcatatgattgttagcattttttagcaataaaaattaagcatattttggcaaataataattatttatttatttattttttgagacagggtcttgctctgtcacccaggttggagtgcagtggcacaaccacagctcattgcaagccttgacctgggctcaagctatcctttcacttaatccacctgagtagctgagactacaggcatgtgcccctacacctggctgatttttctgtcttcatcttgacctccctctatgttgtcagggtttggcgaaagtgactccattttgattctgacaatgttcatactcgaacagagggttggatgtgggggactattacttctgtgtcctcatgggaaacctggctggtgggtcagatgtgtgaacacctaccatttcttggtatcctggtttgtgtttgtgtctctgttttagttttattttagccctatttctagggttaggctagactgtgagcaggtattttctctttttttttttttttttttttttttttgagacggagttttgctctgtcgcccaggctggagtgcagtggcgcaatcttgactcactgcaggctccgcctcccgggttcatgccattctcctgcctcagcctcccgtgtagctgggactacaggcgcgcgccaccatgcccggctaatttttgtattgttagtagagacggggtttcaccgtgttagccaggatggtctcgatctcctgacctcgtgatccgccagcctcggcctcccaaagtgctgggattacaggcgtgagccaccacgcccggccttctcatttttattgagaagaaaatcattaaacccctgcataggaaattaagttcaggctgctgcttcaggccagtctttgcattgttgaacttgcattttctaaggatatttgcattagcaaagatatgttctcccttttattgtcctgacagaagcttcatctgttatttcaattatattgtcaattagtttgcagtaataagacctaaataatggttgatttccgaaggtttgtcacggaagtgtgttgtgtgtttttacatgttaacatgaaattttggactatgtgtagaaggtagaactctaaacatacctcactaagattcccatgcccttgttattcaagcactttctagtacttcggtggagggactttggagatgcaagtcaggttagtaatcagcagacctaaagagtgggagattattctggattaccgtgaaggatccaataataacataaggctcaaaagcagtcagtgaaggcaggatgggggtggtcagagagattcaacatatgacaagatctctaccttctgtggctggctgtgaagatggaagaaggagccatgacctaaggaaggcgggcagcctcaagaagctgagaatgatcccagaccaacagacccgtggaagtgaattctgtcagcaacctcaatgaacttggagtggcagccctggtgagactctgagcagagaactagctggcccatgctgtgtccagacttctgacgcttggaaactctgagatcatcaatgagtattgttttaaatcactaaatttgtggtaatttgttacagcagtgacagaagatgaatacagtgtgttattgaggggactttgtttttcctgtatcttaataatgtgataaaatttagtgggttttttttgtgtatcatttactggttttttttgtgtgtgtatcttaacatctagtttgtcctcataacgtattttaaggtagcacattccagtgtaaaggtggacttgacagaatcaatctctacatagaaggggtttagataaatttggttagatgttcatgcacactttattgtatttgggagtagtcatataactgcagaaattcagaggtggtgggaccttggctatgattctgttcaagccccctaattttacagattttatggaattgagcaacagacaagatgattttgcctaggttcataaacaggaaaaaaggagagccaggaaagaactcaattgttgtaaactgctgtcttgtcttgatgttctgtcttcattcatcatccagcctttcctaggagtgtcagagatagacccaggtagaagtgggctgcccatggggggcttagcacaacagaaatttattcttttactgttctggaggccagacatctaaaataaaggtgttgatggggtcattcttcctcttgagggctcgaggggagaacccttacttgcctcttccagctaatggtgattgttggtcatccttggcgtttattgtcattctcttgcttgaggtagtgtaattctaatctctgcctccatcttcgcatggccatcttccccctgtgtgcatgtcctaaatgtacatgtctttctgtggatatatgcttttatttctcctgtgtaaataaccagggttataatgggaagtgtgtgtttaatttttaaagaaacggccagttttcctctagttcacatttccctagcagtgtattaagtgttcccgttgccccacctccttgctgacacttcgcgtggccagttgttttttgttttcttttttctttctttctttctttttttttttgagacaggttctcactctgtcactcgggctagagtgcagtggtgtagtcatggctcatggcagcctctgcctcctaggctcaagcaatcctgccacctcagcctcccaagaagctgggattacagttgcatgccacctcgcttagctaatttttgtatttttagtagagatagggtttcgccatgttgcccaggcttgtctcgaactcgtgggcccaagcaatctgcccgtcttggccttccaaagtgttggaattacaactgcgagccactgcgcccttccagttttaaaaattttagccattctattgggtgtatagcagtcttactgaggttttgttttatttatttatttttttttattttttatttttgaggtgctctctctgtcatccaggctggagtgcagtggcatgatctcagctcactgcaacatctgcctcctggcttcaagtaattctcctgcctcagcttcccaagtagctggggctataggcgcgtgccaccacacctggctaatttttgtatttttagtagaaacgggatttcactatgttggctaggctggtctctaactcctgacctcaggagtttgcctcgcctcccaaagtgctgggatttacgggcatgagccacagcccccggcccttactgaggttttcatttgcatttccataagactcgtgatgttgagcatcatttcacgtgtttatttgccatccatatgtctttttagataaagtgacttgagtctttgcttctttcaaaattgtgttgattttcttaagttttagttctttggctgggcgcagtggctcacgcctgtaatcccagcactttgtgggctgaggtgggcggatcacgaggtcaggagatggagaccatccgggctaacacggtgaaaccccctctctactaaaaatacaaaaaattagctgggcatggtggcggacccctgtagtcccagctactcaggaggctgaggcaggagaatggcgtgaacttgggaggtggagcttgcagtgagccgagatcacgccactgcactccagcctgggtgacagagcgagactccgtctcaaaaaaaaaaaaaaacaaaaaaagaagggtttttattatttcgatgaaattcaattattgacttttaaaatatttcttgctattgtgttatatttaagaaataactgccaaacatcaggtggcagtaggattttctcctatgatttcttctagatgttttatagtttcagctcttgtatttaggtttgggatccatatcaaagttttccatatggtatgagataaaggccaaggtttatttgtaaattatttgtaaatggcagtgcagttgtttcagcactgtgtttgctagggctgctctaccacacaggctgggcacggcttaaacaacagaaatgtatttcctcatagtcctggaggctggaagtccaagatcaaggatagggcagggctggtttcttctgaggctctgtcctctatgcctgtgtcctcatctcttcttaaaaggatattagtcagattggattaaggtccaccctaatgaccacattaattttaattacctcttaaaggccctagtcacacacttttctccaccttcttttttttcatgtaatatgtcctgaagtttgttctgtactagcatgtagaggtatttatagctgcaaagtaccccactggtatatgtatcataatttgactggtcctctgttgatagacactcaagttctttttaatttctttttgtttttacaaatagtcctgaaatgaatagcctgtgtatacattttttatcttcaccaatgttatctgtgggatggattcctagaaatggaattgctgggtcaaaggttatatttcactttgtgtggtagctatttgttaagccactattttaagtggcaaggaatggcctctgaaaatttccctgataccaagattcgtctctttttttgaacttgtttcttatcagtaaacatgaaactgtatattattttgtgtacgcgtgtatatgctttggaagcaaaaaacaaaatggaaaaaataagtgccctgaaccattccctccagcctctgaactcatttgctgcacttctttattgaccagtagaggccactgttgaataacaaagctggcgggaaggccagcgcacacccgggcaggtctctgtgctgagcctgcattgccaggagcaggtctggagctgcagtttttagaccaccctttcccctccctaagggagggtgtcacgcaggggagtgccaaaggggaactccagatgaagaataaagccagctctctttggtacgagctcttcttcatggtcccacgaaggtgatttgtaaagcttttgtgtgttctgctgccaggcctctacttagttgcccactgacattgtgtttctcccgcaccccacctgcttagcagtttacagtctatctgccgtaatctgttatttttttcttataattaggcggtttggcttgagacacaagaatgggactagattttagatgactgggtgtaggaagcctagcaaattaggttctgtggttatttctcctgatctactccacatgaagagacacaaagggagaacatcagggtgtggcttgtgaaatccaaggtcttagtcggcttggtacttgacctcattcacattcagttcccacccacccctgaaatgtttaatgcacttggcccttggggccagcacttgcctttggcctgccttgctggcccctccttgccactctgccttctctcactgctgggtgtcagcacacccttgtgacagcacttaggtctcttcaggacctctgtttcctggatcagggcttctcagcaggtgttagtggtattttgagtgaaataatttttccttgggtaggccttgttctacccaaggttgtgggttcattaaacggttaatcggtacattagtccgttcttatactgccataaagatactacctgagactgggtaattataaaggaaagaggtttagttgactcacagttctgcataactgacgaggcctcaggaaacttatagtcatggcagaaagggaaacagacctcttctcaaggcggtaggagagagaagagcaagccaaggaagaacttgccacacacttatagaaccatcatgtctcctgagaactcgctatcacgagaacagcatgagggaaactgcccccatgatccagtcacctcctaccaggttcctcgctcaacactttggggattacaagtcaaggtgagattcgggtagggacacaaagccaaaccatgtcatttctccccctacccctcccaaatctcatgttcctttcaaaaccattccatttcaaaacaaatcatgccttcccagcaaggcccccaaagtcttaactcatttcgtcattaactcaaaagtccaagtccaaagtctcatctctgacaaggtaagtcccctctgcctagcagcctgtaaaatcaaaagcaagttagttactttcaagatacaatggaaatacaggcattggataaatactcccattaccaatggaagaaattggccaaaacaaagggctacaggcccccatgcaagtccgaaatccggctgggcagtcattaaatcttaaagctcaaaatggtctcctttgtgaccccgtgtctcacatccagggcacactgatacagggagtggctttcatggtcttgggcagctctgcccctgtggctttgtagggtacagccctcccacacccacccccttcagctactttcatggtgggcattgagtgtctttggcttttctaggtgcacagtgcaaagctcttggtggatctaccgttctggggtctggaggatggttgttctcttctcacagctccactaggcagtgccccagtggggactctgggagctccaaccccacatttcccttctgcaatgccctagcagatgttctccatgagggccctgcccctgcagcagatttctgtctggacatccaggcgtttccctacatcctctgaaatgtaggtgaaggttcccaaacgtcagttattgaattctttgcacccacaggcccaacaccacgtggaagctgccaaggcttggggtttgtactctctgaagcaacagcctgagctgtaccttggccctttttagccatggctggagctggaacagctgggacacagggcaccaagtaccaaggctgcacagagtagcagcggggctgggcctggcccacaaaaccatttttccctcctaggcctccctgcttgtgatgggaggggctgctgccaagatctctgacatgctctggagacatttaccccattgtcttggcgattaatatttggctccttgttacttatttgaatttctctccagaaaatgggtttttcttttttattgcaccgtcatgctgcgaagttttcaaacttttattccctgctttcttttaaacacgagttccaatttcagatcatctctctcaagttcaaagttccacagatctctagggcaggggcaaaatctcaccattctctttgttgaaacatagcaagggtgaccattgctccagttcccaagaagttcctcttctctttttcagaccacctcagcctgggcttcattgtccatgtcactatcagcattttggtcaaaagcattcagcaagtctctaggaagttccagactttcccacatcttccttcttctaagcccttcaaactgttccaacctctgcctactacccagttctgaagttgcttccacattttcaggttatctttatagcagtacccctggtaccaatttactgtattcatctgttttcacactcctataagaacttccctgagactggataatttataaaggaaagaggtttaattgactcacagttccacatggctagggaggcctcaggaaacttatcatgacagaagccgaaggggaagcaagcaccttcttcacaaggtggcaagaaagaagagtgaaggaggaactttcgaacacttataaaaccaccagatctcatgagaactcactgtcatgagaacagcatggaggaaattgcccccatgatccagtcaccttccactaggttcctccctcaacacctggagattacaattcaagatgaaatttgtgtggggacacaaagccaaaccatatcaatggacatttgggttgtttccagtttggggctattacgaatttagctactatgaacattcacacaaaagtctatggcaacataagacccagtagaattgctgggtcttagagtcaatatatatgtaattttagtggaaatggtcaaacttctttcccaaagggtaaccaaaccattttgcattcccatcagtggtgcatgagagatctacttgctaaacttgccagcactttaagtctttaattttggccattcttttgtgactaaagatactgataatgctgaagctattgagctgtatcttattgtggttttaatttgcattacccttatgattcacaatgttgagcattttctcatgtgcttattagccatctgttttagtcagttcaggctgctgtaaaaaaataccaaagaccagggagcttaaacaacaaacatttattgctcccaattctggaggctgggaagtctggtgagggctgtcttcctggtttgcagatgactgtcttctccttgtgcccttacatggccagaggcaaatctctcgtttcttcttataaaggcactaactccattcatgagagttctgccctcctgacctaatctcctcccaaaggtcccacctcccaataccacatacattaggattcaacataggaattttggggggacgcaagcgtttggaccacagcatcattcgtgttgactctgacagtggctcttttcaactctgcctccatttttcttcttacctattttgatttttatatgtggtgtgagatggggaaagtttgatttttttttgtcttagagatgagcatcattcatggaaaagactgccctttgcctctgggccatagctctgtgttccctcgagtcagggtctctgttggtacaggtatgcttctgggctttctcttgtgccccattgttcaatttaactttgagccagtgctacgttgccttaatttccatagctctgtaaggaaggcttggtaactcatagatgaagctttctgtttattctttttttttttttttttttttgagacagagtcttgctctgtcacccaggctggagtgcagtggcgcgatctcggctcactgcaacctccgcctcctgggttcaagtgatcctcctgcctcagcctcccaagtagctgggactacaggtgcatgccaccatgcccggctaatttttctatttttggtagagatgggatttcgccatgttggccaggctggtctcgaactcctgacctgaggtgatccacccgcctcggcctcccaaagtgctgggattacaggcgtgagccaccgcgcctggccctctgtttattctttttaaagatagtgtcttggctattctggattgtttgcatttttatatatcttttagaaagatatatatatgcctcatattcagcaactgtgccaaactcacttttactaattatctttagattcttttgggctttcctgtatatatggacatagcatctgtgaataatgagttttatttctttttcagtccttataccttatatttatttggcaaggatttattaattttctgtctcttcaaagaaccaccttttggtttcattgatttttttttttctgtatgtttgcttactgttttattaatttccccagtctcactctggttgcccactggactccagcctgggcaaccagagtgagaccctgtctcaaaactaagcaacaaagtaaccagcaggaacagtttggaaagacagtgtaccccttatgtttgcttttgcatttgtaaaaagaaaaagaaaaagaaaagtctatgttttgttggtataaagaactatttgggccggcgcggtggctcatgcctgtaatcccagcactttgggaggccgaggctggcggatcacgaggtcaggagatctagaccatcctggctaacacggtgaaaccccgtctctactaaaaatacaaaaaattagctgggcgtggtggtgggcgcctgtagtcccagctacttgggaggctgaggcaggtgaatggcatgaacctgggaggtggagcttgcagtgagctgagatcacaccactgcacttcagcctgggtgatagagtgagactccgtctcaaaaaaaaacaaaaaaaaaacaaaaaaactttgtgtagttgttatcagaaccgttattgtactaggtattcactttgggcaaacagaattttcacttgttaatatgcatattctatggtttataggcttatatattttgtaaaggtgttttgttaaaatgacaatgtaacatttattctgtttggtaatggttttacttattaattttatagaattaacactgaatcctccggaaggaattgtagcaggtaaggtaccaaagttaacttccttataatttacttttaattgccaaagttccttcaaagttaaaatgttgtgaaattttttctcaccctacaggccccatgaatgaagagaacttttttgaatgggaggcattgatcatgtaagttaattttaggtgtactagtttttagggctttgctggaagtcagatgtaagaatcacatcagcagtgtgactgtgtccaaaagcatcagctggaaaaaagactgagttctccagtaatgcccagctctcgtctaggctgctggtctgaaagcagagaacctgagcattgatccaaaagaaatgagtgtttccttagagccagtcaaaggtttagttataattatgtaatatatgtattatatatttgagagttttaaggtggtaattttggaatgttgtatgatcgtggttaaaataacctcaaatggcgtaggtggctttggcttccagaagtagccccttcaggtgtgaaattttgacgagaaaagggtcctcaaagatgtgtctgaccacaccaggcatgttagcgcagccttgcctgccctgcctttgggccaggacttctttttcttctcctttcctcccagttcgtatcttcgtgtgctgcatctcctttttctgttgccttgtctggacttgttggccttgtgttctttccgacccaagacatggcttagtaagtgagcagtgtggttctgggattcgtggcatttaacttagggtgacgttgcttggaaagagaaacacatggacccctgattttagagtgttctatggccttgactcactttgctttttcttctttctaccttagatgtgcaatttttggccattcttagtgtattttcagcaaagtgaggttaaataaaatttaggaagttgaaatttgtaatcagtctctgttttctttcttttctttttctttctttcttttttttttttgagatggagtttcgcccttgttgcccaggctggagtgcggtggcacaaccttggctcactgcaactcctgccccttgggttcaagcgattctcctgcctcagcctccctagtagctgggattacaggtacccaccaccgtgcctggctaatttttgtatttttagtagagacagggtttccccatgttggccaggctggtctcgaacttctgacctcaggtgttccgcctgccttggcctcccagagtgctgggataacaggtgtgagccaccgcgccaagcccagtctttgttatctcattagtgaggtcttttaatttgcagcaaggtcttgggttggattttgttgcattgagaagtgctctagagggcaaggaccggaaaagtgagggctgtgaaacaagtgtgggctctggcttgaagtgatcttaagcttcatgatgcttttggaattcgccagttgcttggatcacattaattcttaatgctctatgggttggtctgagaaacagattgcagctaagtgttgtctgtggaggttaaattgatatgaaaattagtattttggataaacaaaatgtttttaaaaaatcatcaaacgctattcagatggtacagcacgcctgccatttcctgatcatttgtaatatcctaattgcttgggcctatggcacatgttttttcggtgtctgaaggtttctggaatctgtgtttgtgtgtaatgtggcccccaaggcagttatgagatggatggcgagtcccacagtctgggctgtcctcattagtggactgtgcggctgtatacttgtatcggggcagctctttttatttctgtagaagcaggagatcatatacatgaactgatgtgtaacctgcttgtttcatgtgttaatgcaggcgcacctgcactcatgccagcggggcagcacgcctgctgcaggggcccagagtggcgggaggcctgtctgtgtgtagaggttgaaggcgcctgtcgtgtctgcagttatttgtggggtgttggctcctccgtaggcctatttggaagctcattaaaggaacagttgagccgtccagtgtggttttaaaaaaatgttcattgttaaaaatcgattagggtaactattaccaattttaaataaacagtgtaaaattaaaccaatattttgaaaacctgtcttaaaaagtaattagaactatttttaggtagagcacttctgtgtttgaacaaggctttttgcattagtttggaattcccctgcttgaagatcctagtgagtttgtgggttttggtcctgttccagacccttcacaaacaagaggccgtttacaagtgcacttaaaatgcctattagggaattaactgtcctcccatcgatttgtctcaccctgctattttggcagacatctggccaagtctttgctccttggtgataagtttcttctttttctctttattctttgatggcttccagggccgcctctctaccctagtatttctaaaacccgtgcttgcctcacagaagtcgaacggctgttggtttttgctgttgtgcttgccttaagggccagtgaagaaaatgtcattttagatatctaagcaacaaacactaagtgcctttgatatgttagggcccttgtctgaagatacagacatgtcaaagatgcactgaaatctttaccttggaagaccagggttgagggattaggatggagaatagaacagattagtgaatgagaggactaaataatgagagtccgcaggctgtgtctttaaacaccgggaataactctgctgaccctgccacgctcatggtggagtctgagcctgcaatcaaatcgagcgtggctgggatggcggcacaccaggggatgtggccaccgtggctgtgggtgctagcatggcctgctgctcttggcccagtcactttgcctctctttgacttatttggatcaaaacagagaggtttatcagcatcttctagacagatggttacaggtcttgcccagctctagggtccatggcccgtgaccccattgccactaagccacggtgacgggggtgtagctgcagagagggtgggtgccctctttcattgatgcacttatgtgggacagaaggagtcctagacagctgttcatccccagtggccggacaaggcgtggagtcccttggcgcttgctgtcctctgtgtcctgccccagcattcccaaatcagctggcttggtgaccttcttgtctggttcatgcctgactgctgtcacctccccagaccagtggttctagaggctgtggtgaaataagaaggaccttcctttactgaatggtgtgtttggggcccagttggtggatggatgctcccaggttctccagctggctcatggcagccagcttgagggctcccaggctgccgcggcttctaccaggagcccttctcacactgggggccagtgtccggggcacagcagcctccctttatgtccaggtttcttgttgactgaagactgtcacagggcatctcttggcagtattatgccttgctgaaataaacccgagataataaaataggtgtttataatttgtattgtatgtaatctcaccatagcattttcttcaacaaaagtgtcacaaagatccctatatgaagaagttattgccacattcattgcagtaataataataaaaaaggaaacatcactgttccacataatttatggagcatctatatagagtaatgccatgtagctgtaaaacagttcaggtggaattttcatcctggcatggaaagatgtacacaatataaatggaaaaggcggattctagaataataggtctggaaccgtctgtccgtccttccttcctctcctctcctccctcctctctctcttcctttctcccctcctttcttccctcccctcccctcccctccctttcttatggagacatggtctagctctgtcacccaggctgaagttcagtggcctggtcacagctcactgcagcctcaaactcccaggctcaaacaatcctcccacctcagccccacaagtagctgggaccacaggtgcacaccaccacgcccagctagtttttaaaatgctttgtagagatggggtcttgctctgtttcccaggctggtctcgaactcctggcctcaagcaatccttctgcctcagcctcccaaagtgctgggattacaggcaggatccaaggcacccagcctaaacagctttattgagataatttacatactgtaagttttacttgcattaagtataaaagttagtggttttagtaaatttctagagttttgtagtcatcaccacagtccagttttagaacatttccaaaaagattcttatgtctatgtgcagacagttcccattccaacccccaggcaatccctgctctttcctctgactatagatttgccttttctgacttttcctatgtgtggaatcatacactgtctaatcatctgtgcctggcttcttgtacttggcagaatgtatttgcagttcatccatgttataccatgtatcagcagctccttccttttccattccccagttgatggacatttgggcttcctactttttggctcttttgagcaatgctgctgtaaacacttgtcttgtcacactgtctgtgtggacatggagttcatttctctagaccagatatagaggtgtggaattgctggggtgtggagtaaatttgcgtttaatgttttaagaaactatcagactatcttcctagagtagctcaccattttgcattcccagcagcagtgtatgagcattccagtttctccacttccacaccaacactgctgttgtctgataacagctgttcttgtgggtgtaaagtggggtctccttacagatttgacttggatttccttgacgactaatgatgttgagcatctcttaatgggcttattggccgttcatgtatcttctttggtgaacttcagaacttttccccatttttatattcggttgttttcttgttgatggaacgttaagagtttttaaaatatattttgatacaagtccttcattagacataggatttttaaatattttcttccaatctgcaactctccattttgttttcttaatagagtcttttgaaactaaaaagttgttaattttgatgaagtgtgattttgcattttttttcttatatagagcatgcttttggtgttgtatataacccaaggttgcaaagattttctcttatgtttgcttgtagaagttttgtgttttttcacttttacatttaggcctttgatctattttgattgacttagtgtcatgtatggagttaggtgggagtctgtttcattcttttgtatgtggttatccagttgtctcagcaccatttgttgaaaagacagttctttccccattgcataattttggcacctttgtcaaaaatcagttgactataaatgcaaggatttatttttggactctgaattgcattccattgatctatgcctatccttaggccattactacactgtcttgattactggagcttcatggtaagttttaaaattgggaaatttaagtccgccaactttgttctttttcaagattgtttactaggccattgcatttccattacattttagggtcagcttgtcaatttctacaaaatgcctggtgggattttgattgagactacattgaatctttagataagtttgagggatattgccatcatatcagtactgagtgctctaatccatgaacatggactgtctctccatttatttaggtgttttaaaattctcagcaatgccatgatacatttgaatttttagaaatccagttttgtagattagagtatgtgaatttatacacacatagagaaaagctggaacaataaccaaacttaactctggttacctcaaggaggtgattttgggagggggagtgagggaggtatttgctttttattttatatacttctgtatttgaatattttccaacattcttttattttcctagttaaataaggtcaaagtttatgttgtaaaagtgattgtctatgttagaatatactataaagttcttataattgatgaacttatttagtacactttatagttcaaatatattagatttaaaaattttaagaaacatctatattgcaaaaaataattagggtatggctgtagatgccttttggacaggtttaactatgaaaataattatatggagcaaaagctatatttgcccctactatgatttcataaaatggaaatgttcccccttttcttccgagcagttcttagcattggttatctacctgagtatcgcctggggtgcttagaacaccacaaaacagaaaggaaacacaggggatctctgggtttaaaccagagccagggccctgctctgggggtgagggtcaaatatgtcatcctggtggagaccaagtgctggaggaaagtgcaggaaggcacttccccaaatcacggcttcttacagcctcgtcctcttgctacgagggtattgggatcagtttctatttaactcctcactgcctggcacagccacaagcacaacctggcatagcagagccagtgtcctagggcttttaaagtgcccagtgtgggggctgtgtgtgcagcccaccttggtcctgctgtcctgggcattagtggggtgggaacatcggcaagaagcttttgctgaactgcagagcagggactgaaggaaggagacgcacccaagctcagatgccgggagccctcatgcccttcctgctgggtgccctctgtcgattctgtagcgtaagggaggtgcttatccttcccccagagtggagggtgcccatgaagcagtttgcccttcccgtctccagctcagctggctccagcttttggagggccatcgtcccttagtcatccacttcaggttttaaatactgatggatgagtttgcattctctgtgattttaattctttatcacatgtgcgttggagacttcttgtctatgtgctgtgacaaacttgataaagagaacagcagcaaaagcagtcggctttcccaacacctgcgtgcagctgaagtggcgagcgcaccagttcctggaacaccgcttgccggcgaagctcagggcacccacttgccctgggtgctccataaggcactctgacctgcctgctgcttctcttatctagaaagtaaaaagtgttagaaaggcaatgcaaagaagaacaatctctcccttgagttgagtgtggaaagacagaagaggctgatcttcgcttttcactggcatataagtgacccacactgttgctgaggaatggtcacaactctggaggaggacagtgacaaggcagttgtcctttgtgaggagggagaattgctagtcaggagtaggccatgggtgttttcaatatttgcttttgtatctaattcacccacaagacagcaaaacagtctgagctgttgcaagcgtgcctcctgtgtagagtgcagggtcattatgatgcttaatctaatgcttgtccttagctcagctccgaaagagtttaggtcatgatttcaatcaataaggcagcataatttgcaggctttgaaaaatttacatttgctttggatatatttgtgtcctccttgttgttgtttcttttgaagattcccaggtgaggccatcttcggtgaaagagaagtgaggttgtctgggagtatggcaataaaacttgtccaaaaacagcactgtggcgtctcccactcctggctcgggagttgcctggaaggcatgttccatggggtcaggcatgctgctgcacaccactgcccatctgccctcctgtctgggcgccaggcgttctagaaaagagaaagaaatcccagtttcaaaccagtagtaaaccggagcatttgcaaataactttgatatttaagatgtgggcgcacttcaggaaatgtttggtcatgcttctgaggctaggaacgacctggtggattaaaaaaaattttttttaaagaaagccctattatgagaaacaaagaactgttatcaaagtattgagcaaataccatttggctcattccaaaaacactacccagacattttttcttattctggactcagaggtgccagaaatattgagtgctggcaagcattcctgacatatgaacagtgttacttttaaagatagtatctttatgtgcctgacttctgatttcgcagtttgaactgtgttctcttaactctaatactaaattgatctaggaccttgactaagtcatttcatccttggattttccagccttgcttgacagtaaaatgaaaaccacaatccttggtgccctttcatcagagggcgtgtggagaatgaatgggtggtggttatcgtttgctctgagctcttgtactggacaggaggctcggggtggccacgcctcactctgatacatggtgtgtgcccaccctgtgttgagaaggcggggcttcaggaatgtgtttgttcaggccattgcagggggagcagagtaacccaggcttgaggcgtccccaggctgccgggcgctgggtgccagtgtgggccggggggggtactcatccgggcactgtcctctccagcgcggctgttgtaccagtagcaagagctcatgctcgtgcctccctcggtggcgttccctgtgctggtcatgctgaggctctggggactgtcacacagtaccccccccccaccccagctccccaaaacaaagtggccatattcgctatcttcttctgaaaaggtagcaaagacagttttcagaatcaaaatttgtcttttagattgaaaaatcttgtctccatgaagcaatcactgctttgttctcttctgactgttgcccgcagatcagccctgctagggccatgagccgtgctggcatctgctgttgctgccgacagccctgagtgccgcctccaggtgaaagctaaagctcttcgttcagtttctttttgatttttgtctttttcctttaattatagagataaatatttccaagtctgttgttattaatttcactgaaccaagataattttaagatttttaaaacaaatttttacttttaagaaatctattttttaactgaagatttaaaacgtatatttttttaaattatttttttcctgtgccatatcctggattctttctgaaggcagtaggtctggtgtggactgtcctctgctcatccaggcctcggcccctgcacgactgttctttctgccttagcctttgttgttagaggagcagagctgtttaggaagggacttgttctttcagttcgtagacggagaacgggtttactgacctatttattgatctgatgagtcacacccagtgcaacttccactgtttcgttgtctgccgctgtcattcagcagtcctgcttccttatcaaagaaagatggtgcaagatcttttagaactcctccaatgtgtgttttattaatgtgatttgtaggagaagaggagttcgtccctggtgtgaaggtacaggcatagtggctgacactcttcctctcctgtggccatcatgccttgaactgttggtcaagatagtgttaatttatacttgttgggttttaaaccttaagcaggatttctgaaatggtttcatctatttcttccatttacacgtgaggaaagtataggtccagggagactcagtgcctgtgtctgtgcccatgacggggagttgctccaatgttgcatcagtgggatgaggcacagcacatgggcctgcaggtgcagcctggagtggtggtgcctgtgtgcctagcctttcaccgagcatgcagcagtgatcacatgtgctcttcatctgcttcttgaaggttgcaaagatgccttcttgggcacgtttaaaaattaaaaatcacctttgaaatacaactcttagccccacatctgttgaaatacaatgtaatcttgctataccctgtgccgtaattcatacccttatcctaaaatgtgattgtaccacatctgcagaaaaaactcccagatcttagagcattgacattagttcttttctctgatctccttcttatcaagaggttctgctgcttgactcttaaccttcataaatgtgaaaactgcctggaattcagtctttgtacttgtacctaagatttagaccagattgaaactggagaatgggacattgctttccactgaaaagaaagtaccaattcattgttacttagataatctttttgtgtgcatttttattatttatttttatttttgtttattttttgagacggagtcacgctctgtcgcccaggcttgagtgcggtggcgagatcttggctcactgcaacctccacctcccaggctcagacgattctcctgcctcagcctcccaagtagctgggattacagtcatgcgccaccacacccagccaatttttgtatttttagtagagacagggtttcaccatgttgcccaggctggtcttgaactcctgacctcagatgatctgcctgtctcggccttccaaagtgctgggattacaggcgtgagccaccgcacccggcctcacgtgcatttttaaagtggtaaaaatgttcttaacccatttgtcaattgtggtcgacgttgaaaaatgtactttgaagttcagtctacgtattttatatcttctaggggcccagaagacacctgctttgagtttggtgtttttcctgccatcctgagtttcccacttgattacccgttaagtcccccaaagatgagatttacctgtgagatgtttcatcccaacagtaagtgcttttggaagtagtttttgtggtaccaggataggtacggagataatattatcagccacctgaaatgtggtatattctatatgtctatgatgtagatctttagaaaacacttcttatgttttgaaattcagccaagtaagcatggtggtattaagcacatgatttcaattttgaaggtcagtttaatatagataaaagacaacaggcacctaaaaccggatgccatttgacccagccaccctacttcactggggaggaagttttacacatgggtgtgtgctcagaaggggttatgctaatctttgtcatagtgttatttgtaatggtgaaaattttgacttaacctgggtttttaacacaagaataaattaagttatatattgtattagtctgttgtcacgctgctaataaagacatattcaagtctgggtaatttataaaggaaagagatttaatggactcacagttccacatggctggggagacctcacaatcatggcagaaggcaaaggagaagcaaaggcacatcttagtggcggcaggcaagagagtgtgtgcaggggaactgccctttacggaaccatcagatctcgtgagacttgtacactatcacgagaacagcacgggaaagatgtgcctccatgattcagtacttcccactgggtccctcccatgacatgtgggaattatgggagctacaattcaagatgagatttgggtggggacacacccaaactatatcatatatgttagaatgtgatgtagattttttaaatgatctaaaagaagaatcaatgatacaaagtagtatttgtgttatattgactgggaaaagcagtagcactgttataatttcctcttgaaaaagaaattcacatgtaaatgtatatataactggaaaagtaagcacaaaaatgttaaaagtgattcttttttcagattgaaattttttttcctttttgtaaatctttttttgccctaaaattaatatatattaattttaaaaggaggaaaaaaataaggtcatttaagtgaattgtactgtagcttatttgaaaatgtgtccagtagtaggaattggaatttctgaacagctgtagtttttattttttccttttacattcttccttttacatctttgccataggggttttcaggactacccccccacccccggccacttcactggtggaaatgccgtctgccaatagacttgctgtcctaaccctcgtttaggacttctcatttactgcagatattggtacacataggtagtgggcggctgcctgagagagaccatttggtacttcttttcttatctcaaagctgcttcagtcttgtgtgcacaggggatgctcagaagcgtgccttctttcagggagactggccatgcgcctgagttagatgataacatggaggttcatcacacgctgtctacttgagtgtgtttttggaattctccataataaaaagttaaaaaatacaattgataggtaagagtaattgaagtagtttcaaattggttagctataaaatgcaactatgaagaggattgtaggtaattaaaatactaagattgtattgaggagaaatatattattcagaacaatacctgtgacatggcattagtgacaaatatgaccaataaactgattaccttatgtgactatgtactacaggtggtctgattattatttttaatgttctggtaattatttttaatgctcagataatataaatttttgccttactgtaattggattattttgattttttaaaaattatctttgagaactataggtctaccaatatcataaaaactagtcaataaatactttaaaaacaattcaacacacgtactgaaagttgctggtatacagtggtgagcaaataatagcagaccttcaggagcttatattccaaggacagggatggacattgataggagaatcacacaaacaaaatgcaaagtcacatcaggaagttctgggcagcaccttgcagaggtggtggttggatggaccatctgtagggagtgaagcaggagttacctgagtgattcggggaggaggggcccttcacatgtgcaaaggcccagcgcaggaagtgacgggagaggaaggccggggccaaactacctcaggccttttggtcaatactgaaggttttgatgttttctcctgggagtggcggaactccattgaaagactccaagggagtggcatgaccagaatgatctctgacggctcgctctgggtacagtgcaaaggacaggtgggaggaagccaggcaggccctcggctgtagtggtctagggtagagacaccggcaacttgggaactaaatgtgggcactaaagataaagagatgtgtgtggatccacgagaggtttaggacatggcactgctgggacttggtgaaggaggggctgtggcagggacacaggtgcttttgatgcttctgtggatgcagtgtcaccctatgggaccaactcctggagaaggcaacacagaagtgggaaacttcctgattttgtggatgtggatcttaggtggacagcctgatgtccagggcaagtatgcatctagtttcttccactctccttgaatgagaagttgtggttcagttcctggatagtagagcgttcaccactgaacgttcaccactgaaacaatggatgagtggaaacacataggaccaggtatgaaagacaagactgtttgaaggtaagtgatcgccattcacatttgtgaattttcatgaaattcagagcttattaactcaggtgagttaaataaatgtattttaaaattgctatttctattattataactttaatggctttataattttacagttgagtctatctagatggattactgcatatctgagtatatatggagccatctgagaattcctcccaattttatgtaaaagaggactgattaaatgctgtgaattgaaaatttatttctctttatcagaccttgtgtatctttttaatgatgatatttggtggaaagggatttgatttagacacattgacctacattccaggttgtactgatgataatttacttattattagagtaagctaccaagagaaatcctggtgcctttctttttgtagatatttacataattccagttgcctttatcatagccatgtgaacatatattttacacagaccggttcagggatttaatgatagaattagaaatagctaaggaactagctctgaaaagtattgtaaataatcctaatcacattagatattttgataaaatatttgccagataacctttcatttagtctttttgtatatattgcttgaaaaaaattcatatgaaagtggattagactacgacagctgattagaactggctgggtcagcctggagcctgtcagtgagtgagcaggccccaccgggattcctgcagacatgaagcgtgacactcagggccccaggctatgccccagctgtgcaaacagcttggttgctgtgtctgcagtctttgttctcattatctgtggagcctgcccaagcgcggcgatgcctcgggcaccattcctgggctcacttggctgcctctgacccttgcagtctaccctgatgggagagtctgcatttccatcctccacgcgccaggcgatgaccccatgggctacgagagcagcgcggagcggtggagtcctgtgcagagtgtggagaagatcctgctgtcggtggtgagcatgctggcaggtaaggcccgagcctcctggcaggagctgccgtggacacccaggctgcaggtgttctccagccttgcgtcatcctgtctttagaatgtccttttcctcatttgcagttagtttacacatgctattgccatttaatgttatctgcctacacttttccaattgtaagcataccttctagcatagcctggggttgtatattgtattgtcggccataattaactggtctctggtccttgatcgtctttttccctcagtaggtgtttattgaggacccactacatgccacacactggactgggggtgtaaagcttcgtgtgacaaagaccccaactctttgttcctacgttctagggaactgtccaagcctaccagcagttagaggccagtgggatgcaccctaagatcagacacatgcagggactctcgggccacttcctggtggggctgtctggggtgtgtttaggacatgtaggtgttgatgaggtaggagggagggaatggggttttggggcaaaggaagcagcctgggctgaggcccagaggcaggaggtggctgacttgatgggggcactgccagctcattttggctggagccaaggctgcagggagaggagccccagcagaccctggggattggagttgggggtgtgatgtcctgtgagctgtgccttcgaagggccatccttgcagcagtaaccaatagtgtgatggaagacaaacagagacatcgtggtgttgcagtagcctggagagaaaagagaagggctgagtggtcccagggctaagaggaaggggtgggtttgggagaccttgaaggtacaggctctgggactcctggttctttgtctaccagaggtgctgctctgggttcaggagacagcaggatttggggaatagtttgaggtgtgtgggacaaggggcctccatccacaaaagggggtcagacacgagagtgaagatgtggggtcatttctggatgaggcagtaggtgatggagtaggacggagggtgacagcatagcagggaggggtcttccagggcagtcaggaggaagggtgtgggaaaggaaggcggcaagtccgaaaggaaagagcagacccagcagagggccaggggtcgatgccagagtgaggccactcagctattctctgcagagcctttgggtgccgtggagtggggtctagagggatgtgaggtcagggcctgtgacgcgagtgtgtatcctgagagggctgaggcgtgaaccctcttcatgtgctgagtggagggagccaggccaggggattggagattgggagggaggcagtggctcaggctgtcctcagatgtcagctgtgggttttatcctcatcaactctgctctgaaccggtccccacgtgcattctgagcagcgccaccgccgcactgcacagctgctgcctcagcacatgtcatccagttctggtggtctctctccgttctgccttccggcaggccctggctactccctccgtgcctcctaactgcagttctgcagtgactgccagtgccgctggctagggggtgggtcaggtatcctggggtcaggtgtctaccttaggctgcacatttgcttgggattgtcttggtaggagctgtgaggggcagttttgctgagagggcgctctgtgagagagaagccacactgcagagtgtcttgagaaaggtgaaataagcagcaggtggtccccgtgtagcttgtccgggtgccagaagtgcagtggcccaggaggctgctgtgggaggccgtgtgggcctgtgcttaggtggttgtcgcatgttccacagcaagacagatgacaacttgtcctggtgtcttcagacactcagaacgcaggagtcatgagagtggctttcgttgagacctgcgtggccagcactctagaggtggggccgaccccatgcagttctcaggttctttgtttctgggacacagctcttgaaagcccccgccagtgttttaaataaatgggagaccttgccaggctgcttacgtataagactcccttttacatggagggtgttcccttttctttcagagcccaatgacgaaagtggagctaacgtggatgcgtccaaaatgtggcgcgatgaccgggagcagttctataagattgccaagcagatcgtccagaagtctctgggactgtgagacctggcctcgcacaggcgcgcacacaccgccaagcagctcagcattctcccccggcacacttagtgacagtgatgctctgtgctggtaccaaacaaggcagacttgcaagaaccatggcatcttttttttttttcaaacctttcctacttcaaacaggcttctcttctgaaatgatgacttaatgtcgaatattgacagcttactgcagttttacagtattcctcacaaagggcttcaggtagattatcagagctgtcagcactacctctccccgctgaaaccagcagttcatggcttcctgtggattccctccctccctggagtgttgagggggttgtacctgccagacttccaggggacgatggaatacccagaacgctccttctgaagaaatggggccctgtagctgcagcacaggggaagggcccggcaccctttctgggtccttcctggttccctgtgggccccatgaggagtccattacttcctttcttccttcatattttacaggcagatgcttttcttataatctaattacatcttttcatttgttatatattacaaaccatcacacttagaaatacttccaggaaatgcttttttgaagtgtgaattaataagaaatggggtaaatagaaaagaaatttattgctgattggccaggtgcggtggttcgtgcctgtaatcccagctctttgggaggccaaggcaggtagatcacaaggtcaggaaattgagaccatcctggctaatacagtgaaaccccatgtctgctaaaattacaaaaaattagctgggcgtggtggtgcacgcctgtagtctcagctactcaggaggctgaggcaggagaatcgcttgaacccgggaggcagaggtagcagtgagctgaagtcccgccactgcactccagcctgggcaacagagcgagactcagtctcaaaaagaaaaaagaaatttattgctgatcacaaggacagacagttttttcccgaccatactcatcaaagatttacgtttgtatattagtaactagtgcattactagagcaggtgcaggtgaggtctttaaagtttcaatgaaagtttcttctggatctacagaaaaaatttttttttttcaatctaaaaactggaaattctagggtttttgtacattttggatgcactgggaatttattagcacaaaatcattctttgcaactcaaaattcagaagggactctaccatatcttagctcagagcacagaggagtgccttatccccacacttgactgggctgtggaggtgggcatgtgggcccctgggcccaggctggggacagagcccttgttttgtgacttaggattttgatgtggttcccatgttctctaacagggccagctgagcagcacaggccaggaggccacagtgtaagcaataacagatctgccacatgcagaagcaaatatcaggcctgtcgcacacgggcggcatttaaataggaatttctatttttgaaataagggatggtctatgaggcatacagtagatttgatgtgatccttttctccctcccttccataatggatcgtggtctgtgtgactgaacccacacagagtgtcatgggtgacagtttctggttgaagtagctccacgcctggcttctgtggacagcagattcttttccttctcacaaggggctcatttaaaatttggaggctgggtgctgtggctcacgcctgcaatcccagcactttgggagactgaggcgggcggatcatgaggtcaggagatcgcgaccatcctggctaacagtgaaaccctgtctccactaaaaatacaaaaaattagccgggcgtggtggcgggcgcctgtagtcccagctactctgaagactgaggcaggagaatggcgtgaacccaggaggcggagcttgcagtgagctgagatcacgccactgcactccagcctgggcaacagagtgagactctgtctcaaaaaaaaaaaaaaaaaaaatggaacgcagggcaagaactcgtatttggaaggagatgggggaaaggagcggtattatacctatgttgtatttgcaggcaaatgagatggagccctctctgtaaagaagagtcatttgtgcaagtagacggggtctgtgggtgcaggccctggaggggcacacaattgcctggaggcttctgtgagatcgggagagggaggagaggcagtctcttgacaaaataaagtatttttattcatttgtatttattaaatgaaaaaacaatcccatggtgtccctgttgtgtggtggaacctaatgactgttgaaataaagttctgtgttttccctgccctgc

SEQ ID NO: 37128 - DNA, 32783 bp, Homo sapiens; identical to SEQ ID NO: 37127

SEQ ID NO: 37129 - DNA, 13664 bp, Homo sapiens; identical to SEQ ID NO: 36925

SEQ ID NO: 37130 - DNA, 62329 bp, Homo sapiens
gctttggccagagtggtttgatggttttgtgttagtcttcctgcagctgagcttccacaagacactttttccctttcagccacccaatatctcgcgagacttgctattctgcgccccctcccaccttgcgcttgcgcagatcttcaaagcagaaggtcgcgcttggaggaagtggcggctttgagtccggtggcccaatcgctgttactacttctctgaagctcctctcggctgcttgccgagacaccctgccgccaagatgcctcgaattatgatcaaggggggcgtatggaggaataccgaggtaagtctccttttcccgccgtccgctgcccgccgctccctctagcagcttgtgcgcacgcgcgcggaggtcgggggggcgacgaggagaccctgtggggtctgcgtggagggcagcccgggggctgacccttggggccctttccgtgtgtctggccccgtgttgtgcgagcgccagtaggacagggaccgtgatgtcaccacctggctactcggctccaagctcacttgttaggccctgagtgaacatttgttgacttgaatacgccccctcccaccccgcccccccgccccccccggccccgggaagaactcagagttccaactcagccagagttggtcccccggggcaccatccactcttagtccaggcaccacgactctgtctcatactcagaaataaagaagttgccgtggccacaactttgtgtctccattgacttccttgcagaggggaagcagtttgagtgccaggttcagagagcccgtttatgcccgcatctctctggttatctgttatcagggcataacctgtctgccatctcgacagatcccaaggtctgtctctttctgtcactgcctttgcctagatagaagccagaaaggaaaaactggcctaggatagtctctgtttccagaaacgtagtggatagtgccattggtgagccaaagggcagtagagtgggagtgaaatagaaattagattttagtgcgttttgtgttcagagtgtaccgaatttatcagtttctggagcacatcatgtcttttcatgctctgtgtctttttttcgttacattttatggcttctttttttttttttttttacatcttttgccttcctagcgcttgacatctttctgatcatccttcaaacctagttcggaaacacttcttggaatctctgtaagaattaattgcacccccgatattctcatgatacctttttcttccgtttgttaaaacttgctttgtctttttgtaagcatcacatcctctgtgtggtactcggtaagtttcttaacttctgaaagcctcagttttctactttttctaaattgggataataatacttaacctctcttgaggattacacgagttaatacgtttggaatatttagatcagagtagggcacatagtagcctctgagtaagagctagttgctctttcacctcaccagacagcatggcgagaggaccaggtcttggtatccctaggacctaggacagtaaccaacatgaagtaggttgctcgacaggtatttgcagaatgaatcaagtagagtaggtatctgctgtatctatttaattgaaaatgtgtttaagtgtagttgtactgcaaccaagttacaaaaaagacaatgaaaactgcctcagcttccaccgagggaaccagactgtttaaattggagaagagatgacttctgagggagagacagatataaaatcaagtaacagtaggattcctatgcagtggtcaaagctctgcagtctttttaaaaagtatctttgatcatgggagatgtagaggatggagtggggtatctcaagaggcacgtacctcaaatccaatgtgggaaaaaaagcctagaagtaaaatcgcctaagtgcatgcatctatggctccattaactttcttgtctttggcttggcttgccaggcttccttgaggttggtgcattccacatggcaatgggtgccctggtgaaatggtatctagagatggggggaaattggaaggagagctgactagtggggttggggtagaaatatgtaattcttaggttagacctgagatgtggattcttgggtcatagttggggttaaggggctggaggggaaatgccatgtataaacttgagacaggaggcttggattggagaatatattcaccagagtcccaacttgcttcttgaggcctggatatgtcctgtttgataagacctttccccaagggaaaggtagatgtttcaaggtagatgttcaggaagtgttttttgagtgagtgtataaatgaatgagttatacatttttgttgttgttgtgttttttagttatcctttttgaagagaaggacagccacacgttgaagaatactttttcttaatttttgtcataaagtagggtttctcagattgggctgttcccactcccaatttattggagagtgtggtgtaagggtgggtagctgtctttctaagggatttcttcttaatttctcaattcttggttgctgttattatagttaatgaggttttcatccttagtcttttaacctaggtggtgtgtatgtgcatgttatatgtctctttctccaatagccctatcagagttaatttaaattttgtcttttcccacttggagttttgtgactgaatgtactctttggcaattttttttaggatgaaattctgaaagcagcggtaatgaaatatgggaaaaatcagtggtctaggattgcctcattgctgcatagaaaatcagcaaagcagtgcaaagccagatggtatgtatcagtttaataagtggaaaacagaaaaggagcttaattatgatgatggaaaatgtcaactctgtgaaccttatcaaagaaagcagacattgtaatataacaaggcatggagtgggagatggaagttgggtgtttgacttagctgtcacttgcttcctgtgtggtcttaggcaagccatttttctatccctctcccctgcccttgttttctcccaattagggataataatacttggtcctgactgatagagatgtgagttgtcatctaaatgggttaatgtatttgagagtgctttgtgaagcatacaaagtctactttcagggacagatgagccccagcttgtaaattaattgtgttctaaaagtgcataagttagctgttttagaaattacttgctcaaagaaataaatgataaataatggctaattttctaagtaagcctacagtagttgagtttcctcataatacagttgaaatattatatattttatagttaatatgttatatattatatattaaacatacttaatgttatatattatatattaaacatatttaatatgttatatattatatattaaacatatttaatatgttatatattatatattaaacatatttaatatgttatatattatatattaaacatatttaatatgttatatattatatattaaacatatttaatatgttatatattatatattaaacatttaatatgttatatattatatattaaacatatttaatatgttatatattatatattaaacatatttaatatgttatatattgtatatattaaacatatttaatatgttatatatattaaaagatataagccaactctgaacctgtggtgtcacctcttttttatttttattttttgggacggagtcttgctctgtcgcccaggctggagtgcagtggcgtgatctcagctcactgcaagctttgcctcccgggttcacgccattcttctgccatagcctcctgagtagctgggactacaggctcctgccaccattcccggctaattttttgtatttttagtagagacggagtttcgccgtgttagccaggatggtcttgatctcctgacctcgtgatccatccacctcggcctcccagagtgctgggattacaggcgtgagccaccgcgcccggctggtgtcacctcttaaatcatagggtagtggacacgtgaagctatttagggtgttcttggcatgagttatttagcaccatccccaagtcatgtggcattaggaaaatactttggattgtataagaatgacctaatttcctaggcacctggttaggggaaagtatcagaatgtagaaattggccaggcgtggtggctcacatctgtaagcctagcacttcgggaggccaaggctgggatcacctgaggtcaggagtttgagaccagcctggccaacatggtgaaaaccccgtctcttctaaaagtacaaaaattagccaggcgtggtggctacttgggaggctgaggtgggaggatcggttgaacccaggaggtggaggttgtagtgagctgagatgctgccactgcactccagcctgggcgacagagtgaggctttttgaatgtagaaattggctgttaagaggaagatgatttttaggctgaagaagtcgttctgatttctgtttgtcttagtggtaccagttcctgctgtcatatttggtaggacttaagtcctgtttgcctgcctgtcatccagctaagtagactggatggaaaaggtgggctgggtggggaattaggaaagacagagggaatgtcatagtagttttacttaaattttaaaacatatcaaatgaaaggttacggtgaatttagtgagtgtaagtcaaatgcttaaagaaataagccatggtgtgagaatcaaagcatgagaaaatagtatgaaaactggaaacactgtaagaaacgtgattttgtattgtcttccaaatatttcaaaatttctagaaaagcgtaaataaataaaaacatgatagatgagaaagaaggcttatgatcatgattcagtgaagtaaccttttttaaccattactaatcttgcataattaaaataaaatagaatgtgatgagatggggaatattgactggggtaagtgtaaccacacagcaaatattctgttgtcaaaaagaacagtttttgtaattgaaggatgagagcacaagtcagtgtatccattgtgcaaattggatatttatgccaggtaactgattaatatataaaatgatctatgtttaataggtatgaatggctggatccaagcattaagaagacagaatggtccagagaagaagaggaaaaactcttgcacttggccaagttgatgccaactcagtggaggaccattgctccaatcattggaagaacagcggcccagtgcttagaacactatgaatttcttctgtaagtgagtcttcagaaagagcatagaatatatgtatatgttctgaaagaggctgaataaactttgagtattttctgtctttaaacttttaattatggatgtgagtaaacccaaagctaaagccattggataatattttccatatctcagatggttgatcaaaattatgccttctgtcatatacttcctaaaataataatttaaaagaattatacaagtcatgcatgttcatcatagaaaatctggggaaaaaatagtaaaagagcaaataaaagtcacccataatcacactgctaagaattaactactggaacattttggttctttactaatagtttttttttttttttttttttttttaaatttgtatggctgtaccgcatttgtgattaggatctgtttgggttctattttagagtgattgaaaccagtcactgaaatcagcaaattttaatatcatttctttcagatgaagtgatagtaaaaaggctttatgttgttaaagcccatccattggtttttttggggggaaaaatatcgtcagaacttggaaatctggtaattttaactctaaatggtactgtagtgtgactaactcctatgggcttttttctagggataaagctgcccaaagagacaatgaagaggaaacaacagatgatccacgaaaacttaaacctggagaaatagatccaaatccagaaacaaaaccagcgcggcctgatccaattgatatggatgagggtaagtgtatgctttgaggaatttatttctttggtaactgtaaactccttgggcctcactcttttagttcctttctgaactcctctactttagaatcccttttttttttgagacaaggtcttgctctgttacccaggctggaatgaagtggcacaatcatggttcactgcggttttgacctcctgggcttaagcaatcctcccatctcagcctcctgagtagttgggactacaggtttatgccgccatacctggctaatttttaaatttttttgtagagatggggtctccctgtgttacccaggctggtctcaaactcctgggcttaagctatcctcccttttctgcctccaaaagtgttgagattataggtgtgagccaccatacctgatccccaattctgtcagcagtgttcttattctaagtatctttccaaatatgtccagtgttttctgttatagagtagttgctttttctgaacagcgccccttcatcttctgtttcttcaattcagttaattaagttaattaagtgttacggggtgtggtggtatgtgcctgtagtgctagctgctaaggaagttgaggtgggtcgatctctttagcccaggagttggaggccagtctgggcaacataaccccttgagcccagaagttggaggccagcctgggcagcataacgagaccctgtctttaaaactgagtagtgtaattctactgagtagatttttcagaggctagaggtgagcccttgaagatcctgtttctcattcctattccatggagagagacatcaagtcagaatattggacctcagtcctcctattaattacttatttgactataggcaagttatttattctgtgtgagaaggcaacctgtgagacggtgatggagacttaacagtgattctgggaggcattgaatcaggaattccacaatagaaagtatatggaatcaacctaagtgtccattaatgggtgaatggataaagaaaatgtggactgggcatggtggctcacgcctgtaatcccagcacgttgggaggctgaggtgggcagatcacttgagcccaggagttcaagatcagcctggccaacatggtgaaaccctgcctctataaaaaaatacaaaaattagccaggtgtggtggcgcatgcctgtagatccagctactggggaggctgaggtgggagaatcacttgagcccgggaggctgggtttgccatgagctgagatcaagcactgcactccagcctgggcaacagagcaggaccctgtctcaaaaaaaaaaaaaaaaaaaaaaaaaaaaaatggtatacacacacacacacacacacacacacacgaatactatttggtcataaaaagcaatgaaatcatgtcatttgcagcaacatggatggcagtagaagtcattatgttcagtgaaataagccaggcacagagagacaaatactgcatattcttcctcatatgtgggagctaaaagcgttgatctcatggagttagaatagagtgatagatgccagaggctgggtatggtgtgtgggtgggagagcgggattaagagaggttggttaatgggtacaaacgtagatggaaagaaataagttataatgtttgatagcagaatagggtgactatagttagcaacagtgtattacatatttcaaagtagctggaagagaggtctgaaataaatactcaaggtgatgggtaccccagatatactgacttgatcattacacattctatgcatgtaacaaactctcacatgtaccctataaatatgtaaagtatgatgtatcagttaacagaatcaggaattggattttcaacccgtgtgtgccacctattagctgtttgaccttagacaagtcataaaatctctctgagctttgattccctttcttgcgagatggggaatactaatacctgctttaccttagcagggttgttgtgaagcactcagtgaatatttgttaagtttctaaaatgtaaagtttgaacatagtggttcccaaaggcaggctgtggctaggctggctgcatcattatcacagggggagcatttaaaaatagaaatatcagggcttctcctgtatatactgagtcagtacatctggggtggtgtgggaggcacgggaagagcagtgatcttggaatctgagtattttacaagttcccatgtgatttagttggacagccttgcataggaattgttctaaggcatcaatagtggcatgtattattccattctatagagccacgaaaaatgtattggatgagagaaattgttctgaggggaaaaaaaagtatctaatgatagttgttctctcataattaaatagtttttaccctatttcacaatttgtgctgtgccagttagttgataataatgaaggatacaataattgtagccactgtttaatgaatgcttgcgagatgctttacatatttcgttttacttagcccttctcaaaatccttgtgaaataggaattgttattcgaattttatagggaaaccatgcttagggagggtaagtaagtgactaaggtcacatagctagcaagtggtgggcctggtttttaacctaggttctttgacttcaaaactcaagctgtttccattatgctacaccataaaatcagtatttttatgtttttttctcattttgagcaatagagtgtctcttacataccttgcttctagagtatgtaagaactaagaaaatacttagtttttcttcttttaatttttgcagatgaacttgagatgctttctgaagccagagcccgcttggctaatactcagggaaagaaggccaagaggaaagcaagagagaaacaattggaagaagcaaggtatgtgtggatataggaataaaaagcaaagtgtttttctcacataacaatcaacacagaatacttctgtgaccagatatgtggtttttttttttttttcccctctccaccagcaatcaggcaatcaattctgcagtggatagctgggtgtcctctaattcagttaactctaatactgtctacctggagatagctccagatcttacaggttgaggacttagtcccacaagactgaaccccagttttgatgctgaccctaaaccccaggttattttgcttgtgtttctgaccagcgagctgggttccactgccccttccttgggttccattcatctgctagaggactcacagaactcagggaaacacccacatttacaaaggatattttaaaggatacaaatcaacggccccatgaagagatacacagggtgaagcctggaagggtcctgagtgcaggtgcttatgtcccattgaagttgggatatgccaccctcccagccagtgggtgtgttcttgttcaccttttcggaagcccccatgtatttggctgcccacaagttctccagactctgtccttttgggtttttatggaggcttcattaaataggcaagattgattacatcattggccattgcttatcaactcgaccttcagcccttctcccctcccctgaggttgggggttgtggctgaaagtcccaagccctctaatcctgccgtggtctttctggtgactgccagctatcagtcaactcattaacatgcagaaagacacttttcacttggaagagtcccaggattttaggagttgcattgttggaaacggatgaagaccaaatacattatttcacaatgtgtgcttgtctccattcatagttcaataattagtctaggcatccttaggaccaataaaactgcatgatttattaacccgttgggtgaataataattggaattgtccagttcctatttcgctagtattctttaccttctttatttctctgaaactatcttgtatttttttcccccaaccatttcagaatatttatagaaaaccatatttaaaaaaaattgaagctatggcagaggtaatgcccagtttatccagtatgttgagtgtgttctgttggcatatgagagcttcatttgttgtagctattttggagtcagatgactgtaggacacacaagattatgtgtcttttgtatgactgccaattagttactttccttgattggtattgggaaggcactggctgtgaaacaggaaacttggctgaacaaagagggaattaatgagcttagaaccaaattttaggccctcatagaaatctttatttaaaaagtaaacgaatatatattacacattgtctttcactcaggattttcttcactttccccttttttccttttggttaagtccatgattgatatcagttctaatagcccagaaaccaagatgatgtcactaaagggcaaatctggactgtgtcacagcttattagcttctgggattcaggccctagaataacctccctatcctgtacagtgccccttgtggcccccaggttggcctgctgattcttcttgacctgatgaccagcattatgttgtaattaatggctttgaagtgccagatcctgggatggagggttttttaatgtctgaggatgcatgttggcagagctggccaattgctagcctagaatggttagcttatttgggggtattagctgccggggacagtaaacagaaaccaagaggaggtactaacttttccaccattcttggccacctctctattctgtatactcttcagagttaagtactgtgagtaaggttgaaaaaaaatcacttttccatttttatccatggttgtaggggaccaaatttttagagccctttaaccgtgtggattgggccagggacacagcaaatgcatatgtgaaaaatctccaagtgtggctagcattgattgctttaaataaaatttgcagattttaatttaccctgtaatttcttgtaggcattcttgtagaatctacacatctttgtaagttatattctaacaggctggaatggcctctatgcaaagtgcagggcagggctatttgcttttaaatgttaaattacaaatctaccttgtaacttaaagcagttttttattgattataaaagtaacacatttttccttctagtattgttaatgttctcattttgggacataggtaatataatgctatatggcttggttatattcatttagcattattgtgtaaaggttttctaatgtggattgaagtccttatttccattatttaaagaatgaaattactttaaaatttgaaatacatttttctaaacttttctctctctcaacatagatgtgcatttatgtgtatatatgtacactaacgtttatacaaagttggatcatactgtacggttttaatgagaagtcagctgtaaatcttactgagatttccttgtaagtgttgaatcatttttgtcatactgcttttaatgttaattttaattttttttaagagagggtctttctctgttgcctaggctttagtgcagagttcactgcagccctgcacacctgggctcaagcagtcctctgccttagccccctgagtagctggatctacagatgcacaccaccattcccacctaattaaaattttttttgttgagacggagtctcgctatgttgcccaggctggtcttgaactcctgacctcaagctatcctcctttcttggcctcccaaagtgctgggattgcaggtgtgagccactgtgactggcctgtcttactggttttaaatcttctcgtctttggctttcaacatttttaatatgatgtgtctgtagatttctttttgtttatcttacttggagttcattgagcttactggatgtgtagattaatgtttttcaataaatttttcaaaatttcagccattatatatcttcaaatatttaattctgctcctttcacttctctccttttggtacccctgttctgcttatgttggtgtatttaatagtgccacatatttctctgaggctctattcatgttcttcattctttttctctgtttagattgcataattgttactgctctgttttaaagtttgttaattcttctgccagttaacatctactgttgagcctctctagtgaagtttacatttcagctttgtactttgttttgttttgttttttgagacggggtcttgctctgttgccaggctggagtgcagtggtgcgatctaggctcactgcaagctccacctcccgggttcacgccattttcctgcctcagcctcctgagtagctgggactacaggtgcccgccaccacacccggctaattttttgtatttttagtagagacggtttcaccatgttggccaggatggtcttgatctcttgacctcgtgatctgcctgcctcggccttccaaagtgctgggattacagtgtgagccaccacacctggctactttatttttttttaattaaataaatattttttttcatttttgttattccattccttttctaagttagctgataagctttgtgcttttgaatttgagaatttccatttggttctttttaagcatttctgtctctttactgatattctctgtttgatgcaacgttgttatcataccttcctttacttcttggtttccttttgttcttggaacataatggctactttcaagtttgttaatctgacatctggttgcactctcaggcagtttccgttgcttgcattttttctagcatatgggtcattctttcctgtttctttgcatgtcttataattttttgttggaaactagacattttagatgatatactgtagcaattttgggtactcccccagccttcatttattatttgcttgtttacttgtttgatgactggtttattttattttatgtttttgagacggagtctcgctctgtcacccaggctggagtgcagtggcatgatctcggctcactgcaacttctacctcctgggttcaagtagttctcttgcttcagcctccagagtagctgggattacaggcactgtctaccgtgcctggctaatttttgtatttttaataaagacagggtttccccatgttggccaggctggtcttgtgacctcagatgatccacctgccttggcctcccaaagtcctgggattacagacatgagccagcgtgtctggccaattttagtcagtctattcttcccttacctcctgtgagaaatgtgaagcatctgatgttgctcctcacagggtatgctcacagtcaccctgggatagcatggtttgggcagcgctctctttgacattcctttccctgttaagtttcactgattgccagctgtttactgtgttgttttcaacaatgtcctggggcataagttgcactacaaagtgatccagtcaaatttgggctcctttgaagggatgcttcctgatatcagtgtttgagatttattctcaccccagaagggctcctcccagctcttattccctgtttctctctggcaaactagtaggcctacagatttggtatctccattaagtctgtcaagctttttcccaacttgccttttaccagaacttccactgtttttgatagtacccttaggctagaacttctctatactctgttgcaatgaagtccttttgtttgaggagagatgtggatctctcagttctgtgtcctgcttcttccccagggctctgacaggacatgtctccaagtgacagccctactttattagctgagtgtttggtgggaagtaggggatggacagcagcccaaggtttccttggcttgccctccccgtccgtccgcccgcagcgtggagccctcatctcataagccagggcaaaggctatcagggctccagtattctcagcagcactgtgtccaaagctaggacttctgtttggatggaggaaggaagcccacttttcagccactcttgatggaactttgccaccagaaatactgatgtcctaatcctcctggaatgaaagccctactactgggagctggaggggagaaggagtcctgggttcttggctgcacttgtgtggagtggaatctccattcctctgagctggggggaaggagggagtgggtcttggtttaaatatatatatttttctcttttttaaatttaatttaattttattattattatactttaagttttagggtacatgtgcacaatgtgcaggttagttacatatgtatacatgtgccatgctggtgtgctgcacccattaactcatcatttagcattaggtatatctcctaaagctatccctcccctctccccccaccccacaacagtccccagagcgtgatgttccccttcctgtgtccatgtgttctcattgttcagttcccacctatgagtgagaatatgcggtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaatagtgccgcagtaaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgatttaaatattatattcttgtgtttcttaccgagttaaagtagattttcttgatttaatgtttatatatttgctgtatctgcttcagatcctcttcagagactttaattggttgtttttaaaatatatgtaattttcaccattctccctgggtagtgagtttatggagttcctcatgctgtcatgctggaagttactcatagatactgttttgtaacttgttttccatctttcatattgtgaatagcttttcttatcacgaaatcattacagttatagcaacataggaagatgcaaagaaaaaaagtaaaaattaaatggaattccaccctccaatgactatcgttattaatattttgatggacatccttcatatctcctcaggcacatattcattgatagatatgcatacagttcttatgtgttgccctgtaacatgtaaactttctaacattttttacacagtggtatgtcttgggcctctttccatatcagagtagatttatagccttttaaaagtttatgtaaatgtctgtataatatcttataaattcatttaatttcttactgatagttgtttagattgtatccagctatctactatcataaacagtgcttagtgaacagctttgtaattaagtccttgttcatggtgtaacttatttcctcaggctaaaggctaaggagtgaaattgctgctcaaaaaatatgaaaatctttagactatgaatgtgtatttctaacttctctttgggaagagatgcaccaatatactttttcattaccagtgcagcagactgtccattttttgcagccttgccgttaaaacaaaacaaaaaactgaatggtgttaattagatatgcacaaatggtacttgttaatttaatttgtgattctttaattgttaaataaaacttttgtcattttagttacctgcattttttgctttgtgaattgtttccttttgctctttttacaccctttgagtgcattaaaaaaaaaaaaaaactttgcttagactgtttatatttaaccatcatactagttgcaaatattttttcctactatttgccttttaatttcatttataaattttcatagtgttacagttagaagttttatatctcaaagctattcaatgtatagatgagtggattaaaaggaaaaaaaagctgttgatttttttcatttgccatttatttaatttatatttagtaagtacatttccatccagagataagatatgtatttacttgtagttccttttggtttttctttttgccttattatgtgtatgtgtgtgtgcacctttaaattaaaactaggatttgttttggtgaatggtgtgaggtaaggatttaaataactatttcttccccaaataaatagatactttttttttaactgtatgggataatttatccctgtcacatggcatatgattttcaaagtgattttgcattcttttcagacgtcttgctgccctccaaaaaagaagagaacttcgagcagctggcatagaaattcagaagaaaagaaaaaggaagagaggagttgattataatgccgaaatcccatttgaaaaaaagcctgcccttggtttttatgatacttctgaggaaaactaccaagctcttgacgcagatttcaggaaattaagacaacaggatcttgatggggagctaagatcgtaagttgcctttctgattttggaaatggaaaggaatagtaggaggagtcttacgaagggccaagtattatccttgtcagagccagatttttattatttatttattttacattttttaaaatcaattttttttttgagacagggtcttgctgtgttgcccaggctggagtacagtggcacaaacacggcttactgaagccttgacctcctgggctcaagcaatcctcccacctcagcctcctgagtagctaggccttcaggtgcacaccaccacacctagctaatttttttttattgttttgtagggtgggatctccttttgttgtgcagactggtctcaaactcctgggctcaagcgatccttcttaaagtgttgggattataggcatcagttactgtgcctggcctagatttttattagtacaatgtggcctacatatggttttatttatttaatggattcatctttctgagaaaatcagggactgtggctatcacgtttttagcacagaatgctgtttatggctcttgagttgaaatgcatggctctcaattgactgtttactctttgaatcacatcttaacttttatgtacatttatgagtagattagttttactagtggctgaggaatctgtcaaaattgagtctggtatttttagccttaaaaaacaatttttttttttaagacaaggtctcactcttatcacccaggctggagtgcagtggcatgatcacagctcactgtatccacctcccaggctcaagcagtccttccacctcaacctctcaagtagctgggagtacagatgtgtgccaccatgactggctaattttttattttttgtagagaggtgggtcttgccatgttatccatgctggccttgaactcctaggctcaagctaccctccctttgcgtccctcacaaagtgttgggattacaggcatgagtcaccactcctggcccttttagtcttttctagtgaaaaattttaccttgtttttattaagatgaaattaaaagaaaaaacttactgatcctttcacttgatgggataaatatacatttataaaatctttatgttttagggcatagcagattttccctatttcttgagatttttagtttctttaaatctcatatctgaatattgtagggagagtattttatggttgtcaagggttttttaaagttttctactccgttgacctttcatttctgttgacatgaattgttacaaaacaacagctatcagccattgtaaaataggattttcttagatgtactccattgtatttattcctcagattaggactttgctttaggtaggctctacaaataaagagattgaacaggaaaactattcatttggaaggagtactaagtgggggaggcaagaaagacacacagaaggggaggaggtattcctggagctttgaaagactgctttgagcctgtctttaggcttcctaaccatgtttagatgtcacttgtcagtattaagacagcctttttaaaaaagttgtgaattttaagaatcatgagaatttaataacaagttttaaagggaaatttaattatgttttaattttatttctttcatacacattttcctttttacatacttgtcatactttttcctatgtgcacacgtttttattgaatgtattcataatataggaatagtttttgacattatgtggaatgttttgtttatcacaatcttcatacttacatgttttaatatttagtacttcaattagggtaccttattgataattttgttgctattctgagtttgcttttatcttgaatatggtaagtaatggtgtaggggactacttaatgtatattgtttttacctttttttagctattttctttttttttttgagatggagtctttctctattgcccaggctggagtatagtggtgcgatctcagctcactgcaacctctgtctcccgggctctaatgattctcctgcctcagcctcccgagtagctgggattacaggcacgcaccactatgcctggctaatttttgtatttttagtagagatggggtttcgccacgttggccaggctggtcttgaactcctgacctcaggtaatccacccaccttggcctcccaaagtgctgggattacaggcgtgagccattgcacctggccttttcagttattttcttagaaatgaggttgtttgttcaaagggtttgagtatttgtatggattttaatgtttttggctatatgtaacttaaaaatctcttttctactttgatccatgacagtgaaaaagaaggaagagatagaaaaaaagacaaacagcatttgaaaaggaaaaaagaatctgatttaccatcagctattcttcaaactagtggtgtttctgaatttactaaaaagagaagcaaactagtacttcctgcccctcaggtaatctgataaaagcaaatttttcactatgtgaatttatatgcttatatcatttattcagcaaatgtttgaaggcctgtgtaccaggtttgtgctggatgctcttaagaaattcacagtttaatgggtgagacacacataaaaacaagtaattgtgggctggctgtggtggcccacacctgttatttcagcactttgggagaccaggacgggcggatcacctgaggtcaggagttcaagacagaaggagttcctgcccagcatggtgaaaccctgtctctactgaaaatacaaaaattaggcgggatggtggcacacacctgtaatcgcagctacttgggaggctgaggcaggagaatcactggaacccgggaggtggaggttgcagtgagccaagatggtgccattgcactccagcttgggtgacagagtgagactctgtctcaaaaaacaacaacaataacaaaaaaaaacaaaaaaaaccccacaagtaattgtgatatagtatgataagatagcttcagcttctctgtataaattattgtatcagatcttaaactgctcatatgatggtttggtaagtaattatcagctcttaacattttgtcaacagggtagggctttaggcttctttttgtagctgatgagggtaaaggtgtggtttggctttgtggactttaagctgccttctcccagggaatgttttgttgtgttatgcttttcttttttgagacaacagttgtgaaagtcaatgtgggagttgtggagaaaagcgatacaaacattctttcattcagcttattacaggctgtattcttttgacttactatagttggtcagaaacatgggaccttagggtaacctttttttttttttttgagacggagtcttgctctgtcgccaggctggagtaccgtggtgccatctaggctcactgcaacctccgccttccgcgttcaagcgattctcctgcctcagccttccaaatagctggaactgtaggcgtgcgccaccatgccccgctaatttttgtatatttactagagacagggtttcaccatgttggccaggatggtcttgatttcttgacttcgtgagctaccatctacccacctcggcctcccaaagtgctgggattataggcatgagccaccgtgcccagctaacccttttttttgtctgttttgagtagtacagctttgtagaattggacagatttaatggtgcagaagaaaggacttaggagaccagaagaactcttttcccacatgagcacattggctgcatcaacacaagattcttgggcataaacgagttttgtcatatcctgacattcctagtggggatatttattaaactgaaattttgtctttaatttttttcttagtacaccttaggatatttattttggtaaaattactaacacaacacctttagattttcttagggatcttgtggctcgctggaccctttctgtgtgatattttaattggttttcagtcttcctcctccaattttgtataaatactgctattttacattcttggtacgttaatatgttgatttgaaagaatttcagtatagagatacagcctttgtagcttgattctatatcatatgtgaattttcccctcacattctgtagggaaggctttctaaagctatattatggaaactttcaaagccacaaaaaagatgagtactactgtgaacttgtgatattaatcacacagcttcagcaattcatttttctggaatatggaaatttaaagctgtgtcagctctcagttaaaatgttggtttttttttttttttcaatagagacagttttgctgtgttgcccaggtaggtcccgaactcctgggctcaaacagtttgccctcctcggcctcccagagtgttgggattacaagtgtgagccactgtgcccggcctcagttaaaatgttgcttactatgataattgtgtccttttagatttcagatgcagaactccaggaagttgtaaaagtaggccaagcgagtgaaattgcacgtcaaactgccgaggaatctggcataacaaattctgcttccagtacacttttgtctgagtacaatgtcaccaacaacagcgttgctcttagaacaccacgaacaccagcttcccaggacagaattctgcaggtaacgtgtcacgtagtagaatgaggcttttactttgtttattgtccttagaagtatcatgcaggagaactaagcggtttggttgtgtttcttttagtgtaaatggtttgaaactgagtcctgaatgcatagatcttgcaatatttctgtagtagagaagctaaatagattcagcaatcaggtagttttattttcacatttattaaaattcgtaattttttgaagccagcccttctaccttcattagtcttttgtacctgtcagtaaagcatagttttgtaaaatttcacattgcctgccaatcctagaaagaaagaaatacttccttgcatttctgtacttagcttcacatagtgtgcccgcagttctactttcttccctctctctaacacgtggggtagacacagctttgtgtgttcccagggtgtctgtataccagagaatatccaaacctacaaaacatagttgggtcttttggtacacttacatctcatttcctcatctctaatagtcaggaatataattttaaggctttgattcgcggcaaacagttgtgtaaggcttagcaagaaaaacacttgtgcccctcatccgtagaggtgcctgttacaactctttgttttacttaccgctaaaagatctttgttactcattgaccattttcagttttaggcattatctgttgtttttctacgtagaatttgacatttggctttcacaccctctgtgtccgtcatgcatacattttctattcccctattgtctgttataatttggttagctttatattcttggtttatcttatgactctgtaaatcctattcattgctaaaccatgaattaccttataatttgtgtaagttatacaaatatgtaatattcgtacatatagtttgtaatccatagcataccattgtactttgtggtatagtattttgtttttcttggagctaatacttgttttattcagttgctaagttttttgactaagcagtaattcaactctagactacgctggctgtgtctgttttctctaacctgtgctgactttagatagtctcatctttttgaagaaatctttcttagaacttccgaatgttcttgcctggactcattattcttcagggcttgtttatagcttgttcttttgatttcccttcactgtcaccctagagagtcccttggatcccctctttccaggctcccatgtctttggctttcttggtttactcccttgttcaatgaagaatatcattcagtagctttcagagaaagggttcataggaggtagaatttttttttttttagttttttttcattgataaggaaaaattgtatctatttatggtgtacagtatgatgttttgatatatgtataccttatggaatggctaagtcaagctggttaacatgggcattacttcacatatttatcatttttttgtggtaagaacacttaaaatctacccttagcaatgttcaaatgtacagtgtactgttattcactataatcactgtaatgtataatatcttgaacttatttctcctgtcttactgaaattttgtgtcctttgacagatatctccctggttccctcacccctcagcctctagtaaccaccattttactctttttctgtgagtttgacttttttagatcccacaaataagtaaaatcatggggaatttgtctttctgtatctggcttacttgatgtaatgtccttcagtttcatccatgttgtcacaaatgacaggatttcttttttaaggctgaatagtattttattgtgtttatgtatcacatatttttaaattcatttctccactggtggacccttaggttgtttccagaggtagaatttttcaagatcttgcatatctgttaattactaatctaccctcttggttgatagtataactgggtatagaatcccagattgcagtggtttttgttcacagtgttgaaggtagcactgcaaggtcttctggcttccactgttgctcttgagacctcctatactgttgagtttgttaaaagtaaacctcgttttttcttttcttgaagcttacattatcttacatgatttatgatgcatgtttcttggtgaaggtctttttcaaccactgtggatcttttcattccagagactcatggccttcaattttgtaaaattattttgaattaaaattgtttttctccctttcattgatctctttatgaacctccaggttttctattaattcctctgcagttttctatcttactgattttgatttatttgtaggaggttttctcaattttatctttattcagtttttaatttactatcatatatgtaatgtttaagagctttttaaaattttgttcagtattttttttttttaccatctcttatttcatgagtatcttatttctctgaggctgttaatgatggttttgtttttataagttttcttttccttgcatagtttctaagttttttgttttgtttcctttctgtctttccttatgggtatttcctcaaatgtccggtgctctttgcctgtgtctagaagtgggtggggggcaatcacaagctgattggaagctccttaggtgtgggtagggctccttgactcctggcttccctggaggctgatctggctgggatgtttcactgggagagttcttgatgtcagtgttagttcttttgggtcagtgttagttgtttttgcttaggttagtcatattcctcagagaagtaatttccagtctcctatctacagggtataaagttggccagtctctgggaacctagttggggaaaaaggctggatgtctccaatctaaaattaaaaacttctgcttcatttctctattttcatagtgataattttgctcttaactcttcctggtattctctggtttagaaatcttttttgtactctcttcagagagtaaagcccctctgttttttgtaaatcctgtgagagacagagagagagagagagagagagagagagagtgtgtgtgtgtgtgtgactaaaaatcctatagactttgttttttattatcactctttttcttctcattttatattgtttcgtgaaagtttacaaaattatggcacactagttattagccagctcaaggctttgaggaggtctgaacatagggtttctcaagtaaataagtaaaatatctagcatatcagaagctttaaaaacaataatgtgatcttgcatttatttccttggattctgaacacaagtaaggaatgtgtttcagggtgttcaaggccagataaagtgtcagataagcctgttcggacagactgggaaagagaaaacctaaccactcacagaggaaatatggagggacctaaacagtccagaatacagacaggaatccacttaaactgtatagacctgttaataacagggggcaataatggctataggtattgtaagaatcccactagccatcttctcctggtggccctgaagtgatggagatgcttctgatagaggctctgtcagtgttacatggcttagtattgctcgtgcatgtgcagcacttatccagccctttcattaaaatacagagcatgctttcctggttctgtcactttatccatgcctcagcctttcagatgtctccacttctgtgacagataggaataacctgtcccccactttttttttttttcagacagggtctcactcccattacccaggctggagtgcagtggcatgatcacggccactgtgcccagacagtttttttacttttagtagagacagggtttcgccatattgccccaggctggtctcgaattcctgggttcaagtgatctgcccgccttggcctctcagagtgctggggattacaggcatgaaccactgcacctgaccccccacttttttcagtggtgctgtttgaagaagtttgcaagtgtgaatattcacacttgaaattaaaaaaaatagttttttttttaattttgggaaaaaattacattataggacaatataagggacatttaatggaactcctttcatggtttttaaacagttttattgagataccattcttacagaattcacccatttttactgtatttaccgagttgtataaccatcaccacagtcaattttagaataatttctttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagctgggatggtctcgatctcctgacctcgtgatccgcccgcctcggcctcccaaagtgctgggattacaggcgtgagccaccgcgcccggcccaattttagaataatttcatcatccagaaagaaaacccatacccattagcagttattccccattcccctcaaacctgccaagtttttaggcacccattaatctactttgtgtctctatagagttccctattctgcacatatatgtaaatgaaatcatataatatatgatgttttgtgactggcttttttcactttgcattatatcgtcaaggttcatccatgttgtagcttttatcagtactttattcctttttgtcattgcataatattccattgtatgaatataccatgttttgtttatccacttatcagctgatagacacttgagttgtttctaccttttgactgttaggaataatgctgctttgaacagatgtttgtgtggacatgtttttttccttactcttgcatagatacctaggaatggaattactgggtcctatggtgactatgtttaactttatgaggaactgccagactgttttccaaagtcgctgcaccattttatttgtttatttttgagacatggtcttgctctgttgcccaggctggagtgcagtggtgcagtcatggctcaccgaagccttgacctcttgggctcaagtgatcctcccaacttggcctcccgagtagctggtactacaggcatgcactaccaggcccaattaattttctaattttttgtagagatgggggtctcactgtgtcgcccaggctggtcttgaactcctgacctcaagtgatccttctgcctcagcctcccaaaacgctgggattacaggcatcagccaccgtgcctagcacattgtacgtttttattaggaatgtggaagggttctaattctttacatcctcaccaacacttgttttctgtctttttgattatagccatcttgtaatcaaacagatcctagttgtgaagtgatatcttgtgtttttgatttgcatttccctaatagctaatgacatttcatgtgcttattggttatttttatatctttgttgttgttgttattgagacagggtcttgctctgtcacacaggctggagtgcagtggcaccattatggctcactgcagactcaacttctctggttcaagcagccctcccaccacagcctctcaagttgctgggactacaggtgtgcaccactgtgcctggctaattttttatttttgtagagatgggatctcactatgttgtccaggctagtcttgaagacctgggttcaagcgatcctcccaccttggcctcccaaagtgttgggattacaggcgtgagccactgtgcctggcctggcctgtgtgtgtgtgtgtgtgtgtgtgtgtgtgtgtgtgtgtgtgtgtgtgtatttttttttagaaatagctattcatcttctttactcatttttaaattgggttatcttttttttttttaatttaaaaattttttttgtagagacagggtcttgctggtgttacgtaggctggttttgaactcctggcttcaagattctcccacccgagtctcccaaagtgctagaattatatacgtgaaccattgcacctgactgggttttttataattgtaagagttctttgtatattctggatataagttccttatctgatatataacttgcagatgtttcctctcattttgtaggttgtgttttcactttcttgatgttctcatttgcagtacagaaggcttatattttcatgaagtatagtttagctatctttttcttttttgcttatgcatttaatcttatccaagaaattctttccaaccctgggtcatgaagagttattcccatgttttttcctcagattttatagttttagtgcttacatttaggtctgtgatccactttgagttagttttttatgtactgttaggtatggatctaccttcattcttgggcatgtggatatccagttttcctaacacaatttgttgtaaagactgttcttttcccgttgtatgttcttagcagcccttaaaaaaatcaattgaccattaatgtaagggtttatttctggactttcaattctgtctcattgatctattatctatcctgtgccagtaccacactgtcttaattcctatagccttgtagtatccttttgtgtttttaataggctttttaactgattgttaaagaatattgaagtaatgagtgaatgttaactgggagcgtagtagttattttgaaaaagcacaaaacaggtttagaacctgagccatatgcagtaagtttggggcttgtaactttggatttctcttctaaaagatgtgggggaagttatatatttgttggaattgggtttagctgtaacagaaaacctctaacagtggcctaaatagaatagaggtttatttctgtttcatgttctaagtgttgagagataaatcaaactggggcttgtgtggcactccctggtgtcagggacctgggcacctgcttttttgtcctcccccatgtcaggtttctcttcttagtttctccttgtggcaggtacagtcgctgcagggccagccgtcatgtttgcatatagcctgcaagaaggaggaaaaagggcacaccctttcccttcttaagaacacatctcttgcacacatcattctgtctgtcctgctggccagaacttaggcacacatgtcctagctactggggcatgtgatatttgttctgggtagccaggtggtggttaagaattgaggcttctgttactatggaggaagagaatgggtgcttggtgacaagaagtctctgccacagtaaaataaatgtctactaatgaaaatgattatgattggttgaagccctttggaacctctaagatgaactgacagaagttgagatttagtctagtctgtgacatatttttttgtaaaattttgataaattttgttttcactttgtgagcttttattggttcagtgtctgttctatgtgtgataaaggcggtacctctggctgctgttgtgtgtagctaggggtaagaggagttttgcttctgtctcttggcctcctctgatgtagtctagggtatatcagtcaagatttaattaaggaaacagaaccactaggaaaatcatggaataaggaatttgttagaggaattagtcccatatacagttatgggaaaagcagggcattaaaggtctgaaaaggagtgttaaagattggagaaaggtcaccagccctggtgtggagtgagtcatagcttacagggaaatctggaggccaggcatggaagtctggagggttgttgactctttgtcactactgtttctgtgagtttgaagcagaagtctggtcaccagggctgcctgtaaaggaggagaattggatatatggagcagtggggtgcaaggacacactgaaacttgccagctcctctgcaagtctgtcactacctctgaccaatgatggccttcagagtgtagtggttgctacttcacctctgtcacctctgcttctccttctgcctctacctctgttttacttttgatgaactctactcagtaccaagatggaagaggattctgggaaacatcccagtgtaaccacgtcaacaaaggataattcaccacataggagacagctctcagatgcaccggcattttactgggccaatctcatactgggccaaactcccccactcctttagccacaccatttttgggagtgttgcctatttgtaattttggcacatatgatatttcacgtcacccactcttccaggaatatatacttttgccatttgattcttatttctcctctttcctatgcagaagatctaagcctacatacgtttctttctagtaaatgctttatatttggaatagcaaaaaggacacacacagggcctttgataatgtgaaattcaagattttttttcatgaataaagatatacagaataatggaataagtcttgctctggttattttcattttgcctcaaaatttagtgatttagtgcattttactatgcttatgacttctgtgagtcaggaattcagacagggcacagaaggagtggttagtctgtgctccatgatgtctagggccttagtaaggaggactcagcggttctgtgtgatttgatggataggggatagagtcatttggaggtgttgtctttccatgtctggtggttgatgctggctgttggtggggtgggtcctcagctgggaatgtggagtgaatctgcatgtggtctttccatgaggcttgggctttctcatagtgtagtggtctcagaacagttgaacttctcacgtggtatctcagggctccactgtgagtgcggtgggaagctgcgttattttttctaaactaacctgggaggtcaagcattgtcacttttgttgtgttctgttggtttcaggtgaatcacaagcccacctagatttatggggagggaacatagaccctacctcttgatggaaggagtatcacagttggattttaagaacatgaaacatgagagagaaggttgtgaccatctttggaaaataaactttgccacaggccctaagttggacataaagagatttatgggtacaaagatagcactgaggacagggttacagtgaagggactaaagagaacatggtcagttctgcctaaagagatcagcaagacttctgaaagggacctgacccccacaagttgttttcttgtgcagtggaaaggttgcttgggagtatcttaagttcccagtagaagaaacagacctcagagatactaatgaagactggatagagaattcagtggtgaagccagactaaaacccaggcattcagacatttggcctaagctgggaaatttgaattcttgtaatagtaatttcatatgtgaggccacaaaagcacacctctacacataaaactttatttgatgtataaaacttctttttaaattttattattattatactttaagttttagggtacatgtgcacaatgtgcaggtctgttacatatgtatacatgtgccatgttgctgtgctgcacccattaactcctcatttaacattaggtatatctcctaatgctatccctcccctctccccccaccctccaacagtccccggagtgtgatgttccccttcctgtgtccatgtgttctcattgttcagttcccacctatgagtgagaacatgcggtgtttggtttttttgtccttgtgatagtttgctgagaatgatggtttccaatttcatccatgtccctacaaaggacatgaactcatcattttttatggctgcatagtattccatggtgtatatgtgctacattttcttaatccagtctatcattgttggacatttgggttggttccaagtctttgctattgtgaatagtgccacagtaaacatacgtgtgcatgtgtctttatagcagcatgatttataatcctttgggtatatagccagtaatgggatggctgggtcaaatggtatttctagttctagatccctgaggaatcgccacactgacttccacaatggttgaactagtttacagtcccaccagcagtgtaaaagtgttcctatttctccacatcctctccagcacctgtttcctgactttttaatgattgccattctaactggtgtgagatggtatctccttgtggttttgatttgcatttctctgatggccagtgatgatgagcattttttcatgtgttttttggctgcataaatgtcttcttttgagaagtgtctgttcatatccttcgcccactttttgatgtggttgtttgttttttttttttttgtaaatttgtttgagttcattgtagattctgggtattagctctttgtcagatgagtaggttgcgaaaattttctcccattttgtaggttgcctgttcactctgatggtagtttcttttgctgtgcagaagctctttagtttaattagatcccatttgtcagttttgtcttttgttgccattgcttttggtgttttagacatgaagtccttgcccatgcctatgtcctgaatggtattgcctaggttttcttctagggtttttatggttttaggtctaacatttaagtctttaatccatcttgaattaatttttgtataaggtgtaaggaagggatccagtttcagctttctacatatggctagccagttttcccatgatgtataacacttctaatgtgatgtgttagattgatagaaggaatggaaacattgaaatctgccatgactggtattcattttctctgttagctttcattgagaaaatgagtaaggattctgcctgcttcaagattggtatagtaggaccagaagagattctgcaagtctgtctaaacttttaaacttgcttctttgtcttcttgttaatcaggaagcccagaacctcatggccctcaccaatgtggacaccccattgaaaggtggacttaataccccattgcatgagagtgacttctcaggtgtaactccacagcgacaagttgtacagactccaaacacagttctctctactccattcaggtattgtaaatgaacacgtttttattttagaaaaacttgaattcaaggacttagcatatttgctttagtaatgtttacggagaatgactacttattgtgttggattttcctctttgatttcttcttcatagtaataaataatagtgtccaggaaatggttaaatactgtggagtgcctccccccctttctttaagatggagtctcgctctgttacccaggctggagtgcagtagcgcgatctcagcttacggaacccctctgcctcccgggttcaagcgattctcgtgcctcagccttctgagtagctgggattacagacatccgccaccatgcctgtctaattggagtgttcttttgcaaagcttcggatcctatcacgttatttttgaatactttgtatttgattttagagtagattgattcatttttaatgattactttgtgaattttattatgtaatccttttatgtatgtattactattgctttccctccagcattttattatgaaaatttcaggcatttagaaaggttgaaagaatgtgtggaagttatcagtattgaaatggagtcatttatgttacattttaatgaaaaaggaaccctcatgcgcgtatgcctatgacagaaattattgcagggaccttctgaaaaccacacaaattccagataagttgcttctgtgaagacattgccctaccaacagccagtacaggttgagcatcccaaatctgaaaatccagaatgctccaaaatccaaacttttttttttttttttgagacggacttttgcttttcttgcccaggctggagtgcagtggcgcgaactcggctcatcacaacctccgcctcctaggttcaagcaattcttctgccttggcctcccgagtagctgggattacaggcatgcgccgccatgcctggctaattttgtatttttagtagagacagggtttctcagtgatggtcaggctggtctcgaactcctgacctcaggtaatccacccgccttggcctcccatagtgctggtattacaggtgtgagccactgcgcctggccaaaatccaaactttttgagcaccaacatgacactcaaaggaaacgctcattgaaacgtttcagattttgaatttcctgatttggcatgctcaaccagtaagtataatgcagttatccccaaatctgaaaaaatcccatatctaaaactcttctggtcccacatttcagataagggatactcttatctataccggcaatgaaaacaaatgccacctcctgtgataagtccctgtaaccaatggtctttgtttcagaacagtttgcgtagactcctcccttgtatctttaaaaacttctccttgccccagcaccctcagttgtacctatggtctgtcatagcacacatatcccacactgtaatcccttgccgttcccgaataaactctttgttttggagacccggtctctcacccatttaagttgacaaatggtaaagtgaacatccatatacccaccacttagattctaagatcgttaatattttactatatttgctttatcacatatccatccaccaatccatcataatttttaatgcatttcgaagtaacttgcaggtagcagtttgtttgatcccaaaacacttccacatgcgttaactagaattcagtatttctttataactcttgcttagttttaagctgctgttttttaagaagaatctttaaaatacaaatgttatggaagcatgtagtaggaaaatggaattggaacttacaatggttggaaatatttggggtttactttgaattttaagtgttaagatatgtcttcctactggttatttagtagagaaagcacttcaggctattacacatatcatgacagcagaaccaagaagcattggcagccagtcttaaacatttaacacttcttgagagtcttgtaagagagcataatccctcatttcctatgtttagtcggctctctgtatctgaggattccacatctgtgaattcaaccaactgtggataaaaaatattccaaaaaactcaaacagtacaacaataacaaataacacaaataaaaatacaatgtaccaactatttatatagcatttacattgtattaggtattataagtaacctagagatgatttaaagtacatgggaggatgtgcatacgttatatgcaaatacgatgccgttttatatcagggagttgagtatctgcagggagttgagtattggtcctggaaccaatccccggtggatacttagggacaactgtatgtcttgtctctcacctagattgtaaaatccttgggggtgggaaccatgtcttatgtgataacaccttacctatcaggaatagctgtctggcagcatcaccgttctgcaacacaccaatatacaggaaataggcaaccaggaaaaaaaaagactttgaataattaaaatataggttgctgcaaaatctgtggatcttattcctaggagaatctcttaggcctcactcaggaacttactcatgtttagatgtgatttcaaaagtgtggtgtttggtttccaaacaaaatgtaaaaggaggaactatttaataaagtgtgtacatttgtaataatgacagtgatagtgatgtgagaaccaacagcttgatagggagggaggagacaaatatacacaaaactcaaagagtcatctggggtcattgagtgtggtggcccacctccctgcccactgcatgttcttagtcgccctaatgtgccaagaaaaggttgaaataatgtttagtggacgtagtttaggaaggcaagaaaatatcaaatgtagtgattattgtaagtcagtaaaataaaaataccatgctagctagaccaaacattgattttaacctagagatcctaacaaaaccagctggacagaattttgaaatctttattcttttttttttctatatttcctgtgaaataatttatgtgaaaaacatttgaaagcacaatccaaatgtaagtggcacttctgttaattgggattcctgtctttctaggactccttctaatggagctgaagggctgactccccggagtggaacaactcccaaaccagttattaactctactccgggtagaactcctcttcgagacaagttaaacattaatcccgaggatggaatggcagactatagtgatccctcttacgtgaagcagatggtaaatgtcaattcccttttaatactcttaaatttttttttaatatctcatggatgccaaattaaaatttctcctgttagtgcatatcacatataccttaagaatctatacacctgtggatgccagaaaaagaattatttgtaagacttgatgaaagggaatattttgggctcaaaacccacctttctttatgcttactaggtttgtgaatattgatgttcgttgttgatttcactgaagttttctttagcaagctgaggtagaaagctaactgtaaaaagttaagttttgcttctgcccgtgttactgcgtttattactttgctattgggccttattatctaatgccacagaaatcattgtgaaattaaaaaaaaaacttctaatgatactggcttgtcttcagtttaaaattaattctaacctcatgtatatatttggttgatttatatatgttttttaaagttcaaattgatatcaactaaagccaactctgaatggatacataagaattaaatagattaagaacctcatgcatgcagagcatgcatttggacatttgaggggatctaaagttgaataaagatgtcctttgtcctaaggaaatttatattctggggagattgacagtactaaactaagtccaaaaataattgcaatatcagaacagaataagccctttgagtaaaaccagtgtgcttagggtagttaaagaagggaatagtcacatttgttgggtaacaggaaagccttattagaggagctatgttctgaaggagggtgggggctgtctcagatggagactacaatatgagtaagcatggaggatgttttagatatagcaactcatctgttcctcacacctggtacatgtaagcactgaggatggatgggaaaactctgggtaccaggaggcttttttgggaaccaggactctactttctttcttctgcatgggatttagtatttccattaaaaataaacacatacatacaaattcaagtatcttttagagtggattttattagtccaaggacaaactaacttttgaacctgttcttttcatttgctgttaactttcggtgtcagaaatgtgttccctcaaagtggtctttttttctgccctggcctcagacctcctgttggaatatcccagagtatcttcagtgatcacaagtgaaagtttttggttggtcttaatgttgggaagaaggggggatagaaaataaacataagacttgtcttagctctgaagtcaggattatttttctagaattaatattaggctgattttttttgagactttttttctctttctgtaatttttaatttttgtggatacatagtaggtgtgtatatttatggggtacatgagatatcttgatacaggcatgcatgtgtaataatcatatcgtggaaaatggggtattcatcccctcaagcatttaacctttgtgtttgaaaccatccaattattcttagttattttaaaatgtacagttattttgactagagtcaccctgttgtgctatcaatttttaagagactcataaaatactggtggaatgtttaatatgcatgaattgagaaggaccacttcttttctacaggaaagagaatcccgagaacatctccgtttagggttgttgggccttcctgcccctaagaatgattttgaaattgttctaccagaaaatgccgagaaggagctggaagaacgtgaaatagatgatacttacattgaagatgctgctgatgtggatgctcgaaagcaggtgggtaactgtactgaaagaagcgtgagtttggctgaatgtgtcagtaggctggaagaatgaagaatagccattaaatgtcccaagatctctacctagtcctttttaatattgaaaaaacttctaaagtaaataacttatgtcattaataatgtatcctcacataattaacatactcacaatattttgatgagcattcttaaaaatatatatatggaaatttaaatacattctgtcaaattcattatgcttctctaaaatacacataggtagtcttttagacattgcttcaatctagcaaagaaaagatgttattggttagtcttaaaaacaaatacatcttggttcctgggtggtgcgatgtacgagcctgtagtctcagctgctcgagaggctgaggtgggaggattctttgggcccaggagtttgaatccagtccggggaacatagtaagacctctatctaaactggagttggaaatttagatagagtgtgtcaaaataatattagtaacactttgtactaatatatcttatacgtaattactttctcatttgcacgtaacagcacagtgatataaataggatcggtattacaggttgaacattgctaatccaaaaatccaacacctgaaatgctccaaaattcaaaactttttgagtgccgacatgaagctcaaaagaaatgctcattgaagctttttggattagagttagtataatgcagatgttccagaatctgaaaaaatcagaaatccaagatactctgggcccagatatttctagtaaggaatactcaacaagctcagatgaattgaggtctcatggtctcaactttctcaggtctcatggtgggtaagtggtgaatcctaaactagaactgatattttatgacccctttcagtagctgcagtccattgctggatgattttagggaccttgaatctcaggggattggagtgagaatgacatcagtggaaacaatattttagaggggacccatgtaaatgtgcttttcagtggggaacagaggatgatactttttgtgtttagttctcagctactttgagttacatttactccttcagaaatggcatgaaattttaatgtgttatcccacattattcataagaatcaggaaacaatacattttttggctggctttttgagttaaaagtcagtaattttggagtgaaagggaagaaagagttttgtcgtgggagtctctttggagtttaggttttccatttagatgagaaaagtttgttacgtgatatggatccatgcaagtttggagaatgctctagtagacattggaagctcttagtttctattataatgagagtgaatagactgattcatttctgttgccttagcattgcctttctacaaacttaaaccgatttctaaactttagctattgaacacacatgatcttacataccaaagtgtttttagctttactgagagatatcaaatacgctatagctgcaataaaggatataaaaatcattttttaggccatacgagatgcagagcgtgtaaaggaaatgaaacgaatgcataaagctgtccagaaagatctgccaagaccatcagaagtaagtgttagaatttctggtttaggaagttttaagtttctttttatatgattgctgcgttttacatcattcataaagactataaaacaaaatttcatctactttctggaatatagcaaagtagttctcaaatccaatctttaaaatgtttcagtagtaccagaaagaatttagaaggaaaaaaatggaaattgcttttgaaaatgtaaaaccgctgtttaattcatgctgtaacaggtaataacattaatatattatagtgatatgtttggtaattgtatttgttttaaaattttaggtaaatgaaactattctaagacccttaaatgtagaaccgcctttaacagatttacagaaaagtgaagaactaatcaaaaaagaaatgatcacaatgcttcattatgaccttctacatcacccttatgaaccatctggaaataaaaaaggcaaaactgtagggtttggtaccaataattcagagcacattacctatctggaacataatccttatgaaaagttctccaaagaagagctgaaaaaggtatgattgagctggaatatttcttcttgagatttaggtagttgttaggtgctgtgtatcatggacaaataatgaacttatttttccctgttggtattcataaacaactgaaatgtatgattaggagatgcatgtttagattaagtgttatgaaaaggacatgctttaaatacctccatcccccgtgttcagtgtgatagacctttagcaaataaacaccgccagggtgtttttggttcatgggtattaatggcttcgttgacagttgttacagttgccgttttctgtattcagctctgctatctctgaataaaaattagatgcctttagtacttaaacatcacttatttagaataatatgaagaggtgagagagactaatataaaaatgtttatagattaaaccttttagctattgaaaggaaggaagtattttttttactgaatatattcccctcacatgatttccccctactcttttggataaggacatgaagaaatgatttcttatatgaagtctgtatctggtcttttcttctacatgcattttattccttctgttttgacagagcaaacaactgtgattgtaaatagaaatctccataattgtataagaagatacagtgggtctcatcgttggaagcagagtggtcattagcttaaaagtctttttttctttagccttcagccctgaggagcagtgatagacctatggatttggaatgagctgctgtatacttaggataaaacaaacaagattcttacaaactctcctgtcttctctcctgcattcttcctctttcttcgcttttcacaatttcttactttgtgttttctttattgcataagtaatacattatttattataggatttttagaaaatagagaaaggaaggagggtttcgatttatatttcaataacttgtccctgatttcagaataactgagtcactcattttttagtaagtgcagtagggaaactaacatctgttgagttgcctactctgtcgagcacatttaatcattgaactgggattgagaatcaggctacgaaattgatacttgcacagtttcctcttttgaaagtgaaaatatgaggggaagaggaatttaggaaataaattttcctaaattgtatgtatggaaacctaaaacaaggatcacattgttgcttttggagattctgtagagggtaaaccctaacacaatttttgaaaaataataattctaagtattggtttgtaattgtttgaaacaaagtagcttaaatattctctcatattttatctgtgtatatctctctttgttccaaaaagaatttgaagcagctatttagttagcagattatttatggatagtttaaagataacttagccatattctctcgtaatgattataagatctgaacttgtaaatttttactctgtgcagtttcagagtgaaatagcatttctcttttaataaactgtcagattttctttttctttaatatactttaagatatgttaacattgatttgtttccattatttcccttaaggtattaagtgtccattttttcttctatagagatgattttccgtttcttttgttaaaattttttgtttatcaatcatttctcttgattttgtagattttgatgtgtttattttcattattactggaaagattgaaagccttctgtaaggcacagaaggtggttcccagtttttcataagccatgaagcaaagggctgggaaaaaattcatatgcttatggaattctgtgtgtctggcattgggctaggctctatagtatattgttcacttaatcctaataacaaacacatctgatctaaggtcagcatcatcattgcttggaaagctgtttttcagctttccaggctgaaaaagccctgagaaatgggctcagataaattaagcaagctcaaagagctgcttcaatggtaaagctgtgatctgaacccaggcctgtccagctttccctctcattctgtcattttacactattttctttagtagtgaactaaactggtttatgatctatcatctaattcgtgccccagtctcattatctggcaatgtcagggcattccttcaggatgagaaaaatgccatgtgacaaaaagatgcctagctcccctttaccatcacgtgaggtcctgcacacatggtggagtgggagagtggaaggggcacacccagtggtgccatttgtattctgcctcatctgcctactaacgatgtggtcttaacaagtggttgaatctctatgagccttagtttcattagcttttttttttttttttttttttttgagactgagtctcactctgttgcacaggctggggtgcagtggcacgatcccagctcactgcagcctccacctcctgggttcaagggattcttgtgcctcagcctcctgagtagctaggattacaggcatgtgccactacgtcctactaatttttacatttttagtagacacgaggttttgctgtgttaaccaggctagtcttgaactcctggcctcgttatccgcccacctcagcctcccgaagtgctgggatcataggagggagccaccgtgcctggccaaatttcattagcttttaaatgaggttaatattggctaatttgtaaggtgattatgatctttggatataatgtaggtaaaacttttaaacctagtttctcacacacacaataggtacctgagaaatgatagctgctgttatagtgagtgaaagcaaaggatgtttatacttttgaggaaacatggatgcttgatttttaaaaagcagtctgcattgactcaaaggcttcttaagctatttttcctaggtattgttatccacccttccaaaaaacaaccaaccacatcttggatttgactcaaggcatgagggaaaaaattagtcttctaaagctctctggatatggcaagtgtttgtagtacttaaacttattgaaattattattgtaaacaggcccaggatgttttggtgcaggagatggaagtggttaaacaaggaatgagccatggagagctctcaagtgaagcttataaccaggtgtgggaagaatgctacagtcaagttttatatcttcctgggcagagccgctacacacgggccaatctggctagtaaaaaggacagaattgaatcacttgaaaagaggctcgaggttggtatccttttaaaattttaattttaaatgtactttgattgagataatgaactaaataatgccactggagacaatgtcagaaaaacacacctgaggtgcttattgcctttttagttgttggagaaaactacacttaagtgttggatcttcttggccttgttcattgtttttttttgtttgttttgtttttgttttttttttaaagaattgttggccttcatgactaaagagtgccctgcaagttgaccagaggtcaatcagaacctttagatgtgggagcaaggagccaagaagccaatactagtcactcagaacaggcaggtcattgctagcatagcctgttttctctgaagaggaatctcagcagtaacgaggagttttctttttataacaaagagagtacatttacaaaacttaaatacaattctgttcatccttggattactgtgagtttgagttagggagggcagagctggattatctagttagtggcttccatgatttttcatgtctgtgaaaatgttgaaaacatactagatgcagtttcaggacatgtggtttcttaatatagtttgcatattttgaattccagaatctgtgtaggcattttgccaatggcatgtaaattgtggttcacagaccaccaggctgccttgtgcattctttttttttttttttgagacctagtctcagtctgttgccaggctgcagtgcagtggtgcaatcttggctcactccaacctctacctcctggtttcaagcgattctcctgcctcagcctccctagtagctgggactacaggcacgccccaccacgcccagttaatttttgtatttttagtagagacagagtttcaccatgttggccaggatggtcttgatctcttgacctcgtgatccacccatctcagcctcccaaagtgctgggattacaggcgtgagccaccatgcccggctatgccttgtgcatttttaatggtaatctttaggggcatttctaaggccaaggtgggatgggagagaaggggtacttcaggcagtcatatacagaaaatcgtcttggtttcctcttttatgtgattaccagtttctctttacaaaaagtgcatttgaaaatatttttatttagggttaaagccagaagtagtaaaatcacttggggtggttggggctgtatggggctgaggaaatgagcaggaaaaagcagtatcttttaatttgagttattctgagttttaatttaaccattaagatcacatatatataggtagctgatggttaatgcctgtgaacctctttttttctcagtgagaaatgactggttctgaagtaattctcatcttgggtaaaatcttagttcagtgctgctaattatttgtattaccaacttccagcagggtgtgctgttgctctgtgttgtggttcagtgttaaagccagggaaaatagaacatcagtggttaaattgtaagttacatttttttgttgtgtaggcttcatttcttataaatggtagttagcagtgtaattgtgatctaatatcagcatcatcactgattgaaaagctatttggaaagcttctttgtattatttatatataaatacttaggtttcttacttagtatgaaaatcttctcatttgaggtgggtaaactctttttgccgcaaatggcaagaacattttgtgcttttttaaatggtagaaaatttttttctccctaaatctcatttactttgttgaggtactaactttcatgacagcaaataaatgtgtcacacagtgagtggtgccataaagtacagtaatttttatttctgtgttgaattggtcttatgaattttaaagggaaaaatacagaaagagccactcctgttcttttggagatttatttgggtcgtttatgagcaaccattaaaaacatgtggttctctttgttcagttcagtaccaggaactgaaatcttccgttgaactatttttgttgaaggattggtgattttggagaatattcataaagcagtctgaagtcatttttcttttcttgactcttggataacttactttattgtttacccagctagttacttttaaagaatacttaatcaagtcctttaatttggtaaactgtgcttatttcaaatgaaagttcatgaaatcttttaaaaaaagaaaagcagctcaaagacttgaataaacaaacccccattttatttgtatccatcactaattcagaactaggtttcttttagcttgttttagtttttgaagacacagttctattggtttgaaatacataaatattttatttcaattgtggtaattctttcatttcagttgattgctaaattataaacattattcaaagtttgttgtggggaaggaactccagttatattgtataaactaaatgctatacttaaattatcctttccactcttaggttcaggagataagcccttctctgtaagcactgtatgccatggctgccagtgtgtttgatttttgctgccatgaactttggaaccgtgaatctaaattatggccctatcactgcctatcaagcaagatgaagtccagctttgtcgtggctggtgtctcctgaatggattaaaaaaaaaaaatgccctgaggtttatattggaggtagtctttgagccattcattactcatgattaatatttgaaacttagcacttaagtgaaaatccttaagatactcatttaaaactaatagaaccatctcagattttatgtagaatgtggtagaggatgtgtgtgtgcaaggagtttgttaaataaatagaatcagaatgcagttacaggtcagaaataagtggaaaagacttctgaattgtaaccaagtccatgtattttattctgctttggaggcagaattgagtttagaaccttgccagacttttgtgtgtaaaataagacagcaagagcaaacacagcaatgacagttaatataaggaaaggaaaagttatgagagcataccatgctgtgtccatttttacatggtggcaaaaagcccagtgtattttaatagctttaaagacactaagatacattgcaggggagtaaagtgattgctatttatagtggtatcccaaattaataagaaaaactttatttcttttcagtgtcatgtttttttaaaagggcgggatggctataattcagtgtaggaaacattttcacaaatggttaaaaataaaagagctttagtacttttatttattcacacattcagtaattattactgcctatctaccacgtactggatactgttctaggtcctggggataacagcaaggaacaaggcagacaagttctctgtgtttgtgggcttcagttacctggaaaatgcttaatgtgtggagaacctcgttttctgatgatgccagataaatgagtcattactgtatttgggaagtgcaaatagaattttaagtgttctaatttgtttctactttaagtggaaataggaaatcatctgaagacataattattttgagtgaaataatttccagtgggtgcaaaagtgaaatgagaagtctgaatttaggcatgccgttaaatttaatagtatttgaaatagtatctaaactgctgtgttgaggaagtttggctgaaaagtggattttgtcacgttagctgtaaaaatggaaaggctttccttagagatagaaaataggtccagaagtaatactacttctccctgtaatttactggcacagtcaactgtagtcaagaaatattatataacatagacttcttagaagtaaagtaacttaaagaacacagataacacacttaaaatccttctcagtgtacttgtagctcttatgaggacccctgacttgtctgaaggttatatttctgcaaaattggctgcacagtagatctcattttctcagtgattttcattataaagtcagatatttttacacaggaaaaaatttccttaatactttaaagagggaaaacttagggcaaggatttagttagtagacagttctgggtagagtgctatatgttgtcagatatcagcaggtttatgcttatgttgccttgtgtagaggtgggggaagtgacttgtggtacaggagaggaattcacagtactttggaatactctctctttcccaaattctgttctttgctatgacccttataggcactgacagatttcgtagttgtctctggtaagaactttatgagctggaacagacatcctgatacaaccaggttgcttctgttatgcctcaacatgaattgaatttgttttatgcagtttacgtatttcacttcctaatgtatgcagatgtacagtgctcttgtattgctttgttcatgtattactgtccttataaaggtttttagtaaggttttgccttcctggttagcatgcttttcagggatgcaatctgatggttgctaactcatagatgcaaacaataattactttcttggacctgcgtctcatcagagtagagaaggttcactgataaaaatgctggtaattggtatagagattaaaggagaatcactcatagactcctgttgtttgcaaatgttttggtgattgaaccacatcttgactattatatgggatcatattgctgattgatggactgggaagtggagctcccattgactgcctgtttattttgggtatccttaaacctgtttttccagtggtataaggttatattctgggcccccaagcaagagtttcagtgaggggtgctcttaatgtttctgaacctcactgtaacggacttttactgaagacagtattggagacccaaggataatgtgtttattttggaattacttaagcttagtaaccttaacaaacttagcttgaaagtaacagttacactttcataagtcccatacagctcccttttgtaatgacccgaggaaacacttatggttccactgattcatctcctggggaccatcagttttccattggtctctggccagtcttttttagacagtttctcttctatgcatttaaaaaaataacatttctaggcgtctttctataaataatacctgtgctttgtagaagttttaaaagaagtagaaaacataagaaaaggaacctactatccagacataatcaccttaaacattgtggtgtatatatgcaccccgccccccctgcccccacatactcccatatatcttttttttttttttaaatgtttggatgaaggtgtttaaaactaaactgggatcatattctacatttttcatttaatagttgtaaatatgattaaacactagttatattccaccctacttctaaaaaggtggtaagtggaacctttttttctgtataatttttttgagagatatttgttttcttatagttttatagcttgttaataaaagaatttagaattttaaaatacaaactgaggaaagtaaaagcttttctcaggtgtcaaaattcttataagtgggtacatgtaggtgagagtctaaatcagggtaagaatgatgggcagaattgctaattaaggtcttatttcttgtttacatgtgtctagaataatttatttttcagggagctgtctggtgaaatttaagccattcatttccacagcttaaattttttcaggcatgtttgcatttcagggggctgagccaaggagggggacagtcagtttattagcagtggtgtgaccagtgtattggactttcaaatagggcacaactgcatggcatcgtcccctggtggctgtggcctagggcaagccacaaagccactcagtgatgatgccagcagttgtgccctacttaacctctctgggtctcacatttccttatctgtaaaattgggtgagtaatagtttttgttttttttttttgagatggaattttgttcctgttgcccaggctgagtgcaatggcacgatcttggctcgctgcaacctctgcctccagggttcaagcaattctcttgcctcagcctcccaagtagctgagattacaggtgcctgccaccacgctcggctaatttttgtattttagtagagacgggtttcaccatgggtcaggctggtcttgaactcctgacctcaagtgatccacccaccttggcctcccaaagtgctgggattacaggtgtgagccaccgtgcccagccgagtaattgtttttatttgatggaagcatgagtttgagataatataagattaaatgagatactgtatgattagcaaatagcaggtgttagtaaatgggaattctcctcccatgtgtcttcaagtctatatcacccttagagttacctaaattggattatacttggtttgatactatgaggtattaggaactaacctcactttaaacaatcgggtggctaagtttttatattctgtaaattttgaggaatgtctgaagttttagacatgggctgattttaggagagagattgttgtactgagtgaagcttaaaactcagattttggttagcgtaaatagattttacatcgtggattttaatctaacatttcatgtatacattttggtgtgttgaaatagttgacatatttgtaaattttaatgtctcattatatttcactacattgatgtttcatgatttgtggtgtatggtcttgagaaagtagcctttagagtagatacaatattgaatttgacttttaaaaaatcttataagaattttcaaatgtaccccagagtatactggtataataaatcctcatgtattctcacccagctatgacagtcatcaatcatagccactcttgtttcccctgttatccccccttccactattattttgaagcaaattttagataccgtattatgaaatagaattacggtgcgtgaaatttgtcagcttggccttcctaccgatttgtatgtggatatattcttaatttcctgctttgaattgaagtttaccctttcatatttgatcaagtcagctttaattgtatcaagtgtcggtctactttaaattcctatcagtgatagtgaacttcattttatttaagactattagaaattttttgtcagtacatatttaaagcacagtgtggtggcttctaaagtaaggtgtccatcagggcagttgctagtgcttgttttaaaaaattaatttagaaatctgactggttaaatctgagtctgattttccctttttctttgaattttaggaaataaagttttatactctcttgtacctcagtgttgtttctgtgtgtggatgggtgttgggaggagctgggctgatttaagctagtcctgtccctgtatgcatgtacatttcatgcttgaggtttattggcttgaaaaagaccagaaactgtaggttaggatttttcctcttaaagcatattgagcagtcataggttgagcattttacaaagcatgcagataccctcctttgtgttttaataatcaaatgacaggcgtaagataactaagttcaacttgaatattaaaagctgtagtccatttcttctttatatgtttaatgactatatagttatttggctaaattaatttttttctgtgcttaagttaatttttgtacaatttatgtccatatttgcttggaaccttagcgcaatatttgagccagaagacttgcaaagcttgagctaaatgaaataaaattgttggcattaaaggaaagctaacaactttgaagttttaaaatctctgatggtttgagtataagaaatgactccattggatgaggtgaggtaattccaagatacagggtactgataatactaaacgtaccttgatgactaattaagcagtttctgagtataggtattatgctgtaaaaccaaactggaaatggactatccatggagcatagtgtatagctgagttatcaatgaaaatgttaattcgtatgattaatttttaaaaagcattatatgtattaatttgaaattctttgctgttaaggttttggaatgtgtgtttgaatccaaatgtgattggagtatgtaataatgggtattcttagaacatgctgaattgttttacttttttggagacagggtctttctctgttgaccaggctggagtgcagtggcgcgatcatggctcactgctgcctccaacctctcaggcttgggtgattcccgcctcagtctcccaagtagctggaaccacaggcatgtgccactatgtctggctaatttttgtattttttgagagacagtgtttcactctattgtccaggttggtctcgaactcctgggctcaagcgatccacctgccttggcctcccaaagtgctaggattacaggtgtgaaccactgttgcctggctgaacatgttaaattatagaagaaggaacttgaatgtaacttgatggatttagttgttcatatcttattggaaatgaggactttttggtagatatagttgagaaaacaactgatacctagcttgtgtaatgactctggctgaaacagagtttgacatcctaattgcctgttagaatcatttgggagtttttaaggacacaaagatctgagaccatttaaatcagagtctctggagttagggcactggtgctggtagattttaaaaactccactggcaattctgaagtttagctgtggttgaaaaccactggcgtaaaaagacatactccagaaatatttgaagtggaagagagtgagtacaaattattgtcttctttccttgatggtgttgtaaaatttatgtggtggaagttttgtcttttttttttttttttttttttaaactctaactccatcccactactgcctttctagaacttagaaagtactgcttttgatttctggggaaaagtatttttgcattttgtatccagaagaattgaagatgaggaatttttttttctcctgtggaggtaatgtttctactccttgtataccttatttttataatatccttactgagatataaattacataccataaagttaagacaatttaaagtgtatagttcagtggcttttagtaaattgacatagttgtgcaaccattattggaacatttacatcacctcagaaagagattctgtatcagcagttactcctcattccccccaacctgctcacccctaggaaaccattaatctactttttgtatcaatagatttgcctattttggatatttcacataagtggaatcatgtaatatgtggtcttttgtgatgggcttcttttacttaacataatgttttcaaagttcatccatgtagtagtatatattagtatttgtttttatggctgagtaccattccattgtgtggataataccacattttatttatccatttatcagttgatggatatttgggttgcttctacttttacctattatgaataatgttgctatgaacattcgtgtacaggttttcgtgtggacatgttttcatttctcttgggaaatactgggagtggaattacttagatacttccttcacctcatttgaacttcagggttagaaaatcttcccatagagttgggaagcaccgcgagtccatgttctaacgctatttttacactgtaggacagaggtccagtgtgtgttgtttggtcttgtggtccacaaggggcaaactcctcacttaaaagaaggaccagctgtttttccttgctgtgtttccaggaaagggtccacatagacttatattgaagttggaattttaatgaagcttttaaagcctcatccttttactcccttagttgttagggaaaagagcaaaatgtttgaactcttagtatctggaaaataataatggtaatcagacctgacatttgttgactgcttattctgtgccaggcactggacagctgaggctttttatgtctatgatcttatttaagcttcataacaacttgtagcaatgactgccattttactgatggagaaatggagacacataggttaaataacttgcatcagctcaaaacagctgggcagcaatgctgggttgtaagagtgactcactcttaccccgctgtactgtactgcctgccttcaaccagtatatcctaactcccttaggagacatataatcattgccatggaacttggtttgatttatcagaggttcatttataaaggaaattaacagttttcatgaatttattgttcaagtaaattgcagaggaataaaagcttaacttttataaaaatctgaagaaatgaatggttttaaaggagcttcttcatttaaattaattttagatccatctcatgtttgtaaggcacataacatgcagtgttactcgcctgcctccacctcccatgggcttgacttagactttttttttttttttttgagatggaatcttgctctgttgctcaggctggagtgcagtcgcctgatcttggctcattgcaacctccgcctcctgggtgtaagtgattctcctgtctcagcctcccgagtagctgggactacaggtatgcaccaccatgcctggctaaattttgtatttttagtagagatgggggttttgtcatgttggccaggctggtctcgaactcctgacctcaggtgatctgcccaccgtggccttccaaagtgctgggattacagttgtgagccactgcacctggccatatttttaaaagttctattttaattgacaaataataattgcatatgtttatggagtaagatgtgattttttccatacacatatgtgaagtgattaaatcagctaattaacatattaatcccctcaaatacataccacttctttgtggagagaatatttaaaatcctttttttttttttttttgctatggagtcttgctgtgttgtccaggctggagtgcagtggtgtgatctaggttcactgcaacctctgcctcctgggttcaagcgattctcccacctcagcctctggagtagctgggactacaggcgtgtgccaccttgcctagctaatttttgtatttttaatagagatggcgtttcaccatcttggcaaggctggtcgtgaactcctaacctcaagtgatccatccacctcagcctcccaaagtgttgggattacaggtgtgagccaccatgcccagcctaaaaatcccttcttttagctattttgaaataaacatgattctgtgattaccatgctatgtaatagatcaccagaacctattcttccgtctaactgaaactttgtacctttgaccaacatctcccctttccctatctaccctttaccccagtatcctctggtagccaccattgtactctctacttctatgagattaacatttctagattccatatacaagttaacatcatatgatatttggctttctgtgcctggcttatcatagttagcagaatgtcctctgtgtccatctgttgttgcaaataacaggatttcctgttttttaaagactgaatagtattccgttttatgtgtataccatattttaaaaatccgtgtcttggctgttgtggataatgctgtaaagaacgtggaagtgcagacatctctttgacatactgatttcaattcctttggatatgtatagccagaagtggaatggctggattgaatgataattctgttttcagttttttgaggaacctccatactgttttccataatggctgtactaatttacaataccaccaacagtgaacaggggttctcttttctccacatcccttgccaacacatactgtttttcatttttttaaataaccagtctaacaggtgtaaggtaataccttattgtggttttgatttgcatttctctgatgattagagatgttaagcatttttttcatgtacctgttgaccacttgtatgtcgtcttttgagaaatgtctattcaggtcctttccccattttaaaaatagggttacttgttttttattgagtagtttgaatttttttgtttgtttgtatattttggatattaaccccttatccaggccgggagtggtggctcacacctgtaatcccagcactttgtaaggtcttgttctttttttttttttttttttttttgagacagagcctccttctgtcgccaggctggagtgcagtggtgcgatctgtgctcactgcaacctctacctcctgggttcaagctattctgctgcctcagcctcccgagtagctgggactacaggcgcccgctaccatgcccggctaatttttatatttttagtagagacgggatttcactgtgttggccagaatggtattgatctcttgatctcatgatagacccacctcagcctcccaaagtgctgggattacaggcatgagccgccatgcctggcctactctatgccttttgattggggaatgtaatccatttacagagtaattattgataggtgaggacttaaccagtgccaattgttttctgtttatagatcctttgttctattcctcctctcttgcttgtgtgtgtgtgtatgttgtgtgtgtgtgtgtgtgtgtgtgtgtgtgtgtgtcttaatggctttctgtagtggtatgctttggattttatctttttatctcttgtctgtctgttacagacttttgctttgtggttaacttgaggcttacataaaacagcttatataacggtattttaagttgataacaacttaattttaattgcatacacaaactatacacttttacacccctttctcccatattttgtatttctgatgttatacttaaaatttttatataatatttattcccttaacaaattgttgcacttcagttgttaatagttttgccttttaacctttatactagagatataattgatttactcactgccattagagtattagaatgtttggatatgacaatgtatataccatgccctggcctggataaggggttaatatccaaaatatacaaaaaaagttttatactttaataaattttcatgttattaattagtgttctcttccttcagcttgaagaactccttttagcatttcctgtaatgcaggtctagtggtgataaagttagctattgattgaaaaagtctttatcatccatttggttttgaaatacagggttgctgggtatagtattcttggttggcagtttttttttctctctctttcttctctttctttttctttcttctctctcctctcctgccctgtcctgtccctgtctctctttcttttcttttccttccttccttcttttcttttcttttccttccttccttttcttttcttttcttttttttctatttttaaatatatcatcccactcccttctggcctgaaaggtttctgctgagaagctatctgatagtcttatggaggttcctttatacatggtgatatgcttttttcttgcagttttcaatactctgccattagtttttgacattttaattgtgatgtgtcttggtgggtctctttgaatttatcttatttggtgtcttttgggcttcctggatctagctttccatttccttccccagccttgggaatttttctgccattatttatttgaatatgttagttgttcttttctccttctggcacctgataatgcataagttgttctccatgatggtgtcccataagtctcttaagtcactctttttcattattttttctttttgctcctgagattagatggtttccagtgacctgtcttgtagtttactgatcctttcatctgcttgatctagtctgctgtcaaacccctatattgaatttttcagttcagttttggtatttttcagatctatgttttctcattgatactttttaatattttctgtctctttgtggaagttcttagtttgttcttgcattgctctcttgacctcggtgagcatctttgtgaccattatttggaatttcctgttgggtaaatcatatatctccagttcacttgagttggtttctgttgatttattttgttgcttttttttttttggaatatattttcctatttcttaattgttcttgactctctctgtgttggtttctgtgcattacgtgagacaactgcctctctcagtcttcttagccttgtgtagcagaaggatctcaccaatccatccagctagagattttaagataccttttaaatctttgtatttgttcagactgttgtctctattcttggtgccatattccattagtaccctgtgatcagtaaggcagaagccagatgcatagatgtagctgggaaggttgaggtgttgggtatgtgtcctagttccttctgtcatcatgttgaagtcaagtgcttgattcttccactctttctacactaagccatctctgtggcaaatgcctatgcttgtgttgtggctgcactctacgatcctggggagatatctgctggaagtgggcttgtagtatgtccacctctgttttctgtggtttagggagattcaggaatgcaaagccctgtcacttccagagcttaggttgtgaagggtacagtcccttgtctgtgtggagctataaaagtgtggcactcagtctgtggacaaactccttttaggaagaatgagtaggcctggaattatcagtgggatgtgctgggggaaaggctcaggatatgccaagttcctgctcaggctgcctgaggggtactgtttgtctcccccattagctctctgatgcaagttagaggccaggctgtcaagtagcgactggaagagtatgcagttataaaccctttttggagagaaaatgagagctgcatgttccagactcttttcttcactgctcccagggagtgtagccctagaaagtatttgcacacctgtttaaaaccacctccttgtttttttgatctagagagacatgcatatgcctagtctcttccattaccacatctaggagatttaggatatagtcctttgggtggatgctgtgcaaattgaggcatttgatgtgtggacagactccttctaggaggaattggtaggcctaaagttactgctggggcaggccagggggaaaggcttggaaagtgtccagctgctgcttaggctgccagaaggctacttttgcactgtcccattaactcccccatgcaagttaaaagccaggctgtcgagtagccactggtagactgtgccatgagccccttccagggagaaatgtggagcttcacattcttagctgcttctctgcactgcccccaaagggtgcagtccctgaaagtacttgcatgcttgattaaaagtatctctcttgttctagggatttagtgatctaggaagacttgcactagatccctcagctcccagagccaggagatttaggatgcaggcacttggatggaaattataaaagttggggtcttgatgtgtgaacagactcccagaaataaatttttgggatatagatgatgaaggtggcttgcagctagtcccaaaataaatacgttgaatgatagcagaagtcattttcagaaagtagacattagtttttcccatactgtgacattcaagccctctttgaagttcaatcgtgggtcaaattattataaatagattatagattatttaggactcacctataaaaccctttaggtgcaagataaatccttcttaagcttgatattttgttacagtaattgagctataaggagttctagtgtatttttgctttgagacacatacatgaacgcatggtacctttttagccctgttatttaatagcctgcttttctcatgtatgctgatgtgatcttcccctgctctccagataaacaggggtcacatgacgacagaagccaagagggctgcaaagatggaaaagaagatgaaaattttgcttgggggttaccagtctcgtgctatggggctcatgaaacagttgaatgacttatgggaccaaattgaacaggctcacttggagttacgcacttttgaagaactcaagaaacatgaagattctgctattccccggaggctagaggtaacgttatatattgaactgttgtttaaaaagagtgctgcaaagaattatcagggctgtcctcttttacttctcctatgtagactgtctctgaagttggtactgtcaggcttttaaaaatgagagcctaaagtgtttgactttctaatctagaattgcctctgtgtagatggatagaccaggcaagttgtagatacaaaggccttcccttactcattttctgtttccaatatgtagatacactgtgaaatggaatacttagcccttgtgatttgtccccttgaaacttaattgcatcccattcatgtagctcagtgaggggaaactaaaccagtatctttttgttttataccttatgttgctgggaacatagctagtccttccaaaccatcaaattcctatgaccaggtttggattgaatttatctcccaaatgtgcataatagctcctgtccagctaaagggcagtcagggcttcttgaagtgcatttgtgggtattgataagacagtagtggtttgtttatttgaagtagcagcaggatttcatatgaccaaatcaaagaatggctgtgatactggttttatagcaaaagtatttgatatgtttgtttctctttgagaaatatttaactcttaagaatcatgatttaactcagctggtttttaagataataaagtactgtagatttttttcagtatagttacatctaaaataattacttaattttttttctttaagtgtctaaaagaagacgttcagcgacaacaagaaagagaaaaggaacttcaacatagatatgctgatttgctgctggagaaagagactttaaagtcaaaattctgaagtacagtttatattctgtcacaggattaattaattgccggttttcatactctagaaggctgaaactgatgtttatcttcattgacaaatttacccaccatctgtggtttttcagttgtttattttaaatgatatcgatcttacacattctgtgtataaagaccttaactccacaggacggacattttagagtttaaattattaaggctatcattcttttagtaatgtcatatttgcaaacttttttagttttggcctttaatttaaaaagcctaattttaaagtgctgcctgtgagtaactcttgaataaaaacaaaatataaaaaattgagaatgtagccttttgtttgaagtaattagatacttaagagtgcctgcaaaccagcagctatgtactctgtgtcatatttaatgagtaactcttgggtaatcaaaatggtgatgcagtatcttaaacacttaagaggcagttctttgtggctttgttagtttcagcaaagagtggtcatttctgtatacactgacaagttagattaactttttagtacctcaaattttttttttgttaatatcactttaaagaaggtctcttgtctgccagctacttaaataatttatgggtcagggcttaaaagatttaacttccttgccccattattttcttataagtattttttgacaaaggcattttaaaagttaatttcaagaaggccatcaaacttaaagctctatgtttagcctaagaagtcagttacatcagtgtagaatttggggaatggatagaggtggagatatttaattttatataattcatataaattgatttagttacagtatcagttggctacaagctcattatagactagcaatgttttgacatcaccaaaaacgtttgcccagtcttagaatactagggactataggaagggaagggattcattcattcattcgatattgaatgtataccctgtgccagagtcttagagagagaacaacaaacaaaataggcctagttcttgtttagtagagcttatagtcttttgagaatgacagacaattaaaatccaaatgtttatttggtgattcttatgtgtcagacacttaagtgttgggagataagcagttattaagacagagttcttgctctcatggaggtgacattagtggggaggagatactaagtatgtccagggaaagtatcagaccatgagttttagattctgtggaggaaattaaagtagggtgattatgagatagtgaatgagtggctattttagactggacgatcaaagagacctcttggaaggcagctatgctcaccactataccactgcactgtgccgcaccgtaccactataagctgcacggccaaagagacctcttaaagaagtaacatttaagataacatgtgattgacattttagaatgggctatccttgtgagattcaaggaaagaacatcctaggtggagtgaatagcaaacataaagcctcttttgtatgtttgaggaacaaaaaggacaatgcagctagagtgtcaagaatggcatttctgtatataagacctcgttgtatagagccacataaataaggctataataaggaatttggatcttactttaaatatgataagaatcgatgagaagatctaagcaaaggaatgacatgatcagatttggttttagaaacatcactatctccttagtgtgtaaaatctcaccaggctggagatagggaagccagtccaattaggagcctgatgcagtgatccagacaaaaaaataatagtgattctaactagagtccaggtaatagtagtggagatatgtggagagacatgataggtatatacttaatagtcttatcagacgataaattgatattttcctggtgtgtagtcacttaattcaaatacttttttcagtaagttctgggttttctaggaaaaacttcagtatcatcagtgaataatgatagtgtttcttctgatagttttatttcacttttattgcatgttttgttatctgaaatgtttaggacaatgttaacaataatgatgttagacatttttttttcttattttaatgggaatgtccatagttttaagtttgctgttgggagttagatagtctttatctgaaagacagtgtctctcttttagtttttaaagagtttgaattagaaatggctctggaactttaaacagtataccatttgggcatctattaaagcattcatataattgttctcatttgatgttttgatgaggtatattaatagattttcccacattaaatcatctttgcactcctggaatcaggtagattaatttttaaaagaaattttaaaggatttatagtttatttgcactttttgtagacttgaattatatggatttaaaagttgatctaatattaataaaggctcactttgttttcaaaatttgaagtaattcacatacttatagcctaaaaaaatcggcaggaattacaaaatttcaaaactggcacattgtaaactgcatatgcatttgccaggtagtggtgccacttgaaatggtgaacagacacactgttatcctttgtcagtatcctgtaaagcccaggattctttaccagcaccatacagcgattttggtgactattttaacattcacactgaggccaggggtggtgagtcatgcctgtaatcctagcactttgggaggccaaggtgggaggatcatttgagctcaggagttcaagattagcctgggtaacatagtgagaccctgtctctattaaaaaataataataaaaataacattcacattggtattgttcactaaggtattggttgttaaggcattcattaaggtattgttaaaacttgtgttaagcatgttaaagtctcagtaactttgggatagaaataaaatgtgataaaaagctgaaagaaaccaccacaagggagagtcctttttgaaatattagagacataatgctgtctaataaaaaacgacatcaaagaaaaactacactacagtgactgcagacttaatgttggccaaccatgcatcctccctagaaatgcatttgaatttgatttactaatcttttatttaggaaatttacatttttacattagtgagattggtcttttgggctattgtacttttttttttttttttttgagatggagtc

SEQ ID NO: 37131 - DNA, 31118 bp, Homo sapiens
cgcacgtctctcctgagaactaccgagtaggtcgggcctgcctgtggtaagcgtccccctcacccctcatccctcatcccccccagcctggccccggaaccgagatgcccctgcccgagcctggctgcgggccggcaggtggccaagacgccactcggcgggcggcctgctgggcccggcggccggccagccgcgaactggaggatcctcgcgggcgcgtcccgggcctccgggccgcagggggccgctgtgacccgcctgcgcccctgccgcgccgaaggcggggagccgggttttgggggagaactggaaagccgagggtagccgagcggggcgggcgctctggagcggcgggtgctcgggctgccgtccgctccgccagaagcaccgagcagccgagccggggcccgccgccctcctcctccatgaggcccgagtgaggcgcggcggctatagccgacccgcggcgccttccccccgcgtcctatcgcgagcgcagcggcagcggcccctggaggaggaggcggaggaggaggagcatgtcggacggtttcgatcgggccccaggtgctggtcggggccggagccggggcctgggccgcggagggggcgggcctgagggcggcggtttcccgaacggagcggggcctgctgagcgggcgcggcaccagccgccgcaacccaaagccccgggcttcctgcagccaccgccgctgcgccagcccaggacgaccccgccgccaggggcccagtgcgaggtccccgccagcccccagcggccttcccggcccggggcgctcccaggtacggagcagctctaagggccccagtcctccttggcgaacgcttccccacggccctccacgcgtgccgaggcccgacgcgctgtctgcggtccccacccccggttccccgaaagcattccccgagagggccgcgtgaccgggtagggacgggcccggaaccgggtttggaaggtgtctgctggaatcctttgtgcgcctggctggggggaggggccgggtgcgcggtctcggagttcggggtcccgggaggaagtaaaaatcgcctcccctcagcagccctctaaagcgagaccctagcgagtaaccacctcttttccaccgacccctttaaaacgacagagaggaaaaaagctcgcaagcactcatttgagaggcaggtatgcccataacggagtcacagcaagtctattgttcctttttgtaggctgtctgtacacattccggcgataaccataaatttcatgatggttcctgtttaactcttaaaaacagacgcttttcagatggtttttcagtatatagcaagttgctgtacaaaggaaagaatgcatctgacgccccgtttttttttcttttgcagagcaaacgaggcccctgagagctccacctagttcacaggataaaatcccacagcagaactcggagtcagcaatggctaagccccaggtggttgtagctcctgtattaatgtctaagctgtctgtgaatgcccctgaattttacccttcaggttattcttccagttacacagtaagtacaccctttttcctacaactctgggttaatttactggaataatgtggttgttactttgttaatcagagtatgtttgtgctttctgtactacacgtaaaaaaatttttttattgtgaatgttttgaattattgaactcagaaggaaacaaagctgattcagaaatacattttgtagttatattcaaggtattagaatgtaagcttgagatacacatctgtgttcttgtttctagtgattattccattatgttaaaatagacatagttttgatcctaattattgtatgcagaaatgtcctacggggttgtgataaagtatttacataggtataaagaatgtttaaactttcagtttttctttgtcacttatataacaactttaaaaaatagtcacttttcttaaatagccgtacaaagcacagttggaatatgtagaaaggaatttgttgtactggataaacccagatgagtaaatgcatagggattaattatagagaagtgggagggaatcattggagaaatgattgatgatactttagcttaaatcctgtctttcctatcttcttagttttattgaagtatagcagagaatagtgtacttaagtgttagctcagtctcataaagtgaacactcaactaaccagcatcccagtcaggaaatagaacattatcaacatcccgaaaacccactctgtctccttccagttgttcttgatgtccaagtatagcactgttttgacttcataggatagttttgcctgtgttcaaagtttatataaataaagtcatatagaatatattctttctcactttcaatatcaagattactccatattgtagcatataattggaggtgacttatttttataacattccattgcatgaatatatcccatttgtctgttgatgaacgttggtagctttcactcttgggttattatgaatagggcacattttgtgtcttgctggctgtatgcctttatttctttttggtatattaccaaggtatggagttgctgggacttagggtagccagctttagcagagactgccaagtagttttccagagattgttccactgtacattctgagtagtgtatgatttccagttactctgcttcctggtcggcacttggtattttctgtttaaccattctggtgggcatatagtatctagttgtggttttaatttatatttcccttataactgataatgacacaccttttttattacctctttttggctctccttccatatttgacagtaaaagtatggaaaaagctgtgttccatgttttagatactccatgattcttatgctgtataggaaaaagctttgggattggaaagaaaaagatacaggcatagcaggaaaagcaattgatatggggtgaaaaaggccatctatcgtgtaaggtagaaatgagagcatcttgagttcttgccagaaaattgtatttagctcacagaggaaaagaaccattagagccactgtaagaggttgaataaactcttaaggatgcttgttctagcagctacaagcaggttcccatttattttcttccctattgacttgggctgttttatgatggagggatacaggggtgtgtttgtgtatgtaataatcgtgtatcaactatttttacgtggttcaagtgactttggggctgtcgagcagtatataaagtcatgttagtccacctactttgagccactgcatcttttaggcattccttgccatcctctaatagatcagcacctcctgtgctcaatttaccaaaacagattgcagcctggcacctggaaacctgtgtggcctgcaggtgtcttctctagccctgaatgggtttgttttttctttaagttgttttatttaattaaccaatacctaaattagatattagaaacttgaatgttctggtttgtcataaaatctggccttagtggactggcattttgatacagcaaaaattggttggagctgagtagaggcattctctttagatggagtctgtgagctctaatttgctttctggcttatttcattcatttgtaatctacctgaattctacaggcattcaggcttactacccctgttctggtatattctctagccttactggtttaccctaatctttacccatagttaaggctaagagagtttttctcaatccaattagtcatagaacagcaggatccttttttcccccgactcttaggataagctcttgttgcaaaggaaacatttccttttagtagccataatccaaagttagctacattcactcattcaacaaatagtcaagtacttatcatgagtcaagcaccggtgatacagcaacaaacaaaatggacagaaattcctgtcttcatggagtctctattctagtagtctcctggctcagtttgcagacatttattgaatctgcttttgttctacacatgaaaatctatttcctggtatcctttttctaacagcctttatggtagtcttctgctgtgctttcttaactctttcaaggcaccaagcccttttatcttcagttcttcctctaatcctgctgctagaatttcctactttccatgtcttcttaccagtgagttgctatatccatttatccctggccattatttcttctcagacaaaccattatgccttgaatatttgtcacagttcacttaccagagccaaaaatttaacataggaattcataaagcattgatgaagagacagaagtccccttcctcccctgcaaaaaaacgagctttttttctaagagaatccctcttcaagttacttcccagtttttgttctgccttgcagtagtatcattctccaataggtaaaattattcactgtctctcactgttcagacctctgcagtctgatctccctaattgtattgatactatttttgtgactgatgttcttccgatttttaaatttatcttcctaaatctcattttaaaactttgagcactgtaggatctattcagtttataaatccccatgtgccaggtcctgtgctaggtgcaaaggtacctttttagtctatcagaagctccctcccattgttttaagaactaagtatttgaggtactagttttgttcttttttctctctgagtataatctccttcactcccgagactctgcaatgataattctcttccagatttcaacctatgaatttattctgtagcatttgttgttatgagcatctcttctcccctacctctttggcttctgtggcagtactttatcctcccaacttgcagatcattccttttcccctcagatgacagttggtgacgttctttcttccattttattacctcctttgctaatcccgcctattccatagaatctatcacttatttatgtgctaataaccctgacatctaattattcctttgaactctagtgaactctaggcatacattttcatttatttgaccacttcttgaggacctcacattcaaatgcaagtataaaatctatacacagtgtaagaattatttatctcatgcgaatctcttctaactagctgcttacactaagaacttggtggcatattgactcacctctcctgcacacccttgccttaattcaatccagctagctaaagtagtcgtgactatattcactctctgtagtgtctgatcagttttcttttattcccacggttctgtaataggttctcatctcttgacaatgtatatagagtacctaccatgaaaaagtacattttctatttctcccaatctcccatagaattctaagaaaaataaaacttgaaaatatctctgtttggaagccatttgactccacattgaagactgaagaaatttgtggctttaaaaaatctggtgctagagaagtaatgcaggctttgattcaaacacgttggagtgcctgtctgttccaaatactctatgcctcctttttttgcttaaaatggcaggctctggatcctctgttctgctatattcagagcagttctactttcttcttttactgatcagattttacattttcttaaaagagagttctgttgactttaaaaaaaaaaaaaaaaagattgcaaatcagcgctctaagcagcatttttgccacgaagaatgacatttgatggaaacaggaaattagtactttcagctgggacccgtacctttgcctttctgctgttccttgtcattaatagtggtaggatactacaagtctgtaaaactagtaactgtatatcaaaaacttaagactagtttttagttataaaattcacgcatgtatgtagttaacattaagtatatgaatgtgtacaattatgcctaactgctttcacaactttataatgtcaatatttataatgggaacattttctcactctagaggtaagtactgttgtctcttgttttcttaaatggctataatattccattatacagatatatgataatgtatttaaccaattccttgttaatggattgttacgtggattttttggcaatgaacatctttgtacataaaattgggttttaagcttttgtcctttattttgagtttcacagagaggttaaaaatataggctttgttctgcgctcagttcttctaatcagttttgtgaccatgcacagtcacttaagttggtgcatggtccttccttgttcaaaccctctttcccccatcctgtttttcctacttccttaagagccagtttccttaatttggcccccaaagccctctaagatctccttatctgcctcattgacctcattagttaccacccatcctcagtttctgtattctagttattgtctttttcaaagttattaggcctccttggggcctgtgtgcttcttgtgcccatagaaagagaatatctttccttagatatttgtatggctggatctttttttctttcttagtttatatattaactctaagaatctctacttggctttttgcttttttttttttttttttttttgtagtatatttcaacttctgaatgtgtcttccatcatggggtatgagctccatgagaggagagccttgtctgctttattcatggcagatattcatgtcatggcagtatcccatcccctaagacagtctttggcacttagtaggtactcagcagccacaccattttgaatgaataaccaaagtgacttaactactctgtgcctgtttcttctatgcagggaggatagtgatgcttacctcaaaatgttctaggttaaacaagatgcaggcaaagcccttatggtgtctatcacatatcatatatgcagctggtggctattagcttattaactggagtaccatcctaggtgccaagaaatacagctttttatcattcattttggatgctttttatactttagtccctttatgtatgaatacatggctgttgcatttggaatatgactcagtattctcctagaaatttaaaatgtaattcatttgttgaacattctgtgctttactatgtgctcttcaccaatctaggtgaatttgattaattcacttaatcctcagagtcacagtgataatatttatgattagtaaataaatgcatcaacattaatacctcctattatagtagaatgtttaacttgaattcaaatgcgtgacaaaaatctaatgtattagagtttatccttctattcaatgaacactatatgtgaatgaaaaaggcacatgaatctgctatttctgcagctggttttacttcctgactgcctctcatagtacatgcaacttttgctaagtatcacttcagtctctgaagatacataggccgggcatggtggctctcgcctgtaatcccagcgctttgggaggccgagttgggtggatcatttgaggtcaggagtttgagaccatcctgatcaacatggtgaaaccccatctcctctaaaaatacaaaaaaaattagctgggcctggtggtacatgcctgtagtcccagctactctgggaggctgaggcaggagaattgcttgaacctgggaggcagaggttgcagtgagccaagatcttgccactgtactccagcctgggtgacagagcgagactccatctcaaaaataaaaataaaaaataaagataaaataaaaagtgtaaaacatgacctccaaatgatggttatttgaagtggtagcactatagtggtccattttcatgctgctgacaaagacatacccgagactgggaagaaaaagagatttaattggacttacagttccacaaggctgggaaagcctcagaatcatggcgggaggtgaaaggcacatcttacgtggccgcagcaagagaaaaatgaggaagaagcaaaagcggaaacccctgataaacccatcagatctcgtgagacgtattcactatgacaagaatagcaccggaaagactggccccattgattcagttacctccctcctgggtccctcccacaacacatgggaattctgggagatacaattcaagttgagatttaggtggggacacagccaaaccatatcaagcaccaacagtaaagggacaagtggacaattggcaatgttggtctttctcctaagactgtgtcctgggccaggcgcagtggcctgtaatcccagcactttgggaggccaaggtgggggaatcacctgaagtcagagtttgagaccagcctggccaacatggtgaaaccctgtctctactaaaaatacaaaaattagccaggcatggtggtgcatgcctgtaatcccagctacttgagaggctgaggtacaggaatagcttgaacccgggaggcggaggttgcagtgagccaagattgcaccactgcactccagcctgggcgacagaacaagactgtctcaaagaaaaaaaaagactgtctttctccaacatggagcatttctaagggtgttttgaccatgtatgactttttttttcttctatgcactcactgactttagaacttaaccccttcacaaaatgcttctgttttgtagtcataacttttttatgtggcttttcatttactctgtttggagaaggttaaatttcatacaagcagtgtagttattattagattttaactgtttggtaaactttaaagcgcttcgggtggtattccaggcattgagatgtgaaagttgttgctcaagtctattatcttttgtaaaactcgcccactcagccttctgccattaatgaaaaggttggaaactgccaaaggtgacagtggtggaaacaacattagctggaaactactgctgctatcaaggttgtgttagcaacctggatgtagcagccaaaaggtctccttccatttataccgtgatgaaattttagttactcgagcagctttatgcatttctttgcccttggggattaacagatgataaaccttattaggtttttgtttttgttttttttttccccaataaaaaagttgtcaacatttgcagaaatacagagaatggtataatgaatcctcatggcctcaacagtaagctacatgtggccgttcttgtttttatatccctagtccatacttcccctcccactttgaagcaaatcctagatcttatttcattcgtaagtggatcagattcttaatttttatattggcattgtagtgaaatattggtttaaactttattcctcagccatcttagaagttgacccagaatgagaagacaattccctgtttagctgaacagaacctttctgctgttaattataacacttcagcttttaggcaaggaagaaaaatagctcaattgacaattttattgatgaacataaatttttatcatgtgagggatctttaaaaaagcatttgtgctagagacataccaccttgtgtgttttagccagttgcatagattaaaattgttttttcatttttgatccgtaggaatcctatgaggatggttgtgaggattatcctactctatcagaatatgttcaggattttttgaatcatcttacagagcagcctggcagttttgaaactgaaattgaacagtttgcagagaccctgaatggttgtgttacaacagatgatgctttgcaagaacttgtggaactcatctatcaacaggtatgttggcttatagcatgcagtgaccttcagatagcttccttgaagcccaaggatagtggctactccttgagggagaccagattcatgatcacctgcctccacacttactctttatagtttccgggagttctaagtctgtcttgtataaaactcctatagttagggatccaagggtagagccagacaggattgcaagttcacatgtgtagtcaagattcaatataggtaatattcacctgtttagccaaagctctatacaagcagtatagtatagaaggtgatatgggcactgaaaacgaaggctacataagtgtcacccccaccaaaaccctgccccttgttttgcaggctctgaaattagcagtaccagaaaagactgcaattcttttcccctatgtgttgaattgaatagtagtattagagtaggggaggaaaaaaattgagagaatttgcttgcctcataagtaggtctttaaaaaaaagaaagccaaaccataaaatgtcttgtcttagcatttctacttgcctttgctttcttttaaaatttaaggatttcatcttaattccttgaaagtctaatttagtcagttgaaattgtttcattatacaacatttagtttttatcccagcatattggtcattaacatattaacgctttttttttttttttttttttttttttgatatggagtcttgccctgtctcccaggctggagtgcagtggcgcagtctcagctccctgcgacctccgtctcccgggttcaagcgattctcctgcgtcagtctcccaggtagctgagattacaggtgtgcaccaccatgcccagctaatttttgtatttttgatagagacagggttccaccgtgttgaccgggctggtctcgaactcctgaccgcaagtgatctgcttgccttggtctcccaaaatgctgggattttacagacatgagccgctgcacctggcctcattaatgctattttaaaagtgaaaaatacagtagacaacactggcttaacacaaaatttcttagtcagtgtgagactggtcaaaaaaaatgggccatgatcagaaatgtaaactttaggttctttaagtcactgttacaagagcaactcaaatttggaatatatggaagggagattataatgcaaattaatgattattttctatcctaatgtttcatttggctgcttttccaagttattctggatggttactggaccccaagattacctagccaactgtcagttttgaggaagtacctgagatgttaggaagacagaactgcactgtttgtcctcatttctgctttctgctgataaatggattgaaaaggaatatgagataagaaaatgaaacaaatgtatttatttcttgttgcctttctggcttcctccactatttagtttcagttattcagtaggctgcgtaattatacttattcagggctggacaaagggtcagtaacctgataagcgtcaactatttctctgattgtcaaatatgtagtcagtatgtttaatgttttaatattctatgatcaatgatgcataggtttatcaatagctgctaagtttcattgaggtaatttatggaaatttactcatagcaactaacaaacgaggaagtattacaaaagatgacagattaggccaggcgcagtggctcatgtctgtaatcccagcactttgggaggccgaggcgggtggatcacctgaggtcaggagttcaagaccagcctgaccaacatggagaaaccctgtctctactaaaaaaaaatacaaaattagctgggcttggtggtgcatgcctgtgatcccagctactcgggaggctgaggcaggagaatcgcttgaacccgggaggcggaggttgcagtgagccgagattgcgccactgcactccagcttgggcaacgagcgaaactctgaatcaaaaaaaaaaaaaatgacagattaaatacacattcaactctgatatctcccaaacaccactaaaatgatgctatggggatttttaaaaggcggaagctcatagggacagagaagaggaaaagaaaagcactagttttgaagactagaaagcaggtgggtgagtggtacctgatttggcagatctaacgttgaattccaagccagtggtggtaaagctgagaatcaccatgacttacagtgcaaaacctaaaaggttctaaaataaggatggaatgaggctaaaaggattgcttgagaatctaaaaagttagaccatccagatctttttacactgaacagccggtttgaaattttgttgtaacccttcttatgaaattaacaaaggacgtactctgtcaaaaagaggagttatgccacggatgaagacatgggaaccaggaaaaggaactctacaggagagactaagtgaactgtccagatgatggttcaaaggagatctcaaaacaatagcagcatgcatagtaggtctgaagcagccaggcttcactggactaggtcagaaggctccaggaaagacttccgtaataagatgagcacacatgctgtaagacataagaagaaatttacagagtagtgagtttagggataaatcaatgagaagaatataaaagtgtagtaaaaactgaatctagggaagacaaagttgtgcaaaagtaaaagcagtgtaatacatggttcagctataaatgaaaacacagcaaatgaataaaatcataaccatactgtgataggaggaaatagtagagtggggtgaaattaagcagggtgaaagctaaaagctcatcttccatgatgggaaactgtaagttgagtatcccgtatctgaaatgcttgagatttcaagcatttcagatggattttttcagatttagcatatccagtatataatgagacacctcagggagggtacctaagtatattacagctgaagggggttgacagggtcttttttcctttggggatgctgaataaattatgtgttgtacacctgtgttttgactgacctgtcacatgaggtcaggtgtggaattttccacttttggcattatgtggacactcatattttctgtttttggaggattttagatttttggacagggatgctcaagttgcagtaagaaataacatctaaactgaaaaattacgtagtgcggagatatggggattaaaacatttttggctgaagaagtcaaaagtggttgtctttgggagtaaaaccgggatgtaagtaggaaactgttgaatgacaagccttatagaacttgtctttaaatcgtgttataacactaaaaagaagctaaaggaaaacatgcagtgccaataatgggaaaaatgtaagggtgaaccaagtcttgggtaccagctaaacatacatgatgtcaggagaaatcactctttctcccttaatgtgacatatactggccccatgtgagcaaggaaataattagaaataaaagttagtaagtagacccaacatatagagtcagaggggtagcaggacatttgttagatctagattctatgttcaattacatttgtggccaagtcccttagctttttttttttttttttttttttttttaaaaagatgggggctttgttttgtcacccagactagagtgcagtggcgtgaccacagctcactgcagccttgaactcctacactcaagtgatccttccacctcagcctccagagtagctgggactacggtgcatgctaccgtgcccagctaattttaaaatttttttatagagatggtggtcacactgtgttgactaggctggtcttgaactcatggcctcaagcgatcctctggccttggccttccagagtactaggaatacaggcatgagccactgtgcccgacttcttaaccttttaatgtgtgttttcttacctaatattagatggtaaactatgttctctactattctttagaaattgcaattaaagttaaacttgctgaacactgcttcagttatatcaacaatctttgatgtgtagtgttttcttacttttttttttttctgtttttaagtagcttagctgttttcatttcccctttacccaatcattcttggagtgtttaagtgttagttgcttgtgccagttaccattaatcacctctttaaagtctaactgaagctcagggaggtttactgatgtccaaagtcatgaagcaaaatgccagggaatcttgtcctggactgccaaacactaaaaagtctgtgctttcctgccccaagaagccccactggtcaacagtttggcagtattctcattcataattgtcactgtgcagttgaggacatgtacaggttttctgcaaaaaatgggttagcatcaggagacattatctcttcgctttctggtagcctcaggtaactgatgggttttttctttttttttttttttttgtacttattgtggttcttgctgtaaggttgggagggaaagtgaatttaatttccttaagcctaacaatgacaaaagacttgtatatatggtcagtttggggagtcaattttttcttctttagaatgttgctgttaagtatttacattaataatgatgtacctatgtcatataacacttttcttctttttaaaaggccacatctatcccaaatttctcttatatgggagctcgcctgtgtaattacctgtcccatcatctgacaattagcccacagagtggcaacttccgccaattgctacttcaaaggtcagtgtaaatgtgaaattaaaggaaaactacttctaaatatactagaatttgaccattcctcagaccatatattataaaaagctgcaggaaagaatagggcagcctattcttatgtgcattatatttgaagtttatagttcagtataccagtcttttttctgtaatggtctgtgaatttggttttgtgtttagaaagatctttccttttccaagatcttaaaaataaacacttatgtaattcttattactttggtagctttggtttgaataaggatctaattttatttagattagaataaaagtgaataatccatttttccttattgatttgaattgccacttttatcacacttgcattatttgggttttgattctggattttcattccatttatcacttattctgttcctttttattaccatacaattcatacaatagctattaaaaagctttttttttttttttttgagatggagtctcactttgtctcccaggctggagtgcagcggcacgctcttggctcactgcaacctctgcctcccacaggttcaagtgattttcctgcctcagcctacccagtagctgggactacaggcacccgccaccatgcccggctaatttttgtatttttagtagagacgggtttcaccatgttggctaggctggtctcaaactcctgatctcatgtgatccacccacctcagcctcccaaagtgctgggattacaggcatgagccaccctgcactgccaaaagctatcatttttaaaaatatcttagggtaattagttttttgttcttttgtgggatttttttttttttttccgagaccgagtcttgctctgtcacccaggctggagtgcagtggctcagtcttggctcactgcaacctctacctctgaggctcaagcgattctcgtgcctcagcctccccagtagctgggatgatgggtgcgtaccaccatgcccagctaatttttgtatttttagtagagatggggttcaccatgttggccaggctggtctcgaactcctgacctcaagtgatccgcccacctcagcctcccaaagtgctgggattacaggcgtgagccaccacgcccagcctgtcaaatattctttgctatgcttgtttcgtctaatgaactttagaatcagtgtttgaaattacacaagtcttgctagtatgttagatattttggagataatactcaatttataagctaatttagagaaaactagttttcttataatttgatgtcttcagtaacaaggttatcttcaagtttattatagttcgtccattagttttttaagtgacttttaatgattgcaaagcattccattgtgtggttaaactgcagtggaacagaataaagattctagaagtagaccccagagacccttgaaaattcaagcttttgataaaaaggataaattgtgctggtagcataactggatagtcatttgggaaaaaaagatgagttcccatctcactctctgtgctgaaatcccaaatatgtcagagacttattaaaagtgaaatgataggtggggcacagtggctcatgcctgtaatcccagtactttgggaggctgaggtgggcggctcacgagttcaggagattgaggccatcctggctaacatggtgaaacctcatctttactaaaataacaaaaaaaaaccctaaaaatacaaaaaaaaaaaaaaaagctgggcgtggtggcgggtacctttagtcccagctacttgggaggctgaggcaggagaatggcgtgaacccgggaggcggagcttgcagtgagcagagatcgcgccactgcactccagcctgggtgacagccagactccgtatcaaaaataataataataatgaaaatacttggaatagcgccaaatagatatagatacagtttggaaaaatacaaatgtcaaagttataaaaagatatctaaccatacttataattaaagaaacacaaattatagcttctgtaaagattcagagtgggtacttgtaggcggtaggacgccaggaatgctcactcatatttttcagtgcttctcacccccggctgtgccttagagttacctagatacttaaagccgagatcctgtctgaaccctttgaaattctggtgtaattagacgaggtggagctaggacatggttttttaaagcttcccaagtgattctactgtatagctatgattgagacccactcttctcattgactgttacccaccatatgtgcttctgtagtactgtaatcctgtcaataataatgtagagaaatactagtgagctaacaagtaaaaagcaaagcataattctgctacctctttaaaaaatatatacatactttgaaaaagatggaacggaagttaccttcacagcagttatctcttgtttttagtagtagtgcaggtgactttgttctttatactttttctgttttaacctttccaaaataaacatacattgcttttataattgaaaatctttagcttaaaaatttgacttttcacctagtcaattatgtaggtatttgtttgcatgtacataatcatatcctaacgtacagtctgtcatagcattttatgaaaaaaaaagttatttcatcaactcttaccgacaaagttgtaacagaaaagcagccaacaggtgtttttaaataactgatttggcattaattaactgatctcttccattattaaccagaatgtactatctataaatatcccaacttttttctgatgaggaatttaatatgtacaagatgataacaaatatcttaccacatttgacttaaacagaagatgttgctcagttaatatacctcgtaaacattggaattggccacgtaagcacagtaagctgtgctggggtttcgtggttggcaaactgacccagagtcaattactgaacaagaggtaatttattttttctttgttaaaaattgtttacaaagtcaacctaaactggctgcgtggaaaccattcagtacccatagcttttccctttgtcttgaaaaggaaaactgtcaaaaccagttttgtgaagcaagttactttcccagagttttctcaccttatcaataaagattacaaatacttaataacaaaatgataaacttttacagtccatttaaaaaatctatgttagtaacaatatctgacactgtagttcacttatgaaggcagtgacaggattattgtgcctagtttagttaccttgtaggaactatgactgacaataagctccaagaagaggatttcttctttttctcctctgtgtgaagcaaatgggtcaagtcaggggcaaagagagcaaggaaaaatcagttatttgaagctgtcagtctcattggaaatagaaaacaagtccggtgctttctatattgtggttttaatgggggaattttttcctcacattagtacttctctgatacgtataatggaaattacaagaataatggacttaaaaacaattcattttattttcagttggaggttgtgtgtgtgtgtgtgtgtgtgtgtgtgtgtgtgtatttaaagatccttttcaaagttgtagtattaaaaaaaaaattacagagacaatttgggtaaaatcagtgctttcttagtaaaaaacctataagacaaggtgaggctctctctcccctctttgggctgccagtatgctgtgaatcagattacacctatgttgcttaaacatattaaatttgataaaaatcgttgaaaataaaactatcagttttttcaaactgggagacttagtatgaaaagatggtgtatattctagcctcttcaatagtcaggaacagtttctttattgtagaaagagcattgggacattgtccttgcctcttgctgtggacaaccaaactgacaaatggttattttgtttgactatttaaaaagcaaagcaatgtgagattataaaagatatgtctttaattagatgtcggactgaatatgaagttaaagatcaagctgcaaaaggggatgaagttactcgaaaacgatttcatgcatttgtactctttctgggagaactttatcttaacctggaggtgagaagtttttcttttgttaagtactaacaaggcctgagaacataagttgatctcaatgaggaatttgtgttcacattgtacttttacaacattaagagtgaaatgaaagagagaggaaagaaaacatgtttcggcacctgctagtgtctgtggtttactggaccgtctgtccataacatttactcatggacagaatgttaggaaataattactgaggtaaaaatctgcgtacttttaggaagctgtggtttacatgcaaatttaagttcttgagatatcaacagtgatacctttttgagttcttacatcttatatattaatacatttagtatgttgactttcagatggtggctcaaagcagtttactctgcagaactctgagtgaaaagagagactagagtctctctaggcttttcactctaattcacccaaatagttttttaaaaatatttttttaattgacaaaaattatatctttatggtacacaacactttgatatatgcatacatcgtagaatggctaaatcaagctatttaacatatgcattacttgacatacttttttgtgttaagaacacttaaaatttttagcagttttcatgtatacaatatattgttaactatagtcatcatggtgtacaagagatctcttgaacttattccccctaaatgaaattctgtgtcctttgaccaacatctccccaataccccaacccctaagaatagttcttttttgtcctattttatatattaatcttccacataaaaatgcatttgtacaaagtctacagctaaacgtatttataaatttgggtggtatacttaagtatatgcttgttagtaggcaatagaagtgctggattcagcacggcattattactgtgtaatagatttgcttgattttttttttttttttttttttttgggtggggacagtctcgctctgtcacccaggctggagtgcagtgacgtgatctcggctcactacaacctccgcctcccgggttcaagcgattctcctgcttcagccttctgagcagctgggattacaggcacgtaccactatgcctggctaatgtttatatttttagcagagatggggtttcaccatgttggccacgctggtctcaaactcctgacctcaggtgctacccgcctcagcctcccagagtgctgggattacaggcatgagccaccatgcccagcctctgcttgattttttaaattagtgaatatcagatataagcttataccttcttacaccctgatttgagaacttaagatcgtaaacgccataatatcagaaacatcataagacaatgtgaatctatcaaatgtgcatctcagtcattgtatctaaaaggtctatgtccagtccagagcctaacttactatgcctttttaccacaggtagacttagttttttgaaaaatcttatgccatgttctttttcagtctaatttttgtttaagccaaaatatggacagcaatctaaaataaatactgttgagcattttctatatggagataatgatgctaggtcaatgggggatgtaaagataaggcttagttcctgcacctaaaattcttctacacagtgatataagatacatataccactctgatgcaaaataccatattttaaaatattttaaaagcagaataaaatgctgtgtgttcaaaaaaaagtggtagttgaacaaactaaagaaagctttatgaagtagtaacatcaaagtgggcttaaattatgctgactctggtattaaattttacccatagcttaccagttttattagaggtcttagttacatataaagtaattctaacaaattctgtgaagatatcagagtgtgttcctgtgacttttgtgatttagctaaaatgcttattttgccaacaccttgttagttcatttatgtatctgtattatattttggcatcattccttttgttcttttttttggtcccgaaagatcaagggaacaaatggacaggttacaagagcagatattcttcaggttggtcttcgagaattgctgaatgccctgttttctaatcctatggatgacaatttaatttgtgcagtaaaattgttaaaggtaggtttttttttttaatttaactaatttacgtatttacttatgatttagaggaaggttagtctatatagtatacagatgaattcaagatttatcactttaaggtaaatattgacattttacttttttctcgaatattttggaaaagcgagatatacttattgtttaatatatgaagcaagttcagaagtgaaaaatggaagtcctttacgccatttccatttgcaaattctgtcttcttcccttcttatctctgtatatgtgctcttattaaataagatcttactctgttctggctttttgtttttgtttttgccacctaatgaaacatcttagatttttccatggcacagagatttacctcttttattgaataacttcctagtattctgtcatatgcatatgcattgtttatccattccgtaacatctatcaatgtttactaatgaatatttggattatcttcagtttagccatggcagcattgcttgtaatctttcctcttgtcatatatatgtgcagatacttttgtaggttaaattcttaaacacggatttggtgggtggacgagcatatgtattttacgacaagtaatggctaatttgccttccaaatgctgaaccagagtatagccccatcagcagaatgagtacatctcttcctacatccttatagtgatggatataatcaatcttggtttttgttttgtcagatgattttaagcatttcttcatgtttattagccatttgtttattatttcctataaattacctgtttaaatccttaactgatttatttcctgatgaaatgcatgtttgtgttttttttttttattcaaagcttctatacttgttgcttgctgtatatttcaaaaaaagtgacatgttcattaaaatctaatagcctatcttagtcatacagggaatataacagtcgttgacataaaacccatgattaaagttctgctattgttttttttgttttagtttctctcagtcaagagaaatatagagggcgtagagatcactgaatattagatggtagacagaataattaggaatattaaacttgctaaattcatcttgtttagagaatgcttgaactgttactggtatctttttagaatttctataatacactattgaatttcttattttactgacacctgcttttttagttgacaggatcagttttggaagatgcttggaaggaaaaaggaaagatggatatggaagaaattattcagagaattgaaaacgttgtcctagatgcaaactgcagtaggtaggaaaagaagtaatgtaaatagccagtgcatctcaatttcttgctttttctttggagattgttttttaatttgctatacttcagcagggtaagttgatggctaacggatatacaaaaatgcttttctttaaaggaataatattttacctatagtttctgctcactagacatttttgtgatagacgtgtcagatatttttgctcaattacatttagaaattgaaaaagctaattttcttaagatatgaattaaatgaaaaacaaaatccaaatattaactgtccaacaaataaaagtactactgtaagtatagtaggacacataaaaatgtttgaaggatagccactgcctttaaggtccatatagtcatagttacgtggaacataattcaaggctattttttttttaaatgaatttatgtcatataggaaacgtctagaaagtcaaggcatcagatgtacctgttaaattaaggaaataaagttttgggaatctgagatattttagggtctgacagcccttatggtggatacactaactcattttcaactttgtctacagagatgtaaaacagatgctcttgaagcttgtagaactccggtcaagtaactggggcagagtccatgcaacttcaacatatagagaagcaacaccagaaaatgatcctaactactttatggtatgccagtgtttatattttaagttttacttattgcttgaattccgttttggaaattagaagagctacataaagctgttctcagaattcagtgcctaataactgtcttcactggctttgagtgacatggcagccatcagactgggtaaaaaagaaaagagacctggaattctccagtgaaagggtggactagagaaagatatatccaatggcaagagagattgacaaggcttggacttaagtgagcacagggatgccaggaagcagcttttccagagaatttataaccaaggacctgcatctcagacttttactttgcatgttgtagtaacgaaaaataaaataaaattggttggctgggcgtagtggctcacacctgtaatcccagcgctttgggaggccaaggtgggcagatcacctgaggtcaggagttcaagaccagcctgaccaacgtggagaaaccccgtctctactaaaactacaaagtcagctgggcgtggcagtacttgcctgtaatcccagctactcgggaggctgaggcaggagaattgcttgaagcctggaggcagaggttgtggtgagctgaaatcacgccattgcactccagcccaggcaacaagagcacaactctgtctcagggaaaaaaaaaaaatggctactaggccagtgatgccctgaagctcctgacatgaacaaacataaagcagctgtggagaaatgttcctccagccctggtcctggaaattcttaaaagaaatggtggggttggaaaccacagctaaaaatgcactgacactaaatgacaatgcacaacagaacagttcactgaaagacaatagacagcaccgttagaaccacaagaacttgagataatggcatggaaatctgaaaaccatagactttctcagtgaagtgaaaatggctaccaggaagttaggttcctttgcttgttcttgcattattaggtgcagacgggtgacatcagccatgcttcattattgtacttacaaaaatcaattctgaaatgattacatatttttatcactttgattcatcctagaatgaaccaacattttatacatctgatggtgttcctttcactgcagctgatccaggtatgttgtctcacagtcattccctcctcccagttgtttggtaaagtagtaaatttacagaaaaccacatcctcaccagcacaagattgtaactttttgatgtcttcacatcattctaaaataccagtgtaatggtttgtctaatatagaatgctcttcatagtgaccacttgaaacatttcaaatgaaagtatgattccacatataatgtcttgtcacttaacaacagaggatgggaagaattctcaattaaatgcaactattttaattttatatttcctctaacttttttataatcttaaattttcaggtgattagaatggaggggaaagacgattctagttcactgcatagtcagcaacatatattaatatgggttaatactttacacgaagaattacacatttcattcatacttggtgtgtgacagttaattaaaatccaaatctctgcacatttcctcttccagaagaggaccatttatagaaagattgccttaattgtattagatggaactgtagagtgaggaagagaaatttttccctttggtacaaactgcaaccagcttatggttggaatttttccatttgtttcctctggattccaagcattgactgtcctgtgtctctagcacagagaagtttttttagggcaaggaagtagaattaagttacacgctatgggcatcttaaacttcactaaatgttactaaattgttttctagcatgattatgccacttaatcttcccatcagcagcacatgagggttcctgctcctcatctttggcaatactttttattaaacttaatttttgtccatcagattgtatgaaattctatcttgctgatattttatttccctgacaagtgatattgaagttttcttgttcttgttgacctttttgatttctttctttgagaattgcctgctaatactctttgttcatatttctgttggatcatttgtctgtcttactgatctgtaattccttttgtagtctagaacaaagtgattcttagctgagggttttggttaccttctttctctcagtatttgcctgtctttgcattttgtttataatgtcatgtagaacctttgagttttaatgtgaacaaaatttatcagtcttgtttgtaatttctgtggtttaagaaagtttccttaccatttctgttttcttctaaaaatcattgttcttttttatttttaggtctttaatctaccagtgcaatttttatataggatgatatcataggaattatcttttccattgcctgttgtctcaacaattggtattaagccatccttcctttcctagttataataagccccctttgttgtatactatgtaactcttctatcaaattgtgtcttattcctgtgtttgtgtgaatctttttttctgttaatctctttctatgccaatactacacttaaattatttttaccttactgtgaatcttgctatgtctggtaagacaaatctttcctcttattcttaaaaattaccttgatttattttgattatttgttttttattttttctaacctgtttaattgtttctagtactgttcgatttacagaaattcagtttggttgttcagtttcttttcaaggaaaagaagtaatgtagacagccagtagatctcagtttctttttcttaaacgttttttaatctgctatacttcatgaaagtaaaagaaatcttacagttttacagaaaaatcaagctaaattttgtttctgcattttgttcaaataatcttgaccttttctcagagtttcaagttattttttctcatcattctaaacatgcttacttctgtcttatatttttgttttatctcttaattataacccttctgttatttctgatcatcacacataaaatttttgccttaaccgtcttaaacttttatttggaaatgatttcaaacttacagaaaagttacaaaagtaaaattgtacaaggaataccttttacccaggtgtactttttgttaacagttacttgctttatcatttgtgctctttccacacacttttctttttttctctttttttttttttttttttttgagacagagtctcactctgttacccaggctggggtgcggtgatgcaacctcggcttactgcaacctccacctcctgagttcaagcaattctcctgcctcagcctcccaagtagctgggattacaggcctgtgccaccacgcctggctaattttgtattttttttttttttttattgagacagggtttcaccatgttggtcaggctggtcttgacttcctgaccttgtccacacactttttttttttttcttaaaccatttgaagtttcatattaatatgaccctgattaaatgcttcagtgctttgtcttttttcttttttcttttttcattttttttttaatgaaaaacactgtggcttggattataggaacctctgtccaaaatggtttatatttccttctgccaggagccacagagtaggtatcactgacttggacaaattttttgttttcttgtcataggggttctttatgtgggtagtaggaatttgaggtgcaggcccattgttaaaaattctctggggcaccaatttctacaaagtgctctgtccctattccaaacccaggcagacatgaccaagcttcctgctatctcgcagggaagataaaataccactgagatatttcttggtcttttttcctgattcaccttttgtttaagataccagacctttgagggtcccaggtttgtgcaggtgaggttgggcatggagcatggatttcattttcctgtttcacatggggcccaagaccttgctttctggctttctgtgggttttaaaatccaagccccttagttaccgagaccaacatcatctgtcagcctcccagctgcagcagctgcagtttatatatggctttcagttccttcttcatttgtgacctgatgacttggattttcttttttgtgaacttatccatacatttaaaagaatgcctgtctttttgtagcaggaaggttttactgttaaaacggtctctaaattgtcaaaattgggtatcaaaatgtccccagcccttgaagctggagttacggttttatacagactgacacagtcttggaagaacatggcttttacccagtctaatataattgcaaaatttccgttggcttctgttcataagaaactataaggtaactagtcttaatatatactgattcatttttttattcagaggttaggacttcataaagaaatacttaacttaaaaggtacccaataactcttcctaagacaattggcagataggtgtaatatcacctgtattaccttggaggacccaatgaaaggaaagttggcagagctgaaacgtttaccaggtagctgccttccccatctctctgggaagaaagggaaggaaaatcccccattgttaaaacttttggtaggttaacttcatctgaggaacagagaccaattgttgttacctgctttctttacttccttgtggaggagtacagagggagctggaaaccagtagtatttgattaatatctttccaatggaaggactgttcttccccaacagttatataaccattattttgtctgatggaaagcagcagtagaggatataaacacattggctatgaatgtacatcacctacagtggctttgatttccaacttatatctatagtactatatgtaattactttaagatttctgagcatgcaggggggcaaaagtcataatattaaaaaacatttaggggtgattggtcatttcatgtgatattttttcagtatttagtttttctcctatgttgtcttacagattaccaagagaaataccaagaattacttgaaagagaggacttttttccagattatgaagaaaatggaacagatttatccggggctggtgatccgtaagttttcttcagttactaacttcgtgaaatttctgtgtctaatttataggtggagattagacaaagtagctcatgaaggaatggtgtttggggccaggcgcagtggctcgtgcctgtaatcccaacactttgggaggctgaggagggcagatcacttgaggccaagagttcaagaccagcctggccaacatggcgaaaccctgtctctactaaaagtacaaaaattagccaggatcacagaatcacagctactcgggaggctgaggcacaagaattgcttgaacttggaaggcagaggttgcagtgagccgagatcgtgccactgcactccagcttgggagacataactagattctgtctcaaaaaaaaaaaaggcattttgatttgatggtgctatgtggtagtgtttatgtactaaaaattttcagaaaattgtattaactcacagactagttctgaaaaatgtatagttgaggaaaataaccattaaaatatagtatacttaagcataattatttttttaaaatagattctattgtatttagactttaagaagctctaaaacttactgtaagatcttgggcaacttctgttctgcttctccatctataaaataagaatagtagtacctgttgagtcttttttttttttttcttgagaactacatgagaatacataaatacttagccttccggcacacagtagaaggctcaaatcttagctattaaagggtaagttaagagtaaagaaaacagattactatgtaaaaatgtttgaactgataagaagatgttaattataggactgtttatatatctgtttcttcacctgccactctttgtaattaaagatccctttaaacatattactcacttaccatcagagtgcactacattttcttatagaaggaccaggaaattgtgaggtttagtaccaattctgttaacaacttgtgtatatttggacaggctacttagtttcttttcttcctaagtaggagatgggagggaataaattatatcttgaacttattttttttttaatatctcctgtgttgtagatttttttaaaaaagtgaaccacttttattctagtgatattttaattatgtgtcggtttgagatctagaaatacaattgttgctgtacttctatattctagtttaatagaaaacaaaaaaaatacagggatttaaggacccaggcagaactaggaaagttccatctacttgggtataccgctggaagataaagttgttcttggcattgaacttcaggttatcctcttaagtttatttggtaagcatcatattctcttgccctaatgagctcatggttatttcaacacatggccctgtattggaaatggggaagaaacagaaaaggactcatcagcagttggtagggttggcaagattgttttttcatgcttgtaggtggaagggattggattattggaggggtggggaagatgttgatagaatcatgttatggaggaaaaggggtaagacctggagtcaaattctggccccgccacacacttaaaattttacattgttcatttaaccttccagaatctctttattttccatctccaaaatgaagatgatcgtaatgcatatctttttaagatggctatggacattcagtaagaatgtgtagattaaatccttaattgacactttaaatctttcccgccatacttaactatgggaagccttgctttccaccattttaaactacctaatagttggaaaaaaatctggaatagatgatctcaaaagtagcttcctgtgaaaatctgattccaaataaatgggaatgtgactaaattgtcatcatgggaataacccagcagaaatcatagcaggaatagcactttctgttattaagtagacacaaaatattagtgcatcactagaggtgaatggcatatttgaaattatgttctattaatagttatattctaattgtttgttggtaaggtaaatttattaatatcgatcttgagccccaagtttatatgtcaagcctttgattaactttcaggttatagaatttaacttatgtctaaaagtatatatattctttactataatttcacacacaagggactcagaatctgtaaaattttacttaccaaattaagcatttggttgtccgaagactgccattaatgtaattctaaagttaggcttgtgttctattataagtcagtctaggaaagttgtattacattatttttttcatgatttagcatcttactttctgagttgaaaaaccttacacttatgaatcatctttgcttttacagatacttggatgatattgatgatgagatggacccagagatagaagaagcttatgaaaagttttgtttggaatcagagcgtaagcgaaaacagtaaagttaaatttcagcatatcagttttataaagcagtttaggtatggtgatttagcagaacacaagagagcaagaaaatgtcacatctataccaaattaaggatgttgagttatgttactaatgtatgcaactttaattttgtttaacactatctgccaaaataaactttattccctataacttaaaatgtgtatatatatataatagtttattatgtacagttaattctactgttttggctgcaataaaatcgattttgaaataaatgaaatgttgaaaattttgctagttggttagatgcttatcctttaaattctacttttcttgaggggaaaaagtcttcttctggaaatacatattactgcaaaaatgtagcatccttttttaggtaggagtattatagctttcattttagtttgacatttagtgtcccaatgaattgaatttcaaatatgaatcataatcttgaaaatctttagcactaaagtcttggaatatatcaacaactgatttacatatgcagatgctatttgataccaagggctttttaaatgtcatgggggggaaaaacccaacttggtgaactcccagctaaacaaccaagacttcactgaagatttattccaattctagaattgttcttttttatttttattttttcaactgactaacttcattaccttaaaggctagaacattattctgctttatttatatggctttctcacttttattttgtagcatgggttgcatcgacttttttactagagaattttactagatatttgtcattcaagttttcatctgctttataattgatacaccttgagggtcacttttctaatacttttactataatgtggtaccacctcagccctaataaataatatttttacctaatgtcaaatctttttccagctaactaaaaactgtgtacaaaaggattgcttgtaaatatgcatgtaaatagttctgttaataacccactgttttacatttggtacatctgtgtctgctaatacagttagctttctcacttttctgcttgtttgttcagtctgaattaaaattagactttgaaaataaagcttaaatagttgtttcctctaa

SEQ ID NO: 37132 - DNA, 60776 bp, Homo sapiens
atgccacagtagtgcctgtagcagagaaaggattccctcctccacctcagggcccactgctgctgctctccagcctgcagtttcctctaaggctctggattggctggaagagcaacagagggctgggaaagagcttctatatatacctcaggaggaaaggcatcccagacagttttgaagttttcaaagactggctctgctgttaagaagttgtacttaaagcggaggagctaagccacctgccaaaatgtgcaaaggacttgcagctttgccccactcatgcctggaaaggtgagaaccaagttatttttgtttaagagatgcagatatggagaatctttactcaagggaggctgcccagtggtaacagaggtattgtagtttatggctaagctgaggtgaaacaggtgcttgactgtagattgggtattatctcttctctgtaaacaatatagagattttgaaagatccaagctaggagattaatacaatatagagtatttcatacatcatttaatatccagaacatcatttccttcaaggagatgcctattctataagtccttatttagagtaaaaactgtatggttaaggatatagattccaacattaaactgtctagattagaaccctggctctactacttactatttgtgtaagtactatttgggcaatttatttaacctctatgtagctcagtttccttatctgtaaaatggagataccgagagttctctacctcacaggctggttatgaggactgaatgaattaatatatatgaagcactcagaaccatgtctggcacctagtagactgtataaatgttaatttttattaatgtacagggactgggagagggaggcaagtttgcagtgaggaagaggaaatttcccattgttctttgttctctgacctcattagatagaagtaactggatggctagacagagaaaaagcccttgggacacaggggttatttattagctagcattctttttcagacaaatgcatcaaaatctttgaggctccctggttgtccgtaggctggacaatattctggagagaatcctaggtatctaggctaagcaaatagaagaacaaatatcttacttgttagaaaacttaacccaaccatcctctctgatggagagaagtagggatgtttctccttttattgagaatggatttgattaaattgggtttgatccctcgttatttaaagtaaataaagaagatccttgcacagatgttcagccctaaaggcattagcagtgtttgtctcggaagattttattgtttaaagggccatctatgacttctgtctcttacaagttcaggtcttctttttgatgccttccactctagaaataacctaaaaataatttttaaggagataacattgtagcatataattttttctcccaacaatactatctagtaactgaatatgaaacctccagggagacttactctctgaattatggcttccaaacttttttttattatgatccatagtaagaaatatagtttacctaatgaccttgtgcatacttacatattgataattaaataaaagcatagaatattattattgttttttaaatttacataaaagaaacttgtagctgttaagttgtagaagttagattgtaaataagggatcaatattgtctattgtaccaaccctggggaagaggataggttttaaaggtggatactatttattgctattagcctgttctttcctcttacctagtatatagaaagcctaagaaatagggaaagttttctgtgcctttccagaaacgcacagaaaacttgaatatgggacaatgtataattatttcctttgccatttttgcaactatgagaattgcaacttgactttaatggatgcttttagcatacttattgtttgaaattgtgtactcttatgtagtgaataaatcttattaattggcaaacaattgactttagaatgattgtaacatcagtttgccaagcattttgtgattctatgacacattgcttggcatttggtgagaaatcaataaaatttctgttgaaaatttgccatgttaattattttgctctatgttttctcataagtatgcataatattcactgagatatatggatggaacatttctttcaatgattcctattactgtattatatctgattcactagcaacattaatattggatcactttattttttgatgcacagtaaattcttatgcaccaggatataactaatgttcatgtagaatattgaagagtggtgagtggtaaaggagtgagcttattttccccataggttgactgagtcttttatttattgggatgtggtagaatacgcaattattgtgagctattacatattgtttcataatctgttctcatcgtaaatagggtcattgtaatttctaattaccatgctgcctgagaagaatgttttggagaaatggaattgtggagctgtgaagctgttagtacttacccatggaaagggtctaacactgtctattctaaggggaaaatgacacttgaataaatgcttccaaacctgccttccatggctctattatctgactcccaccttcctcccccacacaggctcctgtctttgcatttcttctctccaagccacaaaaggaacatggatatgcttcaatgcttagataaaaatatttaaaaattcatataaaataaattagggcaacaaatacacattatgaaaaatctgctttaaatgaaaagctctgctgaagagttcagttctgacttccatatggcattagaaatataattcactttacaaaagtctgaatagcatatcattatttatcagagtggaaagagtactagttaaggagtaaggtgcagactcaattttgtcattatctgaatttgtgtccctgagcaaattatttcacttccccaggactctatttgctaatttaataggtaaaagttggattcattgttctctaacatgttttcgagttctaacctaatgtaaacgaagtgaggtacacttagtctcaatgactactaagagatgtgattaaaggaaaattttcctatttttctataaaagtttgagagcaggtggggcatggtggctcatgcctataatcctcgcactttgggaggctaaggcaggaagatcccttgaggacaggagtttgaggctgcagtgagtcatattgcaccactgtaccccaacctgggtaacagagcaagagcctgtctctaaaaatcaattaattaattaatttaacataaaaataaagtttgggaggaatgaagaatcaaataatgaaaaataatcaaggacccagccctgtgctgaaaccactgggccatggcagaagcaacctgctcagtgattctaatgctgatttataagaaagcaattataagaataatttgcttcctgtaaggggaattgtttttgacagcaactctttattagcaaagaatataaaataaacttttttttaaacaacaaaaagagaagtttttttccataagattaaagggtggaatatatataatgggtaaggatatccaaaaatctgccgcataaagtaagaaaatttcaacaattaacaaagattaacttttccatgacatgtaaggagaaatctaatcctagaaaatattcctttctgaatgtccagggaagctttcagccaaagtcaactttgatatatttgtataaactattctttatttatttagatttttaagactattgcttattgaaattttaagtaggactcgcatacttttatatgtttaaagaggcaaataattcaaacatttgggcaatgaataaccataagcacagagtttctaccctctggcatattgaaacctgtactatatgggtgagaatcttatactgtcaatgaaaaagaaaagagtcgcgtcaatttaataccttatttttacccatgattttcaagtttgaattttaggcttcttttgaaaatttattttattttcagagtctgttgaatttctctaaacaagtttaaattttaaagtaaatattgctctttgggaaaagatgaatgtattatgaaacaaaaaatgttactattggccaggcacattactcctgcctgtaatcccagcactttgggaggccaaggtgggaggatcacttgaggccaggagtttaagggcagcctgggcaacacagggagaccctgtctctaaaaacaaacaaacaaacaacaacaaaaaataaataaataaaaacaccacaaatattagccaggcacagtggatagcacctgtagtgccagctattcaggagctgaggtgagaggactgcttgagcccaggagtctgaggctatagtgagctatgattgctactattgcactccagcctgggtgcagagtgagaccccatctctgaaaaaagaggattattttaaaaaactgataatactaataattgaactggttgctttatgttatgatgacaactttgatttttaggcttaaaactgtgtgcttatggttattcattgcccaaaagtttggattatttgtttctttaaatatataaaagtatatgaggcctccttaaaattttaatgagcaatagtctcaaaaatctaaatatcatcataatataaaggaaccagtgcagttattagtattttaaagagctacaagccctttgctactctgggtgactggcatagatctgatttctgtttcagactgagaagggctaagggtataatgtgtttaatccacagttcacacaggggcttttggccatctcaagggtgtgtcaatgctaggaatttcagaagccataggaagtaaatgggaaaggtaattttcaaacatttattatttttaaatttattttaaatttttgtttttaaaaattttgtttttaaaatgtattattattttacaaaacaatcatttttttccccatgttctctgatttatgtgggtcaagtgtggacaatttagaatagaaaggcagctaataagcaggactactaatgaactaatctgaggttgttaaacctttaaaagcactagagtgagtcaaggttcctgggttttcaggattaataaattcaaaggcataagcacatccttgggctaattgtagagaaaaggcaagcaccaagtgaattaaagactggcaattagcttgaacaactgatagctcaattggaatgaattgaggaccatcaaagaaacctgagagaggtcctagcagagcttctggttgggtttaggatcatgcttgctgagaataagtatgaatttcaagcttactatacctgatattctagagatgtcattgaaagcattgtagtgaaactttagaatgttaagaaagtgaatgaactatttaataaaatttggagggggatcactaagaaaaacatttattttgattcctactgatgaaacaatatcagtgatttctctagattgcctttcaaacctgtgtacttgccttaggcatatggatgaaagacccatgccctgctcccatggaaatttaagcccagttagggagataaataagaaaaaattaatgctcagtgttgcaatccactacgaaggaatatatccataaagtgccaagaagcacagaagttggggtggtaggcggggcccctagagcttttagtgggcagggaagaatttacaaggttatacggatgatgcttgaagaaagtctaagaggacagaggagttagccaggtctagacaggaagaggagagagaaggaaggccatctaggtgaaggggacaggcctgtgtgtgcagagacccagagatgggcgggcacagccaatttggctgatgttgtgacatctatgtacaacctgtattatctctcagaggccagcaaggagggaaaccgctgagtttctaaccacagttaacctcctgggcagcaagtcctgcatatggttctctgggaacttctccagtgctcatctgttcccaactctgaggatggaagagatttattcaggggaaagatagtcctccccttcacctaaatgattttattactaaaaggatagactgtatttggtatagtagacaccaaataaacattttgttgaaggaatacatgaatgaagttacagcaaatagagacaagagcacttctaggacagcttggtatttcctctgctttccttgggtattggggagaccaagaacagtatcagtgttgacattttaggccacaatcggaaaaagagtgtgtgttgctaaataaagagaggtgcctgctatgggagaaggggagtggggattaggagaaaaagaaaagtgaaggagactgtctgcatttctataatgaggaaagccttgttaaagaggtgagtcttcttttggctgcaatgatggtatcccttaggtgagctctaggaagttgtactgcctgggctgttcctcatgcagttactgttgaagcttctttagtgaattgcattctgtattccagctagttgcccctttctattctttctttcatttagtctgggttatgctgaatcaccagatatcaattcataacacttttagatcccagaatcttacattttgaaacatcccagaaaggttatctaatttgtttctccttctctagcaaggactacacaatattacgggatagatgatatctagggagagagtttatttatgtctctggagccattgttaatggtttttgtctgtactgctggccagagagaaaaggggctaaattttaattaattcagtcaggatcagtcattagtaacaggaaccagaatatggctggaggccagaagataacagtttcctatctctttcctcccttaaagttctaatcagttctcagataacattgcatctgcactactttgaaggctgagtcacccagaggataaagacagtgaaagcctgattgtttctaacgatcgaggaagttactcttaagattacaggattcaggaataggaaagaaaatgttcacagtaaggaaggatgtgagctcacagtctctcccctgcctcaagaccagcgcttgaattgcagtgtggcggggtagaaagaacagtgctcataacttcctctatttcttccttactgtgtgaactttgggaagtcaccaaacctctctgaacttcattttctcagaagtgctaaaagaaataaatgaaatattatatttaaggtgactagtttttagtagaaggacccctattaaacaattattttccttttatctctcttttcccctttgtaggcagtgaaggaaacataatttaagtcagtcaattatgtgctaaggcctttgataaaacttactcctttttatccttcctcatcataacctcatcttttaaaaaaaaataaagataaattttaaaaatggtacagtatttaaaaaatactttatccataattttttcaatatatatatattttaaattattattgttacttttgtttcagtagtttttggggtacagttgatgtttggttacatgaataagttctttagtggtgatttctgaaatttcagggcacccttcacccaagcactgcaccctgtagcctataggcagtcttttatccctcatccccctttcacccttgccccctgattccccacagtccattatatcactcttattcctttgcatcctcatagcttagctcccacttataagtgagaacatgcaatatgtggttttccattcctgagttacttcacttagaatgatagcctccagctccatccaagttgctgcaaacgacattattccattcttatatacaacatggtatatgtataccacattgtctttatccactcactcactggtcgatgggcacgtaggttagttctatatctttgcaactgcaaatggtgctgctataaacataagtgtgcatatgtcttcatataatgacttcttttcctttgggcagacactggattgggattgctggatcaaatggtagttctacttttagttctttaaggaatccctatactgttttccatagaggttgtactaatttatattcccaccagcagtataaaagtgttccctttttaccacatccatgccaacatctattgttttttgactttttaattatcaacgtatatttcttcttacaaaacatatcaagtctttacaaaatgataaagctcattaaaaaccatgatcatacttaaaagttaacaataattctataattcattgaatatccggtaagaatcgaaatattttcaatgctcttttctcaattggattgtttgtattaggatccaaaaatgttcacacattgagatttcttaatcttatatctctctcagtcaataggcttcctgtttattctttctttgcaatttatttgaaaaacacagtctttttagacacaagtataagaggctatataacatgtgggaaaggtactagatagggaatacaggcacctgagctgtaacactggcttctactacctagtggaggataagtcatgtgccagttcccctctccaagtatcactattacatttgtaataggacgtgatcaattatatggtctgttatactccttccagctccaacactttcttattctgaattgggacaccatgtattttgagaaaatattccatttttattataatttcttatctcatctaagtcatataggaaggcctgggaaacaaactcctgaatgtagcttaaaagatgcaatcaattacatatgtgcaattttcttcccataatgtttaaaaatctcagtggactcaattaagaaccccatatttctttaaaagacttgtgataagttcagaatatactcccagtttgtgaaaagtatatattaatatgcagtggaaagtgattctgttttattttggtgaattctatgaagaaaaagggtggtctcggtttcttgtacaatttgaggatgaattagaatctgaatctaacagtgtatgatgcttgcactttatttacagttaacttcattttttcctcttcaagtgtataatgtcactgagggcaagataaaaaagtaaacacagacgcatgtgactttgggggtgtggcaccactgactacatttatactacactacattttctccagtgggaaagggtggcccactcctgcccttctgaatgttgcttagaggtaaacttgtcatttgccttaacagtggaaaagttttcatccttgaggatgggatgagaagggtatgtcagggtttccaggtctttacataattaaccaattttcatctgccatctgggtagatcatggagtactgacaattcttggaagtgctatgaagactgctgactgcataaatccatgtcaggcgtgtatatgctcagcaactgcaaattccaaccagattaggaacatatagtttgcctccagactaggcattagaaattgggtctttcctggaaaatctgtaggtgtgatcaacctaattataggatgcatgcattatcaacacagctaatccatgtgcgtttttaggcttatttaccctgaccatagagctcctgaaaagtccaaacagagtatttatttgcaaggcattccattcagttgccatgcctaggtagaataacttaacctgaatttttgttctccttcaaaaagaaaatatttcagtgtttaaaggaattggccaagcagcttttgaatactttggacagtagatacttgatgaccatgttggtttcatgaatagtaaatgaggctaagacctttattctatattctccatgttttccttcctaactgtttccccaggcgctgctcaaaacagcacctagcccatctggacagatcatttagagacttaaaactctacattctagaaagacattggaactatcatattagagtcagaagaagaaaagcaacacgaaataaagtacttgtaaaaatgtgaagtgctctcctttgcaagtgtttgttattattagcgaagtatgtggagctgttttggtcaagcttccactttttgatattttcttgtgccgaacatctgtttcttgatgaggcacttgtctatgggattcaggaagtttagaaagaatcaagatgttccattaaaaaatagcttcctgtattttggcaagttattttaagtgatagtttatgagagatatccagtgaatgggagtgtgagaccacataacctgtgtacttgggacaaggtcaacagtgcaggtcacactgaagactttcccagaggatctggtggtctgatgcttgctggatgacagactttcagagtcttaaatcttgcttctgaatcaccgaagtgcaaaacaagatgtcatttgaacacacacatgcatgtgcaggcatacacacttacacacatataccctcaatattgtttatgacttggataaaagatggattgtttgttgaaatcagagatttgtgcacacaaactgaaagtgtacctgggcctggtaggaagaaacatttttctttcacaaagatgaacgtagattgatgggaattttttccactttaaggcgaataggtcttttctatctccatagtttggattttatactaagtgggaaaaacaaactttttctctctcctcacacaacacttcacttctgacacccaatgtgtgggatttccccaccaagaaattctccaacattttgtaggcaccaagggtgtgttctacaattcaattcaactctgacactatctacttggagttaacgtcatatcccataggttaagggctcagccccacaagactgccccccacttcagatgccagttgtaagttcagctataaattggggtttcctgtaatcccttctttagcttcaataatttatataatgtctcataagacacgggaaaacatttttacttttactgatttatcgtaaaggctattgcaaaagatacagttgcaaaggatacagttgaacaaccaaatgaggaagtacatagagcaaggtatatgggaaggggcacagagcctctgtgacttcttcaggcacaccaccctcctagccccttgatgcatttttgttcaccaacccagaagctctctgaaccctgcattttagagatttttatgggggcttcattacttagtatatttgattattaactcaagcttcagcccctcttctctccccagaggaagctttgttgaaagctccaagcttctcatcatagtttggtttttctagtgaccaacccttatccaggaggccaccaagagttgcctcattagagcaaaacgtggtcctcttacccaggaatttccaagggatttaggagctctgtgtaaagaaccagggtcagaaaccaagtattagaataaaaggtgctcctagcaccattatcactcaggaaattagaagagttttagcaactttgtgccaagagtttatggccagagaccatgggttagactatggcataataagaaacgcactcatgaaggcagtaagccagcccttcacaccttcactgctcccattttagacaaccaatgtttcagttacttgtttcacttctccattaaactgttactctgaagaggatatctatctgctcattgttggacattacaggctatactgtgtgttccttggtctgaataaatgatggctggctacccaaattgctgcactatctttttttttttatagcattttgagcatttgcatctgacacttcataagcaaaacgcactctagggtcagtggctattcctgtcaagacccatttgtagccctccaaggctactggcgtcagtctcacttgccagctatgttcctgcccttcccacccaagaatctgccacatagccatcggcagtctctgtctcttttgctgacaaacaggacagttcttactggcattttgtttttcagagtgtgcaagaagagtatgtccagatttagtccatctctgccttgctgtagtactcccatgtccactcatttcatggacccaggtggccgtcacaggagagcacacagggatatatatatatatgtattgatccaatcacctttcaaacctgaaagggacttctgatggtcatcagcatgtcctactttaatgaaccccttgaattcccatagtcatttccataaagctgtgccccatgtgggtatccctttaatgggctaggcttccactgaccatatagccaggcaattggccactgcccatgagtcagtaaaaactgaaacacaggggctttcatcattgttaaattcttccgtcattgctaggaaaacaacatgcaattcagcccactgggctcacctgtttttatcttctttgataggagtgacagccttccaacaggatgctgtccatacaccgtggaactactgtccacaaaccaagtaactgttagtcagtcgagcactgtttatagggtattgtctaaatgatgatagagtttggcagctcctcacgcagttccatagtcagtcctaagggaaaaggggctccctgctggtatcttctccttgcattctccaggtagtatgatcttgtgtaagatcctgttcattttactatggaacttttccaggcactgccatccccattagagtgtttctctgatatcaccaagacaccatgggtatttcaggtttcaagattattttatgtccttcagttataaaggtagtttaaattaatgtccaatagcaagctaataattgaccctcaaatggaaattctctagtccaaaatcctcatagttgtcacggggaggcactcacaggcttttgctataagcctcagtctaagctctgtatagggctttcaaacaaagaatatgtgcattcagcctctactctatattgcttgggcttgagcaatcttattggttctaatttagtgtgttcaattagcattgtttggagagcagatttacatgtcttctgtgttacaatactaggtaggggaaatactccccagtcagagacaatgttgatccccataatataaccacttcacacagagcctgcttaaacattccaactttcataattctatcaaattcaaatattttcataactatcaaatttcaaattctatcaaatctcaagtttttctgttctctcaatttcattgtagcttaagtgaggactttaccagtgggttttggtaccacggtgcatgagactcctgtttctaggagctctggaaacttttcttctctactctctgaccatttacccactcatagcaaaaggctttgggttcccacaagggggtcaagcccagagaccctgacccctttattaatctttatctcaattgagtggtctaacttttgctccaagcaattgcaggtcatatttctccttgtaatcttagtcttctggctttttaaccttctccaaactggggtagatggaaggacttagttaaggtcctttaatcaccagagatcactttgacccacaccaactttgacagtgttgtattaagacccttgttttaaccccatcaatgtttgctttattcatcacacttcttaataaccctctaaaaattttatcgtgcttgcatgagtaccattttacgtctctttatttttctgtttattttgctccattgaatcacctaatgccttaataactttttgaacatttttaccttgttgggaagagttccttgactcttccttctgccctttgccatcctcttgttaactactcttatcgtttttattagcatatgtacaacccatgaggggaagccaagatagcaaattcaataaaacttcccagattgtcatttaattttgccacggtaagattatatggagtgcccatgcaaatggtgctttcttacccacagcatttaccatgtcctgggaatacaggcatattcagtgagtgaataacctgattatcacaagacagtcccacgtggcctgcactctaagcagaacagctgcttcatctgggctgttctacatggcatttatgtggggaaaggaagagttcatttcttgggatgacagaccttacaaccttacagtagcttttttttttttttttttttttgagatggggtctcgctctgttgccaggctggtatgtggtggtgcgatcttggctcactgcaacctctgtctcccaggtttaagcgattctcctgccacagcctcccaactaactgggactacaggctcgtgtcaccacgctaatttttgtatttttagtagagacggggtttcaccatgttggccaggatggtcttgatctcttgacctcatgatctgcctggctcggcctcccaaagtgctgggattacaggcgtgagccactacgcccagccacagtaacttttttctagttcgccaggttgcctcttccctcaggaataacctcctgtgtctctggatcctgttttaccatctgtgattatctcattttgagctgtgggtccagaatccaccccaaatccattttagtaaagattcttcaggaagctgatgataccaatctataaaatgaaggaactccttcacactatatgccctggtttcagcagttcctgggttgtgccctctccctgttgactatcttttgggtgaccagaggactcacaggtagttctgttgttctgcgtaatttttccttttgtgggtgcctttcaggatagtggctaaagctcagacaaacttatgcctgaacttggtccaacactgaggtctaacccagcactttgaatttagctattaaagataacaatgaccgtgggattgtatgtttagcatgcctcatcttagtttgtatttccttacatatccaatgaactagctcctcaggagtcagatctaccatcatttctaaactccattgataactctggcttttagtaactgagtgcagtgcagctgcagtttcatactatgtcggaaaaactctcctcaagccgtattttccgtctgctctcacaccaccacaacaatcatcaagaagacttctgcgacttctggaaaaactcccacacaccaagcagtggacaccagctgagagtcctccagttcaattccggcactatctatgcagagataacatcaaatcccacaggttgagggctcagtcccacaagaccactccccctaccagtggtaagtttgcacctccggaacttctgacaaactggcttcaagttaaggttcccaggacccctctttgggttcagttaatttgcgggagtggctcacagaactcagggaaacacttaacatttactggtttattataaaggatattggaaaggatacagaggaagagacactagggtgaggcatgggggagggggtgcggagttcctatgccctacctggtacaccatcctctgggaacctccaggtgtccagctatccggaagctccctgaacccacttctcttgggtttttatggaagcgtttcttctgccagcgtatgaggcgggacctgtcaggggagtgtcttaagacccacaatcacaaaggtgggagaagattagagtcctgcctgtgataggtgaaaggaaggctggaaagagattctgtttcctgaggcctaacacacccattatcacaaaagactgtaacaaaggctgagggagttatgaaccaggaactgtggacgaaaaccaatgtatatcataacaccacacatactatatgtgactagggggccatagccattctcatttagctggcaagattgagaaaaatgcaaataaggttttctcaaattctaatctgagggttaaaataacttttattttattttttaaaatttccctctaatctgttatcttctggacccactaagtatagctcagcttttatctcccttcctggtccagattgggccctgatgtttgtaattatgctgaaatgtgagtgcagatggctggagtgcagctgagggaaagggatacataactgccattagctacttatggaaaacattttattaaatggatactggctcgagagcatgaaaaagaaaagaataacaaagccagttgacaattatgacagactaggaatgagtgcctagcacaattttgatcacacagaggcatgtaataaaagtctattgaattcaattgatagattctgctccacatacggggtgtgatttttttcccctttctctaatatgaccagcttagaatcacagactgagaattgattcagggtaacggaccaattccttcttgtatagatgagaaaagaggtccaaattgttttggggacttgtctaaggtcacatagttgtgagtttgagcttatgcaaggcctctggatttacatttcatcttcattttattttatcagatgaacttttacttaagaattttggtcatatattcataattttgtctgtctttgctttttttcttttctttttctttttttttttttttttttgagacagagtctcgctctgtcgcccaggctggagtgcagtggtgtgatctcggctcactgcaagctctgcctcccaggttcacgccattctcctgcctcagcctcccgcgtagctaggaccctgtctttgcttttaagatatttattcttccattagcacatctttcacacagttttggttactacactgcaatctttaaaaagaaatggggctgggcgcagtggctcatgcctgtaataccagcactttgggaggccgaggtgggcagatcacgaggtaaggagttcaagaccagcctgaccaacatggtgaaaccccgtctctactaaaaatacaaaaattagccaggcgtggtggtgggcacctgtaatcccagctactcaggaggctgaggcagggaaattgcttgaacctagaggtagaggttgcaatgagccaagattgcaccactgcactccagcctgggtgacagagcaagactctatgtcaaaaaaaaaaaaaaaagaccttttttttctctatttctatttgccagatgcatataactgccagttagaataactgagcaactgagagaggtgatattgcatgataataattaaaagcccatatgctgacatgagaccaggttgaattatacctttatcattaccttgttttaaccccatcaatgtttgctttattacttggtgaatttgagcaaattatctaagttctctgtgaggtcacggggtcacagtaatacctgtctcataggattattgtgagcactaaataagtttatgcattgcatgtgttgagtgaaccatgcagttaactgagaaatgtgtggtttctcttaatgtttgctttttcttagttatcttcaggttgcaacaaccttgcagccaaacctcagaaaggatctagaacagggaactggaaagcatcaggaatcatcttcatctccctacagaggtgtaagaatgggactcccatgaaagggccccttgcaaggaacattagaaagtaaatgagacagctggatgacaggaggaaagagagaagggaggatcacagataaccaagttgagcctggggggttgagaggataactggactcttgatggaatatgattacgtgaaagggaagctatttgtagcagatgatgaattcattcttctgaactctcaccttgtcttttaggaatttttagatgatttcaagtcaaaagccctgatcttcctggacaattttatagttgttagttattaatttgatttaaaaaagcagccatgactcccatatgcaagactccagggaataattcataggtaacatagccataaaaatgaagcccactcacacccctctgcgtgtgtgtgtgtgtgtaaataaagactataggaccctgtcttgcctggtttgagcttttgggtttaggagagaaggagcaatattggaacaaatagctggttcaggagaggaagattagataaggctgagaaacagataattcaaaagaggttaaaagaattaggattatctattaactgaaaatagaatggtagaatgaggatcacagaacagtctgactggttttaagtctattttctatagttaactaagtttaaaaaacaaaagctaagtgaggtgtattagtttcgtatttgctgctataacagttgccacaagcttagtcacttaaagcaacatgaatccattctcatacagttctggaagtcagaaatcaaaaatggatccctagggctgcattcctcctggaggttctgggggaaattgatttatttgccttttctaacatctagaggccacctgcattccttgactcatgttacagccagcagtatagcattttttaatctttctgtctgatttcattgtcatattgccttcagacttgaccctcctgccttcttcttacaaggattcttgtaattatattgggccaacttagataatccaggataaattcccacttcaagatccttaacttatcacttctgcaaagtcccttctgccaccatggagggcgatttggggatataactttggccatctgacttgttcccctttctccttttatttctgtgtctatgccttgctaactcttcttctgtcacctagatactttttcatttaacagacattgttcttcccttttttttttttttttggagggatggggtggtcaggaaagcttcctaacactctctgtggcttctccaagttctcaggtctttttgtttcccttggtggtgtgttttataactgatggtctcctgtcacctgtgacttgcatttgaagtacataaaattacatttctatttgtttaaaatggttcatgtctacagtctagaaaagtgtactcagcctaaagacaccctgttgtcttgtggcaacagggtgaccttttgcttggttcctagactttgttgctccattaagcccagatctctgacttagagactcctattccagtaaccacacaatttaagggagtttctattctttagtcctcaacgtgcaagaaccacagggcagactgcattgctcattgggaggaaaaggaaggaatcatctaagaatgctgaggagaagttttcaggaatgtgatttgcatgtacctcgaaaacttatgtgaaatttttagaaaacttattagggaaatgtgaacttccatattaaacattggaaggaatcactggagagacgggagaaagacagaaagagggcgcctgctttgggatccaagccaataccatttccttctctggcatgcaaggtcccagcaagatctccctcagggagaagctatcccttcgttctataaactctcacagaacttttcaattattcttgtagtttatatcacttttactcaattttcctcaacttgtctgtgtatttgatattatctaatttaattcttagcataatcttccaaggtagatattatcaacattattattttaccagcgaataagttaaacatctggcccaaggacagaaaatgcactccataatcctgagtttaccttcaggtgtgctaattcaaaaccaagggctctttctgccatatcacagctgcatctcaataaaagcatctatacatgtctcctttgtaaaatgaaagcaatttcaggtcaggaataattgcttattaattttgtaaaacaaccccatagcatccagtaaagtgcctgacaaatggtggttgctctattaaaatctgacaagtaaatgaatacataaatgaattgaatgcatgaatcagtagattgttcctgaaaatagaaatcttgggaataataagtggctgttaaattttggggggagaaagaagaaatggtttgagatctaattctatgcttcagaaacagtcctcttattcctcattgttatgttattttcctcagcaaactcttttaaaaagctggcaaagataaatattgactaagtattgttgtttgtagtaatgaatttgtatcttttgtgtaaatgtattatgagaggacacattaaagttctgggaactgtagttttattaagtgatgtaatacatgttaatgtttattaagatctcaattaattttacatttctcctctttccctccctccttctccaataccttttactacccctttcatttatatttttgtggtatataaaatgagttactagtgccatgtacaataagaaactttcagtctataaagtcccgcagtataattcaaagcaggaggacatggagacactcaaagactttgaatgactgcagtgttcagaggagctctcatgggaatcccttctgacccctccacctttggaactcaaaataaaccataaatgcctgtcttccttgacctgaggacaattttcccactattcattatctggcttccaaaatgaattgccaaaagtccagccatcctgccaacaacatttggaataagatgggagaatttaaggtcaaagagaaataaactgtttctgtcttgttggtcttgtccttccactgtctccttccttacccccagtaacctactctgagggatagcatgtcagagacagcccagaaaagcatgggaaatatctcaatttccacgggaatccttgagtagggagtggccagtacttgggaaaaacaatactcttttaaaaactaaagtaaaatgacagcaccagggaggtgataatacaatgtaattgagctgaactaggcagcagtggaggtctccacacttgctttctttgtcactccataggagttcccaatgaagaggccagcagtgtatcttctctttgctatcagaattggttgcattattatgaggtggaaatcttctgaaaggagtttaccttgaatgctagtcaaatagatctttcttgagcctatcctatcctatcctatccatttatccattcaattaacatattattaatcaacacatacatgcaagatacggtgatagggataggacaaatatgatagtgacaataataataataggtaacatttattgagtatttataatactatacaccaagttccatgctaaacctattaatgcattaacttatttagcatcgcaacatatctatgagttagaaattctattatcaccatttttacatagaaaaatgaagggtcggaatttaaattaagggttggaatttaatttgtccaatgtcactctgctggtaagtaagagttggaatataaacccaagcagtgcggagctgtggtcttatcatctatgtcatcctaagagttaaagcaactttacggtacttagttatttttaaggttatttaaaataaccttccttggtcttccttggggagaccaaggaagtaagacaaggcacccatcctcaaggagcttgctatctaactgggagtacatacatatgggactcttaggtatacatttacaaaaagctagagtcattccgtgaaaacgtgctatccataacttgagaagaagaaatgtgttctgttctttgctctgtaacttactggccacgagaacttggaaacatcttttaatttctgtgaatctcagtttttccacttttaaaatggggggatgcaaattaaaagctccctgaggccccttaaatatgcctctgttttgtaattttatagtagataagagagaaagcagtctgggatggagtagttacagaggtttcaagaaaagagtgagacttgttctgatcctggagtattaaactggcatagaggtggagggagaaaaagatggtgtgcttgggagatactgaggagggcaacaggagtaggtgtacatgtggttgtggagaataatgggaaataaggttagcagctgaggatgttagaaggcagaaagtgatgtttgaagtagatatggtagatcagtggttctcaaagtgtggtcctgaaccagagatgtgaatcctcaaaccccacctcagacctcctgaatgaagaaaagccagaggcaaaggttgcataccatatgatcttatgtatatgagaaaaaacaaaactataaggatggagaacagatcagcggttgctagggataagaacaggggggcgggcgcggtggctcacgcctgtaataccagcactttgggaggcggaggcgggaggatcacgaggtcgggatatcgagaccatcctcgctaacgcggtgtaaccccgtctctactaaaaatacaaaaaattagccgggcgtagtgacgggcacctgtagtccaagctactcgggaggctgaggcaggagaatggcgtgaacccgggaggcgcagcttgcagtgagacgagattacaccactgcactccagcctgggcaacagagcgagactccgtctcaaaaaaaaaaaaaaaaaaaaaaaaaacagggtaagggctttattacaaaggggcagcatgagggaatttctggggtgacagaattgttctgtatcctaactgtagcaataatctgtgtgttaaaactcgcacaattgtacacccaaaaaacgtgggaataaagaaactttggggtggagcccagctctctgtgttttaaccaggcctccaagtgatttgggtgtacactgaagtttgagaactactgtggttaacacagagaaccattataggtgaggaggaaattgtctctgcaaggctggtctgatagggagtgctgaaggcactgcaataggaagaggaaaatgggcaggtgggatgttacagtaattcagacctggagaagggtggtaaatataggtatgaagaagcaaggacacatttaacaggatttccttgtctgggcgcagcggttcacacctgtaattccagcacttgaggaggccgaggcgggtggatcatctgagctcaggcatttgagaccagactgggcaacatggcaaaatgccatctctacaaaaaatattaatacaaaagttagaagaattggttgagcccaggaggtggaggctgcagtgagccaatatcatgccactgcactccaatctgggtgacagagtgagaccctgtctcaaaaaataaaaataaaaggattttctgggaagacagaaaaacacttgtgacagattagctattggcaatgaagaagaaagtctaaataatgtagattggagcatttataaattatgagagtaaggagaatattacagttacataaaaatgggatattgggaagaagggttgagtaaaaaggaatacatggtgccattcacaaggcattgaacacctcaggtccttgattgctctcatttatatagtaaatatattgaatgtgatcctcttgaaatcttaattttttatagctggaggagctattagaggttttctcactaaacttatttcctttctccctttctctttttctaccttttcttttttggcagaaaacaggagagctcaaataacatattcaagatcacccataaaagtactgactaagttgataataggatttagtcaagggcaaatcttttcctgttgtactgttttgttctgtttttctctatttccaattgttatgctctatgttacgttctatgttgacagctgtcatttttttctgttaataatctggacagtttccttcattggcacaggactttctgtaagtaataataataataaaccttgccacttatggagtaccatagtacatgtgctgggcactaatattagtgtttcacatatagtaactcacttaatcacaagaggcttatgaaatagataccattattatcttcattttacagatgagaaaactaaggcaaggtaaggtttaaaaacttgccaaaagtcacacatgtagtaagatgaatcggggcagtttgcctccaatatccaggccctttaccactatgtcattctgtctcttgctttaagaaaacaagagtttagttttggtattaattggattttctaagagttcaatgttccacttgactttctctctaggaacagtctttttaacgtgtatcgtatttgctttacaagcttccagttacataatctgagacaggatttttgccacagttgggagttggacattgtctctctcaaatgtggggaagatttaacacaattcaacacgttacttttgactgtagtaatagaatagggatctggaaagtatcttatgatattgcttggacagatccaggtggtcatatgacttagttatccaaaacagctggttgctagtcttttcttgatgacttttcttctgtaatggaaacttcaccacatttattgttcacgatttccatggtttcatcaccattttatggtaagttctcctgaacacttcctgtttaagtttaagcaatctttgtgtgtgtgtatgtgtgtgtgctggggtaggggcctttcatgcttatagatggctgggttttgaaaatttataaatgcatcattatttatcagtttcttgttcgaagcttcataatctcttgaagctagagccccttgtgtgggtttaggtatcgtcttggttaagggtaggaaccctggtgcttttaggatcaagtctcattaggcgtactacattgttgtacccttctgtgctcctaccacctccctggactcctgaaaatgcataagtggctagagaagatgaggatttgattagttatagaaccctaaatccctgtcctctgacattttctcagggattctctcttttccctatttttctgcttcttttatttatttatttttaaatttttaattttttaaaaattcttttgagacagagtctcccttttgttttctaggcccaagtgcagtggcaccatctcagttcactgcaacctccatctcccaagttcaagctattcttgtgcctcagcttccctagtagctgggactacaggcacgtaccaccacgcctggctaatttttttgtatttttagaagagacggcggggagtgttcaccatgttgtctaggctggtcttgaattcctgacctcaggtgatccacccgccttggcctcctaaagtgctgggatcacaggcatgagccaccatgctcaggctttctgtttctttctttgccactcatcaaacacagtagtctttcactccttctctctgggaacaagctggcgtatctcagtgattttggggttttggaaaacaaataccaaaatgggatactcttgtcaattatcatttgcttttgacgtcacaacacaactccctcagaggcaagaaagcatgaaatgcctggcaacagtctttaaagaggaaaaattacatgtggaggaatatatgcattaacacccgatacattaatatgtatttaagctattattattatctttaagagttgctacagatcacttgttttctgcgtgtttgccgtggagaggggtgactgcgtgatcatgggtggagtccttgcacctagattaaggaattgtatgattaaatgaaagtctggtgacctcatgtggtcctccacacttggatatatcagggatctgggagataaagtgtgtttctcccccaggtgactgaagaagaggatgcccaacaagtagggccaggtttatgaaagcaagaccaccctatgcataatgaaatccaactgtgccatactttttggacaaatacttattaacaagctcatgtaaaatgtttgtatgacttattctataatctcaataaagtcctagttctttctgccctgactacaccttgtatgaagggtttgctcagatacaataatattctaagctgggattctaatatcttttagttgatatcaggcaacaagaaatcttagcatcaatgtctggatagaggactttgtgggaatcaagccacaggtgccatctctaagggttaagagtgaattacattttcaaaacctttctatggaatgggtgggggtttccacaatagtgtcacaagtccaaataacttgaatattattgtgactggagagcccattatctaatgaacaagcctacgtgtaaacactcacttctagcacgcgtcctgctagttggcaaagcatctgatttcgatctctatagggatagctgaggcagctacagcagccacctttggagcatggtctttctaaagagtttgctgaccactgttgagatgtgaatgcttgattaggtcaagtagctgaattaactatgacatacatcatgtcatattgtagtgattacaaccagctaaaattttttatttcattgtttttcatttcttgttttgtatctgtcttgcccaatttaaacataaactcaatgagaggaccttatcttttttatttcgttgaaaatatcaaaacatattatagcgtacatcatgtggtaggcattcagtaaacatacttttaatttgttgaataaataagtgaacaaaaggagaggctgcacagggttttctttttctttttttcttttcttttttttttttgagactgagtttcactcttgttgcccagactggagtgcaatggcgtgatctcagctcaccacaacctccacctcctgggttcaagggattctcctgcctcagcctctggagtagctgggattgcaggcatgcaccaccactcatggctaattttgtatttttagtagagacggggtttcaccatgttggtcaggctggtgtcgaactcccaacctcaggtgatctgcccgccttgccctcccaaagtgatgggattacaggcgtgggccactgcacccggcctgcacaggcttttctctgtccaccatggtcctaagaaattaagtcagcttatttaaacaagaaccctgggagacttcctagtctgttactgcaggttacttgtgatggtcccttactgaaaatgagctaacctggggtagctgaggtaacagcttgaacataaaaatgaaaagagttgttattaagacaatctgctgaagggaaacgttagaacatatcaagagttgaaagggtataatagataaacgtgctttctgtgaatatatttgacacaaatgacattgtcagttccatcttttcagccatcttatagtttgaaggggcttattatgtaattaatcactaatatgagtgaaagcctaaaacactgctagggaatgattcacttgtgtttagaaacagagctttcatttctgaagtcatatcataacacattaatactactactactatatattccttagcattttcttcacctttttatcatttggagcacccgaggagtatttcatattaactaaccatagagtcattttccatcatgtatcatatattaattatataaatcaagtaagaaaataaatacatgttttaacatgatatcacactattactaaacttctctttcatatgctgttaaagcacaagcaatgagtgaattttctgtagttcaaactgaagtaggtaaattcagaaatagggtagatggtagatgccaaaatgatagattctttccaccacaatcacccggcactgcctttctctgcagttaagagtccatcttgattttaggggccatgctgaggatcctggcaagttgaggatttcagccccagaactgagccgactttccactagcatattcttatactcccgctaagggttttcaagatcatccattaccctgtctcggagccacctacaaggagcaaactccactgatatgaagttttaaatgagcagccaggaagaaagctgttccagctttcagcaaaatgcattctccctcttgataggcccgcgcagggaccctctgggccctcttccctctgtcagtctctgctgggttctacctctcagattagttctcagctgcacggaactcagaggagctcctctctcctctggtctctaatccggcaaatgtcttactctcggctgtggacattgacggctagcgagtgttttagaagcttgtgtttctctttcctgggtatctattccagacatgttctttttagtccgtggaaagaaacctcgtagtgtttcttcagaaggaagcagcctggaaccaatctgctctttgctcagttctttgctaatgctcacgccttcccacagccagcagggggcatctgcgacacggatttaaattgcattgaatttaaattggattatccgatgttaggacacctcttttggaaatgtgttgtaaaaatcttgccttatgcttctcaactctcctccctctcttcttccttctcgctgttcctgacatatgtctggcgtctacagcgaaacctgtttgtgattgccgaaagcctttcaaccacaggaatagcctatgccccagggctacttctgtttcttttaaatcctgaaaaattatggtcttataattgattcttttcagattgctagtgattgcaattatcctccctgcctcttctcatcagcatatgtcctatataatatgaggaactaaatgccccacttgaccattctcaatctctttcaaggacagaaattgaattcacttactttatagtgcttatagtcatttaatggtgttacctctgtccagttagcaaattagagacatcttagtcctccgtgactcattctaagctgcactccaatatttcacctactccaccccaaaatgcagctttactataacctagcaattcagttcattcattcatttgctcattcatcaatttacatggcaaatctttattgaatgctattaaatgccaggccctgtgctaagtgctgaagctgtaattgtgaactaaacaaatgttcactctgctcttggggacctgacactttaatgggagagatagacaatattcgcatatacatatacatatggagatataaatgccaattgaaaaatgccatgaatggaaaattcagagggctctgaggatatattaggagcagtttttaggtatataatatctcccattgcacattgggaagttagggctccttgaggttacagtctatgtttgtttgtttgtttatttatttatttagagatggagtcttgctctgttgtccaggctggagtgcagcggcatgatcttggcttactgcaacctccacctcctgggttcaagcaattctctgcctcagcctcccgagtagttgggattacaggtgcctgccaccacgcttggctaattttttttgtattttcagtagagatggggtttcaccatcttggccaggctggtcttgaatgcgtgacctcatgatccacccacctcggcctcctaaagtgctgggattacaggcatgagccactgtgccaggcctacgttcttttgtttttatactccacctaccttcatcagtgattggaaaaatatctgctatacagtttacatatatgtgttttatattcaattgttccaagtgtctctgaagcgagaaacaactctgtaacccttgaaacacctagtataagattttatatataattggttcttcacacattctggtggaatataattgtatttctcaaaatttaaccatgtttctgtttttagtgattgcttgtgctggttttccacacttatgcatcttaaggtgataacccattaaattcacgcactagcaggaaggactgaggtggtccgtggccttttgagttttgacttcccagccagccagcatacccacacagggagcagatttaaaactgcaaagccccagaattattcaaaccgttttcagtttggaatcactaatgtgagtcatctagacaaagaattatcttcctctgagcctttaattaaactttaactcaagcattttcaattgattttatttcaaaacaagtttttctttgtaaaacaaaagaataacaagaggaggaagagagatgacaggagataaaaatagtttcttgttaatgagcattaatgtaatgtggccaggaaaaaatgtctagtgtgcagtcaaatagagcccgagaccaagcaggaaattgtaaacaaattagaaaattatcttctctggatggtgttgtttttgatgccaaattaatgtcagatacattcaagtttatctataaagggaaaatagtttggtaagctggagctattgttttgtttgaatttttcatttggtttgttttattttcatatgtctgtgaggctatggtagggaggaaagggaaacgggggatgaaataatattccagggattcttgaggagtaaaacaaatctaacattatttagtcttgtgaaaagagtgcaatgtttaaagtgatttgaacttcagcatttctcagctcctcggcctttaaactttactgttgtatgagcagaaatgcaataacattagtcattccctgaacaatgaactcctaattaaatttaatagacttcacaacttaaatactcttaactttataatgctctatacttgagcctataccaagccagaaactgaagccatagaaagaagtgttttccaaagcactgaatatcttttctcccttacatttccagggcaaatatgaggaaaagagtaacctgatgttctggtatgttagtctgctctgaagaaatggaatacgattttctcttggcaatgttataaatgatagttgatttctagatcattccacaaaaaactctatttaagcagtgatatagataaaatagtagtagggtactgattcatcctggttttaaaaggattttgtggtatgtcttgagcatttaactaccatttataaatggtgttttcacagaaaatgcattctgaaatagtaaaagaaaatgtgagatacattgtgttcatatgataggatgccacgtctttaaatacagacagtttttgaaaggcgcttttcaatagttttatctcttgtttgttttcataccaactttgctgcaagctaggtactgtatagaggtccctccaacatccatccctctatctggaagggaagcagagtaacttctttgaatgggctttctgctgtctcacatttcaccctcttgcagtacaaactacttttacatcccttaaaataacacgcacccacccttccctctggaacgctcattcttttctagcccaactgactgactgctgctcattctctagttccacatttgcctcctctgagaagttccccctgatctaccgttgtggacactggtgctcctctgtgagagttctgctgctttctggacagtctgtctttaagcacccgtttgtgattgtttccacatctaagacctctccgggctaaaagcaccttgaaagcaaggagcaaacctaatggtgtttgtatatttactgcatactgcctgacacagtaaacatgaccaatgagttaatcagtaaggaataaatgaattaagtcactaataattcttttacatacattcgatttctttgttctaattatcccttaatctccaactattattcttgcatcaggaaatcaaacacaaatatttttctgccttttacaaaagcaaaaggctcaaatggagcaagaaatagaaaaaaaaggaactaaatttgagaggggggataaagttaaaaccaaaacaaccaaccaaacagaaacctaaacatgagagactttcattacatcattgttatctaaatattggtgagtggactattgtgtcaaggttgaaactgaaaacagttgcagcatggattccacagatgggtgcacaggaagggagggacctatggagccaggaggatatggattatggatgaaggttttcacggactgggtgggatactgtgtcctagtgcaccttgcatctctgactgtaatactgcacattagtcagcagagggtagccacaaatattgcatgcatttctcctccccacttaatgttttcttcatttttcagataaatataaaattggcaattcttgtccccagaggtagaatatagaaggttgtgggtgtagtaattccttagtaacttgcggggaattttttgtatgtttcaatgtaatgttcgaagctagggaacatgggcggtgggttggaaaaatgattgtgtagttagaactaactttaaagaagccgtgttctatgccaaatgctgtgctaagtgactcacatgcattagtatatttaatcatctcaaaaagtcttaggatatactattttatcagtccaaatttctaggcaaaagaactaaacattagataatttaagtaacttgcaacacttggaattaaagcgacacttattctaattcacaatgttatataagctccctcggcagaacagtcccagtttttaccctaatgccgtgctgagcttgatctgaggtactatgggacctgagttggctttagtcaatgagagggtcttagggaaagagtgaaagcagaacaaaatgaaaaggaaatgacactgtagagatgactgttcctaaaacatagttttcaaaaccatatttactagcctaaaggaaaatatgttataattaggcatttatggagtttttataagttaccacaggtttccttacattttttttccctaatatccgtaactgcaaatcttaggcatttacttaaattgcctcatcacagcctccctgtgaacaaatgaggaaagtatgtgtacaatagtaaaatcctatttggctgccatgtgaacttcaccacatctctttaaaactttggttatgattagcattgactgggaggtaaatgttagcagatttgtaaagaacaaaatcaagatatttttagttcactttggcaaatatttttaaatgtttactatattgccaagcattgtgctaggcacaggggttaaaaagtatttaagactaaattcctaccatcaaaaagttctcatatccaagtagaaaaacagaaacataagtcaatgaccataatgcaatatgatgaaccctgtcttaaaagcatgggtaaagtgctaaggtgactgggaaagggtagctttttgggtctcccaatattcaacaacttgtcctatggattaatatttaagatttgcctggtgcttttctagtatagaattgtgataaagtgatggatagattagaaggttagttttaaaactgagcgtgaaaatagttgcatcccgtgatggaggagtacccagaattctgaccatatctactcactaaaatactgaagatacaaagaagcagtaaattctgctgtagtttgttgtttggcaattagtactcatttatcaaggcttactgcacataagatagtctgacagccatagagaacaatggataaggagttggaaacaaaaattttatagagaaataaataatcaagtggaatgatttaattttatagctggaaatagctcaaaaaacatctaaaatgatggataacgtcatcattttacagatgagggaactgaggtctggcagtaaaaagtggtcattttacttctcaaaagaagatatttatgcagccaaaaaacacatgaaaaaatgctcatcatcactggccatcagagaaatgcaaatcaaaaccacagtgagataccatctcacaccagttagaatggcgatcatcaaaaagtcaggaaacaacaggtgctggagaggatgtggagaaataggaacacttttacactgttggtgagactgtaaactagttcaaccattgtggaagtcagtgtggcgattcctcagggatctagaactagaaataccatttgacccagccatcctattactgggtatatacccaaaggattataaatcatgctgctataaagacacatgcacacatatgtttattgtggcactattcacaatagcaaagacttggaaccaacccaaatgtccaacaatgatagactggattaagaaaatgtggcacatatacaccatggaatactatgcagccataaaaaatgatgagttcatgtcctttgtagggacctggatgaagctggaaaccatcattctcagcaaactattgcaaggacaaaaaaccaaacagcacatgttctcactcataggtgggaattgaacaatgagaacacatggacacaggaagaggaacatcacacaccagggactgttgtggggtagggggaggggggagggatagcattgggagatatacctaatgctaaatgacgagttgatgggtgcagcacaccaacatggtacatgtatacatatgtaacaaacctgcatgttgtgcacaggtaccctaaaacttaaagtataataataataaaaaaaagtgatcattttttccaaatgtcatatatctaacaatagtgaagaccagagccctcagaagactagtaggcaatgcatgcagagttctacctgggaactctagcatcagacagcttgggctcacatctgtctccaccaaatactggctgggttatcttaagttatttaaactcctgtcattccgtgacctcatctgcaaaatggaaatagtactatagtgtctgcagatataaaatgagagaacacatataaaacaataatgaggattaaaatgtagtgcaaattaatgaaggacatactaagagcttgataaatgctatttattagaacttatatatcctaatttctgcattagtattctttctgccacaagaaaaataaaagtgaaatgggattttgttcatttttgtttctctgacacaggaagaaatctcttcttaaaatctgtatgcacatgtggtgtcctcatttccccttgtgtctcttctttcagggccaaggagattaagatcaagttgggaattctcctccagaagccagactcagttggtgaccttgtcattccgtacaatgagaagccagagaaaccagccaagacccagaagtgagtcatgaatatggattccactcatttcctccagaggatggctattttccaagtgtttagcaccattcctcatctgtagaactacccccttcaattactcattaaggatcataagagccctcagagagttggtttgcaaagaagctctttttttttttctcaactatctcatgtctggagcatcttattgaatacaggcagaatacataaaaaataaaagataagactctgccttatttttgagagacagacatacttataaaatagacagaccatacttataaaatgataccagccactacagcagtgtggtaaaaatacctgctcatttactgccttggtaaccactcctgatccagttaattatgagccctggatgcttacctgctgatgaactatctaaagctgcttcctcagcagggtgatgtgagaacatttccctcagaaagatactaaggacaaggcagacaatttcagcctaatcgttccttctccaagatagtgcccctcaagttccaacagaggaacaaagtctgttacttaagtgaagaacgaatactggactagctatttctatttaatgtacaccaggtatttttcccaattcataaattaatattcttgattggatttctgcaatcctccctcatccccattctcctctccctacacattcctcctgtcaatttaggcatcctagggaactattacttctaaagagtcatgatgttatggcagtgaatccaggtctcacagtgtgcattggccccgctttaactcaggaacacgactcccagcattcccatcgttcatcatcatccctgctagctgcagagactgtcactacctagacagatacactccatcttcccattaaaacagagatatccatgaaaaatcaagaaaggaaaatgggaagaagaaaaggccaaggcattcaaattccttcgctctgctatcttagagctttgaggatatcacagaagtgtggtaaaaatataggagtccctttaacctccatttctctttttaaatggaatatttgtgtaaattggccagcctgtcctttgtccaaatgacctcaacttaccatagctggattgattgggagataaagagatgagttattctttctctttttttaatctttttccattagcctaagtgaatatttccattcctcctttttttattacttcaaagtgattctaaacaggaagtgaggcataattgcgttttctgcatttgaaaaggagaagctaattcagtgtggagcagcaggcaccaagcggtagtggagaataagaaccacatttcatagcagcaacagatcaaaacatctattttgaagtaaacaatgtgacaatttattgatccgttggtattaactttaaaaaaatagagttctacatttcctgctttaaatctctgctttaacattcacatagacccttaaactgttgagattaaaagggattcagagagaagctgttctggaagaaaccctggggctgaccatttattggattatttacttctcttgtcttccatcccctttcttcctccagaagcctaaattgttttggaaaattccttcatatccctagagaataattctgtatctattgcattttcaacagtgaccaataaaaaagtttcccactctcttctgaatccacagaccccatcccacctcctcatgtttggcaactttctatgccatttatctgacaggaaatactgtgttctgcataagctccatctctctctctcttctctcactttaaaatttctctgtatttttaactcatgttcttctttcagaggggaaaataattcttctcttgattggaggtatttttaacccttctcatattctttgggttactgacatcagtagaatccgtttttttaaaagtattttctattttttaacatgtatttttgagttctcacttttaaaaacaaaaatggaccattgagaaaaacaaataagtgcttatattcctaccccctaaagacagctctgttcccctttttgcacttttagtagccctttttccctgtggaccctcttccccaggagcaaacaggtacccatgttccatgctgaaaaattctcttcccgcctttctctcctgcttctatgcctttctcttacttttactgactaactgtagaaacagaagtctgtactcatggctttcagtcttttctgtatctccttcttaaccagcttcaaccttactacctcacccgaactgttgtttctaaggccccatctgtgacttgtctgcagcatttgacagttcaccagttgacctactgttttttttttgttttttttttgagacggaatttcgctcttttgcccaggctggagtgcaatggcatgatctcagctcaccgcaacctccacctcccgggttcaagcgattctcctgcctcagcctcctgagtagctgggattacaggcatgtgccaccacgcccggctaattttgtattttttagtagagacagggtttctccatgttggtcaggctggtctcgaacacctgacctcaggtgatctgcccacctcggcctcccaaagtgctgggattacaggcgtgagccaccacgcccagcccagttgacctactcttaaaactctcttccttaacttctagtcccgcattccccacctgccttctctttctctaagtgctcccactgttgctcaccctctggatgtgagcattccttaaggctctgctgtaggtcctcctgagaaacaatagacaacattagccaaccacataggtttagtttgtgataactgttatcatggcttacaaaatcatcaattgtaaaatgttaggagctgatatagatattcatatagcttattttatattataaatgtctccctttcccctgcctatgtcagcaatttttaacccctttttctggtttgttgttgtagtgatcattttatactaaagaatgacctccacacataaacagtacctagcctgtgctagtggaaaacagttacagaaagttgtcctgcatacgctcacctggttaggatgagcctggttgtgagtactaaagatctatgtacaatttcaggcccgcatatggatgtcaaaaaatgacatgttttgcttgttcttaagtctgtatgcccaaccgtgatgcccaggtcaccactggttatcaggtaagggctcaataaatgctcataaacttgagcctggtcatgagcagactgtactgttgggcaggaagggagaggggactaggcacatctaattgacagtaaataacttgaattttcttttccttgttaagagcaccaatgtgtaagaacatttttaagacatttaagtatgtgccaggcactgcgcagattaaaaaccaaatcaaaccaaaacaatacaaaaaacaaaaacaaacaaaaaacccaaccacaggcacttgaggttatagctagtaagtgccagcattgccaatagcagtaataatggttcatgggactggtcattaaaatctgagtttggggttatttgtggctttcatcagccaggctaactcaaggcaaaaccatcattcatttacttattaatctgacacacatttattgcaaggtggattgatgctgtaagggtacaccacaggatagggtgaaatgggaaaagttctctgtgcatgacaacctatacccttcggcagtgagtgcctcattgtcatgtgagagattcagtgagtaaaagtggtaagagtagagtaaaaagagagacagcgcttccagcagagatggccacttcctgggccaggtggcatttatactaggcattataaaacatgtggttaatcatctctataaatgtttattttgagtttcatttgaaatagctttctctctctcccccacactcccacgcacagaaactccatacccatcctctgtggtcagctatgaccttgcaaaccagaacatttattggtcatttagatctgcatctatcttgtttccaatgaagtcagacctaatgaggactggcaaattctgagaataaggacaggatgaacctctgttaactcctaggctggtaatcaaaatgctgggcttcatgctgtgggggatgtatcctacttgactgtgcccttaaatcaatttggaccaatttcacccccaagcgggctctgcacatttccttttcaggaatttaatcttggctgtgatgtgctgctgttattgaccattagcctggttccaacaaggccatttgggaaaaatcagattggataacatgcttaagtttggtatacctgctcatgtcatttcttcttcctttgctcctctatactaaccagaggaaaagtggggcaggaaagtgatttcatttaatgagaatatttataaaatcaggagatcctgtgagtaaatcagccttcctcttgctctgagctactttcttttgtctaataatttaatgtcctgctgcttctgtcaacaatgaatagggacttggtgggtgtctattgtgtgcaaaatattgaacctactatagtgaagaaggtaagatgtgtaagaccttgtgctaaacatgtaggcatgaaataatatgtacataaaacagttctccacttgcagtaatataaaagagccaagaggagttattgacctctagtagataggtccttttctggttagaaataaaatgaacaagaatgctatagagacataattataatcaccccgttcatgccatttttttttctttgtgtgctcctttatactagccagaggaaatgggaagagggatgggtagctcacgtgttagaaataaatttctgaggcatcagtatgttttccatctatgatgcctgtatttctagccagcaaaacagaaatcacccaagattatttcacaaggtttgttaccctcaatttggcaagtttaacttgcaaagagtgaacacatgaaagtttatgaaaaatcatataatcaggactcacaaccgatgcatgttctgcaatgaggaatagagaagtaaagggattattcacaatactttagcccaaaacctactgccgtcttggactccttacataaataaagtgaggctgattctgcgcctgggacagcaaaatgaaaagtagaacaagcagctgtcatatcaaccaaagctgcaaatctgaataattaaccacccccccccccgaaatatcattgtataaaaactagaagcaggaattttttttgattgcctggacagttgataaacaaattaagagctaaggaaattccagtttaggaaaaactggccttaatattctagtaaatgctttgtcagtctgttttgatttggcaacgaagaactcacatcataatgcaagagttcgagctgggtgagccgaagagtgtgcagtcagccatttttcccggacaatatcagctccacttgacacatcctgctgtgagagaaaaattggtggttgagatgaaatagcttcagggtttctgcatatataaatgttaaaatagaaacagcctaaggagaaattatatgttggctataaccttctccttttgagtcagcatctcaagcatttgtgtataacattcctgttcaggatatattaaccactctttttttttttaaattagaaagagtaaatctttaaaaaaaagtctgatcctgttataagtgggtaggaaaaatgcgcctacgtttttaacatgtaaatttgctatgatcacaatcccaacataaggaaagcattatacactcacatcttccactatccttaattagacagctttgggatgtggatgtggaaccccaatgccctctgctgattcagttaggtggttaacatgcagtattggtgaggcagagaacaggagttcaatctctgtaatgggacaactggatttcatgaagttatatttggaaaaaagaccacagttggaacaactttcatgggatacataagactatcaagacacagcttaatgtcaaacgaactctacttttaaaaagggaaagacctaaccaaaatgttcaaaaaagatgaagatatgcaataaagatgtatgaaagcaaacccagctcatcaaacccaattgttagagagaaaataacttaaacttccttgtcctgaggatagaccagcagtcatatcatttccatctaagagaaacaggaagtagttattgctggtacatgtggttcaatgcctacttacgccataccccttttctctccttattattgatgtagaacctcgctggacgaggccctgcagtggcgtgattccctggacaaactcctgcagaacaactgtaagtttccattgtttgtttttttaaataaaggtcaggttagagacagaaacaaaaaacatctttgtattacctgtgttcttcttccccaatgttgacatttcttcaatttttgaaggtgatatcaataagggaagggggctgcaggtatgtgattatccagttcacaagaaaaggagggtctgtggcactatgagggaatgtgaacataaggtgttctgaagactcatgattgcagttgtgttcccatctgtcctgcttacttgcatgagccagaacaagtggcttgacctcctcaacattctcatcagtaaaatagagaaattacatttcctgacttagcctcataataaattgataaagatcagatatagcagcataaagatcgctaacaagtcatgagtagtacatcctggttcaaactattatactgtcaactgctcttgtgacctgacatgggttgttatctcccccagcctccgtttcctcttctggcaccatgccttttacatcttaattcaagaaatgacaaaggtgctgatcagtgcagactcttttccaagctaataccagtgcatcaataagcactaggtgcatttccccaatccaaaatccttactgattcccatggcttacagtaccaagttcaaatttctgatgttcaagatcaccataactatatggccggtctgcaggcaaattgaacagttctctgttccatataggatttctacatataatccccttggctggaatatcttttactcatatctctctctcttgaaattctccctctcctataatagataattcaaataagaaatgcctagtgttccttgaccatccagaacaatttatccaccctctgaaattccaaagtcatttgtctgcacatcttttattctacttaatacttgctgccttatgttctgttcatagttggctcacttctatgataggttataaactcacaaacgggcaagaattagtctttttcatgtagataatttcaaaacaggaagtatatagtatcgggaaaacaaatatttgttgaataattcactctaaaagtatgagtcaatttaaaataccctacctatatttctccatctttataacaagaatggaatatgaaactttgtcacatgctttgcaaagataaggatttacaaaatatttctcacaagaccattatgattaatgggcacagagtagatgacaaagaatatatgttgaattgtatatgaacattccttatgtcttgcttttggtgtcataagcttctgcttacctgcaatagaattaatcttttatttttggagacagaaccccacagtctctaatttggaactttctctagcttattcatttctgattctctctctttttttcttgtgctaaacaaagtaccctgccctgacacatgtaagatgtttggtgaatagttatgtagtgaatgagtgaatgaactaaattcattttgcttcttggacctagaaattccacaaggtcaactagtagaataatatttatgtttattaatggacttattgtcttgccttagtggtttctgggccaatagcagattgacagatgacctattgataaattatgaatactagtactctgagcacaggtatttattgctattgtcaaaaaacctgagagttagcagaactattttcatgttttcaaaacctttaaggagaagaataaatatttatgtgcccatatataatccttttcagtcacactaaatccttagggctacatgtctatatatttcaggcttttaggagacagagagctactagaataagaaagctagggttagatagagttaaagagagttaagctagaggcagttagtgtttgaaggactgaagattttcagcttgcaaacagatgattaccatcgtgttgagattgaggcccaagagcctcacagtaatattttctacttctcagaggggaaaatatacatgcacttgtgtgtgttcatgtatgtatgtgtgtatacacatgtatgtatgtgtatatatataatattcacaatatttcatttaacttatatatgcattttgaaattatatatgtgtatatatgtgtatgtagtatgtatgtgtatgtattcctgtgtgtgtttgcctgtgtgtttatatataagttccacataattatcttcttaagtaattaatatttttaagacctgggcaattaatttccctaaagcaacaaataagaaagcatttataactattctagtcaatgctttccttgaaagggacactaatccattcgaagtagcccaactaaaaaagaagggttatggtatggagacctcacagaaacaaaggcaagccatgccctctgggaggcaaagccatcagtaagtgagacagtctctcccctctgttgcgggaagtcagggaccccgaatggagggatcgactgaagccatggcagaagaatataaattgtgatgatttcatggacatttattagttccccaaattaatacttttataatttcttacgcctgtctttactgcaatctttgaacataaattgtgaagatttcatggacacttatcacttccccaatcaataccctttcttcctatgcctgtctttactttaatctcttaatcccgtaatcttcataaactgaggaggatgtatgtcacctcgggaccctgtgatgattgcattaactgcacaaattgtttgtagagcatgtgtgtttgaacactatgaaatctgggtaccttgaaaaaagaacagaataacagcaatgttcagggaacaagggagacaaccttaaactctgactgccggtgagccgggtggaacagagacatatttctcttctttcaaaagcaaatgggagaaatatcgctgaattctttttctcagctaggaacatccctgagaaagagaatgtgtccctgaggggaggcctctgaaatggccgctttgggaacggctgtcttttatgatcgtagttgagggatgcaataagccccagtctcccgtagcgctcccaggcttattaggatgaggaaattcctgcctaataaattttggtcggaccagttgtctgctctcaaaccctgtctcctgataagatgttatcaatgacaatgcgtgcccgaaacttcattagcaattttaatttcaccccggtcctgtggtcctgtggtcctgtgatcttgccctgcctccatttgcctcgtgatattttattgctttgtgaagcatgtgatctctgtgacccacaccctattcatacactccttccccttttgaaaatcactaataaaaacttgctggttttacagctcaggggcattatggaacctgctgacaagtgatgtctcccctggacaccaagctttaagatttctctcttttgtactctgtccctttatttctcagaccagctgacacttagggaaaatagaaaagaagctacgtgaaatatcgggggtgaattttgcccgatacccctctctaattctctactcttaccatcactctattgctctcttcttctttatctgtctctgcttctccccatgacttgtctttctctgtgtctctcttgccactctgtctttgccctttgcttctctctgtctggctgttcctagagaagaaccagtggaatgccaggcttgcccagataattctactccaacatcactgacctgaagagacaatatttgacctattttcccagacatcagctatagaataccatgaataactgtaagccaaactgacaaatcagttcttatgagaagttcttatttgaatccacaaaaactaatagtctataatcagaaattacccaacattagctgtggctgatgcaaaacaggtaatgaagaaagatacatttgggacatatatacatctaaaacttcacaactggggccaagtgtggtggctcatatctgtaatcccagcactttggaaggctgcagcaggaggatcgcttgaggccaggagttcaagaccagtctgggcaacataaaaagaccccatctctgaaaaacagaaaaaaggaagaaagaaaattagccaggtgtgaggcaggacgatggcttgagcccagcatagtaccactgctctctagcctgggccacagagagagaccctgttgctataaaaacaaatcaagacaaaccaccatctctttttgcatgtttgatttgataaatttaaaccatttaaccttgaggagtagcatctttgtcaatttataagggaaatttggcattgttatgttaatgtaggatattgactttcacagttgatgtgttaaatagttccccaagaattccttacattcatatctttaatttttattgagtggcaatgaagttaattggtaccaagcttctaaaaaatataagacagttaagttgctactcagtctcttctaacaaggttcttctcactttccttcatttttaaaataatttttaatcatccagtatatgtgactgtgttctgaaagtatatcaacttcctacatgttttgccttcaattctttaggtggcaccatctgttttcatttcataggcacgttgggcgtataaacagtgtgttgttcttcaaacacaaaaatagaattcacatgggagtttaaataagagtgacatttaatagttccccacaaccatttttaagagcagagaagaatgaaacaagccagaagcagcaaagtttttatgtggatctcccttccctaggagtttcagaaggccagagcatctccttgagacacccttgtgatttagatttgtccatgggaaatgaaggagcctgaatccagacacatctttttgtttctatctttgcactccccttttgcttctttctctttggttttcttccttctcttttctggctcatttttgtcatcatcttcctcacaggcaaccataatttccttgaaaataattattataataataaaagcaatagctaacacttattactcatcatgtgccaagcactgttctaagcactttgcatatgttaatttaatgattgcaataattttaggacttgagtgccatcacaatccctagttttcagaaaatgaaattgagattaaggggaattaggtaacttgcccatgaaataaaatgctataacagcagcaaaatccataattaatttttttaaagttagtgttctttgattctgtcacttggaaggaaatgcttccctgaatgtgtcttatttctgcgggaacctctattaaatgttaggtgcacagatttagactgggaggtgggatgcaaaagagaggcaaacaggtgaaacatactcaaagaattaacagcctaatggaaaagatatagaagcaaacaatcccaacaaaagaacagaaagtgactgcttctctcataatgataaaaatcttcaagagcaagtcgatggtagtaagtaaaggctacctcacagatgaggcaacattggagttgggctttgaattaattaaaagattaattttaaatttgtaatgaataacaataatgaacaccaacatgtattgagctacataataataattatgtcaggtaccatgtaagaattttatatgaattatttatttcttagcacaaccccatcagataagttccattagtatctccattgaacagatgatgcaacagtctcagagagatttgatgacttgctcaagttattgcagtaatataatttttaaccaataagctagaaatggtgcttatcaactatcaatgacttcatttttatcccccctggttgaagagatttgcactaatctagtttttaataatttttcctttgtagcaaactgacttggatttgtctaatgctcctttaattttcaaagtgattttataggtgttttcatcttgttcttaggtagggctggctgctagtttacatggatgtcaaaagtgacaccattcattagggcgaactctggaattgtaatgtagattacaacctggagtgtttccataagaccagataatcaggtgggtttcattggctttctagagagtggatgcctggcgaggtgggttgagaggtactccgacgctctgtgcaggctcagcagggaagaatgtggtgatttgtcagggaggtgtgctgaggctctactggagtgggtagaggaatggttgtagggcaaagaagaaatgtgtgttctttgcagaatagagacatttggcctggattgtgtttgactctgacccaataggttgtccgcaggggtgataggaactaaacagagatagtggctgaggaaggaactgacagacaaccagaggctaaagaggagaagcagtctcaggggtcactttagagggaccctctagagagtgcccaaaagccaggtgcacagatttagagaaggaatagctttacacatcttgcagacgaatacaatataaagctattttatgagttatacatgaacaaaaaggttaaaagaatattgtggaattcaatgaaagttacaaaattagtatccaggaaatggacttgctgcacagaaaagttattttgcaagcttattccctggaaagtcagtaaatgtgaatatttctgtggaatcccggcatacatccccgtgtcataaataagaatgtttgggaggactgagattttgtccctatgctttccaaagatgcagaatgggtgattcagagataggttgtggggatatggggctaattagaataaatttgtcacagacttattctgtggaattatttttgcctccagccgtcttagaccttattgtgtgggagctcataagacttcatttcctggaagctaaaacatgcctgagaatgttttcattttgacagagactatctgacaccttttgtttaagaaacaatggacatatacatagttttatatacatatacatatatacatatacatagttttataattttagtcttatagttttagtttacaattaaaaactatatctatatataataggctatatctatatctatatagactaaaatatctatatattatatatagatataatttttaaattataaactaaattggttaaaatggacgttttaaccatgacacagagagaaataagttttatatttttcttttagcacttatgctaactctcgtgtcactaagttaagacaaatagtgctggaaatatagtaggaaatattagaagagagagaaaatacacctgattttatccagttacaggttatcaaatggttttaaagtaattcttctggccaagtttctagaaaaaattggtttttttttccttgttttccttttcccttcttttcacaagtgttgaaaattgtttattatacctaccattgctcctagatatatttttattgttaatcaattaaaaatgtatttagggtaagtacaggaagaagggatcaaattacaaagtgtctttcttggatcctgaaattgatggtgaccctaacacaagttaacgatcatcctagccattctttttctttaaaattgggtatggtttcagggtactgtgaagggtatgagaagagtaaaaatatacaggaggtaaattgaaaatggataactatatatagcgtctttgtttttatcattgcatacgttttatgcttgtgtgaaatcaacgtattggcaatgactaataaataaaactttagagcctataaaaagaataggtaaaaggaataaatgaaaattaggccaaaggaaatgaattcagaacgtaaatatgatccctaagcagaactaatgtattgcagaagtgtttccaggtgggggcaaattagagaaaactggaccctaaagtactggtgacaataatccttccttctgccctggggggcaaagtgacattcgaaacatgttactgagggtaggtctgtgattttgacacagcttctggaaaattagagtttttctctctcctcctgtttgaaatctttatttttcttagataataaatgaacatgaattctctccctatagccatacattgtttagaattttggtttatatatatatatgtgtgtaatatatgttgaataatacatatatattcagcattaaggagaaggaaaatattggatcaggcccaagaatccttacatatacatagttttataattttagtcttatagttttagtttacaattaaagactatatctatatataataggctatatctatatctatatagactaaaatatctacatattatatatagatataatttttaaattataaactaaagtttatcctacatgagcaattgtacactggaaacagaatcataatagctataatcatattgcatttaacatgttaaagaaacctgatgtataattgatggacatggtaagtacgctacatggggtaacttcatctggccctttcccactcatcctttgggtctcaaattgaatgttacttccttgccttcccttagcctaaaatgaagtcaggactctcctatgactctgttactacctttcatacagttttcctttcatcgtgtaaatgtttcttctgtttcttcattttctttctactttttccagaatctataagctccattaggacaggaaccatgtctattttacttatcgtggtgacttaaatcatagtgcttgggacataatagttaaacaaaaatcatctgtacaaagagaaaataaagaattgtgagtagttcatagtgatacttaacattaacattacttgcatagacaagccaagttttaaatgtattattttctccttggtagtttaagtgtccagaatggcattagtgttaatagtgttccttgatacgtaaataggtaaacgtttgtcacttaaatagacattgcatttgattgtttggaaagacaatgtggtaaatctctgtctagttctagagttccatacagctctgcatgatgagcagggcttgagctctgtgttctctgctgtctatcttccatctctgtctcattccttctgcatttgaatgaaggagtaaaggaagctagacatgaatgagctaaaactttgtgcatagaagagtattgctaagccctttccctttctctcatggatacaatatttgttaagtaaattaataaatttctccagctgactgtttttttctttccagatggacttgccagtttcaaaagtttcctgaagtctgaattcagtgaggaaaaccttgagttctggattgcctgtgaggattacaagaagatcaagtcccctgccaagatggctgagaaggcaaagcaaatttatgaagaattcattcaaacggaggctcctaaagaggttggtctctgggtaggtgggtcagttaagggcagctcattagctctcaggaaggatttacatctgagacacagacctcccgttgggagccaaaggctattcctatttgtgagtcgaccaccttattaagcacctattgagtacaaaggcagagcaacatggtcaagtatatatgaacaatcctgttcagaccgctttctagttttatgggtctcacctccactaacctccagtggagatcataccaatgtgaaatcttgcatgaattgttgagtctctgtgaacctcatttcttcctttgtgaaaataagaataatggagactactttatggagatgttgtgaggattaaattaaatagtgggtgtaaaaacttatacaggttgaacatctctgatctgaaaattcaaaattcagaatgcctcaaagtctgaaactttttcagcaccatgatgccacaagtggaaaattccactgacctcttgtgataggtctcagtcaaaatacagccaaaacttttttcatgcccaaaattattaaaaatattacataaaattaccttcatgttatatgtataggtatatatgacacataaatgaactttgtgtttagacttgggtctcatattaagatatcttatctcattatgtatatgtaaatatttcaaaatctcaaaaaattcaagatctgaaacatttctggtcccaagcattccagataagtgatgttcaaccagtgtattattcctttctctcactgctatgaagaaataccaaagacttggtaatttataaaggaaagaggtttaattgactcacagttccgcatggatggggagacctcaggaaacttacaatccagacagaaggcacctcttcacagggtggcaggagagagaataaaagtggagtgaagggggaagccccttataaaaccatcagatctcgtgagaactcactatcacaagaacagtataagggaaactgcccccatgattcaattattgccacctggtcctgcccttgacatgtgggaattattatgatttaaggtgagatttgggtggggacacagagccaaactatatcaaccagtatctcagtgtccgaactgattaatgcctaatgagtatttctataacttttctttgtttttctttccattcccatttctagtctttcctttaaacacctctctttttttgtcctttctactcttctttatcctttatttccccacttggacttttccatttacactgtacttgggacaatggtatatttactcatgaaaatcaaaatattacaagaaaacagtgttagagatgttgaaagccaatataccactgattgactattaaagcccagatttttgttgatttcaaagaaactttggggaagttgatctgcttttttctttgttatttataaaaccacattgaaagcctattgtggaattcaggatggccacagcaagccctgttcatcatggtatggtcaggttactctaatttcacttgtttcttttaatccagtctggaaagtaaatgtttcatcaaggtttggagtcaagcacggaggtgatctgggcaagccttgttgagtaggcagaaatctacttaagatgtttgagagagaaaaactcccaaatatcccttctctaccacagatgctctagactcctggagttccaccattagatatgtatttctttagttatgagttaccctaaatgtgtttgagtggatggacaaattatgtaccttgatactagtagatgtgcttcctccatgacacagggttggaggttaggagtatgagaatgtacagtactgtgggtcaaagccacgaaaatgaaaaggtgctagaaagaatctagatttaagtttgatgtggatattaatcttgaaattctctccagatcaccccttcttctcctcaacctccaccctaagcacatatgttagctctaccctacttctgttaccatttgtgctgggccatcctttcttctgtcagcatgttatttctctgtatatattgacaagaagattaatttaacattaaattggacatgtatttccccatttcaaaggattctccgacttaccttcctatcaacttgacttcctcttcacagaattctaagatttgctgaaatacctacaaatagtagaaacccactcagataattgttagttactctgagctctgggaaaacattattggttattatgaaaatatgagacattaacctaaaatataattttaaaataaacaataccatggctagctgagttatagggacaaataaattgtggtcactagttgaaagactgtaattaaaatagccttgcccttcattctaaatgatctatgcttatgcaagagtacaatagtatacattagacccaaatacaggcatcccaggattatgtagaataatgatcctgagctgggtattagagagaatgtgaatcctactcctagcacataaaaagctttcaagaaatatttttgagatgaaagcatgaaaatatccaacttcagacattcttagatgtgggactttgggcaagtctctagctaaagctctctaatcctcagttcttttaactgtaaccatcttgtgtatatgtatgtgcacctgaagtatgttaagtcatagcttttattacttaaaaaattctccaacttttgtattttgatgtaaatatttactatttaattttgatgaaattgacctatataagacctagattacccaggcaaatagtaatctgaattttgttgctctgaatactcacctcaactctttaatacaagaaactgactgagagatacaatggtaaaaattggaattaaatttaaacaagagaaatggccatgtggaagtcaataagtagataatttatacattgcaaattatcatttgaccatatttgaaattaatgaaatgatattgtttctggataactaaacagataaatatgtatcagaatgacttattaaagaaggcttaagcacataaaaataccaagagaaatagctgctatttgctggtggatactatgtcctagagggttttaaatacatcactcctttaaaaaataagattaggagctacttttataatttttagaaactcaatcatttggaataagcctgtctaccaagctcagtacagatatatacttaatataagagaaggaagaagcattgctttcagtgtggcgggaagaataatagactgagaatggagaaatctatgttatagtctcacctctaatccacactagctgtttgtgggcatgtaacctgacctctctgaggtcttcacatttaaaggcagacattggacttcatcaactctgacgctgatcccaattctgacaatctgatcttccaacaggcctgcataaagtacattgacccctttcacctctggaaaatcttaatgtagctcaacgcccttcatcctagactttgaagcacagctcagtcctgctgtctgttctgacctggctccccagggaatcatgcattttgtctccaactctaactaatagctgcttcataattctctgagcccaaagagctctattcagtaccaaaaacctctaacagcccaggagagacccaaaacctttatcagtgtttcaattcacaaccataggctgatttggattctatttctgtcttgtttacactcaaaatccttaaaaaccattaaatcgtacaacatggagtataaagattcctttaaactcatagtcagccaagttcaaataggctgtaccttgtacaactccagaggaaccattcacgtagaccctagtatggttgcaatgtagtggccctgcactcaggacatgtaagccacagtgcatcccagtgctggagtctactggttaaaaggctgggctctggagccacatcactggatttctgaatcttctctctaccattaatgaactttgagtaaatcatgtaacatttctgtgcatctgtttcctcaactgtaaaatgtagacaacagcatctattatacctcatagagttataagattaaatgagttcatccgtgcaaagtgcctggcaccgaccgagcactcaataaatgttaattgctgttagctgttttcattattattctgtcagaatgactgtttcctggtttgtttttggaaagaacaagttttcttgttcttctggagccatgcaaaaggtcctggatccccagacagaatttacttctctctgttcaattcctccaatagacgtgaaaccaaatgttgtgttagaattttaaaattaggcaccagggccggacgcggtggctcacacctgtaatcccagcactttgggaggccgaggcaggcagatcacctgaggtcaggagttcgagaccagcctcaccaatgtggcaaaaccccgtctctatcaaaagtacaaaaattagcccggcgtggtggcacatgcctgtaacccagctagttgggaggctcgggcagaagaatcacttgaacccggaaggcagaggttgcagtgaaccaaatggcgccactgcactccagcctgcctgagtgacagaactagactctatccaacaaaaaaaaaaaaaaaaaaaaaagaaaaagaaaaaagcaccaggacacctggattcaaattctgattctctagattcaaatacacttatcagttctgtgatcttggggaagccacttaaccttctgcatataatatttttttctataaaaggaaagaatcattcttaggattgttgtcaaggattaaataagtaatgtgtgtgttagcttctatgggaggtctgacacctggtgggtgtctaataccggttggatgcatctgttggaacatcagctgccttatcccatcgcctataaagtgagaagtgacatgtctcagtttttaatgactttcctcccctcttatgttttattgatgagaaattccacctccctcttcacccctcatcaaattctataacttaggcttatgtagtgaccctgtttcctggcccacaggtgaatattgaccacttcactaaggacatcacaatgaagaacctggtggaaccttccctgagcagctttgacatggcccagaaaagaatccatgccctgatggaaaaggattctctgcctcgctttgtgcgctctgagttttatcaggagttaatcaagtagtaatttagccaggctatgaaatcatcctgtgagttatttcctccataataaccctgcatttcccattaatctacatatcttcccacagcagctttgctcagtgatacccacatgggaaaaatcccaggggatgttgcttactctttttgcccacactgctttggatacttatctactgtccgaaggccttctttccccactcaattcttcctgccctgttattaattaagatatcttcagcttgtagtcagacacaatcagaatcacagaaaaatcctgcctaaggcaaagaaatataagacaagactatgatatcaatgaatgtgggttaagtaatagatttccagctaaattggtctaaaaaagaatattaagtgtggacagacctatttcaaaggagcttaattgatctcacttgttttagttctgatccagggagatcacccctctaattatttctgaacttggttaataaaagtttataagatttttatgaagcagccactgtatgatattttaagcaaatatgttatttaaaatattgatccttcccttggaccaccttcatgttagttgggtattataaataagagatacaaccatgaatatattatgtttatacaaaatcaatctgaacacaattcataaagatttctcttttataccttcctcactggccccctccacctgcccatagtcaccaaattctgttttaaatcaatgacctaagatcaacaatgaagtattttataaatgtatttatgctgctagactgtgggtcaaatgtttccattttcaaattatttagaattcttatgagtttaaaatttgtaaatttctaaatccaatcatgtaaaatgaaactgttgctccattggagtagtctcccacctaaatatcaagatggctatatgctaaaaagagaaaatatggtcaagtctaaaatggctaattgtcctatgatgctattatcatagactaatgacatttatcttcaaaacaccaaattgtctttagaaaaattaatgtgattacaggtagaggccttctaggtgagacacttttaaggtacactgcattttgcaaaaaaaaaaaaaaaaagtaatcttttagcaaccccagtattccttcactatttcgcttcctgcattagcaaattttacttacagtcaaaagtgcagatttatactcctgacgtgtctcattcacagctaaataataggccataggacttttggtaggtttaaacttttaattctgtatttcatgattataagtcttgctagaattttttctaatctttagtagatttgattaaataatgattcacagaatttagtaacagaatcaaactaagccatgtatgagggtaatcgagatgaggatattaactcaaaagaaatagggtgatttttaaaggattaataaaattctgaaatgttaagtagaagattacattgtctagtcttgtatttcctccttctgttgctctctttcattcacacactctcagtttctcatatttgtagctcatttatttggttatttcctaagaatattgaaagtgaagcaactatgtgactgtattcttcaggtaaacactgactgcgcttgttggattttccctatttttgtgacttcaagaataatatgccctgctgaatacatgccatttcacattctgaaactgggtagagtggttgggtgttctgccaacaattgctagtggtgtgaattcattcatatttgccagtattgctcacttcaaagaaactccttcatcaagcagtccagagctaggccagatcaatgctacaatcatgaagttctcattgcatgcaattgtgtaggattgacaaggaactcagataaaaatttccagggtgcacttccagaaccagcttcaacatatgtctacattgcccccaagttaataaagtgccaaccctttactctctcatacagccagaaatgttagaaatccaaaatcttggtgcattattttttcataaacgctaaaacatttgaagaaacaatttaattatttaaaattcaagtattttattcacattatttgcaatatccaaatgtttaaaaattcccagataattaactagctattacagatctcacctagagggttgatgttatgaagactccagtggactgtactcacaaattgactggacaccctatgaaagtgggtagacctctcagcggaaaataagaagggcttttacctacagggcaggacagggtcccatgagagcagttctgtggagatataaaaagaatggaagaaggaatgccttatagtgatattgtgacattatatctatatatctacatatatctatctatctatatctacatctatataatcttacatttaaaattgtattcctacacatattagaaactcttctaataaatgaagtaaaaaaattaaaaagaatacaaatattccagccccaaatgagaaatcaaacatattaaaattgttcaagaaaatttctttgaacacttctgaaagtttttggaaacttagaaaagagggaaaaaaatccagtgttactagtaatttccatggtaatacagataaaatacattcttttaattctgggaaattagaaaaagtggggtgatctttccaggaaaaacatgtgtaacatctgcttatcactccagctccctcctcctcctcctctccacgttcccttgagtaaatgtctgggaaagcatgaagcttgatgcaagaaccctgttgtactggcgttttcctcccctgtgaaaacgtaactactgttgggagtgaattgaggatgtagaaaggtggtggaaccaaattgtggtcaatggaaataggagaatatggttctcactcttgagaaaaaaacctaagattagcccaggtagttgcctgtaacttcagtttttctgcctgggtttgatatagtttagggttggggttagattaagatctaaattacatcaggacaaagagacagactattaactccacagttaattaaggacgtatgttccatgtttatttgttaaagcagtgtgaatagccttcaagcatgtgaataatcttccatcttccccgccacacatacacacacacactttttgtttctttcaggtagacaccttttaaaatgcagaactaactgaggcatttcagtaactttgctttcaaatcaataaagtcaaatgtatggaaacattttgtgccctactctccataccccgtgtactcaaattctctactgtatgaattatgctttaagtagaattcagtgccaaggagaacttggtgaaataaattattttaattttttttttatcctttacaaagccatggattttatttggttgatgtgtgctctgtacacaagccatttcaataggatggagctgttaattattttccaaagagtaatagacatgcaaaagtttcaataaaaactgggccattaacaaataaattaataaactaataagcattcccttctaggtttttgccaaactgcctatccaataacaaatttgagaatcgttgtaaaagctagttatatttcagagaaatgattttcattattgaaactgttctccctagcaggccattttccctttttcctgggagtttagcaagtttaggagagaatagtcatgaaaagaaagggaagaaaggggagaagggaagaggttaaaaagtaagtgctcagacctatgaacgtaatccctttgctacaaatatttaagagcagctcagcttggttgaaactgagttttgtcatcttccatatttgcaggaaggtattttctgacttgcaatgcagctagatgtaaaattttattttatcatcctagaaagccttgactagaaaaatgaataaatattgagggtttcctgtccatatctggcttgcatgtgccagaaagcagagaatagaaaatgtaatctccaacatccaagcatcgaaacccaaggggtaggcaattctatgtaggttttggacatgaagtttggtgcatcttggtttatgctggctcaactgctattaaacctctctggcttatagtctcttcattctattagacaagcacgtatcgaacacttgcttcgcacaaggctctttagttaacaatttagcagctactgtttgtgttaaacacacttttcaccaaataggttctgaggcaaacgagagcaatgactatttaaagaaaggctttcccagcatcacttacacatcccaaaactaaaaagatcaactcttccaactgagaaaagactcctggctttgaatggaaacttacagcagagagtcacaggccacggcaacaacaacgacaacaacaaacatttggaatattattctcaactcacgttttaataatacatcttattatttttctagtagagaaactacaaatcagcctcttcaacatttatatacagtttaataagcctcttgcaagttacttgttctctcacctgaggtatttttttcctccccaccttgcccctgttcctcccttcctcttctccctttgcaagaggaaatatttaacatatttgggtccaacttcaataatgtaataattaatacattaaaagcatttaacttcctttctagaaaaatgcacaggctaaggcatagacaaaacaaagagaaatgctgagaaatttgccactggagacaagcaatctgaataaatatttgccaaaagttctttttatgtcatatagtgtcaggatttgaaggagctatttttttttaatgttgcaactagcaactcatcttcggaagacacagccaggagaatgaagtagaagtgaaaggtttataaatccatttgtaagcatttatcccatatattttaaattcaagaaaaattgtgtttatctttagaattttgtattcaatactttatgtactatgtgactcatgcttctggataaataaagcaccaaatatgtatctgtaaccacaatcacacatattatattaaatatatatctata

SEQ ID NO: 37133 - DNA, 60776 bp, Homo sapiens; identical to SEQ ID NO: 37132

SEQ ID NO: 37134 - DNA, 63491 bp, Homo sapiens; identical to SEQ ID NO: 36926

SEQ ID NO: 37135 - DNA, 7904 bp, Homo sapiens
agtgaagaatttggcgccatcttgagaaggtcaaagtgattcttcgattaaatgccttacttatcgcctagtgtgacctggcgcttgggtttactctccccagcaactgcgcctcaaacgcaaagaaaactgcaggtcctcggggaaggatcgatttcaccattcaagagaaaaatccatttcccagattcctcccctttatgtaaacgtctggtacctagtagacgttaaatacacgtgagttttccggttttataagatcacatactgcaaaccaacagtaaattacattaatacgcatttctttagaaattcttaattgctaggcactgacatataaattgagtttgctgttgttttagagagaaaaatagacatattcattttttttcaatcaggacatggtattcgtttccttcttaagcttcccatttttgaggtaggaaagtattggtgtgtgtctctatctctaccttgctccctcattagcaggcttaatgggcaggaattatgtctgttttgctttccgttggatccccgggtctagtagagcgccttgacacatagtaggtactcgacacagatgctggcttcatgatgaagcaattgtcctcgaattaatacaaaagggaagattcagactcagcgagccggtaccattcgtctagggacacacagccaggaaggaaccgaaccaggattctaacccaggattacccaagttcgaattctaattgaacataagtccttagcgaccttggacggacttactaaactgccctgaatctcggcttccttagctgcaaaatagggttaggaaaagtggactcggtgctcctctgcgccgcattcccgcagcgggatttgtgaaagcgaacttgagccccacactgcagaagccctgaggtcctgtctcaaccagaatccagcacccaggacaagccctccagcgacttcagaccttcccgctcccgaccccgcccgcccccgagaggcgtggtcaaggcggggccagaaggcggacgcgtgcacggagcggtaaagcgcaggcgcaaagcttcggtgacgtcagagaggcgcgctcccagctcggagccgactcgcagacgcgccccgcccctcggcgtcgctctggactggcgcaggcgcaagccggcaagatggcggcggctggggctttccgtctgaggcgggcggcatcggctctgctgctgcggagcccccgcctgcccgcccggagctgtcggccccggcccgactctatcacaagaaggtagggacaaaagagggacgcgcggaatgccgactcagcggaggcctgggctggaggggcggccgcggggttctgcgcagctaggactgggagctgtcccctcccacgtctttgccctgactcgctttcccttgctgcgcagtgaggctcactgcaactgataaacaacagttaccgctcatcgggcggcgacttccagggggccccgccgctggccgcgacttcgtgcgtcccaattttaaattcgccaacagcccaggaggcagggtcctgttgggacttgtctttctgagtccagggacagacacacccccggagcgggctccggcttcagccactccgctgccctggccagatgaccttgggctagtcactgcgcctctctgaacctgtttccccaggtgtaaatggggggctctcagctgtcccttacaaaggatactgtgcgtggagtcctggcatggttcctggcacataggccccagcacgaggagaccgtttctgttactgctttaggagtgcataggggagtcaggcttgtaaccaacatgcgtaatgtttttgttttgtttggggggttttttggcggggaaggagggatagattcatagtctgcagccccttgctgtctggtggcacaaagtcccccagacgtgagactcccactcgagaaacaactaaagaatgccataaatcaacgtggcacaaaaggcccctacattagatactatcctgaggtcccttttacttggagtcaaaatccttagtcagatggggggaaaaggggactggaagatcggcgtgcttactactaaccagtaaccaaacctcaaggttattaaggccttctgtgtgccagttcgaatggatgtttattgtgatctggcttctgccctttctccaagggcttcttcactcctccccctcccgggggtgtgttttgttgagggtacaccctgaagaaacttggactagcagcctttcagcagccagggtgcgctgctgcaccagggtgatgacaggctgtgaaatacggtaatggcactgtttttattttaaaagacacataaacgtacacattccatagcattgttccctgtgtaacagtcaccttaaggcttctaagaaagctttccctccctgggccatggttatttttagaatttttaaatagtaatcatcctttgaggatggattttatttgaaaataacaaaactgctgtttgagcccaagtctggtgatgtaggtgggtgaaagtcaagtatttttgtaaaaatcctatggaactaagacatgatttcactgatttttttttcttctaggtatctcaaatctgtgaagtattgtagaggagacacaaaaggaattgggggtcacaaatggttctcattgacatgagtgtagacctttctactcaggtgaaatttggtatttagtgattgcctgccaggttcaagatgctgaccgaggagcttaccatcaaaccagagaccagtaccaatagagagtgaacatgatttatcttaaccctctcattttaggttgttgatcattatgaaaatcctagaaacgtggggtcccttgacaagacatctaaaaatgttggaactggactggtgggggctccagcatgtggtgacgtaatgaaattacaggtatggctagtcttttttaatagtgataacaataatccctttaagtttacaaagcacttgcgcatttcacttggtctccatctttattcctgtgagatctccaagcatttcacttggtctccattcctgtgagatgggatgagtccatgttagatatgactggagcagggcctcaatcgtagctctcctgctaggctagtgtactatgccaactttttccaaaatagaaaagtaatctcatttttgtactcactgtatcagtttaaattctgacttcagccaactaaagagttttgtgaattttactgatcaaaggaaaatcccagtgagctagcagtccccaatgaaacaagaaacacagtaaattaaacctgtccccagattgggggaaacatgaaaatagtgtctagtgctttgggtaaactgtagttgtagcaccaatctgctgcttcatggtgagtgggcagcttgccagaggtcttcatacctatcttggaatacagaaacaaaacaggaggaaaccactaagtgtaatctgctgcccaagaaaaaagtattaaccagagacctttattgtggactctgtcagtgtttaaagaggccagattgccccagcagctgtgagcagacttccacaaatagaagttcatagccaaaatgcaggccagagtcacaaaacaaaagaatattggagtggagggacatatttttcagctgatctttgtcagttgggcctggatagttgtccctgcatttcacttttcatcactgagctctttgaaacaaggcaaagtcagtaattaatgccatcacttagtgtggaaagcaagcccaaagcccttggggaaggccctggtgaaccttcgtgagtgccaggttccagagggtggtcccaggactcaccacttaactcttgtctcttttctagattcaagtggatgaaaaggggaagattgtggatgctaggtttaaaacatttggctgtggttccgcaattgcctccagctcattagccactgaatgggtgaaaggaaagacggtaaggtggctcacaaatctaatgggtcaaaaacaagtaaccatgacttttttttaatattctaaatttttaaaatttctcctatgcagatgttgattatattatcatttcttcaaattgggaattatggatcattctactaggtgttgtttgggtttttttcttgttgatcatttttatttttttgtttgtttgggtgttaattacatataaaaaagatcctcacctgtccctctaacaaaatagaatttaaaagaaatctttggctttctctaaggttaccagtgctcttataatttctcaagtcagagagttgttataaggtagttattttcttgtttatttcctctcatgtttcaggaagggttctaggtggctttcaagaattggtgaaataaactagcctgtgttaaaagagggattaaataatcaaaaagacagcaagggtgggggcaaagtgaacaacgaaatcagaacagtgatccaggtggctgatcgcaagccctctaaaggcagagataataaagagctagaacttctttttcatccctttgtctcccaagtgtctttccctggtagctgcagaggtcaaaggtcccaaacacagtgaagagctggactttctaaaatccagttgctgtcaaaacctctcagaaaagccaaccagcaaggcactcatctttgctgccccaagggaccaggttcagggagctgagtcacagaggagcatgcttggaagctggccagctccacagcagagcagtttgccaggccacgtgccacctgcttcctgtggctcacggccttctggctggcaagcccctgtgggccaggaagctcagacctaacctgctgtggcaggaggtagctctgaagtgatttgtcaggaactgtcctcaggtgaagggagaaatgagacaaggcacttttgctcccagaacctggcccttaggggactgtgaattgtgatcagaaaatgggagagaggacatttctttaaccttgagatctcccatctgagtttcaggagcagaacctgaatcaaccaagaagggttagcagaattgggaaactgaatgatagacatagtcaaagagtctggctgttgggaaatctggttttctgtaaggcagtggggcactgttctacatgggcaaggatctgcctgcctcacattatcccccagggctgtcaaccagaccccaggcatcctctttagttgatctggaggagatgctcctataggcaaaggggacaccaaagagagcattcggcctgactcggctgtgccactgccactgtgctacttacctgaaatcttcccaacctctctgatgccattcggcacttctagtcaaaaggatttaggctaacatttggtatgaggacatcggagaagctgatattcacaaaaccagcataggaaatcactaccttttaaggaagagattcctgttacaggccacaagcagatccctaagagacttctcacaggttccactcctgacttagagaagtgtctgggctgtctttgcttacccaagccaggcagtgcagctgtgtatacttcatgcttgagaatcccagctgcagctttgataaagtgggagtcctgagaagacccttagccgtttgagttattaaacagaaatcatccccaccaaccctgagagcctctttggcctcccttttttattggctggccctcacaagataaagtgttgctaaaactgcccatctttccattatgcctctcaggtggaggaagccttgactatcaaaaacacagatatcgccaaggagctctgccttcctcccgtgaaactgcactgctccagtaagtctctgctctccataccagtcagctgggacatttggcagtaatttcaacttggtttgcaacagtccttttagatcatggagcccacgtttgtaaccctcagaattagagctcatgagtctgtccttataacctgcagagggttagagcccccatggtctcacattcatccctaagagaatcatgccagaaggaggtatgcaccagccatcatactgagcacttcatgggcgtaatttctaaacctcacaaatatccttgagtgcacagtagatgtcattacttccctcttatggatgaggaagctaaggcttgggttgagacgcccacatcacatggctaataagtggaagagccagaatttaagctccaatctttgatttcagaatctgtgctgtttccagcagaggagaaaactcagctttcgccataatcctgtttcctgtgtatttcttcacttcctgtctggatggtattcctgtcggggtctgcatctgtatatatggaacaactaagcccagttgtacaatgtccccctccctgctatcctaaaaaaaagcccagatgccttaagacttgtacttggctttccagtttggtctctgtattaaatctaatgctttttccatcatttcttaaccttctcagggaaagaaggaatgagaaacattagccttaatgcatcgatggaggtttactaaccaaattagttaaaaatcagcagagagtcaggcctcttgccaaggtaatactcacagcagaagagccaggtgccggggcagacacactaactcattcttcaggaagcctggtcagacctaagttctttccacttgatctggaattttaagtacccataaagaaaggtcatcacttgtaaacattttcacatggtttcaggaaatccccagcccttttattaggcctttttaggtactgaaacctttagctgatgttctctgttatttgcttgctttctgctgtcattccagctctctcagtttttattttccccatagcctcactttgaatattgactcctaaataaaagtggtcaaactctcgatcactagagggtgatgtggcaaatgccatcccatcaacagattgacatgatcttttttccaaagggcatgtcaacttttttatcatgacaagattttgtccaaagctagactttgatgggagcaggcaagaagtaacatttcctgtgtccctactatgtgtcagacatcttctgtaagtccccacactatcctggcaagaaaagcatgattatcccagttctatagaagagaaagtagggtcaaagaggctaaggaactagcctgggatcacagatttttaaccctagtctgtctccaggatcacccgcaggagtaactcagctcaggaagcagctgctgacgtgcccagcaactcctcaccccagctttctggcttggttactccattagtccccaccagcaccacttcctcccagctcttaaagattctattcccaagtccatttctttcacatctagaaacttaggcttctttccttccgttacttccagtgctggctgaagatgcaatcaaggccgccctggctgattacaaattgaaacaagaacccaaaaaaggagaggcagagaagaaatgagccctccctcggcgaagcctccagcaggccacaccagctgtttcccacctgctgtgcagtcaccttagatgttcagaagccgcttcctctccactgaagagctatgagatacgcacaatacttgctgttcacgttatgactctcatgcaagcaaaatacacagtttcattgttctgaatcctgtggtttctttcagcccacttttatcgccttaacctagttaatgtatattttgaattgtgtgtatgacctcagaactgaaattgataatgaagttgcaagttttgatagcccgtgaagtgcataagtatctaattttacctgaattgatttggggggaaattaccagtagaatgccttggtctgaatatttgatagaaccaattgttgtacataaaacagattgcgcatatatatatatgtataaaaaataataaaataatggaagatg

SEQ ID NO: 37136 - DNA, 33825 bp, Homo sapiens
gccgccgtccccagcgagaggcatgcagcgctgaggagcggcgacccagcacggcggcgccatgaacctcctgccgtgtaaccctcacggcaacgggctgctctacgccggcttcaaccaggaccacggtgaggaggcgcggccctgtcgccttgcccggccgggccttcccgcagcccggggtccccggctctcaggcctctcctgggcgcccctttccggccaggccttccacccgggaccccggccccgcccgagctcccctccgaagcccccggccccggccctcgccgctgctcccagcccgagccggggtccggaccaggcccgaaccggctcccaccttcctggcctttcgcgctcccccaccccccgggttgtgaccgctcccagccggccgtcccgggccgaggtcgaggtcggtgggagacggcacagaaccccagcctcctgcgcggacgcccctccccgcgcgccacgcccactcgggttccctggctccctgcgggctccacggttatcgggattttccccacagcgtgattgacgccctgcccagaaccccgttttgccccctgttcctttcagggtctttagtaggtagcccgtggctgagctgacttcgcttgggtttactggagccgcggagccggcgtctccgacgcctctggtggcgagtggcgcgggtggggtgcaggtctcacctttcccgtcggtttccatcggaaaatgtcactctccccacccccactccccgggatttttcttcgtgtttggtggagtcaaaggacttaagggaggcctttgagggaaatcttacttcttttcccatgtcggaatccaggtgtaagcactggatgatttaaagcgcccagggaaggtgacctccttccccgcaggtgcttcggagctgcgggggatgcggccggggcggcgcggtcggattcccgcgggaggcgggcgggacctggattcggatggttgcctcctcacctcccatttgaagggcgcgcttcccaaaggtcctgatggggaggaaaaggaatgtccgttattccgagacaggcttctgcgaggctttacatgttggctttggaagttttgtttttgaagagaatccaggcaggtgctgtatgatcccgtatatgtgaagacaattttatttatttatttatttcattttgagacggagtctcattctgtcgcccagcctggtgcgatctcgactcactgcaacctcctcctcccgggttcacgccattctcctgcctcaggctcctgagtagctgggattacaggcgcctgcctccacgcccggctactttttgtatttttagtagagacggggtttcaccatgttggccaggctggtctcaatctgacctcaggtgatccacccgcctcggcctcccaaagtgctgggattacaggcgtgagccactgcgcccggccggattacacatatttgaaagaactccctctcagtgattttgatgcctgatgccctgggaccagtcaggcttcctgggcgctgccagcttccccagggttgtgtgctggggtttctccggaagaaagttttgctgagatggtaagggagatgcctagccttctcagagggtggtttccaaccatctggtgtttgtaatgccttctttttagtgaagtgtgctatacctgtagaagggtggatatatcataagtgttcaggtgatgaattttccaaactacacacctgtcactaacaattaagaaattgaatatacctggccacgcttgattccaataaatgctccctacctgacttgtgacatcatagattagttttgcctacttctgtactttatttttgtacttatttttgtttctagctgtttttttgttttgggttttttttttttttttttttttttgagacggagttttcgctcttgttgcccaggctggagtgcaatggcgcgttctaggctcactgcaaactccgcctctcaggttcaagcaattctcctgtctcagcctcccgagtagctgagattacaggcatgcaccaccatgcctggctaattttgtatttttagtagagactgggtttctccgtgttgagtctggtcttgaactcctgacctcaggtgatccgcccacctcggcctctcaaagtgctggggttacaggcgtgagccacggcgccaggctgtttctaggtttcttactcaacatcatgtttgtgattttttttttccgtattgttgagtatagttgtagatctttttttttttctttttccgagacggatcttgctcttgcccaggctggagtgctgtggcgtgatctcagctcactgcaacctctgcctcctgggttcaagcgattctcctgcctcaggctcccgagtagttgggattacaggtgcccgccaccgctcccggctaatttttgtattttgaatagagatggggtttcaccgtgttagccaggatggtcttgatctcctgaccctgtgatccacccacctcggctgcccaaaatgctgggattacaggtgtgagccaccgtgcccggccagatcattcttgatgtacaatgttcttttgtgcagacatacaacaattcatatatccagtctaccatggttgggcatttgggtacgttccagtttttggctaccataagcataatatgagtaataagagtaatgattaatctagaagatgtctctcagtgaccatatgttcacatttccacaggcatgtacttctatatacctaggagtagaattgagagtatagtagatagtacaaatagttttccaaagtggttgtaccactttgccctcaactagcaggtctaagagttcccatggctctacacccagctcacatttgatgttttctcttatttttggtcattttggtggctgtgtacatctctctgttgtttatttgcattttcctgattttgtgtttcttgaccacttggatatcctcttgtgacatgtctaagtcttttgcccatttttctattgaggattttgcctttttcttgtggatttctaggaggtggtttgggtatttctatttttattttttatttttgtttttttttttgagacggagtcttgctgtgttgcccaggttggagtgcagtggcgtgatctgagctcgctgcaacctccccctcctgggttcaagtgattctcctgtctcagcctcctgagtagctgggattacaggcgctcaccaccacgactggctaattttttggtatttctagtagagacggggtttcatcgtgttggtcaggctggtctcgaactcctgatctcaggtgatccacctgccttggcctcccaaagtgctgggattacaggcacatgccaccatgcctggctaatttttgtatttttagtggagggtaggtttcaccatgttggccagggtggtctcgaactcctgacctcaggtgatccgcccacctcggtctcccaaagtgctgggattgcaggcgtgagctgctgcgtccggcctcaaatgggagttttagaggcctttgtgttgggctttcacaccacttgtgcagtcattggaaagatccagactttgcaacatttcatgtgaaaaataattgaggggtttgtttttttctctttccagccacagcttcatagagccaacagttggacatggcatttaaggagatggatgtagtccctgggtcacacacgagcattaacacacgatcatctacgcacttaagtgctttattcagtttctaacagtgctgtttatttggaccattaacagcctgctgtgtgacttggaggcagtgaccaggatgagtgacctgggtaactcattgagactctgacaggattttaaggagttaggatgatttataggtgggagcaaagtcacgggagaccaccctgtaaatgggaaagagcatcctttcctcaccttcccggttcctggagtctaggactacctcttgtctccccagcaccctgcccttcccttcacctggtgtccacagtgggcgggattgcctgcttggtggctttcctctagaagtgtccttcacgtttgtcactgatcgtcctccaagcctgggccatggggatgccacagaaggcccctgcagtggggaagttgtgtgaacaactccaagactcctttgctaaaggacaaacaaaatgccctgcatggatgtgcttgtcacttagtaacatttgtacaaggacaggagttgtgacttagcacctatcgtgtctgtgtggtttgagcatctgcaagagttctcagtagttgtcatttctccagacctctttcttttaaccactccaggcctggggattaatgtctcttttacacttctgctttaggatgctttgcgtgtgggatggaaaatggattccgagtctataacactgatccactaaaagaaaaagagaaacaaggtaagaattaacgggacattttctggtttctcccctttccaaccctcggagtcttaaatttaaccttgcaggtggagcagggaagggatggctgttttcgagaagtaaatagggttcatggcccctcataaacttggagggagctgtcctctttctttcgttgagcttctacaggtgctgagggatacaggtgttgagcaggtttgttcactggcctgatttctctagtgaattatcgatcagcatgaacttcttgtgccttttcctgtcacatcagggatttttggcagcagaaacctcttttcaagtaaagtcttacctgtaaccctgggatgtagaacagtaagtggtgctttatgtctgggagtttattttgtaagtcagggtgcatttcctcagcctgcatccatgctgtgtacgtttgagtcctggttctgccctttaccaggttgctgtgcgaccttgggcaaatttctcagcctctttgggcctctattttttttttttccttcttccgagacgggatcttgctctgtcgcccaggctggagtgcaatggcatgacctcggctcattgcaacctccgcctcccgggttcaagcggttctcctgcctcggcctcccgagtagctgggattacaggcacccaccaccacaaccggctaatttttgtatttttagtagagacggggtttcaccattttggccaggctggtctctaactcctgacctcatgatccatgcacctcggcctctcaaagtgctgggattacagacgtgagccaccgtccccggccacctcactttctttgtacgtgaaataaggttgataacaatgcctgcctcagagttattgtaaaaatgagtcagggtgcgtaagacacgcagattaatgcctgcgcgcacattaggtgctgtggagtgtatgatgccacatacactgtatgatgggatttatgcagataaatgtatgatgggataatgatgggatttatgcagataagtagttgcaaaacattttaaaacagcttgacttgcaaatctcaggatactttttactgaattgacccagaagcttacaggagagttgtagacgttggtgtccaagttgaatcattagcagctgtgtgggaaaaaccccccagccatgttttctctccactcttaacagcacgacagttgtcagcacagaagacttctgtgactgaatgtggggaatttctccccacacaccaagcagtggacaccagctgggtgtcctttcagttctgacgccatctacctagagatagagtcagatcccacaggttgagggctcagtccccaagactgccccagtccccaccatgcatgagtctgggcctcctaaacttcagactgactggcttcaagttggggttcccacagccccctccttggattcaattaatgtgctggagcggctcccagaacttggggaagcacatttaccagtttattataaagcagcggtctgcagccttttcggcaccggggactggtttcatggaagacagtttttttcatagggggatggtttcgggatgaaactgttcccactcagatcatcaggcattagagtctcaggaggagcgtgcagcctccatccctcgcgtgtgccgttcacagtggggttcatgcttctgtgagaatcgtatgctgccgctgatctgtcggggcagagcttggtggggatgcttgttcgcctgctgcttgcgtcctgctgtgcagcctggttcctaacaggccacggaccagtactgccccggggttgcagacccattgtaaaggataattgccaagaatacagatgagggcaagcacggaacaaggtgtggggggacaggctatggagtttccaagccctccctcggctgccaccctccagaaccttccatgtgttcagctgacctcttggatttttatgttttttatttttttacttcaaaattcatttttctttgattttttttttctcttttttcccacatgtgttacagaaaatacctcttggagatatatacatatctatctctgacgttgtctcgctctgttgcccaggctggagtgcagtggtgtgatctcggctcactgcaagctccgcctcccgggttcaggcctttctcctgcctcagcctcccgagtagctgggattgcaggcacctgccaccacgcctggctaattttttttgtatgtttggtagagacggtgtttcactgtgttagccaggatggtcttgatctcctgacctcgtgatccgcccaccttgtcctcccaaagtgctgggattacaggcatgagccaccgcaccccggccacctcttggatttttaaggaagcttcatagtatctgcattgcttctcctagtgtgcagggtgggagcttctctatggaggttcttcagacccacaatcaggtggagaagatttgagttctgccttagcaggtgaaagggcaggagagagattctggttcctgagggcctaacacacccaatattataacaaaagattgtaacaaggtctgggagttatgagccaggaaccgtgggtgaaaacctgtatgtgtctctctcataacaccacaacagcatattaacaactgcttcctaattaatgaagtgtttacagtaaattcaacatttcttataaaaatgagtttgacggcccgcacggtggctcacgcctgtaatcccagcactttgggaggctgaggcgagcagattgcctgagctcaggagttcgagaccagcctgggcaacacggtgaaaccccatctctactacaaatacaaaaagttagccaggcgtggtggcgcatacctgtaattcaaattactggggaggttgaggcacgagaatcacttaaacccgggaggccgaggttgcagtgagccgagattgcgccactgcactccatcctgggcgacagagcaagactccgtctcaaaaaaaaaaaaaacccagacaagaaacatctaaaacttctaaattccagaaaagtataccattgtcatggtttagctcatcacacacatatacccggtcttgtgcgtctgccagctcggctgtgtctggggcaggctgtccctgagcttagcatgcagtgagttctcacatgtgcatgtgtggtgtgctcccgtttccagcttatgtgagtagataggccctaatgtgaaatggatacagtagggccacactgtctttttgatggcacatttaaacagtttggctctgcacttacagactcatctgctgctctgcgtctggcagcttacagtttaacaatgaagagcaggccaggcctctaatcccagcactttgggaggccaaggtgggcagatcacgaggtcaggagatcgaaaccatcctggccggcacagtgaaaccccatctctactaaaaatacaaaaattagctggacctggtggtgcgtgcctttaatcccagctactcgggaggctgaggcaggagaattgcttgaaccagggagtcggaggttgcagtgagccgagatctcgccactgcactgcagcctgatggcagagtgagactctgtcttaaaaaaaaaaaaaaaagaaaaaaatcccagtgaagagcagcaccagacttgcccttgttcctttttaattgtagcagtttgctttcctgagtggtggggaaggaagcctgcatgacagtgtgtcctggatctgggcttgtggcatggttctctccagggtgactgtgcattgagtaaggagactgtgggctctgagcaggctgctgtttccagatacgccttctgccacttggcaggaacgggaagctggtagttcagggaagccttcttggggatccctgctccttcagtcttggggggcagtgttgtccaaccctgctccccgacataggtcctgcatccattgtacacccaggtttgttctttccacacacacagcccagccaccctcccgacccacacacagcccagcagcccacctgacccgacacacacacagcccagcagcccacctgacccgacacacacacaacccagcagccctcccgacccacacacagctcggcagcccacctgacccgacacacagcccggcagccctcccgacctgacacacacacagcccagcagccctcccgaccccacacacacacagcccagcagcccgccccacctacacacagcccagcagcctacctgacctgacacacagcctggcagccctctcgacctgacacagcccagcagcccgccagacccgacacacacacagcccggcagcctcagcacatctagcttcacaacaggtcctgcaggcttcgtgctgtgtgctcacccagcgtgccaggtgaaggtgctagagaaatgggaggcctgcaatgtgtaggtagcaggtggttcctgcgggtggggaggacacagaggtggtgggtagctttgggaaggaggtggaaaggggaagtttggtaacctggtggtagaaggttaaattggtagagccttgtggagtaatttggcaagctgtgttcattatagatgtactgtttggtgcctgtataccaatattacttgcaacgctgtttccaagagtggaaaattggagaacccgaatgactttcatgaaaggggtgattactgtggttgtggcacatcctcaaaatggtgcttcatgcggtaagaatgccgagaccaatctgaatcctcatttggagagatggccatggcattgttaaaggaaaaagaaagtagagaatagcatagatggtgttataggaacaaaatatctatgcacaaagtttagaacatacgtggccaggcagagtggctcatgcctgtaatcccagcactttaggaggccgaggcaggtggatcacgaggtcaggagatcgagaccatcctggccaacatggtgaaaccccatctctactaaaaataaaaaaattagccgggcatggtggtgggtgcctgtagtcccagctacttggaaggctgaggcaggagaatcacttgaacccaggaggcggaggttacagtgagccgagatcgtgccactgcactccagcctggtgacagagcgagactctgtctcaaaaaaagtacataaatgatgttgtttcacagtgttttctactttatgcttttctgtgttgttttatagaaatgatgcataatttttataatgggaaataaggttttctttaaaaataaaactccacagaaataggaacgagaaacagggactgcacgacatgacagaggcaaaaataaaaaggttattagcctcaagtgctagaatggttgattttcactcatttgtataaagtgattcatttttcaagcatctcttagtggaatagaagttatgccagtattcagacatcccctttccccattttcttttattagtttcttgtgttttgcagcaggctctgttgggagagtctgggcctgtcaagatgtggtgtaattatatattttggttttcaccctggccggtaactcccacagacctggttagtctttttgttacaatattggccctcaggggaggcctctgaccttctcctacccccctttcaccctaacgtgtcctgtctccccaccaccaccccaccttccttcctttcttttcttttttctttctttctttcctcctcccccctcccctcccctcccctcccctcccctcccctcccctcctctcccctcccctccctttccctcccctccctttccctcgcctcccctcttctttgacagaatctctcccaggctggagtgcagtggctccatcttggctcactgcaacctccacctcatgggttcaagcgattctcgtgcctcagccttccaagtagctgggattacaggcacatgccaccacacctggctacgtttttttgtttgttttgtatttttagtagagatggggtttcaccacgttgaccaggctggtctcgaactcttgacttcaagttatttgtctgcctcggcctcccagagtgctgggattacaggcattaaccaccacacccccaccctttctaattgtgggtctcaggaccctccccagagaaggccgtaccctctgcccctgggaaaggaatgctgatatcatgaagcttccataaaatcccaaggagacggggttcagagagcttcacggaagctttgtgtccttcccctaataccttgccctatgcatctcttcatctgtatcctttgtaatattctttgttataaactggtaaacataaggaagtgtttccctgagttcggtgagccgtgccagcaaattgaacccaaagaaggggtcacgggaaccccaacttgaagctggtcagtcagaagttttgaaggttctaacttgtgactggtgtgtggtgcagtcggtcttggggactgagccttcaacctgtgggatctaatactctctccaggtagatggtgtcagaactgagttagaggaagaccagctggggtttgctgtgcggtttctgctttagtcacagaagtcttctgtgttggtgattgtgtgagaatagagaccatgattagaggagagggtttttctctgtaccacaaggactggggtgtacctcaagttttcctcagctgatgtttagtaggagcctgttttgtgtcctacgcaacctattgctgcaattttagttgctgttacagacaagtccgaccgccagggacccttagagatgtagacgctgacatcctgggcaggcttgggcatttcttctttttgtgggtataaaatgttccaggaataaataaatgctcagtgctgtgaagtaaaaccagcactcaggcaaaagtttaattctctcagtaaggcaatttacttctgcagaagggtgccccttgcatcagtcaagatggcaagagcacagagaacaaaggagaccgggggtttttatcctgaacgcagtccctatctctgtgtcactcccctatgggctggggtcggactgcacaatctgagctgacccaataggctacttgtacatatttttctaaatatagaaggggagggggatgtgaggtacagaggtggagcgtgtgagacgtgcagtttcaggggaacaatgtgtacaggtaaccaagggaacaggtgtgagttattgattagagttgacgggaagcgggtaggctgtttacagtaactaggggcaaggaagaacaagaaagtcgagttcgagaacaaaggataaggaagttaacaggctaaataaaccctttgaagagaaactcagaaagatttattgtatcttacatttttctgtaacaacgaatatcctttgtaatatttcagtaccagcccttgggatctggaacatagaaagctctgaatgtaaccctggtctttctgtggggagaccctttccccctcttcagctgcaggaggtgggggtcaggtattatgggagaatctctttggcggggtttagaagtcctctctaattcctgaagtttggctcttacctttgattacttctcattccaggaaaggccttaactctccttctctgcctcttcacttgattctgaaaaatctgtttttcttttttttctttccatttttaaaacccagagaccgcatagctaactgtgcctgtgactgactgtgtttgtcttctttttttttttttttttttgagacggagtcttgctctgtcacccaggctggagtgcagtggcgtgatctcggctcactgcaacctccacctgccgggttcaagtgattctcctgcctcagcctcccgagtagctgggactacacagctggctgatttttgtatttttattttttatttatgtatttatttgagagacgaagtttcactcttgttgcccaggctagagtgcagtgacgcgatctcggctcaccgcaccctctgcctcccgggttcaagtgattctcctgccccaacttctcgagtagctgggattataggcatgcgccaccacacctggcaagttttgtatttttagtagagacgggggttttccatgttggtcgcgctggtcttgaactcccgacctgagggatccacctgcctcggcctggcctcccagagtgctgagattataggtgtcagcccctgcacccagccaacatttctttacttaaccattagctagaatcacatcttgctaagggaatgacttgttgcttttagaacttgaaaagacggctgcgcacagtggctaatgcctgtaatcccagcactttgggaggccgaggtgggtggatctcctgaggtcaggagttcgagaccagcctggccaacatggtgaaacgccgtctctactaaaaatacaaaaattagctgggtgtgatgggcgcctgtaatcccagctacttgggaggctgaggcaggagaatcacttgaacccaggaggtggaggttgcagtgagccaagatcgcaccactgcactccatcctgggcgacaagagcaaaactccatctcaaaaaaaaaaaaaaaacctgaaaagacttatgatataatcaagcattaataactttattaataagcctaagatcatgtagtttataaaagggctaaacattgtctctcggttaaatagtgtttgaagagtacattagtgaccttgacataattctcaggtcactcagatgtgtttctaaaacttactgaacctacattgaggaaatagttacacttctgacacctggggcaaagaaggtcttcagtggcagcattttttaaaaaaaaaattatggtaaaaaattatgtaaaataaaatttaccatcttaaccatttttaagcgcatagatcagtaatgttgaatatattcacattgttgttaaacggacctctagaatttcatcttgggaagccaaagtctacatccatcaattctgcctcccctgtctcctagtaaccaccgtgctacttttctgtctccatgaacttgactgctgtagggacttcccgtgaatgccatcatatatgcctggcttatttcacttagtgtagtgttctctaggttgatctctgttgcagcctgggtcagaacttcaggccgggtaccgcagctcacccctgtaatcccagtgttttcagagtctgaggcaggaggattgcttgaggccaggagtttgagaccagtctgggcaacatagtgagaccttatcttgacaaaatcataaatgagaaatattgtttctgtttaaggctgaataataaatcactgcacgtatggagcacgtgctgtttgttcatttctccatctgtggacactcgggtccttctgcatctttgctattgtgaatgatgctgctacaagcgtgggtgtgcgggtatctcttccagaccctgccttgagttcttttgcttgtatgactagaagtgggattgctggatcatatggtaactttgtttttttctttttttttgagacagagtctcgccctgtcgcccaggctggatggagtgcactggcgagatctcggctcactgcagcctccgcctcccgggttcaagcagttctcctgcctcagcctcccgagtagctgggattacagatgtgcactgccgctcctggctaatttttgtatttttagtagagacagggtttcaccatgttggccaggatggtcttgatcgcccgacctcatgattcgcctgcctcggcctcccaaggtgttgggtttatgggtatgagccactgcatctggtcatttggtaactttttgatttataaaaatcagccttttttttttttttttttttttttgagatggagtctcactgtgtcacccaggctggcgtgcagtgtcacaatctcggctcactgcaacgtccgcttcccgggttcaagcgattctcctgcctcagcctcccaagtagctgggattacaggcacctgccaccacgcctggctaatttttttgaatttttagtagagacgaggtttcaccatgttggccaagctggtttcaaactcctgacctcaagtgatccacctgccttgcctcccgaagtgctgagataacaggcatgagccaccacgcctggcctttttattattttttaattgagggagcgtctcactgtgttgcccaggctgatcttaaactcctggcctcaagtcatcatcctgccttggcctcccagggtgctgggattataggtgtgagtgagctgctgtgcccagcctctttttaattttttgaggacctgtcctacttttttccagagcagctgcatcagacagtgcatgagagttcccatagcttcatatcttggccagtacttgttatttcctgggttaaaaaacaatattagccatcctctgcagtgagccctgttctcatcactgcacttgcctgagcaacactgtctcaaaaaaagaaaaaaaattagtcatcttcatgggtatgaggtggtgggatctcattgtggtttggttttgatgtctctgatgcctaatgaagttgagcatctttctttgtacttgttggccatttgtaaattatctttgaagaaacactactcaaatcctttgccaattttaaaatcagattattaatttttttattgttgagttgtaaaagtccttcatatattctggatattacgcactgtatcagatgtgtggtttgtaaatatgctctgccgttccataggttgtgttttcattctgttgattgtgtcctttggtgcacaaaagtttgatgtcccaaaagcacattgcccgtgctggtttttttttttttttttttgagatggagtctccctccttcgcccaggctggagtgcagtggtgcaatccttgctcactgcaacctctgcctcccgggctcaagcgattctcctgccacagactcctatatagctgggattacaggcgcctgccaccacagccagctaatttttgtatttttagtagagacggagtttcactatgttggccaggtcgaactcctgacctcaagtaatccacctgcctcagcctcccaaagtgctgagattacaggcgtgagccactgcggccggcgaattttttaatttttatttttggtagagaagggatttccttatgttgcccaggatggccttgaactcttgggctcaagcagtcctcccacctctgcctgccaaagtgctgggattacagatgtgagccactgtgcccggctgccttgaattttaaatatctcgaagatcgagctgaggaacttttgagtcatttcgtgcagctgtgactggagagatagagctcatggtcattgcagacacagaagtgggtgggtggatggtcctcctgagttacgtgaaccatgcagaacgtgggagtttctcatcagtgtgcccctgttgctcccctcagagagcattggtcatccttttgtcatggaagacctctgaaaatttgtggacattttcctcttacgtaattcatgaacagttgggagcatttcagacttcggtggctcacacttacaatcccagcattttgggaggctgagatggcaggattgtttgagaccaggagttcacgaccagcctgggcaatacagtatgacctcgcctctacaaaaacttttctgaaaaaattaaccaggcgcggtgatgtgtgcctgtagtcccagctactcgggaggctgaagcaggaggagtccttgagcccgggagtttgaggctgtagtgagctgtgatcacttcactgcactcaagcctgagcaacacagcaagaccctgtttcttaaaaaaaaaggaaatgataaaagtcactcagcttttgcattaaagttttgtggggtttttttggtttgtttttatttttgtttttatttatttatcttgagatagagtctcgctctgtcaccaggctggagtgcagtggtgtgatctcggctcactgcagcctcagcctccggggttcaagtgattctcctgcctcagctcctgagtggctgggactacaggtgcctgccaccacgccggctaatttttgtatttgtagtaaagacagcgtttcaccatgttggcccagatggtctcagtctcttgacctcatcatctgcccgcctcagcctcccaagcattaaagcttttagtatgctgtcttggagttgacaggttttgccacctcttgaaatgtgaattcaagtatttcatacattttgctgagttagcttcctagggtgttgtgtgctcagcctttatgaaacagtgaacatgatgacagtaaactgagagaatttggaaacctagcactcactatttttttagccagtcacctttctcatttctgacgatagttagatataaattgctgattaaaaatgagtcctgtaggccgggcacagtggctcatgtctgtagtcccagcattttgggaggccgaggcagactgatcgcctgagttcaggagtttgagatcagcctggccagcatagtgaaaccccatctctactaaaaatacaaaaattagctgggcatggtggcacatgcttgtaatcccaactacctggggaggctgaggcaggagagtggcttgaacccaggaggtggaggttgcagtaagccgagatcgcgcgactgcactctagcctgggtgacagagcaagactccttctcaaaaaaaaaaaaaaaaaaaaaaaatgagtcctgtattcccagctacttgggaagctgaggcaggaggatcatgtgagcccaggagttcaaggctgcagtgagctgtgattgtacctgtgaatagctactgcattccagcctgggcaacacagtgagatcttgtctcttacaaaaaatagaaaattgctgcgttacctgtcttgactttctcttttcttttttattgtaaaatatacatattaacttgtaacattggtctttttaaaactatcatttcagaatttctagaaggaggagttggccatgttgaaatgttatttcgctgcaactatttagctttagttggtggtggaaaaaagccgaaataccctcccaacaaaggtactgtaattgtgtattgaagaatcatgcctcacgtgtcccacccagtctttttttgaatgcgtttatgtttgtggccatgtgtgattttccctagtagttctgtgaaatatccaggactggtcactggggaggaagcaggcgaagagggcaccaggtctctattcccagatggagcacctaaagagcatcactcgcttgcattgtcatagaacacgtgcgtttcagtcagtaaacggaaaacgggcctgctgcaccttaggttgacgtcgtaaatgtcatgaattcattttaaagcaaggtagaaggattttttttcttacagagagccattgacttaaaggaacattagtttcatagccacgtggaacaaaacaccacttgggctctgggtttcgggatatgtttgtcggagtgggagtacgtgtgtgtatgcagatgatgtggcgtaagagctctggcccttttaagtagagggaggagtagatagctttcctgacagccgtgtgcctcgtgccagcttaacctcgctgttggttgaggaaagagggctcaaggcgaaagatccaggaatggagggcagaacacagggaagaggtgggaggcgggaggtaggctgggtgggggaggtgggaggcagatctgggggaggcttgaatgccaggtaacgtgtggccaggaaggagatgccgtcagatctgtgttttgggaaagttctggtctagatgcagtgcatgaggtgagtgaagagacaccagaggatggggcaggtgtgggaagcccccgtttatggggagaggcaggaaaagtggagcaagcatcctcgtctgagcccagtgccaggcgggaggaggcctgagaaaagccatctggttctggtgacattgaaggccaccggtggtctcagaggatgactgagtgggagcccagtggtgggtgggtagggtgggaggaggtgaggagggaaggagaggctcagtgagggaggcagttcagaatcaagaccaggatggggctctgggggcgccgcatgccaaatgggaagtgagtgggtgaactaggatctgggtgatatcacgtacttaggaatagaatagcccaggtcagatcaggcacaaaaggattgtgtggaaaggcagaaggttccagatgactcgtgacaagctttggggcccagctcacagttctcagcagagccccgtgaactgcgtgaacgtgaatgtgcggaagagagaccacactcgggtgaggactggccctgcctgatacatttatttttgttttggaattaggaacagagaaatgaaatgggaagagattatcggtaggaaaaacagtggaagacagggcttgagatcttggcctttgagcggttctgtaatctcacaaggtttgtctgtgccagctttaaagcagagttgagagtggctgctagcatagcccagaggggcagaggcctgtggcttgtgagtcctctggaggagcccacccagaagggacagcggaggttccacagagagagcagggcaggatttgcaggagaatgactttgccctggctaattggggatgggcagaaatcctgctggtgaattggtctgtgtcttgtcatggagaacttcattgaccattaaggaggaaaggaagcttatagatggaagtcaggaggcctagagggccgcctcccttgccctacctctggcactgctgggggaccccaggtgctaacaagggagccatttgtatgagataatctcaggtctcattctcattataaagtttctaagaggtgaaaaagccttagaaacttcacagacttagaagaaagcagtattcagcaggtttttgagtaaatgtactttttgtagcgtttaaaggtacttttttttactagtaaacttgatttttatttatttagttttgagacagggtctcactgtgttgcccaggctggaatgcagttgcgcagtcctggctcactgcagcttctacctccccaggctcaggtgatccttccgcctcagcctcccgagtagctgggagtaccggagcacccaccacacccggctaccttttgtgtttttagtagagacggcgtttccacatgttgcccacgctggtctcaaactcctgagctccattgatccgcctgcctctgcctcccaaagcgctgggattacaggtgtgagccatcacacccagctgtgttttttgtgtgtttttttgagacagggtctccctctgttgcccagcttggagtgcagtggggtgatcatagctcactgcagcctcagactcctggactctacctgagtagctgtgactaatttttaataactttttttttcagaaatgggagtctcactatgttgcccaggctggtcttgaactcttggcctcaagcgatctcacaccccagcctcccaaagtgctgggattacaggcgtgagccaccgcacccatccctcctgtggttcttcaaaagcacggtgctggttggcattctcatccctaaagcttgtcggtacattagcccttagaacacaaactgctaatttatgctaatagaatgttgcaatgttagcaggcaaacaagacagaagaaattttgaacttaaaaaggagcaggggctgggtgcagtggctcacacgtgcagtcctagcactttgggaagttgaggtgggcagatcacttcagcccagaagttcgagaccagcctggacaacatggtaaaaccccatctctaccaaaaatacaaaacttagctgggcatggtagtgcatgcctgtagtcccagccatttgggaagctgacgtgggagaatctcttgagcctgggaggtcaaggctgtagtgagccaagattgcgccaccgcactccagcctgggcgagagaatgagaccctgtctcaaaaagaaaaacagaaaaagaggaagaacaacccaggaccttgagtggagtgaggaacttgttggccctgatttgtgtccctctgatttcactttaaaactgaaacctcccttcctgatgcaggtttatttgcagcacttttaacatcagtacctatggtcaggcttgcctatgggctcagtcgggtggaatcaaggaaggtcagggagaggaacgtaaccaggcaagggcaagggttggcagagagagatgaacgcgctcagcgcgcctgtgtgcgaggccagtgggtcgcctgagaccgggaccgggctgtgcgcactgagagaggaacggacggggagggagcaatggttggcagagagagatgaatgcgcttagcgtgcctgtgtgtgaggccagtgagtgggtcacctgagaacaggaccgggctgtgcacactgagagaggaatgggcggggagggagcaagtgggcagccagctaccaagaaggggagacgctttgagtggggaaggtgcccgagggcggatccctggcacagctcacggtttgagttacaccccaaggcctcccaggtgcgggtgtgtgtctgaggcctgagggtgggcgcagctgtgccagtgggaagagaaaacaccttaggcgccaagctggcatcgctgcatcccagcgccatggcctgctgatgactgcattcatcttttctttctgatatttcagtaatgatctgggatgacctgaagaagaagactgttattgaaatagaattttctacagaagtcaaggcagtcaagctgcggcgagataggtgggtttggtgtcagtaattttttaaagtggtatttcactttctcaaaagatggctgaaatacttttctatttttggcagaaaaatgtttaggaaatgatgtattaaaatgttggtcctggtttttatgaccataaggatataaggattatttatattgctgcaagaaaggcagcgaattgtgtttgtttccagggctccgctggaggtaagtaggtggtggcgtggatgacgtgcgccacagtggaccagccagtgggtctcaccgtggtgagttatgtcccattccgacatgtgcagagctgaggacatgagttttgagccttgaattaccctgggcttttagcccctgctttgccaaatgctgcctctcaataaaggttttcggtttgaaggtaaaggaaaattgaattttctgtgttgaaagtagcaggtggttctgtcagccatggtctcaggggcgtttagggggaatatggaagtttgtcctagtacgttgagcaagatagcgcagagttcgttcatttgggtttttatttaatatgatttgcatattttactctaagatttccatctctgtcggctgtgggaggacagcagccgagcaagttggatgtaaacagaggtcatttcacctccctgccctttttttttttttttttttttttttgggagatagagtcttgctctgttgccagactggagtgcagtggcacaatctcagttcactgtaacctctgcctcccgggttcaagcaattcctgcctcagcctccggagtagctgggactacaggcgcacaccaccaagcctggctgattttgtatctttagtagagacagggtttcaccatgttggccaggatggtcttgatcccttgacctcatgatccacccgcctcagcctcccaaagtgctgggattacaggtgtgagccactgcgcccggccaactttcctgcatttttgtgtgggtttgtcattttaataacgtcaatatttaaaggcccttagtaatgcaaatgtggccgggcaccgtggctcatgcctgtaatcccagcactttgggaggctgaggcaggcggatcacaaggtcaggagttagagaccagcctggccaacctagtgaaaccccatctctactaaaaatacaaaaattagctgggcatggtggtgcacgcctgtaatcccacctactcaggaggctgaggcaggagaatcgcttgaactggaggtggaggttgcagtgagctgaggttgtgccactgcactccagcctgagcgacagagtgagactccatctataaaaaaaaagtaataataataataatgcaaacgcttgagccagatcgaggatattctactttcagacttttcttattttttccagacacagtagcataaaaatatcacttctgtctgttttgctcggttctgaacctagatggagtgtttgatgatgtctctctgaacctcagagacgtctcttaggctgaccttcacccaggcgagaagcactccctcagcagagccagcccacgtgcactcgccgagctccaggcctggcgctggctacctgcctccagagctttttcttcaggaacactccttttctgtgtggtattttcagtgtttctcagtttcagtatgataagaacaggagcataaaatgtttgggtttgactcttgaggaaagcaactctgatcatgtttttctttccagaattgtggtggttttggactccatgattaaggtgttcacattcacacacaatccccatcagttgcacgtcttcgaaacctgctataaccccaaaggtgagagattgagcagacgggtggcgatgggaaatgggtccacatggagatgcctgtgctgggcactcccttctccaagcaggtctctgagcaaagtgcttggcgagagcaatcctgagcacagaggggcctccagaggagatggaccttccaggacccacagctcagcatccccaaactaccttctgaccagagtcacagagtgggggcccctgtcccctcccacccagtgactatgggctctcagaacctccacagtgaaccaggaacctatgttttcaccacttcgggagccactgagttctggactcaagcctttccttcccttgtcttctgaattggaggattgattgtgtttgactttgtcatttattgtaccatcttcatatctttttatattgggggttttgcctctggctttgttagggtaaaatttacaaaaaactgactcgttttaagaataccatttgtggccgggcgcggtggctcactcctgtaatcccagcactttgggaggccgaggcgggcggatcacaaggtcaggagattaagaccatcctggctaacacggtgaaaccctgtctctactaaaaatacaaaaaattagccgggcgtggtggcgggcacctgtagtcccagctacttgggaggctgaggcaggagaatcacttgaacccaggaggtagaggtcgcagtgagccgagatcacaccattgcactccagcctgggcgatagagcaagactctatctcaaaaaaaaaaaacttcaataaatttccgtcattgtaaacagttgtgtagccaccgtcacagtcaagacagaacagtcggccgggcgcagtggctcacgcctgtaatcccagcactttaggaggccaaggcgggcggatcacgaggtcaggagatagagagcatcctggtcaacgtggtgaaacctcatctctactaaacatacaaaacttagctggatgtggtggcgggtgcccatagtcccagctacttgggaggctgaggcaggagaattgcttgaacccgggaggcggagcttgcggtgagccgagattgtgccactgcactcccgcctgggcgacagagtgagactaaagaaaaaaagaacagtctcttctcctggaaaactttcttgggacagtcccctccccactcaaccctcaggttttgtttttttacatgtatttgtcctctgtgtgtgtgtatgtgtgttactttgttggtcccttcggccgtgttttggctattaggaaggaggagtgtcgtgcatgttcccatagcagcctttgtgtgggtagtttcatgtctcttgggtcgatcctgagggttcgactgcccggtcacaaccatgttgtggttgtgtctgactataaaatgcggccgtttattttccagagtggctgtgtccccttgcgtctcatccatgatttatgagtgttccagcattgtcggtctttctagctgtagccgttccgtgcgtgtgtgatgatatctcactggtaacggcatctccttgtggttttggtttgcatttctctgaggactggcggtggcgacatctttccctgtggttcttccctttcgagatcttttgggaagtgccccagatgttttgcccattttttagccggttgtttatcttataatgagatgtaagaattttttttttttttttttaatatgagatggggtcttcctctgttgcccaagctggagtgcagtggcatgatctcggctcactgcagcctctgcctcccaggttcaagcagttctcccacctcagcctcctgagtagctgggactacaggcacaccaccatgcctggctaatttttgtatttttagtagagacggggttttaccatgttggccaggctggtcttgatctcctgacctcgtgatccacctgcctcggcctcccaaagtgctgggattacaggcgtgagccaccgcgcccagccccattttttttgtttgttttttttttttttttggagatagagtctcgctctgttgcccaggctggagtgcagtggtgcgatctcagcttactgcaacctccgcctcctgggttcaagcgattctcctgcctcagtcccccaagtagctgggattacaggcacccgccaccacgcctggataatttctgtatttttagtagagacggggtttcattatgttggctggtctcaaactcctgacctcaggtgatccgccttccttggcctcccaaagtgctgggattacaggcgtgagccactgtgcccggccgtaagaattctttatatgttgtagatttagccttttccctggcacacttttgcaagtattgctaaaagatttcttttatgttttcttctacacatttggtagcttttcatctaaagttaaatcttcgatccatttcaagtacattttgtattcagagtgaggcacacgcctgggttcctttctgttctatgtggatatctaagcttggtacctttgttttgattaaataaatacaaggttttttttctggactttttgttctcttccattgatctgtgtttctgtctttatcccagtaccatcctgccttgataagaggtttaaagtaaatctgaaattaggtaatataagtcttgcaatcttcttactttacaaaaaaaaaaaaaatttttggtcatgcctgtaatcgcagcactgtgggaggccaaggcaggtggatcacaaggtcaggagattgagaccatcctggctaatatggtgaaatcccatctctactaaaaatacaaaaaattagctggacatggtggcaggtggctgtagtcccagctactcgggaggctgaggcaggagaacggcgtgaacctgggaggcggagcttgcagtgagccgagatcacgccactgtacactccagcctgggtgacagggccaggctccgtctcaaaaaaataaaaaatttgggctgttccagtgcctttatttttccttataattcttagtatcagcttgtctttcttcaagaaccctttctgagaggttagctgtgatcacactgactgtagatgagttagatagtaatagccaatcttccagcccacgatcacaagaccagctctctctcagatcttctgtggtcttcctttgcaagatgttacagtccatggataggtcttgtacatctgttaacttattcctccgttttttaatatttttacgctgttgctgatggagcagcttttaaattttataattttgcattgcattttcggtggcgtgtaccctgacggacggacagttggtaaagtcgttaattttgcattgcattttcggtagcgcgtaccatgatggatggacagttggtaaagttgttcagcagatgtcttgattatgaggaggtctcatgcgaggtagctttgcttagccctctcatactctttatttacaatgaaaaatctttaaattgaatttgtggttctgatatttataaatgatatacatctattttttcggagaactttgggggcagaaagtggactttggctgtgagaaatcaaaggcagttcttgattggtgtcctctgtctccacgcaggcctctgtgtcctttgtcccaatagtaacaactccctcctggcctttccgggcacgcacacgggccatgtgcagcttgtggacctggccagcacggagaagccacccgtggacattcctgcacacgagggtgtcctgagctgcattgcactcaacctgcagggaacaagaattgcaactgcatccgagaaagtaagtgtgccactcaccttgttggtgttgtgcctcctggagcagcaggctcagcaaaatggccattccctgtatcaagactcaaaaggcagtgggcctgccccaacctggagcccctcaggggcctgtggacctggctggtcatgtcatcagacaggttgaagtcttcacaggtcgtcttgtgcccagggactggttttatttctaattatttacaaagcagtgtcttgtaaaatatgataagccaaagaaacagggccaggggcagtggctaaacctgtaatcccagcaatttgggaggccaaggcaggcggatcacttgaggtcagatgttcgaaaccagcctggccaagatggtgaaaccccgtctctactaaaaatacaaaaattagccaggcatggtggtgtgtacctgtaatcccagctactcggaaggctaaggcaggagaatcacttgaacccaggaggtggagattgcagtgagctgagatcatgccactacactgcagcccgggtgacagagtgagactccgtctcaaaaaaaaaaaaaaaaagaaacaaaaatacgtccacatccaagttgattacagtgatcagatatgacagctttgtcatattctcatagattttgcagaaccactcaacttctgtgctcctgtcttcacagcctgataacacacagctcaaaacccttttttacctgcttagtaacgtgtcttcattgaattaccaccagattgtaactgaaaatattgacgtattggacacattgtcctttgatttgcgaggtcagaagaactgttaattttttaaaataattttaaatctggggttctttatacttctttttgcctgaattcagatttttacaaagaaaattggtatcttgtactatagttttcattgaagactgcaaacccggtgttactttgtaggaaattataaattgttaaggaggtgagaccgcaagccggtgatggtatccgtttgtgggcacagtgcactgaggttcagtgcggccctgctcctaccctttcacgcggtgccagtgccagggtcactcctcagcacgtggggacacgcggtttggggcgtgtcccgctcactcctgggactcagctgagaacaggtttagttatttctaggtagtttttgttttgttttgttttgttttttgagattgagttttgctctgtcacccaggctggagtgcagtggcgtgatctcagctcactgccacctccgcctcctgggtgccagcgattctcctgcctccacctcccgagtagctgggtgacaggcacccaccgccatgcctggctaatgtttgtatttttagtagagacgaggtttcaccatgttggtcaggctggcttggaactcccgacctcaggtgatccacccgcctcagcctcccaaagtgctgggattacaggcgtgagccaccgcacccagccctttaggtagtattttttagaatggtatcatattagcaacaaaatagatataattttgtatgaattagaaatgcggttcctctgtatttttggtacattttttcttaccctttttatctttagattctccatccccactccctgcaacttttcttctttagatagaatccccgttacaaatgtggatgcttctctgcttcctgctttcttagccgcagcggtgccctccgggttagccaggtagatgggattacgcagagccttgcaacatctgtgacccatcccgtgctgtcggcagtcaccccgtgaggctgctcctgccttgtcccccacaagctggctccttactgcacccccaggagtaggggctgctgggttgaaggatataaagattttttgttggatgttgtcagagtgtttgacaaaagatgcagcagttctcgttttcccagctgtcagaatcagctgaagagtcctcctcgttctggaggagatgttaaaaacttccctgaggtcttgggcacctctttcttgggaaagccagcatagctgacatggatgggtttaagtccttttatttttttttttttgcctcacctttttgatggccggattcccgtgctgcttttcctagctatctgagggacttaggattcggacagtgcttctcagatgagctccctgtgtagcaggagcagggagcctgggcctgggtgttcctcctgggtctcagccagggatgcgggcatccagggtcagtccaccctgcccggtcaggaggttgtctctggaagcctctcttgacttgtgcccagtgccgtgggaccaggagccaccaaccaactcgttctcaggggcacaactgtgtgctggcagttggaggagaaagttaagtagtagatgatgtgggtgagtttgagaaaggcttgtgtggactaatggatttgtgaatgtgagtcatttcaaaaactaacgaaaaagttttgaatctttgataatgaaacacttcactgtttttcaaaggggacgcttataagaatatttgatacttcatcagggcatttaatccaggaactgcgaagaggatctcaagcagccaatatttactggtaagggcacctccaacttcaccggagaagaacttcgggctgacagcacggaagtgggcctttgggatttgggagagggggtaggagcagccaccctcccccgaataaggccagaggagggagaagcttgggctgctagggggttgggtttcagctttttaaattgtgattaactttaagtttttatcgtgggaaattacacagaagtagaaagaatgtcataattaaccctgcttcagcatttattagtatttgatggtttttgttgttggtgggttttttttgttgtttttttggggtttttattttgagggaaggtcttgctctgtcgcccaggctggagtgcagtgacgctatcacagctcactacagcctcgacctgggcccaagcgattctcctgcctcagcctcctgagcagctgggaccacagttgtgcaccaccacgcccggctaattgttgtgtttttgtagaggggtctcgctgctgccctggctggcgggcttgggttcatccctgtttatttttagtctttctggtgtttttgccagtttcatctcgtcaccagcgctctggcttgtgtttaaggcaatgctggagaccatgttggtttgtctgattccagcctgttacagtctgagaggccacactgccgccccacagtggtgtccctacagccccccgggtgtctagtgctgaagccctacttgggtagcatctcatgccctgtggccacggccaggaggcctggtgcctcccccttggctagtattgagcagcatttgggtctttgagatgaaaatgtaattaatatagccgggcgcagtggctcccgcctgtaatcccagcattttgggaggctgaggcaggtggatcacctgaggtcaggagttcgagaccagcctggccagcatggcgaaaccccatctctactaaaaatacaaaaattagctgggcgtggtggcgtgtgcctgtaatcccagctactaggcagggctgaggcaggaggatcgcttgaacctgggaggtggaggttgcagtgagccaaggtcgtgctactgcgctctatcctgggcaagagagcgagactctgtctcaaaaaaaaaaaaaagaaagaaaatgtaattaatttataaatacggcagctttatctgtgaggtcctgggccttgtggtgtgcatagcacatccctgtctgctcctagaacagacagcacacggccaatgcctgccccagcccagctgacctccataggggcagcctgcaccttcctgaggccaggatcattggagagaatgtgtgtttctcacccgagtcttgtgagagcagccctgagcggcatgttgggggtgtggtctgcaagaagtcccttccctctcccagacacacagctcatcagctgcatttgtggggcacccaaggaaaacttgccgtgatacactggattgtggctgtggctttgtggcttcaacctgtggtgctgtggggatggttgtcggcttgttaaagaaagggcagtattcagaattggcacctccagagtgggaatgttgaggtgttccacagtgtcgacaagtgctgtgggttaagtctctggactcctccacatccacacaaggcctgagctgtgctggttttctctgcagcatcaacttcaatcaggatgcgtccctcatctgcgtatccagcgaccacggcacagtgcatatttttgcagctgaagatccaaaaaggaataaacagtccaggtaggtgttaggatgcctgctggggaaaagccgggggatgagaggagtccccagtgtttcagtgtggacgggacaggccccccaccccagcagggtggtgtggacagacctcatatgctatcagcgctgaaatctttttcatttaattttatatttgttggggtttaaaaatcagtgcaggctgggcacagtggctcatgcctgtaatcccagcactttgggaggccgaggtgggcagatcacctgaggtcaggagttcgagaccatcctggctaacatggtgaaaccccatctctactaaaaaacaaaaactagccgggcgtggtggcgggtgcctgtagtcccagctactcgggaggctgaggcaggagaatcgcttgaagccgggaggtggaggctgcagtgagccgagattgcgcccctgcactccagcctgggctacagagcgagactccgtctcaaaaaaaaaaattttttttttaaataaaattgtacaacaggctttgtcatgcatggcaaaaaaaaaattcattaaagctcaaaccatatgaaggagcattttcgtattttcagcagcgtattctgagcttacgcaggtgattttttttcctgtaaactttgaaccaccctttcttttcttgtcttcacagtttggcctcagccagtttccttccaaaatacttcagttccaagtggagtttctccaagtttcaggttccctcaggctctccgtgcatttgtgcctttggaacagagccaaacgccgtcattggtgagtggtccttcctggagagaacgtccccacccgccccacctgggctccatccactgagcgtcagacctaacttcccatggacgtcccagcaccgcgctgtggcaccgatggccgcccagttccccttatttctcctgtgggctcagtgtgtcccgcttacggtctgcacggccatttgggatgtcttcagcccccatccctccagtttcccccaggaaatcacagggacaggtcttccaatgtttgtatagatgaccaagaatgtttcttaaccctgtagccaacaccgggtgattagatgctcacaccaagacagtcaggattcccggccacggtgccgaccgaacgcattcagtggggaccctggggcctttcagggctttcagagcagctgcctggctccaagaggccctttgcagttcagctcagtgggactcgttgcttttaacttgagggaaagaaacacacaggtaaaatggtctccttctatcccagcaatttgtgcagacggcagctactacaaattcctgttcaaccccaagggggagtgcatccgagatgtctacgcgcagtttctagagatgaccgatgacaagctgtgactccagctgggggcgccacagcacccaccacctgccgccttcagactctcggggctggtgccagtgccccaggggcctcctgggccacgggctggaggggctgcccagggaccttggtctcgaagccatacgtggttgtctgctttcctaaggactcccatttccagtattaaagagagaatcatcatcaaggcaccgtaggtaactcagtggctgtgaccagctcgactggcggccactggctgttcccatgagttcagctgtgacgttagcttcagtggctccgccgcatcctcacactgacgggggctccatacggacctggggactgggctgagagggtggacgagttcaggtttgtttttgcagcagattccgtcgttcttactgagtctgcagcgggggagtgaacaagtgtgcagatgtaagttcttacatgataagcagattgaatacaacaccagcagcttgccttagaaaaggagaaaggaattccttttcccgcccgaacatgaagaaaaatgacctgaccctgtagagagaacacagtgtgaatgtttcccctcgtgtgagcccagcctgtggtcttctccgtacccgcaacgtggtcatctgtgcccgtgacgtcacctgtgcccgtgcgtggcgtccccgtctccgttggggccattagaatgaggcagacaccaggccactctagaagccgagccgtcacacctcaggcgtgtgcggggcggggacggggggtctcctggttacattttggattaaacctgtttcccggttatgtgtagggaacagcagagtgatgcacgaactttgaacattcgttatggggaaaacatcctttaacttcggggtcgtctgccagagcagggtctgggagggtccatgcagttcccgctggtgtggagggaaatgccctggtctggcctccgagcccccaggtccaccgtctcccctcccctcatttgtaagaatagctacacactaacattttgggaaggagaggcacataactttttttaacatttggtaactaggttatgggctctacattgtcagctacttgggatatatatttaattttcttaaattcccgttaaactctattttatggttttgatttcagattgcaaacatgtaaaacctgcatagcagcgagttctcggttttgccggtttctttagttctttactgtcactgtcatgtaatcagctaattctctgtggatgttgctgtaaagtatgcatgttcctttcatgtgtatttaatcatgatgtttaattttgcacacttatttgtaatgtttcttttaaataaaagtgactaattttgttgt

SEQ ID NO: 37137 - DNA, 48120 bp, Homo sapiens
ttctgtctggcggcggcagcatggcggcgggggcggctgaggcagctgtagcggccgtggaggaggtcggctcagccgggcagtttgaggagctgctgcgcctcaaagccaagtaagcggggcggcgagcggtaggagtgaggagccggagcgggagcggccgcgagaccgggccggtgtggggcggcgggtggcccagcctggcttcttggtgcccggctcccttcggcctcgggggaccgggcccggcgccacccgtagactcccccgagcctccgcgtgagtggcccgagccgcaggttccccgccccggaacagcgagcagggcgcgaggctcgcctggaagccccggccccagccctggctccgaccccgacggctgtccaagcccgggggacgcgaccttcccggcctctggcctgggcggccccgccgcgggacggaggcggtggtgactcagccgtgccgcagtggcggggcgggggacggggcggcgccgagaccccggccctccgcgccacggagcgggacccacggctgcgggctccacctttcctgtgcccgccgggagggagcggcaggctcggcgtcggcccattgctcttcagcctcccttcaggaacgcccctgtcgcaggaagagcggcgagggaaggccccgttgcattagctaggcctggctgccttttgaagtcagcctttaaagtttgttggacagcaggtagcctcagtcttcagacttaacctgttgccggagacagagatttcctgttccatgaactggtgtagtgagagtctgttcagatttggcgccggtgtccaggtcttcaatccctgggaagactacaaaaggagatccagaggaatgcatagaaagcgttttctgggtggactagaagctctgaactgcaagcatgcttacgagtaaatgcttactagcgtgcgtgcctgcagggaaaggtctgcacgtggactctccgtgataataccacctcacattgtagactactccaaggactgagttgttctcttagttgtattattagcggttgttatgggaactcttatgtcggattgcctgggatccagtcccaccgcagccactcagtagccatgtaacccctgggcacgtttcatgcccaagcctcagtttcccgacggtgacatagattagcacctgttagtacctcagggttgttgtgagggttaaatgagatgacgtatgtaaaatacaaataatacaatgcctagtatgcaggaagcactcagtagatgttggcacttagtatttcagtaggaagtagaatggttcatggaattcacaggcaaaaagctttgttttgttttgtttttgagacagggtctggctctgtcacccaggctgcagtgtagtggagcgatcacggctccctgcagcctccgcctcccaggctcaagtgatcgacccacctcatcctcccgagtagctgggaccacaggtgctcaccaccacgcccgtctaatttttatttttttttatagagacgaggtctcgccatgttgcccagcctcgtctcgaccttctggactcgagcgatctgccctcctcagcctcccaaagggttgggattacaggtgtgagctaccacgtccggccagaaatgcttattgatctaaattttgttttgtttgttttcgagacaggctgttgctctgttgcccaggctgagtgcagtggcgtgatctcggctcactgcagcctctacctcctgggttcaagcgatcctcccacctcagcctcctgagtatctgggactacacgtgcggtccaccacgctgggctaatttgtgtatttttcgtagaggcagggtttcctcatgttgcccaggctggtctctggaactcctgagctcaagtgattcgcctgcctcggccttgtaaagtatcgggattacaggcttgagcccccgtgacctgccctgttgatctaaattgagtgaaattttgccgactgaatttgaattagaggcaagtagtactctgattttgcaatggagagtgcaggtgagatggggtgttgcctttggaaatggggaggggtgcgagttactgactaatggttagaaatgctttatgggggtgatgaaattaaagtgttatttaaacagctctttaggcatttcaggtttacctgggaaattgttacggaaaaaagcaggggttggggagggacatgtgacatttactcactgatggaagctgggctctgactcatccagtacagatcagcacaatcacaggagtcaccagaagtggcctcttgaaatgagcaggtcttgtgtggacctgccctaagtaaacgttttgaatttaccatcacctgaaaggctgttttgtctgttttacatgtttgttttaaatgcttcatgttttaaaaagtccttaaactatcaaaatgaataaaagtgtttttttttttttttttttttgggggggagacagagtctctctctgttgcccaggctggagtagagtgcagtgacacaatcttggctcactgcaacctctgcctcacgggttcaaatgattctcctgcctcagccttctgagtagctgggattacaggtgcccgccaccacgcctggctaatttttgcatttttagtagagatgggtttcaccatgttggccaggctggtcttgaactcctgaccttaggtgatgggcccgcttcccagcgtgctgggattacaggcatgagccactgcgcccggccaaaatggataaaagtttaaatgtaagtaccatttggatgttgtatccttgccgctggcctgtacttgaaatggcccaggaaacaatgtgcactttccttagtgactagttcaaacggacacgtgataaatgatgtgtggcatctggggaaggagcacatttctgcagcttttttggtgaagatggagacatttaagaatattaggccgggcgcggtggctcacgcctgtaatcccagcactttgggaggccgaggtgggtggatcacgaggtcaggagatcgagaccatcctggctaacacggtgaaaccccgtctttactaaagaaaatacaaaaaattagccaggcatggtggcaggtgcctgtagtcccagttactcgggaagctgaggcaggcgaatggcatgaacctgggaggcggagcttgcagtgagccaagatcgtggcactgcactccagcctggacgacagacgaagactccatctcaaaaaaaaaaaaaccaaaaaaagaatatcatggtggcttacaccagcaaacccagcactttgggaggatggcttgaggccaggagtttgagagtagcttgaacaacatagaacccatctctacaaaaaataaaaaaagtagccaggcatggtgatgcatgcctgtagtccccagctactcaggaggctgaggtgggaggattgtttgagcccaggagttccaagctgcggtgagctatgatcctgccactgtactccagcctgggtgacagagtgagaccctgtctcaaaaaacaaaaagtgcccgaattttagtacttgtgttgatgtaataattttaaatctactttccaaatcatcgcttctccaattttaaaatttgacatgaattgaaatttttttcttttaagtagttgaatcagatatttacataagttgctgaaatctcagctggtttgtacaatggggttattaatatccatttgcagagtaagcaggtttagtatatgatatgtttaataagcagtagctggtatctgcagatgaatgtagtagcagaatactataataattgaaaaacaactatttgctgatgaagagctgaagtttattacattgtctaaagttacattagtcaggatttgaatgtggtttttgtctgatggtttttctccaacaatgctccaggcatatggggctatccattaagatggaaagaatactgtaacatgtaatccaaaaggggataacgtttatatttgtttcagatatagtatgtccttataatattggacattatgtgcttaattgagaaatggaaggtaagcattaaataggagaatattgtggataatttcaactaacaatatcatgttttaatgttttcaaatgttttatatttttgtttcatcttctcaacatcccagagtgttggttattgctgttttacagatgtggaagttaaattactcttcaaaaccatgttagtaataatgaaactgaaatgaattcagtttctatggcatactttcttcttttcttttttacttatttgggctcatactattataaagtttggtaacctactttaatttttgaaaaatgtagttatattagtattttcctgtggcgttgaaagttctttgaaaatttgatttgtaatggctttatgttttcttatgaccatttaaaaactattattgagcatcagaaatttttctgatttgctacgtaaagtagtgggaaaatatccatgtacagaaaatctttgtctcttaattacttccttaggattgatacttatgtgtaagaaatttctgaaaggtcccaatttaatttttaccagcaggacatgaaagtacttctcgtcatcctttttatcattgaatattatgatttaaacagtccttttgttggctgggcacggtggctcatgactgtaatcccagcactttgagaggcgaatgcaggcagattgattgcttgagcccaggagtttgagaccagcctggtcattggccaaagcccaactttacaaagaacaaaatatgcctgtagtctgggaggctgaggtgggaggatcacctgagcccaggaagtcgaggctgcacttgccttgcactccagactgggcattagagtaagaccctgtctcaaaaaaagaaaaaaaaaattttttttttggtcaatttggtggaaaatggtatcccagctttaaaaagaaattgaagtattacatacagtaacaatgcacagatcttaatcgtcagatgtggtgaattttcacaattgtatacacaccgataaccaccattcacaggaagaatatagaacccaggaagttttccatcccctttagcccagctactgatttcttactgtcactgtagatgagttttccctgctcttggactttgtgtgagtagaatcatacagttctttgtctgtgttatcttttgctcacatattttcaagcttcatttgtgtcattgctcatgtctgtggttggttcctttttactggtaagttacattctgttgtatgaatgtctatcactttctcctgttggcggacatttggctaatttccagttttgatttattatgtatagggctgctgtgagcattcttgcatgaggcctctgtgaacctctgttttgttcttgccatccttaggcaatggacaaaaaagcttccctggatcctcttcattgctggaggctatggtgggcagaggctcctgagggagggttttgaggggtcaggcctgtgttctagttttagggccagaattcagttccagggccccagacaactgcaaggaagactgaaaaatgtaatctagctgaatgcacaggaggaagatgaaacagtgcttgattgaaacagcacagtctctgccgtggacctgaggccccacctactcaaccattgaagctgctgagttgtgctggatgcaaattaacatccggtgactaggggctcctacaatgtgtccttccctgccttaggtgggtcttcatttggagcttcctgctttccttgtgtgcctgtggacactctcccttcatcagtcctaccagtggtcttgccctctgttttcctatgctttgataaatgaccttgcttcccacctgagagaaaacaggatttcaggtagcatctccccaagccctccttccactctcacctctcccaacacttaccatttatttgtagccttacccattcttaattccttggctcctgactcagaggagactgccttcttcttcttcaaggtaagctcttctctgctctggatttcccctctcctgcctcttctgagtccttgcatcctcagctgtcttgtgtctacggcccttccctctccatttgcactatcccctagtaaaataaacatataaggattttcttgtattaaaaaggcccatcccttgattttgtctttttctctgcctgtacagatctcttagagtacatctctgcttcctcatcttcacttcagtcctcagtggactgcagtctgacctgtgcttctgctattccattgaaggtactctctctgttagttgccctttcctgttgcattggatgattgtcactccctcttgacactcttctcttgacttctatgtgacccttcaatcttccagtaccgcctaggaccccttaatcttccagtaccgcctaggaccccttctctgctttactacataagttccttctcctccatctgtcctaacttaatgttgataagccccctgaggcgctgacctcgggtctcctctgtgtccctctgtaaccctttgcggtgtggtgctggcactgttcctttcttgattcccaaatctgtatatcaggtgcagacttcttccctgagctctagacatcatactaacaacccattaaacttcctttcctcaggttggcagcttctgcactatgatttgaggcatagtgccaccactagccatcagtctctaagccagaacttggagccagctgtagactgccttatctgtcaccaaatcctgccccttctaccttcgaaatcctcatgctgctctttgcttctgctttcctgacactttattgtaggcttattctcttctcgctggtattatttgatcagtttttacagtttgttattcctttccttacccataggttagttgtccttggttctttttgccatggaacatatttctgttcgtgatttttcagatttttttgggaggtggtattatatttgaacagaattccataaaactgaaggattttttagttggatatgaccatagatatctttgccaagataattttgtgtgaaaactaactaaaatagatactgagttattaatatattctgtgtgttcatactataaatgtttagaattttttttttttaaatgggtcttgctctgttgcccacactggagtgtagtggtatgatcatggctcactacagcctcgaccccctgggctcaagtaatccttccaccttagtctgccagaatgctgagtacaggcatgagccaccttgcctggcctagaaaaatcttttttttttttttgaggcagagtcttgctctgccatccaggctgcagtgcagtggtgtgatctcagctcactgtaacctctgccttctgggttcaaacaattcttctgcctcagcctcctgagtagctgggattacaggcatgcaccaacacacccggctaattttttgtgcttttagtagagttggggtttcaccacattagccaggctggtctcgaactgccgacctcaagtgatctgcctgcctcggcctcccaaagtgctgggattacaggtgtgagccactgctctgggtctagaaaaatcttttgtagcataatattaaaaagtataaaaaaaagtctttgtgaaaagcagttctattcttttcctcgttttgcactggcatgccttcattttcaacacttactgctgtttctatggtcacggttatgtctctccatcactataccacatttaaaaagtaaataatgatattattagtaatgtgtctacaaccatttttcacaaacattgtgccattaatacagaaattcagtttccactttgcccaggggtctgaaaatatggttgatttgcctggctttttttttttttttttcgtttactttaagttctgggatacatatgcagaatgtgcaggtttcttacataggtatgcatgtgccatggtggtttgctgcacctatcaacccatcatctaggttttaagccctgcatgcattaggtatttgtcctaatgctttctctccccttgccccccaccccctgacaggccctggtatgtgatgttcccctccctgtgtccgtgtggtttcattgttcacctcccacttatgaatgagaacatgcaatgtttgtttttctgttcctgtgttagtttactgagaatggtggcttccagcttcatccatgtccctgcaaaggacatgaactcattcctttttatgactgcatagtattccatggtatatatgtgccacatttcctttatccagtctgtcattgacaggcatttgggttggttccaagtctttgatattgtaaatagtgctgcaataacataatgtgtgcatgtgtctttatagtagaatgatttataatcttttgggtatatacccagtaatgggattgctgggtcaaatggtatttctggttctagatccttgaggaattgccacactgtcttccacaatggttgaactaatttacactcccaccaacagtgatttacatgacttttaattgaggtggatgaatattcagatctacttcaaatgggcttcacttgaaatatcattgaattgaaaatttatctgaaagagtctcaagaccttgcagagtgcttttatgttccagtgttgtatacaacaaaattctagcaatatgaaaaacttcagacggttcttttaaagctttcttttttttctttttggtaatttatatcagtatttgtgtatttccaaaattggtataattttaaataaatgcatttaattgatttacaggtccctccttgtggtccatttctgggcaccatgggctccacagtgtgcacagatgaacgaagttatggcagagttagctaaagaactccctcaagtttcatttgtgaaggtatttatatttcaatgtcatgtcttttgtgaatttaattctgatttatgggttagattagggctgggtgcggtagctcacacctgtaatcccagcactttgggaggctgaggcgggcagatcacctgagttcagtagtttgagaccagcccagccaacatagtgaaaccctgtctctactaaaatacaaaaattagctgggcgtggtggcgggtgcctataatcccagctatgtgggaggctgaggcaggagaatcttttgaacccgggaggcagagattgcagtgagccgagattgtgccactgcactccagcctgggtgacagagcgagacgctgtctctaaataaataaataaataaaataaaaaattagattttattaactaatataaagatggagtggtatggaattccaaatatgtataattggtgtgggatctgttatttttgcacatcattcttaaaaatcttaaaataattttgcattttttttttttttgagacagagtcttgttctgtcgcccaggctggagtgcagctccagctcactgcaacctctgcctccccggtttaagcgattttcctgcctaagcctcccgagtagctgggactacaggcacatgccaccacacccagctaattttttgtatttttagtagagatggggtttcaccatcttagccaggatagtcttggtctcttgacctcgtgatctgctcaccttggcctcccaaagtactgtgattaggcgtgagccaccacgcctggccaaatgtacacttttccttgatcatcctcgggtgtgaggcatgactaccaaatgtcaaggtggctgtgggctggagttttggagagcacaggcagacaaattagttccctgtgggtaactgtggttttaaggcatttaaaatagtaacacaaattatgtcattgaaaagctaggtgtgctgtagaaaataattcaggaaggggtatgtaaatgctgctagggaccagggaacaggaagttgctatcttggtttagatgaaggcagacctccgggagaaggtgaaagtctttctaacctgttcagaatgtagaggaagatggaagccagtcagtctcttccttgcctcttttgtttttcactctggttatgtgtactcctacattcctgctgtctctcttgagtggatgagtgctaggaaagctgtagttttgactgtggattaactcaattggtttagcacgttaaagatattattcaggacttagtactggtttaggcagcagggccaaaatatgtgttgagagtcttagaaatgaattatcaggaggggaggtgcaccttgtattcccaagcctgaatccttaagatttaaaaaacaaatgaaaaaccaaagtcttattttttaaaacaagaatctgtgagttcagagtacatgttacccaatatactcatatatgggattaaaaataacatcaactgtattggtctgtatgcctctttctatgtaaactgaaaacacagaattttgacagggtaattcattcgtatagtaggtgataaaattttcaggaggcttctgtataaataagtttgctttgaataggcattatactcagttggctcaaaattccaaacagtgtagaaagatgtccgttgagaaggcccaccccgttcctctgttgtcacccttgtgtcccaccacataagtaactgcttgtattaattttgtatgaatccttctagtgtttctttatgcaaatagggcagatgtgaatatagtgattagctttttaaaatttaaggacttatttaaaattccaatgaaatgtataatgtaactgtagagtgtaaccctaaaatgtccaatataaataatagaagggggcattaaaactgcatgtttggtcagtgataaaagataatgattacaagtgaaatgaatgattaaacatttcaatcataagattaatcaagatgatggtaattgttctaagtctgcttttatgtgtatcatgttactggtttaggtaacacattgttcttagctgctatctgaatgatttatttaaagtgactatagaattacttctcacattggtaccagacttggcagtgagattttaagttgttcaagtgcttaagtatctctgtgagccaaaggttggaggagccctcagcgattttgggttgtgggggatacctgagcctgactgcacctgccactcatgaggatgatgacagcgtaagattggtcattcttccaggagtcatcactttccagaaattcactctataacatagtttttctttgattagccatcattaagggcaaaggtactttccatggcatttgtaaggcagctaattaaaaggcacttgccggacaatagtaagcaaaagagaagtagaatgagagatcatcgttctttcccagtaagagaggcgtgcaggctgggcgcctcggctcacacctgtaatcccaacacctcttgaggctgaggtgggaggattgcttgaggccaggaattcaaaaccagcctgatgcacatagcaaaaccatctctacaaaagaaaaactaaaaaagttagctgtgcatgttggtgtgcacctgtagtcccagttacttgggaggataaagcagaggattccttgagcccaggaggtctcaaggcggtcacaccactggacgtagagtgataccatgtctcaaaaaaaaggaggaatgtagttcattttaaaacagctttctttttgttaatgagagtttttggaaagttctagagtatgaactaatgttcttctgcttcatcttgtgtctatttgatttcttagtcttttttttggagacaaggtctcactcttattgcccaggctgtagtgcagtgatcttggctcactgcagcctctacctcccaggctcaagcaatttctccaccttagcctcccgaatagctgggactataggtgtacacccctgcccagctaatttttgtattttttgtagcgatacggtttcaccatgttgctcaggctggtcttgaactcatgggctcaagcagtctgcctaccttggcctcccaaagtgctcagattatagatgtgagccactttgcccttcagtctttttttttttttttttttttttttttaatgatgaaatggtttggcatttttggcttgtgaagtaaagggatcagttcatttttgtgactgggatttataaaatcattaaataagtgatcatacactagatatttttaaacagattgtaaacttttgtgactatcaacaatttcttattttgtaggagctggtaaaaatagagttagaagagttagtcacccatttttggtcagagtagttagtttgtgctctttggaattgaatgctgaaagacaaggttttcatatttattgcatctgaatccctcattctctgtattgatgatatggtcgtaaagtgtatttggggtggggcacagtggctcacacctgtaatcccagcactttgggaggtgtgagtgggaggattgttcaaggacaggagttcgagaccagcctgggcaacatagggagacttcatctctacagaataaaaatttaaaaaactagctgtgtacacctgttgccccagctacttgggaggctgtggtgggaggattgcttaagtccaggagttagaggctgcagtgagctatgattgtgccactatactccagcttgggtgacagagtgagaccttgtctcttaaaaaaaaattaaaaagtgcatctgtactccttttgggtgctgtgtttataatgggtggtgttccatttacctgagtcactgccatgtctagtgggctcttctgggctccgtcctgagtttgtcacacctcctagggcccagaggagatgatgtggtatttctatcactaaaaggagttcaagaccagcttgagtaacatggtgaaaccctgtctccactaaaaatacagaatttagccaggcatgatggcgcatgcctgtaatcccagctactcgggaggccgaggcaggagaatcatttcaacccaggaggtggaggttgcagtgacccgagatcgcgctactgcactccggcctgcgtgacagagcaagactccgtctcaaaaaaaaaaaacaaaacaggaaaagtcttagagaaaccttgtgtttattcagaataaaatgaaatagttaaaatgttttagtgccttttattttcaaattacatagtcagtatcttctctcatactgattcttgtttgtatctttacccaaaataggagtacacctttgtcatttaattaattgtttgatataatcttccaaaatatggtatctggcagaggggggtgggagagaggaagaatagcacaaggctttgttgggtgcctgctgctggttgtatttgagatccaaatcaactattttgtatgaaatcgtagctattttttcctgtagcttttttttttttggtctctgtgccattggttgcttggatcaggaaatgccctatatttttgtctatattgtcatttaattccttttttcattgcctccttgactagatggtgagatacttgacatggggacctttacctcatcaggttttcattagtaaaaaaaaaaaaaaaaaaatagggccgggcatggtggctcacgcttgtaatcccagcactttgggaggccgaggcgggtggatcacgaggtcaggagattgagaccatcctggctaacacggtgaaaccccatctctactaaaaatacaaaaaaaatcagccagctgtggtgggacatgcctctattcccagctagtcgggaggctgaggcaggagaattgcttgaacccaggaggcggaggttgcagtgagttgagaccacaccactgcattccagcctggataacagagcaagactccatctcaaaaaaaaaaaaaaaagaaagaaagaaaaagaaaaaaatgactttcctttgttcgaatggctcttgctttccatgcaagcctccctgatcccacttccagcttactgctcccatcctgctaggccatagtatactcattttaccatatcatgtacttcagtgcaaacattctcaaagtcagacttaccagctagctggttggtgagattttatactattgtatttcatttgacattaattttgtttatatagtagctgctgtacttgcattttattttcattgtaatttaaaatatacgatcaagggtatggaggagttacgtatttaaatgtatttttgcttcttgaaaaacaagaatctttattcttattttgaaagtgcgactatcttaaagatacagattgcactgttgaatttctaaagatctgtacaatcattataaatgtaaatgtagtttatgtttaatttctgagtgtataattactgtatgtaaacagatagtgttgggcaatcttccgaagggtaccaactagctgtataaccaggtgcatgctaactagtggaattaaaatttttcagtggcagagaatgttggccaatttatttggcatcttaagagagcatatgttggatttcattctacaggaaggaactctaaaaatgcgtctcagataattctggtagaattgttttttttttttttttgagacagagtctcactgtgtcgcccaggctggagtgcaatggcgtgaactcagctcactgcaacctctgcctcctgggttcaaggaattctcctgcctcagcctcctgagtagctgggattacaggtgtgtgccaccactcctggctaatttttgtatttttagtagagacggggtttcaccgtgttggccaggctggtttcgaactcatgacctcgtgatccgcctgcctcggcctcccaaagtgctgggattacaggcatgagccatcgtgcccggctctggtagaattgttaaatcttaaaaagactgtaggtttttatctgtgctatcttggtaattaaaaaaacccaaaattaacatggttttattagctgtttctgggctaagtttggtgaaagtatttaaagaagttatcaaaacttttttttaaaattattattatactttaaattctagggtacatgtgcacaatgtgcaggttcgttacataggtatacatgtgccatgttggtttgctgtacccatcaactcatcatttacattaggtatttctcctaacgctatccctccctcagccccccaccctccaacaggccccggtgtgtgatgttcccctccctgtgtccatgtgttctcattgttcagctcccacttatgagtgagaacatgtggtgtttggttttctgtccttgtgattgtttgctgaaaatgctggtttccagcttcatccatgtccctgtaaaggacatgaactcatcctttttttatggctgcattatattccgtgatgtatatgtgccacattttctttatccagtctattattgttggtttaaagtctgttttatcagagaccaggattgcaacccctgctttttttgctttccatttgcttggtagatcttcctccatccctttattttgagcctatgtttgtctttgcacatgagatgggtctcctgaatacagcacaccgatgggtcttgactctgtccaatttgccaggctgtgtcttttagtcttttaattggggcatttagcccacttacatttaaggttaattttgttgtgtgtgaattttttttttttttgagacggagtctcactctattgcccaggctggagtgcagtgatgcgatcggttcactgcaacttccgccttccaggttcaagcgattctcctgcctcagcctcctgagtagctgggattacaggcacctgccaccatacccagctaatttttgtatttttagtagagacagggtttcaccgtgttggccaggctggtctcaaactcctgacctcaaatgatccacctgcctcaacctcccgaagtgctggaattacaggcatgaaccactacacccagtctgttacatgtgaatttgattctgtcattatgatgctaactggtaattttgcccgttcgttaatgcagtttcttcatagtgtcgatggtgtttcaccatttggcctgtttttgcagtggctggtactggttgttcctttccatgtttagtgcttccttcaggagctcttgtaaggcaggcctggtggtgacagaatctctcagcattttcttgtctttaaatgattttatttctccttcacttatgaagcttagtttggctggatatgaaattctgggttgaaaattctttaagaatgttgaatattggcccccactctcttctggcttgtagggtttctgccgagagatctgctgttagtctgatagccttccctttgtgggtaacccaacctttctctctggctgcccttaacattttttccttaatttcaaccttggtgaatctgacagttatatgtcttggggtcgctcttcttgaggagtatatttgtggtggtctgtgtatttcctgaatttgaatgttggcctgccctgctaggttgggtaagttctcctggataatatcctgaagagtgtttcctaacttggttccattctccctgtcactttcaggtacaccaatcaaacgtagatttggtcttttcacatagtctcatatttcttggaggctttgttcgtttcttttcactcttttttgctctaatcttgtcttctcactttatttcattaatttgatcttccatcactgatatccttttttccgcttgatcgaatcggctattgaagcttgtgtatgcttcacgcagttctcatactgtggttttcagctccatcaggtcatttaagctcttctctacattgattagttagccacttgtctaacttttttcaaggtttttagcttccttgcaatgagttagaacatgctcctttagctaggagaagtttgttattaccgatcttctgaatcctgcttctgtcaacttgttgaactcattctctgtccagttttattcccttgctggcaaggagttgcgttcctttggaggagaagagacgttctggtttttggaattttcagcctttctgctctggtttctccccatctttgtggttttatctacctttggtctttgatgttggtgacatttggatggggtttctgtgtggatatcctttttgttgatgttgatgctattcctttctgtttgttagttttctttctaacgggcccctcagctgcaggtctgttggagtttgctggaggtccactccagaccctgtttgtctgggtatcaccagcagaggctgcagaacagcaaatattgctgcctgatccttcctctggaagcttcgttccagcggggcacctgtctgcatgaggtgtctgtcggcccctactgggaggtgtctcccagtgaggctatacgggggtcagggacccacttgaggaggcagtttgtctgttatcggatcttgaatgccatgctgggagaaccacctgctctcttcagagctgtcaggcagggacgtttaagtctgtagaagccttttgttcagatatgccctgcccccagaggtggaatctagagaggcagcaggccttgctgagctgtggtgggcttcacccagtttgagcttccctgccactttgtttacactgtgagcatagaactgcctactcaagcctcagcaatggcctactcaagcctcagcaatggcggacgcccctcccctagccaagcttcagtgtcctaggtcgatctcagactgctgcgctggcagcgagcaaggctccatgggtgtgggactcaccgagccaggcacgggagggaatctcctggtctgccagttgcaaagactgtgggtaaagcgtagtatttgggcagaagtgtaccattccttcaggtacaatcactcatggcttcccttggctaggaaagggaaatcctccaaccccttgcgcttcctgggtgaggtgacgccctgccctactttggctcgccctccatgggctgcacccactgtccaaccagtcccaataagatgaacccggtatctcagttggaaatggagaagtcactcatcttctgcattgatctcgctgggagctgcagactagagctgttcctatttggccatcttggaagcgatctcagcctaaactatcaaaactgttaatttaaatttctgttttgaaatttatatttggctgtttgacaaagattctgattttgaaatactatttttttttttttaatatcacacatcacagagtagaaggaagcctcttttggaggtttagccaaatgttcctgaatagcaggtttaagtgttctctccttagtcttgcagctcagtgccatcattggtaagtggccatccccattcttggcttaggtatagtgaccacctttgtttaatattcggtcaaaatttatcaaacactaaatgccgcacagtagtctaggcactgaggatacagaacattaagggtcacagacaacaaatagtagacatatatgttatcaaggtaattttaggtagtaataagttctgcaaaagaaagaaataggctatgaaaatgggaactgggataggtgggatactttatttagattgggctggaagggtgtatctaaggaagagagatctttcttttttttttaagagataaggtctcgctctgtcacccaggccagggtgcagtggtgtgatcatagctcactgcagccccaaacttccgagctcaagcattcttcccaccttggcctcccaaagtgctgggattacaggtgtgagctactgtgccagcagggccatttgaaaaatggaaaggagccagccattgggagagctaggaagagcttttaaccaaagtgcagagtgtcaaagcaaaaggctagtggggctggagggtggtgagagtgtgatgtgaggttggagtggcaggcaggggtcagtgaccttgtggggaacgataacattcaggtcttattccaagtgcaatagcaatgacacagttccattcctgtcataagtcagttactctggctggagaatggtttgaagcgggaagggtgcagaatagaagcaggtaccccagttaggaggctcctaggccaggtgagagatgaaatgatgtcatggtctgagtgggattatattttggaagggagcccagaacacctgttgatggagtaggtgtgagagtgagagaaatggattaatcaaggttgtctcctttttgattttaggaactggatggattttgtgagatagagatgccttgtgggaggagcaggtttagtgagaggtgtttgatagagctctgagtgcaggtgttgagtgtatagtctggaggtgaggggagaggcctgggctgggaagaagttgggagttgtaatagcagcgtcatttagagccataggatcggatgagcccactccaggagaatgagtgtggataggcatagaagaggactcagaaccaaggctggcacatgccggtgttcaggggctgccagagatgacagaaacggacactgagtttgagcatttagggagggcagaggaaacatggagagccaagtggaaggtgttgcaggaaggtggttgtggtcactgttactgaaggatactgaagggtcagtggaatgaggacagggcagcagccatgaagtggaacatggtgtagggaggcgcttggctccagagacacactgtctgcctacatcactcaacaggtttgtaattgtcctagtccatttgtgctactataacagaataccttagactgagtaatttttaagcaacagatttattgctcacagttctagaggctgggaaatccaagatcaaagcaccagcagattcagtgtctggcaagggcttgctctctgttcccaagatggcaccttgttgccgtgtcctcacttggcagcaggagaagaagggcaaaaacagactagccagcctcaaacccttttataatggcactgttcccatccatgagggcatagccgtcttggcctaatcacctcccaaaggcccctcttaattgctatcacctttgatgttaatttccagcatatgaatttaggagggacatatacattcaaatcatggcagtgatctaggccaagttatggaacctctttaagttccagtttcttctgtaaaatggatgttaaagacggtgcctgttgttgtaaggattaagtgagtctatacgtgtgaggattaagtgagtctatacgtgtgaggattaagtgagtctatacgtgaagcacacttagaatagtatctggcccagaataaattgtagctattcgccgttactgtcacagtggcatccgatgacccctgctcaataaaagtagaatagagagaggattccccatctctggatttacctgatgcctcccttgcgctttctttccttctccatagacacatagcaggtgggactggtcccaaggtttggattcttggtataggaagcaagtggttcccacttgaggcattttgcctggattctgttttggaaatgttcatgtttggttggtcctgaagtcttgtataaatcctactttgacatgtaatctttatttttgattgtagtagtagaaaaaattaaccatagtatagtgaaaaaagcacaggttttatagtcaaacaaactttgattgtttctcagctctgccatttattagccatgtatctttgggcaagttacccaagttatctcctgtgttagttagggttctctagagaaacagaactaactaataggataggtacagatagatgagaggggatttaggaggctgagaagtctcaccatctgccctccacatgctggagaactagggaagctggtggcatagctcagtccaagtctgaaggcctgagaacctgggggccgctggtgcaagtcctgcagtctaacggctggagaatctagagctgtgatgtccaaagacaggagaagatggatatctcggctccaggagggagggatggggcaggaggggtgggggatgggggtgtgcggaggagagggagggagagagagaaagagggagaaagacaggatttgcttttttgcttttcctctgcatttttttttcctagttcttttcaggccttcaacctattggatggtggccgccgccccccccccccccccccccccccgcccatattgggtgagaatggatcttccttactcagtctactgattcaaatgccagtctcttcccaaaacaccctcacagccatgcccaggagtaatgttttaacagctgtctgggtatctcttaacccagtcaagttgaaaccttaaaccaaccattgcacctcctctttaactacttactaagttgaaatgataacatgctaaaatttcgcacctttcaaaattgtctgtaggctaggctgttttatgttaaggccttctcatggtttatggcacagggtaggtcgcccatgaatgatagctatttctgataatctttgagctcttctgaatgcagatcctttaaaaatatttatatatttattttctattttcattgttaaaactgttacattaaatccaacaaaaatatttctaacgaattttagtgctgcaagggttttaggacttcagatgcccttgatgttctggagaactcttttgccttaaatgatgttcctgttcccttcttcttaagatttgtctgttaccattgtctcttgttatgaggatcccttcctctgggagctgattgagtggaggcagttgtggtagttctcagccttcagcaggaattgtaagaggtcatttgcttcccagaagaattgttactccactggaaatcagcaggaatataagaatgtaagaagaaatcagatttttttttttttttgagacggagttttgcttagtcgcccaggctggagtgcaatagtgcgatcttggctcactgcaacctctgcctcccgggttcaagcgattctcccgcctcagcatcccgagtagccgggattacaggcacccgccatcatgcctggctaagaaatcagattttaaaagaagataggaatttgtttttatgagtcagggtgctacctgttttgttctggtttaagatcacattaccttatttctacttagtattgccttttttttggatttgtattacttgttggttagaattcagtagtactgaaggaagggcccttttgtgatccttgctgaatgcccagtgcgtagtgggcactccatagatgttagttgaaagacagaaaataatgagctggaggatggtagtgtaggcatgccctagtcattaacttttctggtcatctttgatctgagtgtgctgttgtgtatgtgaaagaaaataacacaaacgtctttaaaacttttgagagtctgttctaaatagctgtctcgaatgccttatctttttgttcttttttcagattattagactattgttgattttatagaattttcatataagtacattttaaaaatggaaataattaaaaatattgttgcaaaagtgttttctaaaaaaataagaattaaggtagtaaaagagcacccaagaatgtaggagatagaagataaaagccaaatacatagtactctgcttcccactttctctgcaagctttatttgggtagatataacctgattgggtaaggctctaaataaaaatagtatttcaagcccagtggaaatcttttactcttggaaaaatacagtgtatatattttaaaaactttttaacaatataatttatcaataaattttatttcctacaggtataatgtgaatacagatttttattggtttcaaaagtttatattaaattgacagtcctatgagggaaggatatagcttggtatttctccaagtgtatcatttataaagacctacgtaaatagcttacagtaattgtgccctaattatttagaaattgtgttactaaatgtgttttaaattcatgcatcagatatcacatcctgtcttgttcaggggccttaaggaaattatcaaacacaatgcagtcatcttatttaaaaggtatttacattgtaaatagaccggaagcaagtaacctagcaagatatctgcctagtgtccagcagccttgcaggagttaaaagcaaaatttatcagacatcaatagtttattgaagaaatagtcctttttgcttcataatttgcagaaggctgcaactgtcagtcatgatgtactgcctcttgaaattagtcaatagagcaaacagcaagaattgctgtgggcagaaaataagcactgtaatcatgacataactggggtcagtgatttatggatttcaatatagtagtagctgcatatgattgaaaatttactaggtcactagtgcaccaaaaattttattcacagcctccaggcatcttttgaaatgtgcaacaaaataaaaacctctgaacctgttttgacactgcaaactcagtggatgacatgccagcccagtgagtctcatttaaatgtaaatgtgtcataaacttttgtaccatgctctttaaaaaatgccagctacttgaagggataatgcatgtgaaactgatttacatattaaagtagtgaaaaaggaccttgtaataatcaagcttgaattcttttattttaaagttggaagctgaaggtgttcctgaagtatctgaaaaatatgaaattagctctgttcccacttttctgtttttcaaggtaaggataaaggtggtacaagagattatccatttgtagggtgccatggggctacctattttgtttctttaccctctctctaatccccgaatattaggtgtttggctgtttctggccctccacctttcttctgatagtctcatttttgcaccgatgctgagaaagaagaccatgccagctgcttgccagcatcttagaaaagtagcatggactgtgtagggccagcagccagaatcagagcttcttgatcaaaattcagatatgtggctgtggaaccccagtgttccctgagttggttaaattggttgtttagagcatgtgcctggacataatggaatctctggctggttctggtttgatgaatgacttttaggaagcaggtgcacacctgtgcttccaggcacccatgggtgtcatcgtagttccccaaatacctcatttatacttagtaatagattcattccagccaatgtgggggcagtcttttttgtattatgttagactgacctgatttgactttgagatgttgcagtgttttctcagtgtgtttctgagaaaagaaaaaaattatgtatttctaaaattgagatgcagtgcaggcaattggcaatgagggtttctttttttacatctccggtaatactgttgtcccctttaaaaatctgctataacaatgtcattattatggaatgctgcatgtattctaaataactttttaaactttagaattctcagaaaatcgaccgattagatggtgcacatgccccagagttgaccaaaaaagttcagcgacatgcatctagtggctccttcctacccagcgctaatgaacatcttaaagaagatctcaaccttcgcttgaagaaattgactcatgctgccccctgcatgctgtttatgaaaggaactcctcaagaaccacgctgtggtaagaagctgcctttaacataatataaacaaaatgggtgctttcccagaatggggtatggttgagatgggcatcctgtttccaaggatgctataccatacatcttatacttgtgttcacatacttttagaaaatcaaaaaggttataattcccaatgacactatataagaattagtttgcattatggactcagcatgttggaaccaaaaggggtctcagaactcatctaattcagatttttgttttatactgaagtcctcagactcaaagatagaggtgacttgcccaaggtcacctggtaagcagagttaggattaggttccaactaccatattgctgtctcttttgcctgtttatctacttttgctgttaacagttattttttctttcttggcagcctcctgtttttcacctagttcagattcagcaattaaaaaatttgcggaatttttcagtgtttttgtgtccagcctgtgtgcttttgcctcccctgtgtcatcactgtctaatgattctcttcctgcattgctgtcatttccagtttatagctgctggtaatggaaagattccgaattcttggcttgtagtcactcttattttctgtacacatggatgcttataattttgtccttaagtaagttttagagttatttgacccctctggtagtgggtttatgttattttctttttactgtgcctagtacaacattagtatgctgcataattgagcatttaatgccatttgatgatgctgttgagactctaagagtatttgtatcaactacacaggagggactttattaagataggggcagtaacattgagtatgctcttgatatgattacagcatgtccagagtgactttataaagatagccaagcttctagtgtgaatttgattctaaattcttccctgtagggttattaaattacatattagcttatgataatgtctagttttaaaaataaagtttcatgatgaattcttattttttcgagatggaatttcgctcttgttgcccaggttggagtgcaatggcacgatctcagtgcgacggaacctctgtctactaggggtcaagcgattctcctgtctcagcctcccgagtagctgggattacaggtgtccaccaccatgcccggctaatttttttgtatttttagtagagatagggtttgtccatgttggtcaggctggtgtcaaactcctgacctcaggtgatccgcctgccttggcctcccaaagtgctgctgggattataggcgtgagccaccatgaattctgtcttaaaagtatctcttagttctgcctaaaaaatttccctgccagtatttatgtgtcagataatgcctgctatttgtgtattgcaaagctaacttagtctgtactaaactaaaggtagcaacagatagtctctgttgcgtttgttattttgtttttaacgggggttgcaaatggttcacattcaccttcttccatgaaacatgaaaattatttcttgtactttgtgcggtggccactaaatgggaacttaccacttcagttgaatggattgtattcagcaccttcattcagatctcaggtacagtagaactggctgtgaaatgtgggtgaagcacacctacagtgaaatctctacagtattctctcctttggggttgaacagcagcagtctcagtcttttctgaatgataaacctaatgaaaaggcaggtggcaacactgaagcttggggaaggagtgctcagaggagaaggatgtcctgggaagtgtgctgcactgggtgtcatgccaggcgagcctcaggcccacccctgcggccttagcaactttggggacaagtcaggtaccctccttgtgcctttaattccttctagtgctgttgggaacaagattggctgttggagccaatcttggagggccttttcagtgtagatattgtatgattattcaagtaaattagagagaaacttagacattttaatttttctgcttaccttttactttattaaactgaatttaaaatatactgctagcatttttatatttatattaaacttatttaaattatgtttattataatggagtgagatttggaagactgtacaaataacagaataaaaaagaagctttgaaatatttcagggctgggcgtggtggctcatgcctgtaatcccagcacattgggaggctgaggtgggcggatcgcttgagatcaggagttcgagaccagcctggccaacatggcgaaaccccgtctctactaaaaatacaaaaattagctgggcatggtggagtcctgtaattccagccacttgggaggctgaggcaggagaattgcttgaacctgggaggcagaggttgcagtgagccgagatcgagccactgcactccagtatgggtgacagagtgaaactctgtctcaaaacaaaacaaaacacatttcagagccatctgaaaacgtagtattatagttatttaattaataaaagacaataaatattttgagatacatatggttgaatggttacagtttcttcttttaaagtacttctatataatttttataactacattttcagtgggtttttctgtttcctgatattttctgtttcatgtctttctgtcacatatagtaaatagatcatttaagaatgttgctgttctttaataaaatacttaggattaattggaaaatatttttaaactgttttcttatgggaacataagtcacctcgaccctctgctgttcctttctgagcctggttagtggagcattgtttttgctcttcttctggcattttagagaagggcgtaggcaaagctccctttataaaagcactggccatctcatcttgtgaacacgcacgtggctgctctttccttattttgcaccaaattagctttgaaagtgctatctctgctaacaccactgaactcccactgcggagtattttgatgtttgttttttgattagtttgtccccaccttgctttctgctaatcagaaaaacatgaatgaataacatttaaattttatatctagaaaaccttgaaagccatttttagggtctctcctggagccccactggactcagcctaacccctgcacaggtcatgtctccatcttcttatccttcatgtgggctctacctgcagaattgtatggtgtgttatgagcctgacgtgtagatagggtctcagttgaaaagaattggattgtccttactctgtgctcctcatgaagatgggaaaatgcttgttttaggaagagtttccagaagcactgaggtatatgtcatcttaaacagaatcttaaatccttgagcaggttaattatttgggaattcttataactatttcagttaacaaagcttttagcaaagcaaaaggtatttgaggcatagtcagatattccttctgcagtgagagtcatccagccgggctcttacttttgaatcagccacagaatcaggtttcagagatgttttttagggtttattgttaggtagtgatgagatgcggtgttaggcacctattcatgtcatgagtagaaatgactgggggtggaaatggggattctgtggcagttaaacattacttttctacatttaaatatttttattgcatgcatgcatttttcttaaaaaaaggtgtgtaaatattttgttactagaataaagccttcttgccatcttatccttaagcgtaacatttctagtctgccactttaactcttaaaaatgaaacactaccaatcaatctttctagtctgcatgtaattgcctaaagctaaaataaagcttcttctcagccagttacagtaaaaatgagttaatatattggcaacagaataaccatcagcaatcagccgttagctgtttactaatgaactcccagatgaataaaaaaatttcagaatcagtgttttacttcaggctgtacatgaacttaacacttcagatgtaggaaaagcaacttatatgctatacaaataaatactagtgcttcatctcaataaactgcagatttggaaaatgtttagagctcacttgtagatccatgttttaatagtaaatatgattttgggtgacatcagtaaagcccattcttgcaattaatcttatattgaattttatggtttgattttatttaaaaacaattgctgacactgctaagtcttatagaaattttgaatctgaagaataggttcttttccagtgaattacaactgtgtttgagaagaagaatgaggcgtgaaagagtagggccctacatagtattgggaacaatggagaagaattagcttatggaaagaaaaatactttttttttcagactaggctaataggtttataaaagactgatattcacactcttattcttcagttataatgtcataataagatgatgtcaaaaaagtacagaataaaaatgtgtcacaaaagtataataaaatcatggaacataaaattgtcgctatagtgtagtaaaaaaattacattacatactttagggaatgtaaatagttttaaaaaagaaactgtcaagttatgacatgagatgagaaagaataccgtcaatctattgatggttcatatataacaacagagaagatagctttaaaattcaatgtactgtgtgtattttagactacaggagaacacatgccttcttgatttctaatttatcctacttagagatagtgaagattgagaactactgaagtgggaactcaggaagtagtaaaatggcagtagaaatgcaacagcattgggttttaagtatagtcaagtagtagttaaaaataacaattgtagaattttttcatctgcccagaattgattctcatagattcataacagaaaggctgggagggactgtcagagcatcaggtcagtctcctgattagtaggaaagtgctgagcggaggccacccatggcctcatcatgtgtcaccttggtgggtggagggagcaggtgtcagattcagatttctggttttgtttaaagacaaggtcttgctttatcactcaaactggaggctggagtgcagtgacaatctcataggtcgctccagcctcagacttctgggctcaagtgagcctgttgcctcagtttccccagtctctgggattacaggtgtgcaccatcacccccaggtctctgctttttggctagtgctatttctcctgtgacaaaaaatgtccatgatattgaagaataactttaataaatacacacaccactttttttttttttttcagtagtcacagttgtgtcaaaaagttaagtcatatctgagtgtgtgatatggttcaaggtcaaataaggggatccaggaatttattttctctttgtatattattcagccatgctaattaaatcaccagcaaaataaggcaggcgtctatgtcttttagatgatatgtacgctgaactaatgtattatcatgtgtatgtgttttgggagagagaagttaagtgctttatttctttttttgtgtacaggtttcagcaagcagatggtggaaattcttcacaaacataatattcagtttagcagttttgatatcttctcagatgaagaggttcgacagggactcaaagcctattccagttggcctacctatcctcagctctatgtttctggagagctcataggaggacttgatataattaaggttagaattgagaagtctgtgctttgtaaagaaattccatttagagcatactttttaaaatgttgtgataaatctaagatacaaatttcttatgaatctatatttactaataagaacctgcaatgaatacacagtatttctgattagttgattgatcaataatctgtgttatggtatgatcaaggagatttatgttataataatttttttcataaaactggtatgtgtgcttattttaggagctagaagcatctgaagaactagatacaatttgtcccaaagctcccaaattagaggaaaggtaagtgttttagaaggtttcaaatagcctatcatttaatatattaaaaatattttaaagtcctcaggttttgcattgctctttctgtgtagaaatcaaggatttggtatgccagacgtcataattgtttagtcacattagccattcaaactttggcaaatctaatttgtattggagaaattttagcaccaacttagtgatcatgtggaggatctgctttgcttttatagaaatgtcattgtttctgtggaacaaccaagttttgcttacctctctgcatttcagagccagggtccagttgttttgtcactgctccttggcgtaacctcagcacactcgtgttttactgggtgcagccttggtgactgctgcgggtgctgccccaacgccagagcactgagtgacaagtggtgagtgtgaaaaactcatcacctcgcaacaagctttgagcacttctcatggcctttctagaccacgagaacttacatgaacagattttggaggtgtgaaacatgtatttgttttatcaaggatctcacttggcttttagagacgttctcttacagaaatgttggactttggtgtgtaaggcaacttaatgggatttttattgcagtaaaattaatatagaactttaaaaaggaatttattatatcagcaatcagccattcatagttggggctggagattgtaagataaaccttcctttggtaatttttttttgccatgtaacatcttgagaatttctaaaagtgtttaataataataaatacctcatttgtctgtcgttaattaataatttctataaacagcgtccaatccacgtatgtcaggctgatctttgagtgccgcattctgtcctgtggttggtaccatttcctgtgttcttcatgagaaaatgatactcctcatcccttttttgactctgggcgtcttcatgtgtggttcttgcctgtagcctggtgatgcccttggcccatggaggctgtgtggtctccaaagacagctgtgttttttatatgcttgtatttgctcttcagttgattttccttctctgctgagtgcacttgccgctgttaatggccttgtctccatcagacctccgtttcctaatgtgctgcttctaaatctgtgcttgcagacaccaaagggtaacgggctagaattatgtcggaaggaaaattcagcatatttggagtaataatttaaagggctccgagtgagcagagtgtaggaagtggagttcatggacttgtgacatgtattttggcagtactttgtgagctgtggttccctgtatccaggtgactgggttagttagttgggttgtcagggtcagcattgtattcctatatctgttcatatttttctgaacttgagctaatcccactcggttggcaatgtaagtgatacagctttgtgcgtgattgatgcatttcatttgggatgagtttataaggatatttattattatttttttttgagacggactctggctctgtagcccaggctggagtgcagtggtgctatcttggctcactgcaagctccgcctcccgggttcacaccattctcctgcctcagcctcccgggtagccgtgaccacaggcgtccgccaccacgtccggctaattcttttgtactttttagtggagacggggtttcaccgtgttttgccaggatggtcttgatctcctgacctcgtgatccacctgcctcagcctcccaaagtgctgggattacaggcgtgagccaccgcgcccaacctctaaggagatttttgagctgtgaattgggagaacatggtggcgtgaccccatggggcttaggttctttagtgacccgttgtcccagcactgacttttcttgagatttgtgactaaacttgtggctgtatacagataattaaaattcctgacagcatgttagattatgatgtttgaaagactatataaaatataaaacatgttaagatgagagaatttgattttagtatctggcattagttgatgttctgaggtttaacgctgtcaccctgcagtccgaccttgtgagctttacacgtgtacagtggtatgcagcatcatgatggaagatggtgcacacaagatctagttctggaagttttggatgggcttaatatataggccccttattgaacaattccttactgaattggttattattattatttttttattactgtgagttgatgggcttaaattgcaacttgaaggaacattcgttgccttaaaagccatattgtgttttacagtggcttagggagagaatgaaatcaaggaaaatgtcaacgcatttgcttgtttaataccactcaaagctgtgaactgtcatcctgccatccctcaaatatgcatgttactcacgaagcggaggaaaagtggtgttgcataattgagctgagccgttttatatcaattttctctctttaggctcaaagtgctgacaaataaagcttctgtgatgctctttatgaaaggaaacaaacaggtaaagaactcaaaaatggttttatttgtaatttcttttgatgttaacatctgcaacaaggggacagttaaatctttttcctagctttagctaatgaagctgtagcgatatcaggaagttatccacgccttaattggtgcttacggagatcaaacaaagtaatctacattttgcttgactttatcatcaacatctcagtggggtgcatttctttctgctgccaaactttgtcagctaatgtggtcaacactgttaacactttactggttgtatgagttgttatgtcattatcctttgtttgagtttgtggactgctgaagtgtgcagctgagtcagtggacttcctgaatgcagggaacctggtcgtgcttgggtttgcacccctagatcgtccttttgtgacagtggaggagcaaaccctggctgtagcaggtgtgctctgtgtgtttgatgaatgagtgaaatggtcagcaattctcatttttaatgggatggttcttacagctttttgatgtaagtacatattgattatgcgtcattttgaatatcaagtttgatagattacttccaccgatagtttgagcagaactaattttctttcagattgagatcagagtggtaatttccagaaaccagccatacacatttatatcatattttgtaattttcatagcaattgaacctctacttaattctcaatcagttgttgaagtaggcagggttggacagactttggcctgttttagagataaagaaaccaaagttttgaaaggtgaggctgttggaataaagaaactgcctcacttgttagcaagatgcaccgggcaagtgacatggagaaccactttgctcattgggaaagggacacaatacttcacagggcagactctggttgccataactagtgtataagttaacataactagtataatgaagctaattagttaacataactggttaatataattaggtaataatgaaagtaacagtaacaaagaaaatgttaatataaatttcagcatgttggaaacattaggttagggcctaaattctttgattttggttcagtgtattgaaacaatagaggaagttaataattcctagtaatgataaagtgacattttttcttattctcggtaatggtttaagtggatatttattctcaaaactatttttttctggaaacctagaaagtattaatacattttggaaacaatgttattggggctattaaaatgttgacatggtaccatatcttttccacaagattgctggaatttggagtcctgtggcatgaaaaaagcttaagattttcataaactcaaaaaagtgttagtattctgtaatgtaaaaataaatgaggctggatgcggtagctcatgcctgtaatcccagcactttgggaggccaaggcaggtccgaggtcaagagatcgagaccatcctggctaacatggtgaaaccccatctttactaaaaatacaaaaagtttgctgggcgtggtggcgcatgcctatagtcccagctactcgggaggctgaggcaggagaatcgcttgaacctgggaggtggacattgcagtgagccgagatcacactccagcctggggacagagtgagactctgtctcaaaaaataaataaataaataaataaataaataaaataaaaagaaaaatgggagtcagaatccagttggaaatgggaaaataattgtcataatcattgcaaaaaggctaagtgagttaagatcattttgcatgagtgaattaaacaatgaactcaaatctctgtagaaaatctcggtttcacttagaggaactttttgaccacagagaatataaactgttggaacacatgtcatctcaagtggttacaaaccaaaggaaaaggaagtctgtgggtcacgtgtgcctgggttgatgtgtagatgggttcgtacttgaagaggggatgagcagaagctctgggagctgagtgaaagtagtggcagctatgctggacaagtgctgtgctggttgacaagagtattaggtacaaccatgctgcttgggtcatacaaaaattgtaatctttgcaaattttttttcatttaggaagcaaaatgtggattcagcaaacaaattctggaaatactaaatagtactgggtatgtaaatgttgttttcaaatggtgtattaaaaaaattccaacctggccaggcgtagtggctcacgtctataatcctagcactttgggaggctaagacaggaatattgcttgagcccaggtgttcgagaccagcctggacaacatagtgagaccccatcgccacaaaaaataaaaaaattagccaggcatggtcacatacatctatggtcctagctacttgagagactgaggtgggaggatcactggagtcttggaaggtgaggctgtagtgagccgtgattgcaccactgcactcagcctgggtgacagagcaagaccctgtctcaaaaaaaagaaaaaaatatttcaacttttcagttctgccactgatacttttcagttgtaatgtctatatccatacatatctgtatctttctttattttttgctgtattgttttgtgaatgccttaacttagatcaaaatagtattttctggccagtgtcaacctattagtaacataaaggaggtctttaggccacctttggaataactatttgtctactttcccagaggaaaatgtataactgagtcctcaccatgcataaagatatttcaggggaatatattataggtagtttttaatttttctcaaatatcctagttgctaaacagtacagaaagctgaggggcacatattaaggtccattacctggatctgagaggtagcacaagttaaattgcagtgctcctagttttgatgtgctcagtggtgaagctgtcaggtaagaacattgccattgatttttgtggttaaaaacaaaagcacttatttggagatatacagcacatgttctatagggtttgtcagatatttttgtttatttctcatttcatgattgtatcttttaaaaatcatgtattctaactgtagcttcaaataaattactttcaagtaatctttgatatacttcaaagatctattgaaaatagttaaatagtacaggttgaatacaatttcagggacataaaaagaatatagggccaggcacagtggctcacacctgtaatcccagcactttgggaggctgaggtgagtggatcacttgaggtcaggagttcgagaccagcttggcgaacatggtgaaaccccgcctctactaaaaatacaaaaattagccgggtgcggtggcgcacgcctataatcccagccactcaggaggctgaggcctggagaatcacttgagcccaggaggtggaggtttcagtgagctgaaaccacgccactgcactccaacctgggtgacagtgagactctgtctcaaaaaaaagatgtggttgtcgtctttagattactatgacattttatagaagcaagtatagtcagtttattgtaattgtaacttcaagcctgttcctttcttcacccctgccctgggccatacagtgggggctggcttgtttttggtcatttttgattttcccctttctttgtcgaccctctgctgcgggtccacagtgagacacacacagtccatccctctctagcagtaccaggttcctcaggtgtcttctgagccgacacactgggcctgactcagctcgtgtctttggtggaacatcttggtaacttggctttctgtcccatatctgtctaatctccattgtattgaaagcaccctgttgtcgcagagagcaggaggatgctttgggagagcatgacctcccagctctggacttgctaagcgtgattggccctaggatgagtgaggccatccaggacctcagcttcgcttaacacgagcagaccatgctcttgctgggcgccaaatgtatgtggagaaaactcctttttactttttctcatttcttatcttttcctttagtagccaaaatacacatgcatgagtggttgagaaccaagtgtatattgaggtttgaaaggtaccctttatgaataacttttaggaagtatactggctgttaggactccacatacatacacttgggcccagtgcttcctggatcctttatgaatagttgtataactcattgtttttatcacagtattaagagatctgccacctttagttcaacttgaacaaagacttacattggggtttttaaaaagcattaggtttacattggggtctttttttgttcttctttcaaacattccttttttggtaattgcttctgatttatcccgtcatttagtttttttgactgttccctgtaccatagacagtttccttgggaacttgtttactaaataaacaagatttccctatgatggtttcagttttatggaaagtccagttttttttacatgtagcattttctttggccacctttgggaattgcacctgtaccctcaggcaccctgcaaggatttaggcatacatgcttgctaatacctgaccacctaacggtgaaatcgctctgagtggatacagttggatattcatgcagtgatttttcattttttgtacaagtaatgttcattgtatggtataaagccacaaagctttcattggccttttgtacattaaaaacagcaccctctctgaaataagtttaagtgtggaaagcatgtctcttgctaaggtggagggagctggcagcgtggttgttatccggctgctgagccctccagcctccgtccacgagcactactacatcctgctgcacgggcagcttccaggaggttaagaagcagcagcctggggtgggttagacattagaagtgggtaagagtgttcagttaatgaaggctcgtgcagatgggggtgtgggtctgatccaggggttggcaagttgcagctggctgcccatttttgtaaataaagttatattggcacatagccacatcccttcatttatacattgtctgtggctgcttttatgctgacagttgcagcagagagcagaactgagcagttgcagcagagactgtctggcctgtaaagcctgaagtgtttagtgtctgactctttaagaagaagtttgcccacccctggtctaacccaatattgtccggagaaaaatccagataaagtcatatgttggaatgactaattctgtgtagtaccagacagattaagaagtaaaatcatttccattggtctgtagtacattttgttagcagtgaaacggttttcttgattattttaaaaacatcaaatgcatagaggttttacactttgatttaactgtatttccagttaaaatgtcttctcttttttgcagtgttgaatatgaaacattcgatatattggaggatgaagaagtaagttctgtgtttgatgtttcacccttgtcttagctttaatcttaagggcctgataggatggtttcaggattcctgttgtttctttaggttcggcaaggattaaaagcttactcaaattggccaacataccctcagctgtatgtgaaaggggagctggtgggaggattggatattgtgaaggtaaggccagttcttctgctgttctaaagaacggaaaagattttggtatgtttaaaaatgatttcatattgaatggaaacttgagagttgtttttgactcctgtttccagcctgactctcagacatttctagaccagtatcaccgtttctgtgtgcatgactaccctgccattctcactgtccccacgtggcagcctgttcttactttcacacctgagctaaccattgcatctcctttctgtggggtgatcttccctgtcactcagggtccttgttagatcctgcttcagctcccagacaacaaattgttttttcttgccttactcatctgcccttgggtgcatggagtgacagcagtgtgaggcctgtggcccggtgctgcccatccttgccacagaggctgaggatcactgcccctggtcccccgaaagaaaaaatgtaggtcctttttggttttgagatgcttggaaatctgttatctgttagattgtgttttagataagacaccatttcttatgtatcttgagtccttcctgatgctttgtgtattttaggagttcagtaaatggttgttggatggataagtgactttacttcttgattgagttttaaatggacgttactttgcatgtatttaatgtctagaattcagggcaggcccaccaactaacacctgtgtgctctgtagctctttgattagcccaaaacaataaacagaagctgtagctttaatatctacacacagaccccactgcaccccaggcccactgtgggcatggtggcatcgaggagggtggtagctggttgggtatagagaggagctagacaggaatgctgggcaggaatgccagggtctgctcaggggcatgaacaaaactgccccgaaaagtgggttgctgactgccctcaggccttcctcttgcctcaatccatgagagaattttctgaggtcagatcttcgactttttatgtggaaaacaaatagcaagtagtactacttctagttatgttgtaaaataaaagttttttttttttttttacatttttttttgagagagtttcgctcttgttccccactggagtgcaatggtgcaatctcggctcactgcagcctctgcctcccaggttcatgtgattctcctgcctcagcctcctgagtagctgggattacaggcacccgccaccacgccccactaatttttgtatttttagtagagatggggtttcaccatgttggccaggctggtcttgaactgctgaccccaggtgatccgcccaccttggcctcccaaagtgctgggattacaggcatgagtcaccgcgcctggccaaaataaaagtttttaacacgtgcttttgtaaagtgaagcactagcctaccactgaaatgacatcagcactttggaccaatatgttttataaaaacaaagcttgagttccattgatgcagaggctctttttgtcctttggtggcctctgtgtaggttttgtttcctgtggagttccaggtttgatatcatacttcttaaacaagccagtgagacatttttcctggggaatggtctcactcctggaggaaaaaatttttaagactattgctcttgaatagccctgaagcagcagaaacagatctgcatttgtttcttccctccctccctccttccctccctccctccctccctctttctctctctctctctctctatatatatatatatagtcttatttttgtaagacacaaagaatactcaaaccccaaatactcttgagcctgttcttgtctgaatgttttatagcctgtaccttagccattggtaactcttgggaagatacaatcaataaatctcatttaattctaaagctaagctgcgtgggtaacttctttttagttatataacagagtgttatatgattttttatgttcacctgctaagaacatatacgtttgaaatgtgtgatattgttaacgtttttccttgagaagatatatggaatagatcttacgatcccattttgatctgtttcttgcagaatgcagttcttcatgttcagttcaattaaaagatgtttgaaatggtctaatctggctggcctctttggagcaatgagcgtttgttttgttgaatgagggactgaatgatgatttagttactcagctaatctagtgtcctgagaaaattgtgagttgttattgcctctgaagagtaaacggttcactactgctgttccagaatgtttggacttaagacagtttgttgagagagatagaagatttggttaggtttagactttccacctgccggctcgcattaacagcagtgagggtggcgaggactgccttatttggcgcgctcccaatgttccaggcacactgctttggtgctttaagaggctgcttcacgtaatctcccaagcagcctcagagagcagaattcttcttagtcagtagatgaggaaacagagacatagagaggtcaggtgaattgtccaccatcccataactagtaagccattgagtccagattccacctgagggccacctgcccttgcccactcagctgcgtggtcctctccgtgccttcttgagtgtgtgctcagaaaagtcctgctgggtcccttggaggggcagggtgtctgcttgttgagtaggtagaagaagatccctagacatgactgaaagccgtctgggttttgtgtgacagcatcattcctatttgaatttcatccagaggaggtcatacggattttaatggttttattgattgatgtttatgctgttcagtgataacctgaaatgttatatcatactaaatgtttctttaaaccagaaaatcttatttatcatgtctgtcctttcaagcttggtgtctataatccagattttaaatctgaaaaacaggcacaaggagcatggcgcctgtactgcagttccagtcaacctggtggtagctcttttgatgccatgtctgtttctgaattgttaggtctttttaatggtttctgcctttccctcttactggtactctagcttttcctgaggcagagatgtgttgccaggttgggtttcaatagcaaagcctgattcctctctgtgagtggaagaacgggaggggaacaagcatcatatttgagtagacttttaacgtcacactgctttttttttcttcctttttttcgagacagagtctcactctgtcacccaggctggagtgcagtggtgcaatcttggctcttgggtcactgcaccctccaccttctgggttcaagcaattttcatgcctcagcctcctaagtagctagaattacaggcacatgccaccatgcccacctggctaattttttttttaatagagatgggttttgtcatgttggccaggctgggcttgaactcctgacttcaagtgatctgcccccttggcctcttaaagtgctgggattataggtgtgagccactgcgcccagccacattacttcattcttcaaccttgaaagtcacttgatttattttccttatttattgctacagtttaaataggggcttcattggctccagttgctgcgtttcctaatactaaacaatctgttggttttaggataccttaacttcatttatttatttatgaatgaatgaatgagatggagtctcgctctagcccaggctggagtgcaatggcacgatcttggctcactacaatctccacctcccgggttcaggagattctccctgtctcagcctcctgagtagctgggattacaggtgcccgccaccatgcccaactgatttttgtatttttagtagagacggggtttcaccatgttggccaggctgttctgcaactcctgacctcaggtgatctgccctcctcggcctcccaacgtgctgggattacaggcatgagccactgcacccagccttatttatttattttttaagagacagatttcaccatgttggtcaggctggtcttgaactcctggcctcaagtgatctgcccacctcggcctcccaaagtgctgggattacatttgtgagccaccacacctggccaagaataccttgttaaattttttaacctgatagtgtattcagggtttatggctcatttagtttgagagtgttaagagactggagttttaatccaataggtgtttcttttggttctcagatatacatacaagctgtgattgtttagatgtttccatctttttatatatgcatatacatattattattgttgttttttatttttaggaactgaaagaaaatggtgaattgctgcctatactgagaggagaaaattaataaatcttaaacttggtgcccaactattgtaagaaatatttaattacattgggagcagttcatgatttagtcctcagaaatggactaggaatagaaaattcctgctttctcagttacatgttttgtgtatttcacaatgtcgtgctaaataaatgtatgttacatttttttcccaccaaaaatagaatgcaataaacatcttcaaattattaacaataattgtatgaaaaaagtgtatctttacagcagtattaaacatacagctactataattaacccaccttaaatctctttttcttagtacatgagtatcttctagcagttaagaaaggcagtcttcagaaaatggagaactgtggcggaatgcagtacacaacagtatttaggacaactcctttgccaacacaatggctcccctcgctggtgaaagatctctttacagcttaggaaaaacaacggaaattagtttctgatgtcattgctgagctcggcactggttacattgcagaggcagtgtaggatgtctgcaggtttagagactcatttcacaaggcaccagtagtgaattatcaagaaacatttaagaggaaaatgatttctcattgaatatggtacaacaagcacttttttcataaggtctagaagaatgggtagtcatgacaaagaatggaaaagtattgtcatttgttgtaagcatcactacttttttttttttttcagacggggtctggctctgtcacccaggctggagtgcagtggcacgattatggctcattgcagcctcgacttctcggggccaagcgatcctcctgcctcagccttctgagtagctgggaccacaggcgtgcaccaccatgcccacctaattttttatttcttgtagagatgaggtctcctgcctcagcctcccaaagtgctggaatttacaggtaggaccaccacacttggtccacttacttataataaacattgatttggtcgttcaggttcctttggtcctcctattgagaacagtttgaagtccatgaaaattttaacaatatttttgatcctgaatctaacatatttgaaaaatagttgctccactaggcttccacagtgcaggcttcaaatgggatggctaaattcacctcatggttcttagttttttttgtacttgtggcacattctcttcatatattaccccaccctgtttgtttgggcagttaagatgctggtactgtctggtggcgataaggaaagggaaacagaagtcagtaattcagacaagaataaacaggatgaaatgcatctattcctaggtaagattagcccaccacctccacactgctgctgtctcttcagctcaggctgtttttctctgttttgattgtgtaaagagtagagtgctgatttgtgtgttacagagggtggtctgtacaagtcataaagctcgacatggccttgcttcctgctaggtgttaggacacccatgatggtggagtctcttggcattctgtgtaattagataaggctgtttatagcattggtccatgagaacttccttgtttctatttaaaatgaaaatcattgtataagtaaaacttcttaaatgtagatagaaatagaatttttactgaaattttatgaagccattggccgcagggatgtgtgtcatggaggagggctccatacttttttggtatacttatctcaaacttaattcatttgcatactgctttttctctaagtgccaactgtcctagtatattttctaagtcaacttttactttcactttatcctaagcaagaatatctttggcatcacagactcagtaagcctgtttttttctaatgcacatacaaataaataaaatgcacaacttttaacataaatggctgcctccaatttgggaaatactgttctggccagaggccgttgctctgataatgtcatgtggttagtgcattttaggaagacctcctttccctttggttgactcctgcaggacataagatatcagtgacgttatcctttgttgagccatcctggtttgagtcaggatgagtgttgagagtttttggggagttgcccctgtgtcctatattattttatcctcttaaagtctgatggtctttggctccactgactccaggtaagttggggtgacagtgcagcatatttctattttctagttgtttctggccagacatggggaaggtcaagacatcttgttcatgcaaacggattgatggccattcctaatctgattttattagtgtattttaggaagtaaagtaagattcttgagcccagctgaacttcccctattgaattttctaacaaaaagagagtttgcgtatgggtttataattgagcctgctcttgtagaaatgttttatcagaattgaaatcctctctgatccccaaattctagagacaaagttgttttctgaatttgagaaatctgttcagttcacaaggaaaggtgacaatgtgtcatttggatgttgtcccacacgtgaggcctcgttgggtgcttgtggtgggagggaccctccaggcaggctttgtatggagggttttcatgtctggacacatttctgttccgagaagcactgctgcgtttttgggagcgtggaccctggccagagcctgtggccagctctgcctgccctccctttcttggcctgctcttttgagtatgtagtggggctttgtgtggcatcctgccaggttaaagctgcatggtgcttaggatagagctggtgctgtggggaggctcttgatgatgggggctgccatctatttgcctgttaactcttagaaaccaaacctcaaatgtcagaatttcctttctagaagaggctggttgaataggaaccagaaaggccctcatacaggcagggctgttcactcctcttgacttgcgtgtttgtgccttccttgtaggaaggcttcttagggaattgttatctgtttaggggaaataagcctgcaggaatgaacttttttttaaaataaaaactcttgatcaaaaatggaaagaaaaaaaccagtgaaacaggctaggtagtttgtggaattctcctttgcaggtgaggggagaaagcagctatctcaagggcacagctacagattgggagctggggcttccatccagggtctgggacacccaaaccttaggcttgcccctcccgggaggcctccccctcagagctatgtgggatgcagttgcctttttacctgtgatgagaaactggtgaattgccaggattctggctctggcttcagtctgcccctttccggggattagagggcattaaccctacttcctacagccaagcagctcttcctcatgactctactttctaactccgggggttgactgattgatttgaagaccgccttgttgatgaatgtgttgaaacttgctatcataatgtaaatgctccttaataaaataacaggacctggtgggttcagttgccttgcccacgtgtgacttacatgtttttgcctttttttgttgaacactgagccttgcagaaccatcaggaagtccaccttggtcccactggattgatcattaagaaggaaggaaaaaagttatttgccatttccgttctttacaaaaatgtcttaagtctgctgaggagtagactaaaaaatagcatgtttttataattagaaagcctcattttaataacttaaaaatgtttaatctctgaaacaactgtaatacattttaagcgcttggtaatcattatctgccttattggaaagaattatacaaataagacctatcttgacagtcaaaagttacaagcttaagattgcaatatgaaacatgatttctggtttagtttttaaagtaaaatcagctttcttttcctttgttttttgagacagggtctcctctgtcacccaggctggagtgcagtggtgcagtcatggctcacggcatccttgacctcccaggctcaagatcctcccccgtcagcctcctcagtagctgagatgacaggcatgtgccaccatgcccggctgtgttttgattttttttttttgtagagatgaagtctcactatgttgcccaggctggtctcaatctcctgggctcaagtgatcctcccacctcagcctcccaaagtgttgggattacaggccctagccaccatgcctgacctaagatcagttttcttaaatttgacagttgctacttttcaaaattcaaacctttctaaataaaagtaagttgattatttgcagatgaattcttgttttatacacatttcagatgttgagtttgaggacctagacccttccctttttgtctagtcacatttcctcacggccgtccactgatcgttgaatcagcgtaaatatggacagtttctcttgagtctttgggtcttcatttctgaaggctcctgtgtcacgtaagacttaaataaatcttacgcttttctcttgttaatctcttttgttataggagtgtcggctgtgccccttgtgatgggtgaggaaaggtatccacctttctgaatcagacacaagctgcagtagcttcctgatgcctcattcaccaggatgggtaactttaaagacaagttttataactggcatcccatctggtttcagagtcttgggggcttttttcatacagctttgtctgatatttagagacattcagattcagaagccatgagttcagttagctcatgggccgggcacgtgcactgactcactggctgcagcagaacacgttgagggagtcttggtgcacttaggtcactgtaaggttctagggctgggagctgggatttgaaccaggatctgtcagcgcagccccagtgctgtgcttgaagcctcgtgccacactggctttgaggtagcacgctgcaagttagtgagtggagttgcccaagtctggggcttctgaaatgacctggtatttttatgttcctgttagaaatggtgtggctttcacaaattaagtgccaggctgggcacaatggctcgtgcttgtaatcccagcactttgggaggcggaggcaggcgggttgcttgagctccggagcttgagaccagcctgagcaacatggcgaaacctcatatctacaaaaaataaaaaattaactggtc

SEQ ID NO: 37138 - DNA, 8863 bp, Homo sapiens
acttggctctcgccctccggccgggaagcatggggcttcccaggctggtctgcgccttcttgctcgccgcctgctgctgctgtcctcgcgtcgcgggtgagttcgctcgcaggggggccgcgccccggctaggggtctgcggtggagcgtgccagggagcagagccagcggcgcggcggggtcggggcgttgcgtctgggaggacgagcctcctccctgggtccccgatccccgggcgccttgcgcgcgagcaactcttctttgcagccagtttgcagccgggattctagagtatcccgggagcagcactcggaaggcggggaggaggctgcttctgggaacgagaaggggtggagctcagcctttcggggtgctggggggtgggtggtccctgaggtgctcactctgggggcccgcaattgaagccgggcaggaggcgcagctggggcgcatcctcaaagcctgaattccgcgcccgcctgttgctggaaaaggcagcttccttcgctggagggggtgcgccgacccaccccttcccccttctgcctgggcatcacgccaggctggaggtgagcgagagcgggaggttcggcggctcccgcccgagctgggcgttggcaggggttgcggggcggtgtgggtcgcctcgcgcctccccgagtgatgggatcataggggacagagatgagggatggaggattcccatactggaagcgcccgctggcttattttggggaccacattcaggtgggaagtgcgcccgggcacctcggagcgtttctccggatccgcctggtagcagggcgctctcgggtccacgctgcccttgtatggcccgcagcggtgtcgcgtgtttctcttggctcccattccgccgtcccagccgctgtccggctggggaaggggagggctaggcaatacccagctcgctggcctcatgcccagtgccaaccatgtccctggggtattccaggctactgcctcccaggctgactttatttctggggaaagggctaaatcgggctccacagttgcagccggtccagctccaccctgccctgctcttctagctctgggaggagtcaggggtctgaggctctgggttggagaccccaccttccacctgccctccttgtccgagagccaaggtaacaacccaggcatcccagagcccaggcagatggtgtcgagtgacatcacctcctcacagggctggcagcacgctggcaccactgacgtcactcctgcccactgcctggcccttgccctgacccctgggggagactctgacctctccatccttaccagctacctagggtggggtccgcgggtgtgtgcggagtgttcatggaggtgctgctgagggagcatgagaccggaacttccgccagagttagcccgctggggagtgagggcagggattttggagggcagaggatagagcagtggtgtcttcccctggcggtggtgacacaaaagggcctgtgtgccccagcctggcacattctttgcattcccacactctgagctcacccggagaggagggggcctggaaggaaaggggccttcctcttggccccgagcctaggttgcccctttctgcccctctaccagcctcagctggagctgttcggtgctcagtctctgctcaatctctgcttggctccaaggacctgggatctcctggacggggagagggctggcccaggtggggcgcgggtcggggtgggggtagagcgttcagaggacagggccctctgcagaccctctgagtggcaggaaaaacagctgcagcagcgctgcgaggggaggggcggacagcagccggagctgacacagctgcgggggccccgcctccctcccccaggtgtgcccggagaggctgagcagcctgcgcctgagctggtggaggtggaagtgggcagcacagcccttctgaagtgcggcctctcccagtcccaaggcaacctcagccatgtcgactggttttctgtgagtgcttgggctcctgcaagagcagcccggggagggagactctgcccctcttgtagcccaggacccttctcctcctctgtgtctcctcccattaggtccacaaggagaagcggacgctcatcttccgtgtgcgccagggccagggccagagcgaacctggggagtacgagcagcggctcagcctccaggacagaggggctactctggccctgactcaagtcaccccccaagacgagcgcatcttcttgtgccagggcaagcgccctcggtcccaggagtaccgcatccagctccgcgtctacagtgcgtgaccctgtgtctgccagcagggtagtgagggtggtgggacgtggccagatgtccccctcatttctattttcttgtagaagctccggaggagccaaacatccaggtcaaccccctgggcatccctgtgaacagtaaggagcctgaggaggtgagatgtgtggcaggtgggctgggcagctggtgcgcagccgctgagatggggcttgaagggggctcggaggcagggagactcacaccctgtgctctttaggtcgctacctgtgtagggaggaacgggtaccccattcctcaagtcatctggtacaagaatggccggcctctgaaggaggagaagaaccgtgagtagccctttctcccaaaagccacccttgggccaggtgtggtagctcacacctgtaatctcggtgctttgggaggccaaggcaggaggatctctggaggtgaggagttcaggaccaccttggacaacatagggtgaccctgtctctacagaaaataaaaaaattagccaggcatggtggtgtgtgcctgtggtcccagatacttgggaggctgaggcaggaggatcatatgagcccaggaaatgaaggctgcagtgagctaggattgcaccaccacactccggcctgggtgacagagcgagaccccatctcttaaaaagagctgtccctatggtactacacaggaactgccttatattttcattaagcttttaacttaaaaaaattatacaaatggtacttgaaaatattttcatgagaatttaaactgacaaaaaatctagaagtttcttcttgcctgagaccccccctcccagaaataatctctgctatcagggtgtgttctttcaagcctatttctatgtatttgctcatatatagaaatatttctagaatgatataggcttctgtgttttattatctaaatcagtcattcttaaccaggggtgattttgtaccccctcctcctaggagatacttggcaatgtctggagatatttttggttgtcacacatagagggggtgctactgccatctagtaggtagagagaccaaggatgttgctaacatcctatagggcacaggacagcccccacaataaagaatcaacgtggcctaaaacatcagtagtgctggctgggctcacgcctgtaatcccagcacttttggaggccaaggtgggcggatcacctgaggtcgggagttcaagaccagcctgtccaacacggagaaaccccatctctactgaaaatacaaaagtagccgggcgtggtggcgcatgtctgtaatcccagctactcaggaggctgaggcaggagaatcacttgaagccgggagggaggtggaggttgcggtgagccgagattgtaccactgcactccagcctgggcaacaagagtgaaactctgtctgaaaaaaaaaaaaaaaaaattatcagtagtgctgagaaaccctggtctaagtggtggtgtatggtatacattgttagacaatttcttttatacaatgtttctgggtcagtctatttagatcaactgatcgttttgcttactgccaagttttccatactacgcatagcaggtagtcgagttcaccattccccatttagtggacatctagacggctgctcgtttttatcattgcagcattctttgcacacatccttggatatgagcagacatgaaaatgtttttctagggttgacactgagcagtaaaagtgctgggttgaagggtttccagcttgcatttgtacctggccttctacaggggacagggggctatttagatggtcccctgccaaccccagtggacaaccctagggtggggctggaggtggggctgaggctgagtcttcctccccttcctccctgcccaggggtccacattcagtcgtcccagactgtggagtcgagtggtttgtacaccttgcagagtattctgaaggcacagctggttaaagaagacaaagatgcccagttttactgtgagctcaactaccggctgcccagtgggaaccacatgaaggagtccagggaagtcaccgtccctgttttctgtgagtactaacctgactctctgcttactggggctggggctgctggaaactcctgctggctcccccttatccagcccagggttgactcatgggccaagagctaccccctttgcctatgcagacccgacagaaaaagtgtggctggaagtggagcccgtgggaatgctgaaggaaggggaccgcgtggaaatcaggtgtttggctgatggcaaccctccaccacacttcagcatcagcaagcaggtgtgggggctttgtgctgggtgcaggtggggatgcaagcagagacccaggtggagtggcgggaggtgcactctgctcacctccccaatcctccctagaaccccagcaccagggaggcagaggaagagacaaccaacgacaacggggtcctggtgctggagcctgcccggaaggaacacagtgggcgctatgaatgtcagggcctggacttggacaccatgatatcgctgctgagtgaaccacaggaactactggtgaactgtgaggggctggggacccaggacagggggaccaggctggggcaatagggaactggccccaccctgccctgggtgacatgattgctgtacccccagatgtgtctgacgtccgagtgagtcccgcagcccctgagagacaggaaggcagcagcctcaccctgacctgtgaggcagagagtagccaggacctcgagttccagtggctgagagaagaggtacccaggcgggtctggggcaaggggctgatggggtgggtggggctggcggtgacaagaatgtgctctttcccagaccctctgacccatctctcatcccagacaggccaggtgctggaaagggggcctgtgcttcagttgcatgacctgaaacgggaggcaggaggcggctatcgctgcgtggcgtctgtgcccagcatacccggcctgaaccgcacacagctggtcaacgtggccatttttggtgaggccctccctctgggtagagaccaggtcaccccaagtggggtggtttttaagctctttgacaaaaagccacctgctgccctggggagctctggtgcggagggggaggcaggctagctgggcttgccacctcacctctccctacctccccaaggccccccttggatggcattcaaggagaggaaggtgtgggtgaaagagaatatggtgttgaatctgtcttgtgaagcgtcagggcacccccggcccaccatctcctggaacgtcaacggcacggtgagcgggtgtctcatctgccacactctcctaatccctgcctgcgctttgtggccaggaccagagatcctccccatcccctgagctgcctccttcctttcctcgcaggcaagtgaacaagaccaagatccacagcgagtcctgagcaccctgaatgtcctcgtgaccccggagctgttggagacaggtgttgaatgcacggcctccaacgacctgggcaaaaacaccagcatcctcttcctggagctgggtgagggctgcatccctgcaggggatggcaggggcaggcccaggcacgggcagtaacttgcgcttctcctaacacccctccctctgcctcctagtcaatttaaccaccctcacaccagactccaacacaaccactggcctcagcacttccactgccagtcctcataccagagccaacagcacctccacaggtaagccaggcctggcaagagaacagggctgtgccagggcatcctttctgccctgtccctccccagagagccctgtccagaaaggtgagtagcagccccatcttgtcggccctggactggctgggccaacgatggtgacgaagtggcctggggcagggagtgacgaggagtgtctttgtggcgcagagagaaagctgccggagccggagagccggggcgtggtcatcgtggctgtgattgtgtgcatcctggtcctggcggtgctgggcgctgtcctctatttcctctataagaagggcaagctgccgtgcaggcgctcagggaagcaggagatgtaagcccaacaccggcccctccgcccccgcccgttttgccacccagcctgctgcctgcccagcgcccgcctgccccttgacagcaggagtggggccctgggtcagggtgctgcctgctccactacccactgcccagcttccatcagccacatggtctcatgacctgcttccctgccctgggctggccctggagcaaggagccctcatccattccacatccttcacagcgggcccttctcttcctgtggccctgagataccaacctctcacctccctccctcctcccagcacgctacccccgtctcgtaagagcgaacttgtagttgaagttaagtcagataagctcccagaagagatgggcctcctgcagggcagcagcggtgacaagagggctccgggagaccaggtaggaggcggttcctgtggccagagcctgccacatcctcagggaccgggggcagtagggactaacggttctctctatccttcatccctctttgtcagagatagggagcaggccccatcttgccttcttaacactactcacagatggcagggccaagcaagtggctgagggagcttggaggaagactgagaaagaccctgtcccatcaccttttcctgaccaatgcccgtggctctgggtgtggccatttcaccagtgcagtcagacgggggccgccctccttccctggcctgccatgcccatcctagcttcctccccaacgctgcccaccaaattcatcggcttctgcttccatctctccttcctctcggtgctcacaccttcaactcagcaccgtctccgtgttcccctcttctcctctacccacttttagggagagaaatacatcgatctgaggcattagccccgaatcacttcagctcccttccctgcctggaccattcccagctccctgctcactcttctctcagccaaagcctccaaagggactagagagaagcctcctgctcccctcgcctgcacaccccctttcagagggccactgggttaggacctgaggacctcacttggccctgcaaggcccgcttttcagggaccagtccaccaccatctcctccacgttgagtgaagctcatcccaagcaaggagccccagtctcccgagcgggtaggagagtttcttgcagaacgtgttttttctttacacacattatggctgtaaatacctggctcctgccagcagctgagctgggtagcctctctgagctggtttcctgccccaaaggctggcttccaccatccaggtgcaccactgaagtgaggacacaccggagccaggcgcctgctcatgttgaagtgcgctgttcacacccgctccggagagcaccccagcagcatccagaagcagctgcagtgttgctgccaccaccctcctgtctgcctcttcaaagtctcctgtgacattttttctttggtcagaagccaggaactggtgtcattccttaaaagatacgtgccggggccaggtgtggtggctcacgcctgtaatcccagcactttgggaggccgaggcgggcggatcacaaagtcaggacgagaccatcctggctaacacggtgaaaccctgtctctactaaaaatacaaaaaaaaattagctaggcgtagtggttggcacctatagtcccagctactcggaaggctgaagcaggagaatggtatgaatccaggaggtggagcttgcagtgagccgagaccgtgccactgcactccagcctgggcaacacagcgagactccgtctcgaggaaaaaaaaagaaaagatacgtgcctgcggtgaggaagctgggcgctgttttcgagttcaggtgaattagcctcaatcccccgtgttcacttggctcccatagccctcttgatggatcacgtaaaactgaaaggcagcggggagcagacaaagatgaggtctacactgtccttcatggggattaaagctatggttatattagcaccaaacttctacaaaccaagctcagggccccaaccctagaagggcccaaatgagagaatggtacttagggatggaaaacgggcctggctagagcttcgggtgtgtgtgtctgtctgtgtgtatgcatacatatgtgtgtatatatggttttgtcaggtgtgtaaatttgcaaattgtttcctttatatatgtatgtatatatatatatgaaaatatatatatatatgaaaaataaagcttaattgtcccagaaatcatacattgctttttattcatcatgggtaccacaggaacctgggggcctgtgaaactacaaccaaaaggcacacaaaaccgtttccagttggcagcagagatcaggggttacctctgcttctgagcaaatggctcaagttctaccagagcagacagtcaccctacttttcagcagcaaaactgccctgatgacgcagcacgaagggcctggcaggctgttagcaggagctatgtccccttcctatgctttcctgccactt

SEQ ID NO: 37139 - DNA, 8863 bp, Homo sapiens; identical to SEQ ID NO: 37138

SEQ ID NO: 37140 - DNA, 38802 bp, Homo sapiens
ctccctccacctaccacgtctgccctcgccgctctagccctgcgccccagcccggccgcggcacctccgcctcgccgccgctaggtcggccggctccgcccggctgccgcctaggatgaatatcatggacttcaacgtgaagaagctggcggccgacgcaggcaccttcctcagtcgcgccgtgcaggtaccctggtgctggggggaaaaggggtggcggcgcccgggaaggttgagggaggggaccgcagctcgacgcggcgcccccgggcctcgccgaccacccagcgggcctgctgcagccagaggcctgggagatgggcgcggcctggtcccctccccgggcccggcggcggatttctgccccgctcctgcccaaccgccgctccctgggaagcgaggcggggtggggacggggccgggagcttcctcccacccctggggaacactaaggctgcactgtccgcctttctgataccacgacgtcagtgctcctgtggcctccaccccggggctggcggaggcttgcgagtcctttgcggtaaccgagacacaggccattcttgcactaccccccaccctttcctttcgtctctcaccctcccctcggagtccaagaagggagtttccttttcctgtccttcaacccagagagctgccaacacagttccctccggccctctttctccctgaaaggactgtcctgggcttggcagcccgcgggggaaatggagatcgccagttggcgttgagactttgccaagaccacaagaaacctagggttggggggttttcactctttttcaaaatgggaagcaccagctgtagatcaaggagagatgcggggatattgttatggctgtagtcacagtagtatgttttaaatatactttaaggggaaaagttgactacctctcgatattctacaatcaaggaagtgtcagtactaaggaacttgggccgtttcccacagtcatcacccatgttatgccaactcagtaaatctgtgaacagatgtaaatttcacaacatgaattataaacaatctggtgtttacggtcacggtagcaacaacattctcttttgtaaaaagaaaacaaaaataattttctaatatgcataccaaattggtgctgaaatgtaaatctgttctgtggctttactactttccttgcctttgccccaattttgttggcacagttgatcctacattgcactatccctggcaaaagagtagtagagctagagcaaggtaatagctgcctatattatgaaaaacctgtcaagcactttgtaatgcatttgacatattatctccagtcttttccataactttgccagatagatgttattaaccccttttatatatgtgaggaagcagccttactgaggttaagaaacttgcacaactagtaaataaccaggtgctgtctgacctagtactcccagctgctttttcttccgggataagcattccagatttaagatagctagaataatagaatgctgtggcctagagagaccttaaaaatcatctggttcaatctgagcatttccatatcaacaagcaagtaacactttagagatggtaaattccttctagcttttgatttctaagttctaaaatctgcatggtgagtaataagctagctgccttaacccttttcttcccttccttccctaaaatatgatatattgtagacgttgagcctttatagttaaaataatgttttgatttaaattcactagcttctaatagttcaaagacaaggtgcaagaagaatgagtgattgagggtgtgaaatgaattttgatgtgtgagacacttgtacacttttaacattgactgcaatagaggactagagcccttggtatttttgtttgtcctagtgctcattacctataattctagatgcttatgaggatttgacactgtataatgctactcttttaaatacagttaaatatgtttcagacgtataactcacaccccttaaagaggacacatttactagaatttagtctgatttaaattgtggatagactcaatttaaaaaattaaatctagcaaagctctcaaaatgtgtacttcccaaagaattttaattccttgtttcaaattctttaggaaaaagttttaaattttatgctaatctgttagccatcaaataattttcttttcagttttaaatatttaagtgtctactgcatgtctgatgtctgcttgtggctactgtggacactggtgatacagcagtgaataaaatcagcaaagtgtctgccctcctgaagcttacattgtagcggaagataagcttgtaaatacatcaggtggtgataaaaatcatggccagaagaatagaataacgcagagatggtggttgttaatatctttattagtattttctaacattagtatcgtgtatagataggatggtcagggcaagtctttctaataggatgaaattcaagagacctcaaggaagtgacagacctagttttttttggaataaaagtatttcaggcagcaggaagaagtacaaagactgaagtttcaggggcattaaggagaccaatgaaggagctgtggccataatacacgtaaaaggcgattgtaacttagattacagtggtagcagtgaaggttccaaattatccagtattggctgttggattggctgtgaggtatgagagaaagatgagttaaggatgactccaaggttttggcttgagccgtttattaagggaaaaattttaggagaaacagacttctttaatgtgtctgtaattgttagagatacatactgaaatgtttatggataaacttatatcatatctgagatttggtttttacagggtatttttttttttttttttttttgagatggagtttggctcttgttgcccaggctggagtgcaatggcgcgatctcagctcattgcaaccttcgcctccccgattcaagccaatctcctgcctccgtctttcaagtaactggaattacaggcaggctccaccacgcccagctaattttgcatttttagtagagatggggtttcaccatgttggtcaggctggtcttgaactcctgacctcaggatccacctgcttcggcctcccaaagtgctgggattacaggtgtgagccaccacaccagttgagattagcgtttgaatatttcaaaagaaaaaaacagaagtcgctgaaacaacagcaacggaatgttgatagttgtggaaggttggttatgggttcatgaggtttcattatactgttatacttttgtatgtttgacattttccataatacttttttaaagataaaatttgtaagaaaaaaaggatgcttctaaaatagaacatgtgaaatttggaatgctgtgtggtagttttcaacaaaacactgctttctcatctcagtatttatttcatcactgagttcctacattaaattgcattgacatcagtataatgccaaagtaccaagtttcatgctaagaatagcttaagagctatgccaatatctctttataagcagtaagaacagtagagagagaaacattcacgtttataaataataattttcattcaaatcaaattgtaccgtaaggaatatgccattctttggttggccaacgccatacattgttttccattttacttaaaaatttctaagttaaaaattaaacatgtttcttgttttaaaaaaaggtcagctcaaactagtaaagcacatagatgcgtcccatcaccactccacttccctccttttaaaatttgtttataagccttggtactttaaaaagaatgttagactagaatgtataaatgagtaggaatgtttattcttaactagcccatttgggtgcttgtttttaagtacctcaagatggtaaaatacaaaagtatcaggtaattcacccttgcttaattgttattttactagagttttaaatgccatttattcttagaatccatctttttagtccaaacttcttagttgagcattaaatactcccttacaatctggtcctttctctcacttatataaacactgtattccaaattattttttaatttccaaaatatcttctacttattttaggcttttgttcatatggttagactcctcttaagtgtcctgtctgcctattctttcctttccttaagatacaactttattcatctccaaaatggagagagtaaaaaaaattttaaaataaaagtaaaataaactttttttaaagatatagcttcaaatccatctcagctgataaggcttcttagaccacaagagcttgctgtgaaatcgtgaatcattttcaattccaaatgatgaggtggcacttttcttctaatgaactgttatgttagatctcttggaactctaaagttctgttactctgactttctttaataagtttgtatgtgctaaggcatcaactctgtttcttattcccctcttacaacatctaacatggttcatcttttatatcattttagccaggcaaattaccatccatatgtgaagtttaatctttgaagggcaacaataagcatgttaaataacagtatctttattagtattttctaacattgtttgcggaccttgaagttaactaataccagtataaattgagtacctcctaggtgcttggcgttgaaagatacaaagctgaatgagaccctgttcctgccctcagagacttcataataatagtctcaaacttgtcataaatcttatttgtactaaatagccattttgtgaataactttatttgataaatctttcaagtggataaaggaacaagagatgtgtttttaactcagaattcttattgaagcaaaaccttgctcaccatcattaaaataagagcaaagactttctaaaaagaatttttcaaatcaaattacttagggagggagttcattttaattttctaacatttcctctaaactgattattaaagtcatactatgaaattcgtgaacaccagctattttctaaggaatatagttcttaaaatatagttttgagcttggccttgatctcccatttatttcagcaagtgtcatggtgtgtctaaggatgtaaagatgaatatgatgttgccgttcaatagctcctgtcagaccctccctggagtttcagtttggccaaacaactctctcaagcacttctgaaatcctatttcttttacagaattcacaccgtgacaacttcaccatgtttcttaaattctaataaataaaatatgtcacattcgaaatccatacattttcttgttatataaaaactctacatgtttagtgttacttaaaactgttttcacatcctttggtgctatttgcattactttagtaaaatagatagaagatagtttgttaacctgatgttaaaatttacacttatgtactacatgagtaaggtaattagaaaatctataaaactcttttaaattcatcatatttcttgaaagaattttttttttttttttgagacggagtctcgccctgttgcccaggctggagtgcagtggcacgatcttggctcaccgcaatctccgtttcccaggttcaagctatcctccttcctcagcccctctagtagctgggattacagacacgcgccaccgtgcccggctaaattttgtatttttagtagagacggggtttcaccatgttggccaggctagtctcgaactcctgatctcaggtgatccacccgcctcagcctcccaaagtgctgggattacaggcatgagccaccgtgcctggcctttcttgaaagtatttttaaggtaatgacagagctacaaattaatcctaaactcttaaccacacccaactgatgtactcctagttgctttgctactatatttaaaatgatcaaacacctaagtcaattactttaatattctttggagaccagcttactgaaagaacctcaacacagttaatatatttgaagcaaaactccagcacagtgaagtaacagtaataacagctgaaattcctaaatgggccaaagaggaaagtaaagtaatgcagcatgcactaaaccaagcgatacatatttaaatagttatgaatgagtttagaacagtggttctcagtcttggctgcacttaaaatgcttggggaatctttataaatgccaatatatgagctacaccccagtccaattaaattagaatcttaggggttggatcagaccagacatcagtgttttctaaagctccctcaagtaattctaaagaacagccaaaattgggaaccaatggagaaagatgcaccttacagtttactaatacattattcagaatctgtgttacatattttccaagaaatttaaattacttttagagtattaccctttagtaatactggtgattagagtttgcattaaatagatgtctttgatcacacacccattttatttgtagtcttttttttttctaaaagtagagtttggaatccaggctccttatttaataatgtgggttatatgcctatcctgtagtaaaagaaggattacagtgcctggtataatgtagccgactcacagacaattctttccgcaaagcaatatttagagaaaatatataaaaggggattaaacttttattcttatgccactttgccatattacaaatgaaatatgaaaaaattaggtatcaaattatattttagaaaacattgagtttaatgacttactaagaagatgcttatttacagtttgccttttattttaggttgtttacacaaaagttcttaattattaaactatactgccatctattcattaaaagatatgcttaaaatcaactagtttctcattaatacctattatcaagagattacaaaatcagtaatgatttttgacttgaagatgttgaaaactaaaatttttatgggttaatttaaaattttttggtaactaggaaagggatctttttttaaaagaaagaattaataggtcttttgcccttctgaaaaggtgccattattataattttgtttgagtcaaggcagtattctcctagtagatcataaaatccttgagggcaagaagtacatcagatgctgatcatcttgctgtagaagccataaatatttttgattagtaatttaaatattaatttagttgagatgactcctagtgtctgtagtagacgcattatttacagtgctttagagaaaatgtattaaatattgtatttgttatcttaataaagtgtacttctgattaattatggaaaaatccttttgcttccaccaatgataaaatttgggaaatattatgtcttttacaattatatatttaagtaataagatttaaatttataatttcaattttaaaatatgatagcattagcaatgtccttattgtgtgtcttcctcccttttattcattcatgataggatttagtttactaattttggtgaataattattgaatatcttgtagaaagcagaagtgatctgggggagaaagctgtccagagtgctgcgaacagacataggagaaaggaagcacagaatatgattggataatagtaatagaaatagaaaatactaattttggaaatcagcaagtatttactggaagggtagtatagcatgataagactatgactcaaacagatgtgagattgaatcccaacaatgacaccttggacaaagtgtttaatcaccctgagtctcaatttattaatctctacaattattcttactttattttaagattctttcgagtatttgttgtagaatgcacagcttagttaatggaatttttgaacatacactaagccttgacacagaagtatgagaaagatgtaaatggatgtgctgaaatgtgaaacatagaaacattgtcatgtgaccctacagtactgctattttctaaacaggttttctgtaattagactgtctcactcatgtgtaagggttccatgtatcttctgaactaaaatagttaaaaaaaaaaaacctactaattgtgtgtgtttgtagaatctttatcagttaacatattttctttcttcctcagactcatacaaataaatcacttggtgcaaatacccatctttgctctgttatactttcatactcttttcaaaaagaatatatatttattgagatacctgggaggtagtatcatgagagtcacaaagaaaatgttaaataattaagcaaacaggcctttttacctgaagattgaagtgttttattttccaaataattaactttctaattgctgattttcctgaaatactgtcgggagaaaacttgccctgaaccccagtttgtatcagataaattcagtgactattttattttatatttatttattttattattaacttattaattagagatagggtcttgctgtgtcacccagaatggagtgcagtggagtgcagctgggactacaggtgtgcaccaccatacctggctaattttttggatttttttgtagagacgtggtttcgccatgttgcctaggctggtctagaactcctgagctcaagtgatctgcctgcctcagcctcccaaagtgctgacattacaggcgggggcccctgctcctggccataagtactgattttgaattattgatctgttgatttttctattaatctattcttggttattaactataagttaaggatttccacagagaaattaatatttaatatgtgtgagggtgatgctaatgagcttaaagaaattgtgcaactggaagataaatcatcaggactatacactctttccttagatcttaacatagttcatatcattcagtcacaggtcgtttgttacctactcagagatgctgtttctctaactacccgcatctcacactcctcaaactcctgctcccctttctaggcccaagttgcccatccctcccccactgaagccttccctgattctcctgctctccctcttcctctccctgaagaatgaattctttctctgtacttggatttgtatgtcactcagaaacaaaccaaccatgttggtccgctttaccatcttcatatctttatatccttattatcagattatttatttatctattgtctgtctttgccattaaaatgtaagcttcctaagaacagaaaccttatatgttttgttggctgctgaaacccatgtgtttagaagagtgcctagcacatatgtaggtgcttaataagtatttgttgaaggaataaacaaaatgaacaaacaaatggataaacttgcttattaaagggaaatttatgcatgcagtttcaatttttaaggggctaagtgaattttttttagatcactctttataggtgatgttcacctgagtgaaaggtattccctttcttcccttcctattggtcactttatctgggagttattttatctagccattggtggtagactttgaacatgtaaaagtctagtaggaggtctgttgcttagaatcttcagggatctgtaaagactacggggttctctgttaagaatgaggttgcatagtttatccagctggccttgggatcagggtttgcttttgctcagtgcccagtcctccagctacactgcaagtttatgggcttaggcaatagctttgtaactgctatttttggttctacccactaggtcaggggctggctatagaccattctcaaaaagacccaaggctttacaaaagctatttaagctgttatttctagcccctaaacaggagcctcagtggagattgtaaccagaagtctaagaatagaattctagaggatccttcagcttaaggtgttgataataacctgaaagtattaaaccaagaagaaggatgctgaaagaaacaataaaactcagaaaatagagtagcaaacgagatttttgagaaacgaaaggagagaaaggcaaggtgaacactgttttgtcagccagaagtgagtcattactgagcacagaattaatgctagtgatatacctgtgttaagatgggaggaagccacatattctagaggaaaatgatgcatgataaacagcttgagtcatcacctctaatgtttaattaaaagtatccagaaggctgtagatctacacagaatctttttactgctttattattatataggcagtgctaccttttctcaaataccagtatattcaataataaaaattgattcattgagtacgtttaaccacattttatgacctttaaaagatgtcttcatagtatgaataggatatgttccaaaagttagtctataaataaattgctggaacatatcctcagcagcttaaatgacaggttttatggtatgttctgggaaactatttatctaactaggtgtgattaaagtgctaataagacataaaccacaataaacattaacagctctttcaaaacttaataattacaaggcaccaaacaaagtgatttgcatacacaatcatacttaatcccccaaacactataaaatatgtattgtctctcttttataatagagggtactaaagaaaaaatattcaatacattgctcagctcacacagcaaggaacaaagttaagatttgaattcagattcaactgactcaaagctcttactctttaccgttatcctagtctacctaggataggtagttgaaatagttgcatgctttatataccaagaagtatacttaggttttctgtagaattcacaccatacattttagcagaactaagggtatgtgatgactgtaaggtagggtcatccacaaaagaagtatggataaattaccataggagcaaaaaaaagtattcataagcaatggcttacaaagctggagcatggttatttgtatgtttaggattgtttagctttgaatttgctttttacttattgatatggttccctaaaatttatttgcagtatatttaatttttgttttacaatcaataacagttcacagaagaaaagcttggccaggctgagaagacagaattggatgctcacttagagaacctccttagcaaagctgaatgtaccaaaatatggacagaaaaaataatgaaacaaactgaagtgttattgcagccaaatccaagtaagaaactctacctcttgtgtaccttaagtactattagtgggtttttaaatgttaaaaaaaaaagttttaatggccatctgaaaacataggatttttttattgtagcttcaaggtcagtgggtttttttgtgtgtgcttttgtgaagaggaagtgataaacagctatgtacctaaccaattttaaaatgatatttttcagtcttttatagaatccttgtaaaaaatctcaattttaggcagtgactttgaattttaatttatgagcagctgtgtatataaatatgttttcctttttcatctagggaagaattgtccctagataattaagacaaagttatatagttgcttaagtaggtaccattttttatgtttaagtttttggtgtgtttttttgtttgtttgtttgtttgtttgtttgttttttgagacagagtctcgccctgtcgcccatgctggagtgcaatggtgtgatcttggctcactgcaacctccacctcccaggttgaagcaattcttctgcctcagcctcccaagtagctgggattacaggcatgtgccaccacgcccagctaatttttttttgtgtgtgtgtctttagtagagatagggtttcaccatgttgtccagcctagtctcgaactcctgacctcgtgatccacctgcctcggcctcccaaagtactgggatgacagccataagccactgcgccccgcctatgtttaagttttacattttcacataaattatttcatttcatcttcagacaactatgagattttcagataagtcaactcaataatcttgcagttaaggtgcataattgtttagtgaatgaaactcatgagttagcatcttgtcaaatgtagcatagctaattagaagtggaaattggactagaaccgggtgtatgaacatccagtcttttcactgtgagctttgcatatcaaaactgaagaacaaaggtacaatgtatgctttccttcttttttccccaacttgtttgggaccaagttgtgatatgacatatgcttacttttagatactaacttaaacttcaagcactatataaatattagcagttctctatcattttagttaaatagtagtgactttttaaatacaccttttggttgaaaaacttaactgttgagttctgtgctcagtacctgggtaacaggttcatgtgtaccccaaacttcagcatcattcagtatacccaggtagcaaatctgcatgtgtactccttgaactaaaataaaagttggaaataaaataagctttttgcactttgagtgagtcctaatgtctttggacaccatgtaatattttttattcatttaaggccatttaaattctacactctggcacttttattaaaagtaatagacatttttccccttgttctaaacatatttttctgaatgggaaataagctcattcacaactggtaaacagggaaataaaatacaatttcctcctgcccctgttttgtgccaggaagtcgtaataattgtttttgttttttgtttgtgctgtggtttttttgttttgttttgttttgttttgtttgagacagagtcttgctgtgtcacccaggctggagtgcagtggtgtgatcttggttcactgcaacctccacctcctgggttcaagcgattttcctgcctctgcctgctgagagtagctgggattacaggtgtccaccaccatacccggctaatttttgtatttttagtagagacagggtttctccatgttggccaggctggtctcgaactcccgacctcaggtaatctgcccgcctcagcctcccaaagcgctgggattacacgtgtgagccaccatgcccagcctgtgctctggttattaagttacataggttttgagcagccaaacctaacactccttttcttgtaattcctatgttgttttcaatgtatgatcttctggaaatgggtttttcaaaaatacgttatgcagaaatacatattacattgtagcagagttgcctgcatatttaagattttattataacctattgaaattaaacatttattagtattccaaatattttattaactgaacgaagtcagcataagattccattttaaacttttggccagataggtggaaaagcagtcaaaattaagaatcagagtcaaaacacaaagctgtttttttttttttttgagacagagtctcactctttcacctgggctggagtgcagtggcacaatctctgcttactgcaagatctgcctcctgggttcaagtgattgtcctgcctcagcttcccgagtagttgggattacaggcatgcgctaccacacctagctaatttttgtatttttttttttagtagagacggggtttcaccatgtcagccaggctggtctcaaactcctgacatcaagtggtctacctgccttggcctcccaaagtgctgggattacaggcatgtaccaccacaccgggccaaaatgaagttctgaaatttaactagtatcttctaaatggttatgttttaaaaagctctttttggttttaactatttaaaggtatttaatttctgctttaaaacttctgattttgtactagaatctaccacaaaagcaagtatcattgctatactctattttatgtattataactaagccttttaccaactcctgaaatgtttctgttactggttcagctcattttttaaattttcagtgcactgtgtgaaacttccgcatgcgtaggaatctatgtgaggtacttagagggaacctatttgacttagcttcaatttatgcttaatcgttgtttctggaaacttaagccattttttcacttgtcctgaaatacctctaggttggacagcattgtaaatgttaatatctttggtcttaagcattttgctaaccaagtgtttattcagcttttgtttttttcccctttccatttattctaatgttctattattgctttaacctttcgtattttaaacttatttttaatgatgaaatcttttgagtgaatgcatgctcagagatatacttgtatactttaaacataaactaaagccaaggcatcatattgctgatctgtctgtagactattccaagcctggattgttctatgccttaagcgcctgtgtctatatttagactctaggcaagaaaaagagagagcaaatgctcatgctaaagctgtcagatgtaagtctttggttcttccaggtactttatatctgtattttcctagccagaaatcctgattttgaaattatgaatgtacattcagagtaaaaattagagttaaaatgctacaaacagggcaaagacaccttcaataaatattaagtgaattaatcagtccttttctggaacttaaaatcttgtagaatactcaaataataattttattttattttaaaatgcttttgtgccaagatattttatcaaatttctaaaatataattttttagttatataatagtctaacataaaatttaaaaaattatttattaagatatgtgcttgaatgaatgctaactttaggagatgataaatggctgctgatgggggaaaaaaacaatcttctaattagttttgctttttagaaatcattggtaattttaacctttctcctagatgccaggatagaagaatttgtttatgagaaactggatagaaaagctccaagtcgtataaacaacccagaacttttgggacaatatatgattgatgcagggactgagtttggcccaggaacagcttatggtaagtgaaatgcaaaaagttctaataagggatatctttatgtttagatttattagagatgtcattaacatattagtaggccgggtgcagtggctcacacctgtaatcccagcactttgggtggttgaggtgggcggatcatgaggtcaggagatcgagactatcctggctaacatggtgaaaccccgtctctactaaaaataacaaaaaattagctgggtgtggtggcagacacctgtagtcccagctacttgggaggctgaggcaggagaatggcgtgaaccttggacgtggagcttgcagtgagccaagatcacaccactgcactccagcctgggccacagaacgagactctgtctcaaaaaaaaaaaaaaaaaaaaaacatagtagtagaattggttttaacttcaaatttatgttaaaaatttttgatgaagtgagaaatataggcaaatatatacagttaaatgtaatatttaatatattcaagcatatatttagttattcagagaattcacatcttttttagttctaaaaagtttaatgaattcttcacttgttctcccagtgatcttacaatacctatgttataatacttgtgatattgcaattattgtttgcatatgtctcttcatttttaaaaaagctttcttagggcttattttatgttaaaggtacttggcacgtagttcttgaacaaatcagtgcttttgttataattttgcagtaatgtcagtaaccaaaaaatattaacaattgttatctctggatatttggattacatttcatttctgtttttctcttatgtatttcaaattttctatagccgtggtttagttacactcgctttattagttgctgtacagactttaaatgtatagccctgaagctcaaagttacatacacatctttattgtcactctaattttctcataacatgagactgttacagatttcagtagcttcttttcctgttgtttatgtctaataataattctctttatacatctgcaagatactggtctttggatatgaaatggtaggtagattaaattaatttctacacatagttctgatttacagaatggtttataaattctaggattaaatgaattttaagctttagtagttatctttatgtcagaaagaaataacctaaatattgttgaatgccactaatccattgacaggcttttttaggtacacaactttgaaacttctacattgtgttcttcaaaatctaatttttaagtttgaaaatgcttagaacttcaaaataaaattatttctgaattttactgttaatttttagaaaaatgttatacattaaacagatgttttattgcctacttgtgccaagctcagttagatgctgggatcataaaggtatgtgaaaggaacccagcagccccttccttcaccaggctgaagaaggttttagcagagcatgaacattagtaaaggcttctagattttcttcccttttaaatctgcttaatctgtttgcacctctagtaattctagtgaatgtaccctggttattagaattgggctttgtgaacctattaccttattagtaattaatactaaaaattgagtatcacaggcatgggctaagcattatatagtatatatatttacatattaattctcatttatatcctgcttttaagataaattatattaccttcattttaaagacaaggaaacaggtttggagaagttaaataattaatccacagtcacagctagtatagtaattcaaatgaagatctgtctgtatccagtgacggagctcttaactactatctgtattaccttccttatcagtcagatcaaagcttatcctaacatgaagggattaagatccttagagctaaagcttattagaagtaaaactaggagtggaaccctgatcttggggcttcctttctttctactctactttgtactgtacttgccctatttaagtatcagagtatatgtattgcaaaagcatggattttttaacttaagatatcactatgaactattacttatagatacttcagatgataactgcaaggatgtagaaacaggacaaattgtgacttgatctcttggaagcattatacttttataagtataaccacagtcacccctcgatatccatgggggattggatccaggcccgccaccctgaggataccaaaatccatggatactcaggtgtcatataaaatggcatagtgtttgcatataacctatgcacatcctccctcgtactttaaatcatctgaatgtaaatgctgtgtaaatagttgttatgctgtattttttaggaaataatgacaagggagaaaagtctgtacatgttcagtacagaggcaaccatcttttttttttttttttttttttaatagtgacaggccctgctgtgttgcccaggctggccttaaactcctgggctcaaacgatcctcctccctcagctttggagtagctgggactgcagacatatgccaccactgtgcctggctcctcagccatccttttttttttttttctgaatgtttttgatcgtggttggttgaatccatggatgcagaacccatagatacagagggccgactgtgaccgtaaatattttggggtatatttgccctctttagtcccattggtagaattggtacaattatctatgctacaataggaagttcatctttgtctccttcatttagacacatactcttaaatttacttttaaaataaaactaccttaattacagttaattctatttggttttactttagcaagcaagttacagctaacttttaaacagaccaaattgctgatttatctttacatgattttattttctggtattaccagacaatgatttttaaaaacatttttcctttgcaggtaatgcccttattaaatgtggagaaacccaaaaaagaattggaacagcagacagagaactgattcaaacgtcagccttaaattttcttactcctttaagaaactttatagaaggagattacaaaacaattgctgtgagttgaaaaatgtcccctttatttagtaaaatcatttagatatatatactttttaatgaataatttggcctcttaatgactgtgtagatgtagtggattacaaaattaaataatctaggtcagtgcatgttcaccagaacacaaaattaaaccaaaataaaagactactgaacatttactccatttgtgtgtcctacagtgttattgagatgcctttatcccttttcattcattaccaacgctaaaatctatagagaggttcctggaatgattatgaaaatatggtctaaaatatcaccatagtatatataccgtgtagctcttcattttttaggattttaacttattttcttagtgatagagaatgaaaattttctaagagttttacaaagctgctcttataaatacttcaaactttaatttgcagatttcctattacaatatattatagaaactttgaatatgttcacaatggatttgtctctgtataaacaaatatttggcctgagacagaagaactatcaagttaaagtatgatttaaaagatattagcagccgggcgtgatggctaacgcctgtaatcctagcactttgggaggtcaaggtgggtggatcacttgaggtcaggagtttgaaaccagcctggccaacatggtgaaaccccgtctctactaaaaatacaaaaaaattagctgggcatggtggcaggtgcctgtaattccagctacttgggaagctgaggtaggagaattgcttgaaccctggaggcggaggttgcagtgagccaagatcgtgccactgcactccagcctgggggacagagtgagactccatctcaaaaaaagtgaaataaaataaaataaaataaaaattagcttatcagtgcaatgaaatttgacatatggaatctaagattaaagcaaactgaattataataaacttacatactatacagaagcttgaaattccctgaagaattctaagatactatactaatgtttattcattattctgtaagtttgaaattccattttggagtggttgggttgcatttggtgctatgacacattaagtgcagcccacccaatccttgaggtaggacaccaggcgtcaaggaacccttgccccaggcgtatacttccttctttctaggcactttctggataatctgtaacaatttgaaagtcagtctggccactaatgacgttttgggctgcacaattccttgtaaagatagactgtcttgtggaatgtttggcaacatttctggcttctggctagcagactccaataacatccctccaccaattgtgacaaccaaaaaggtattgccaaatgttcccgaggcagggacaggatcataaaatattaaaactgatattcctttgtttccatcattgcctgccatctttcccagacacttacaatgtttcaattatttattttaaaatttaaaacagtaacaagggggtgggggggggcagatacatgaatggtaactttatagccaattttgtagtcatagatctttatcaagtgatacatatgtttactagggaataatactttaaatgtgtatgctcttaacagaattttagcatctttagcccttattttttcttttctatatttatagaaagaaaggaaactattgcaaaataagagactggatttggatgctgcaaaaacgagactaaaaaaggcaaaagctgcagaaactagaaattcagtaagtaaatagaaaaatatttttgattaataactttaagatttgtaaaatattttgctaataaaccatgaaagatacagactattaactttagagtcttgtttttgtgctttctaaacaaatttatcagaacttaatacatccaaatcactgcaaagtagtcatatcaaaaaggtgatattcatggccaggcacagtggcgcatgcctgctatcccagcactttaggaggctgaggcaggcagatggcttgagcccaggagtttgagaccagcctgggcaacatggcacagccccgtctctctacagaaagtacaaaaatgaacgggcatggtggcacccacctgtagtcccagctactcaggaggctgagatgggagaatctcttgagtgtgggaggtggaggttgcagtgagccaagtttgcgccactgcactccagcctgggcaacagagccagaccctgtctttaaaaaaaaaaaaaaaaaaatatatatatatatatatataaaatatataatatatatgtgtgtgtatatatataaaatatataatacatatgtgtatatatataaaatatatatatgtgtgtatatacacacacacacgtgatatttagctatatagctgctgctaaaaaacaaaaattatggtagctcctaatgtgtcattttttttaaatatcgtcagtggtcgcaaatatttttggagatagatttattataattggaaatagcagaaaagatagtaattaagatgagactcaagtttgagaatacttgtgtgtgacttaaaaattagatcagttccctttccacacactgctcaaactaactaaaagaatgttcaccaagaatagttccaaaaccattcaaaccaacagtggcagtatggactttcaggcaacgatgttgaatgcgaggaaactcatttggataaataaattctagtatatattccagaaaacctcagaatattgagtaggtatatattaaatataattaaatttttctttaaagatttatttataagctttttagttaatccaagttatactgtctatattattccagaatttgaaaatatcagatttgaattggaataactttaaaatagtataaaataaaccaagtatgaatttgttagaagaagctaacaagttaatacttaatttgagctatggtatgatagtacccctgccttctgtttccaagtcactaccactgccaacatcaagaatcattgcgttaatgagcatattaccacagtgctggtactgtcttatagttctcttgtttgggagataaaaaggttgaaaattggtttagagtgaaatttaaaactgattaacttggtattggatagtaatgtcttacgagactaccctaataccttgtatgagcagaataagttatttttgtctatggtttttttcttttttggagatactgtattagttactgctagagaagagctatctttgataagacattaattccaaatttactggcattttcacttcacagtttatcattacatcattatcacaaacaacaaaacttccctaaacagactatctgcagcatcagaactttgaaaatgaacactatagatagcaggagaccttgaattcttttattagtttctagttgctaataattaatttgaaaagtaaattataaactagtttttaaagatagaaatttcatactcaggaaaaaaggatcatttggaaatagatattttaactgggacagaatgtctttattcaagatgcctatatgtgcccagtgataattgtggaataaaaatactgttaccaagtttcagtacaaaactttgtttaaaaagcactattacaggaatgaccgtctgcttttctacctggaaaagttccagaaagcacacacatatagatttaacagtgtacaaagtcctttaatatttctaaattattttaccactgctattaaaatatatagaacctaaatataatagtagaccaattttgagagatgtttcctttttgagatatctagaaaagatcttggcaatttttctctgctgcgtatttttgaggataaaggttttttttctatgggaatttatgtttaaagtaaaagatgatacaaatgattttattcagttcagcaattttatttatacacagctattctagaacttacgtattacatacagcaaaatttaactatagccaaatactatttttttagtctagacaggaagttcgatttcctgattttaattgtatttttcccctagataaccaacacatttttcttcaaactttatagcagttaagtctgaaatactttgggaagaaaaagttctcttagtttattattacataaagcctggaggtattcctgtatttggtgatcctttttttcccccctgtatttctttgcatttacttgaagaatcactaggagtttgctttttttttcctttctttgatacatttcctggttcctagttggcaactgaagtggttaatctgaccttagaattactttgacttcacgtctttataaatttccatggattgttttgcaactagttactctgctagtaaggtttgggatctatccatattgacactttttaagtaatttacttactagtttcttgtgactctttttaagttctgtgtttactaaatgctaattttgtgcaaggtactgtactgaggagttcatagataaatgatgtaaaatctctgccgccctcagttcacaatctggtacaacagatcatactttttgatgatttagccctatcagtaaagaatttctgcttgtatctaatattgctgttttatcagttagcatattgaagaatggtaaagcaacatcaaaggcatttctcaaaaatataccaattaagcagaaagaaagcccactttaatgtttcacaatgaacaaaaatacagttttgaaaaatagattgtgtatatgataaaatataccagagaagcaagaacaaaaataattacaggttgaatatcccaaatccaaaaacctgaaatctgaaatgctttaaaatatgaagttctttgagtgcctttatgacgctcaaaagaaatgcttattggagcttttcactttagggttccttagccagtaagtataatgcaaatattccaaaaccagaaatctgaaacacttctggtcccaggcattttgcctaagggatacaaaactgtaatgcatttcaattataaggcacctacatttacgaatccaattttagtctaaatctaaacttaaaaattattttacagttttagtaatgttaaagataaaaatcagctgatttcaaagctctgcagtatttagtggtttagacctctgttaattttgggacatccaaatttgatggaaaatatttctttaacatcatatagcaaacttaagcatttccacagcagtgtaaatctttaatctgtaaactcaataaatttagagcaccatcagtatagcctttaagaacacatgtttgaatttaaggtttactagaaatgtaaggattgacatgcctttaagacttcagagtatgccaagacctggctgaggctgattgaaagagaatgtggttgaaggcatcataaattcataaaatagaaatgatctttgaataggaaaatttggggttaggtaggactttcttagtgaaaatttaataaaaattgtaggtaactggcagttttaaaaatgatacattttccctaaatgattctcatttaaagtcaagcatcaacatattttgttttgaaaatttgaattttggggaaaaaaatgaataggcaccactatatgcagtttcacagaacaataaatgtagtgggggttttttaatagaaaaaaatatttgattggctcttttacttgtttaatgtgttatttattgtgaagaagtaatttgtttcactgtgttcattggtataatgtgttctttgtctcttactatgcacttaagcaactaaactcagctcgccttgaaggagataacattatggtaaatttctcttacatgctcaacttcctgcatgtaaaatggctgaaggtttgttggcctactgtgttttctacatcttgaataaagtgccttctcttgctattagccgcttgtaaaattttgaaataattggaaccatgtattcatttatctttaacaacaaaaatataaggaaaaaatactagctgaagtaatactggaactttaaaagaaattgtatgttctgattgccaaatatagtgtttatgccaaatacagattttagaatatgaatttatacataaatatatagtgcctttttgcactgactaaaaggtgctaatttaagctggcatttatattttcacttttggcaaagaaaattaacaaaatatacttaaagaaaggtgtaaggtaaacacattgcctttgctgctcagtagcttcaagatttaccttattttcacccaaactcaacatagaattaattttttctgccatttcaggccaagacagaccccattaggttaggtactcctgtaatggccaggcttattttccacccagtgctaactcacttaagaaagttttggtggaatggtgatagccttgggaaagaatagagaatgcagattgttttatggtatccaatgtatatgttgagcttagtttgagaaaatttttgagctattagaagttttttattttagtaaaatagaaagttgtaaaatctgaacatagccaacaatttgtgcacattaaccaataaaaagtatatagtgtgttttattttatttctagatatattacttcattagaagtgtcaagggatctgcagtacagctaatacattggcaattaattggctgctttcattcactagcattaaaccaaaagcaggaaagtaataggaaagattattgtacagaatatataaaatgcatttttgtttttgtttttttttaaatggtaattactgaagccctggctgaattagggcttaccttagatagcaagagaatgcattaatgtgtttccattgtcctatctataggtaaatgaaaagcgtgaggatatttcagtcattgctaatttaaaatataaagcatagcttttctttttgtctgaggtaaaaacataattctaaacaattaacaggactttgtttcattaatcatttgtgtttactattaatgtaatcttatagtaatatatatttacagctggtcattttatatttattatatctccagcttattgtttctctccaaaaagactgtttcagcagccattaatccttgctttgcttcatttcctaaaatgttagaatttatacctaaatgagaaatttgaaatcatttagtccaaatctctaattttccagatgagaatactggagctaagaaaggttaggtgttctcaatttgggaaaactgtagatttaacataagattttaaaattgatagcaatgatacatataaaagtcatactttcacagtatgttaagctgtaccgatttagttactactgtgtttaatctataaatatgattctgaaaaagagtatgccatttaaacaaatatttatatttttctatactaagttgtagaaaataaattccaactttcatgctttatatttttctctaatttttaatgctggctagatttgggcagaggaggtgacaaaagtaagtaaattattaaatacagaactatgaaacaagaatttagttgacgttgattcagtaaatatgtattgggcaacaacccatgggtccagtcacagtctgtgttagtataccttataaaatctgaaaatgagggatatgttcaggtctctttagctaatagaagctccaccaagcagttgaacaatgctgcagagatgtggtttgcacacacactgataaatcttggatacctgttatactaagtggtaatcttacagttccttactatagaaggcaggcgaaatgcttgttaatgatttttttaataacaatttttaaaatgtaaaatatagttaacaccatgtcctgtatcttcagagaatgggatatataatatttcgcacaaatgaattttttttttttgagatggagttttgctcttgtcgcccaggctggagtgcagtggcacagtcacagctcactgcaacctccaccttctgggttcaaccgattctcctgcctcagcctcccaagtagctgggattacaggtgcccgccaccacgcctggctaattttttgtatgtttagtagcggcagttttttcaccatgttggccaggctggtctcgaactcctgaactcaggtgatcaacccacctttgcctcccaaagtgctggcattacaggcgtgagccaccgtacccggccacagatgaattttttaggtaactgaagcttgttctctccagcaccaaagctaatttttcccagtcacattagttgaaaatatctgtaaaaatgtattttactgctgcattaaatataggatagcaagtatttgattttactacagttaaggtcattattatgaatatttatcatactgttaacagttggatttgttgtttttcgactatgttgtctcttccctcagtatcagactgttgcttctagaagctgtctgtatgactgctgctagcagttctgtctgtgttaccatttctaatcttctgtgggctgggaaagcaagtaattaaacaagaatttaagggataaaattataaactatagtacatgcagacttgtttcaaatgcttttttaagtcttcagaagcatttttcatttacttcttatgtttaggcctaccaaactctgacatccacatgaggataacactggggactgaggacaggtgatgattttggcccctgacaatagctttataaactttaacttttattttctggctttgtaggattgattttacagtctgttttatgcataggttatagagctgttgattctgtgacttggatctccagtatgaaattcttaccttatgctcttatcccccctttgtgagtctgttcatcagtttagttacggttccacactggcttctgatttctctctgaacttctagcatgaaaaggggcagagcaacacagaagagaatacaggttgaacaaaaaaactagaatgtcttcctctttggcataaagatatgccagaaaatttctgacttgattttgcagtctcagcaagtttaggaaataattgatacaatacatgggaagaaactcatgaaacatattatatacatatatataaaaatctaaagaaacctatcaaaatggatttcaggggtttttttcttctacatatctcacttctgacatttttataattaaaaatgtataaatgaccaggagcagtggctcacacctgtaatcccagcactttggaaggccgaggtgggcagatcacctgaggtcaggagttcaaaaccagcctgaccagcatggtgaaaccctgtctctactaaaaatacaaaattagccaggcatggtgtcccagctacttgggaggctgaggcaggagaatcccttgaatttgggaggtggagtttgcagtcagccaggatcagccgttgcactccaagctaggcaacaagagcaaaactccatctcaaaaaataaataaatgaaaatgtataaatgttaagactttacattcctggagtattttaagattttaagccatatgaatagtagtcaacactgatcaagatagtcacagcaaatgcctcagaagcattaccaaaatttagggcttacagatacccaatcttgatatcgtgggccaacagattcttgcccatcttccagttacattttagaaaaaactcttctggcttacctaacctatgttatgctatcatgtagtctagtagcagttacttttagcagtagaaggtcttctccctagagattttttagacgacagaatatcagccctttcttatctatctttctaatgtggatcattttcttccgaagtaaattgattatgctaagcctaatttaaattcctttagcctctcagatcagttattatgatcaattatatatgccagaagtatagatgatttgggacatttgactgtttgaagccacccaatatgcactaaaacttgttcaagaaatgagatgcatttttccctatcatctaccctctctaaagtctagattgtacagaaggacctcctaagctttgtaacatggtgcctttcttcatgattaaattttactcaaacctagaagcctgatccctcatccttaatgagatcatttgatattttttattcagtgtacttagcattaaaatattatttctacttcagtctcaatcttcccggtcaccttaatctgctacctagtttacttgcttattaccttacctagaaataatgtcagttagtaggatttttctgccatttctactaaaggccattaaattaaaccgtactttgacaatcaaagacctatatggaactaacctagtttatttctgaagtgcatttatttttggtttgctgtatttacttctgttactcaaagccttttgtattcaaccaagcagaacagttaatagtgcatatgtaatattgatgtgattggttttccttagtgctctccttaggaagaacattgcttctttttttcttctgggacttttttctacttcataccagcttccagatgaagcttactttgtccctgctatcaaaacaccatgggttctggttttagtcaagtaaatttaatttcaacttctgacttactaattcaagcttatttccgtaagtccaagctagaggtcaattattagtcccctctgctaggtttgttgccagtgggctgttacagcaactgattatctactttgctgctacttccttgtagactggtttactagggtaactattgccaccaaaggatgaggagagggagatgaggcctgaaagaaaaaagttcataccttgttgggttttttttgtttttcgttttttttacttttattacatcttggaaatgtcatgaatcatttgcataggtggaaaatgctatttgtgctggagaggtagtcaaacctatcattataatgatgatgtaaccaatgataattcccaatgggagaaaagctaactattctgagtaagctgtgaggttttatttctctttcccacttattaacaaccaactctgactaaaggtttgagaagatgttttttgccactatttgctatttttagatcttgttgatttttcagtgaactgttttgtcgcagcagtaagcctcctttatcagatggttgaaaccagtagtggcatactgttatttacatctcttcccagctccacagtgtgtgacttcacgttagtagctggaaatcagctgtggtgggagtatttatatcatgaaaatctggatatgagagcttttttttttatttcttggggaagaatttaacagcacactactgattgaagttcgatcataacttaaaaagctttttaaaaccctagtgtatcttaatagatagtattctgcttaagacattttttatgcatagtttgaaaagaaaatttgaaagaaagacatttaaaatgtaggacaaagaatcctttgaatgaacctaaaaactggtgctagcaacaagtgtttggcaactaaacgcaaggtgaaaatcctatggcttcactctaaagtcttttgcatttgagactgaagactctttaacttcaaagtaaaaactgtagtaataattgagaatttttgcagcaatattactttatacttgtaaaactggtcatcttaaaattttgtaaaatagtaaaatttagcaaaattgatactagaaaatttatgaaaatatcttggctttctcttagtagtttttgtaggctcttaagagtgtatcattaagctttagcgtaacagattcttttcaatcaagtactggaatcagttgtccaggtggagtaatacagaaaagctaaggtctagaaaccaggggaccattttagatacaaagcagaattgcggaattgccagattataacttgaggtttgttcgggggattttttttaaccatctaaaataaatgtatataagatggactgagtcttctaaagagattctaaaactatattcttacttaagtctgaacaggaattaagaataactcaaagtgaatttgatcgtcaagcagagattaccagacttctgctagagggaatcagcagtacacatgtgagtattcattcattggaaattcatttggaacaagactttggtagtcctaaggcaattttgggaggaaaaactgaacttttcagtcattcatcaaggaaatttaaattgttctactttccaatatatccgaataaatattttaaattgttgtttacatcttatcaccgagttctcccaccctcattaaatatacatgttgttgtttattggctaagcagagtttgctagtgtactattcacgaaggccaatcttaataagccttgtagtaaaatgttagatactggtgagtctacctcagtacaatattgtggtctgtctcccccttgcatttgccatttaagttgactatacagctaagaactaactataattttccttcacaggcccatcaccttcgctgtctgaatgactttgtagaagcccagatgacttactatgcacagtgttaccagtatatgttggacctccagaaacaactgggaaggtgataatttacttttcacatgtaaagaggagaaattcagatttttgcttatgaactaatactaaggatgaagattagagcaattaaaggttcttactagctttcttagaaatagtttcttttttttaaggaaagtaattatcagttttctgaggtaacagaatattttgagcttttctggcacagaggcatgttaacagggatgagaaaaagtgaataccttttcagtgctgtaaggttaaaagtgtttcaagttcacttttctcctgctactgaatactttttgctattggttgaggaagatataattaaattgacagttacccttaaagataaactaatttatacttattcattactcatctgtttactatattgaaaaaaagttttagaatatttcgtaagacctcatatctaccgatgtgattattttgagtatgttaatatacttcaaagcaaaatgacagtatgtaaaacacaaagctcaatcactcattcatcacgtatttattgactatctgccatgtgccaagcactgttacatattgtggggtaatatcagcaaacaaaacaggcaaagatgcttgcctttatggagctcacattataaggtgacactgaaaataaaataatgtttagggcaaacatggtctctgctctcacaacacttagcctaggtagaaatacaaagcaagccgttggtagacaggccatgtggtaggcagaaaagcagaaggtgcctggtattgtgaaggcatctaactgtgactgaggtacatctagcagagtttcccaggtgaagttatcttggtaggaataatctagatgaagaaagggacagggatgaatattctaagcaaggaagaatatgtttataaaaaagccagaagaaagagagtagggaaagttcggggaactgatagtagtccattcaggctggagcatagtgttcaagaatggaatggtagatgaatctagaggagttaagcagggtcataccatgaatggcttttaaagtaagttgttgtaaggagtttggaatttatatattgaggaaccattaaagcaggggagcgatatgtagcatttgaaggatgaatatcaaaaaatcgtttcaaggaataaggtaaataaagtcactttggtgtttgtttctgcacattaacacttcaaaacttggcctagaataaaattgagcacgtccatgaaaccaattttgaacctcaaaaatgaatggtagcctaatcattagttattttaatagaatatacaggagcatttacataactatatatttgaggttttattagtggtgttaatatctcaaggcagaacagcactttatcttcacatcattataactattttaagcccaagaagccttagtacttttttccactttatcctgaaactctggaagtgcggcataggggttgcttatactcgcattctacttaaagccacactatgcttaggacttggccatttaaacaaaatccagttgttgcgttattactgctctttgagataagctccagcaatacaaagtaaaaccagtgctactattctagaaaagaaagtctagcttgtctctccaccctcaattatattattgctaatgaccaatgacattggaggaagttttatctctttaatttgttgcaggttatgctttttaagataatacatagaaatattcaaatatagaacttgacaaatcatccagcttcacactaacacattcaaaaactatttatgaagaagagaaccagattgtattgttaatagttgcaataacagtaccaacaggtagtagaagtaactgaataacagccatcactttggttgagcttaagttgtgcataggtgctcttccagacacctcatgtgtattattaactttataatcctcaccaccaaatgaggtaggtactattattatccatattttaaagatgagaaagcagaagtactagtcacaagattagcaatttttttaataattggaaggcttttgcatttcaagctccagtggcttaattgacatttttatagaatgagtaattgctatgattttttaacgtatcaataaaagttcttagaaggtaaaaatggcctttcagttcattttttaaatctttaactctgcaaaattgacataggtacacttcagtggctaatcaaaggctaaaatcatactagtagatttggaagtaaaatatggttagagaactaaaaaagccatgtgtatatacatattcatataaatagagctttttcttatcttcagaaatgtatgtatttaatccctactgaagaaccgagttcactgaggaaaggatactaggacaggtggtcttaattttagagaggaaaagctatatttaaaactatttcaccctttatccatcagagaaacatttgcttttcatttttaaaatgtactgttccagatgtgggggatatagtatataaataaaataatcaaaattcctgccttcctggaatctacattctatatgggggcagaagggagcagaaaagcaatatgtatataaattatatagtatattagaaggtgaaaatggtgtaccggaaaatatagcaggaaactactttgatgggagtagagaaagacgtgagaaagcacacatgcaggcatctgagagaagatgctccaggtagagggtgcagcaagtacaaaaaccctgagggcatgacatagctggtatggtcaaggaacagcaaggagggcttggctagagacgagtagaggaaacggggagccaaaacatatagggcttcgactttggtctttactcagagatgaggcgcctttggaaattttgagctgaagagtgacataattttaggctttaacagaatcattctggctgccacgttgaggataggtgttgggtggaagctgactgatctgtttcaaacttattgcaataatgtagtcagtaattcagtcagaagatggcagtggcttggatcagggtaattgtggtaggtaggatggaagtggtcaggtcctgtgggcctgtgggtgttgtttgttttttgtttgtttgttttgttttgttttgttttgtttttttgagacagagtcttgctctgttgcccaggctggagtgcagtggcgcaatctcggctcactgcaagctcctccatctgggtttatgccattctcctgcctcagccacccgagtagcggggactacaggcacccaccaccacacccagctaattttttgtatttttagtagagacagggtttcaccgtgttagccaggatggtctcgatctcctgaccttgtgatctgcccgcctcggcctcccaaagtgctgggattacaggcgtgactgtgggtgtattttagacttaaagccagaaggatttgcttgacagactgtatgtatattggacacaaagaggtcaagaattattgcaaggttttgttttgttttgttttagagacagagtttcactcttccagtccaaggtggagtacaatggcgcaacttcggctcactgcaacctctgcctcccgggttcaagagattctcctgcctcagcctcccaagtagctaggattacaggtgtgcgccaccatgcccagctaattttttgcatttttagtagaaaaggggtttcaccatgttagccaggctggtcttgaactcctggcctcaggctatctgcccgcctcagcctctcaaagtgctgggattataggcgtgagccaccacgtccatctgcaagtttttgacctaagtaactgaaagaatggggagttgtagatagttaaaatggggaatgccagaggaggcaaagatttcagggatggaggtctgggaagtatgtcagttatattagaagcccagttttaaatatgttaagtttgagatgtctcttaaacatttaagtggaggtatccaattttaggatatgcaggtctggacttggattgggggcagggtgaattagataattagagagttgtcagcatatcaaagatatttaaatctgtgagactagataaaccctcaaaggagtaagtatagagaaaaggagaggatcaaggactgatccctgaagtactctagcatagagagttgaggaacgaggcaaggaagatgataacgagtgaggcagtgaggtaaaatggaaactaagagtatggcctggaagtcaagtgaacatgtgtgaaagtgggagagaatggtcactgcctaggtcaagtgagaggactacgaattgaccattggatttaggaacattaaagtcattgctaaccttgacgagtagttttggtgaaacagtaggcgcaaagtaatgtttgtaatataagagactcggaggagaggaattgtgaccgtaagaatacgtaaatctttcaaggggttttggtgtaaaggggaacagaggaatgaggcagtagtcggaggagaaagtggggtctagcaattttttgcttgttttttaagataggagaaataagggcatgtttgtaagctgatgggaatgatacactaggtggagaaaatatgataatgtgggagggaaagggaagaattgctagagtgataccctagagaggcaaaaaaggatgagattttgtgcacatatggaggaattagcatcaggagcatagacagctcattaaagagtttcctggccaggcgcagtggctcatgcctgtaatcccagcactttgggagatcaaggtgggcagatcacttgagctcaggagtttgagattagcctggtcaatatggtgaaacgctgtctctacaaaaaaatacaaaaattaactgggtgtggaggtgcatgtctgtagtcccagctactcaggaagctgaggcgagagaattgcttgcttaagcccaggaagcagaggttgcagtgagccaagattgaaccactgcactacagcctgggcaaaaggaatgaactcctgtatcaaaaaaaaaaaaaggagttcctgattgttcttttttcctctcagttaaaaggaagcaagctcatcaactgagtgtaatggttatggggagaactgctgaaattttgaggatgggcaagagggtatgaaatagtcatcaggggaatgaaagtgaaagtgaatggagtagagaaatgtagtatcattgccaggtggcatgtggacccacttgaggttcctagtcataaattgaatgtaaaacaaagcttttctgtgtttctcctgttaaagtagatgcatggatactgaataggtaaataggtttttaccaaatcagtacaatgaagtgagtggcataagaaatgagagcatatctaagagttattataataattaactatggacatgaagaaggtgttggtaggatcatagaccctggtaggcttgttgatgtgagagcacttgaaagaaaaaggcgatggtcaaagaatgggatagtagaaactattattattggaagggttgtggttactggaattggtaagatctagatgtgactgtgggaataggtggctgaactaggatcaggtatgaagtcactagaagagaagagttcgaggatctaagaggctaaagggttggaagaattgtccatttggatattaaagtcaccaagaattaagtaagagataatgtcagtgagccaggtgataaaatcttctagaaatgaaagtaagggaatgaggcatctgtaggtgattgcagtaagagatactgggtatctctttttttaaagagttgggaatgatacaatagatggagaaaatgtaatatgggaaggaaagataatatgataaaatgtaatatgataaaatatgataatgtgggaggaaaagatgatgtgctatagttgaataacatgaagttgaaggattggctagaattgtttagggaaaagagtctaaaaacagtgatgaagaacataagactcctccattgacctctaggttcagtgataaaagaggagtatgggagataaacgctagcactggaggatgaagggaaggtttagagaagaggttaaggatacagggaattttgctgatgactgaaatgatttccagatggtatagtgctcgtgaagagaaaagaggacttttctagtttaatgaatttattaaaactttgaatttttgtagatcattttttagcttagaaatggttgaattagaatgatgtcagaccagctattttgtactgttttatatttggtattattggggaaactagccttaaaataaactgaaaattctaattatcttcaaattatttatgagcacattaatcacaaaaatcactaatttctaatagaaaatttttctaaaaaatagcacaaatgaacttgtaaaatttgtcctattctaccattgagtcttcaatttcattgagataattagcagtcatattatttgaatgtctaccttctcactatgtgtatgtccttaagggaatagtatcatttcatcttacgtcttctgcttctcatagtcatgctgaacatgtagatacaagtaaataatacttacatgtaaatgacaataaatattttatttgaataggaaaatgtgattggaccagtttatgaaaaaaaggtttagttattcaaatatttctcaaagaattaaattaagaaagcctcatacttgtagtatctaatatttaagtagtttttcatcaatatttttatttagtaatttataaagaaaagattaagaaaacattctaatggaagttttttggggaaaaaagtatagccattaattttaagttaatattataaggacagttttgaaacagactttcaaggatttatatttgaataccacctgaattgtctctagtataattggcccaagagggaaaaggaagatagatatactttgtcattaacgtattattaatatctataaatcttttccaatgtgaaggttggtagaaagtaaacagcgccaccgagtggtggtattaaggagctttagtcacttggaaataaataattcgctgctttcttttcaacagttttccatccaattatcttagtaacaacaatcagacttctgtgacacctgtaccatcagttttaccaaatgcgattggttcttctgccatggcttcaacaagtggcctagtaatcacctctccttccaacctcagtgaccttaaggagtgtagtggcagcagaaaggccagggttctctatgattatgatgcagcaaacagtactgaattatcacttctggcagatgaggtgagtattgtgggtatgagaaggaaaatatatcacgaattgacataccttctaatattataacaaaatgcaaattcctcattagttatttggaaatggtttcatagattacagatagttatattaacataaaattttaattaatattctttaatagaatatcatagaaatatttaaaacttttaactgccaaataacttgaagatgtataaaactccctccaataagatcctttatctaggccagacatggtggcttacacctgtaatctcagcacttttgggaggccaaggcagtgggatcacttgaggccaggagttcaagaccagcctgggcaacatagcgacacctcatctctacaaaaaatatgaaaaattagctgggcatggtggtgtgcgcctgtagtcccagctactcaggaggctaaggtgggaggatcgtttgaacacgaaaggtcaaggctgcagtgagccgtgatcatgctgctgcactacagcctgggcaacagagtgagaccctgcctcaaaaaactaataataataaataaatcctttgtttttcagcacaattgataataacgtttaaagtccttttggtgaataatttaaacaaattaaatacaaatctgattggttttctacttgtttatttttttaatgtagttaataactggaagtattttattttgcaggtgatcactgtgttcagtgttgttggaatggattcagactggctaatgggggaaaggggaaaccagaagggcaaggtgccaattacctacttagaactgctcaattaagtaggtggactatggaaaggttgcccatcatgactttgtatttatatacaattaactctaaataaagcaggttaagtatcttccatgttaatgtgttaagagactgaaaataccagccatcagaaactggcctttctgccaataaagttgcatggtaaatatttcattacagaatttatgttagagctttcatgccaagaatgttttcttacaaaattctctttttattgaggtttcactaataagcagcttctacttttgagcctcaacttaaagcagaactgttttctactggatttttcattaacagcaagctttttcttttatgtaaaataaatctattgtgaattg

SEQ ID NO: 37141 - DNA, 38802 bp, Homo sapiens; identical to SEQ ID NO: 37140

SEQ ID NO: 37142 - DNA, 5230 bp, Homo sapiens
atgggccccaaaaaatcttggcgaaggtcggtaaagtgctaagctgttgtctgcactctttcatcataaagtcacttttttccactgcctgaggtttggctgttgctcctgttatcccaagctctaagcccttcccatggtccccagacccaggcaggggtaggtctcgtctggagtgtcccgctgccaagtgccctgagaagccagtcctgccttggtgctccactgagggacgcttcggagttaaccaccgtgcacttgttcccgacgcggggctggggcgcgcgcagggcattgtgggtgcatagttcagccagcgcgtcgtcggctggtgggccccaggcgtggactaccattcccatggtgctctacgcgcagctagccgccgtcgcctgcgcgctcaggcctctgggattagtagttttagcctcgtggatgtgggcctgaatcggatggcctggaactcgccttcccggcgacctgtttggcagggcggggcgcctcgcgaagatggtggcgcgcgtggcgtgtggctcccgtcgtctggccaagtctcagcgcagcgcaccggccggcgtctcgttggcctggagcccacacccaccgggtccctgaccccgcgccccccgcgcccggttcccggcatgcctcgcgcccgtaagggcaacacgctccggaagggtggtcagcgccgtggaggaggtgagtggggtggggggcgcgggacagctgtatgagcggcgggcgggggtcctgctggatccccttggttgttctcgagggccctgggtggggaaccccctcggccagccccacgcagcttcccataactctaccgaggctggcacgtgccccagcagtcattggccacgtgcgtgcccaacttgagctcgctgcccactgcctgttgggagtccgcgctcccagcggtgacccggccagcccctccgggcctcagttgcctgctgggtggacaaactcaccggacagggcaggaagccagtcctcttgccaaaccctgatcctttcctggactggtcaaggaagttggcgggagtcctggcctgctccggtgaagagagggagggggctctgttgggaagctacctggttagggccttggcagcttggcaggcctgactccacaaggtagctgagtatcctggagcctgaggcagtcttgggactcgcttatcagcttagaccaggagcctatcttaatgcgttaaacacatatgtttactctgctgggatggggtgcctaccacgcacaaatttatttatttttattcttgagggggaagggaggagggccgggcacaggaaggaggaaaatacctaggcacaactttaaactggtcaccaccatggtgggttttgggtgggggacatctaatagggtgtggaacatgttcactgagtggtgtcagccccagacttaggactcagggaggcctggggggaagtgcttctgggtgagtcctgagaggatggagaagagagcaagttgtacaaagacctggcagctggagggaccccagcgcagtggagtgaatgagggaaggctgggctgctccggcaggtagaatagtaagataaaatgggagcaggctgggcgtggtggctcacacctgtaatcccagcactttgggaggccaaggcaggcagatcacctgaggccaggagttcgagaccagcctgaccaacatggagaaaccctatctactaaaaatacaaaattagctgggtgtggtgtcgtatgcctgtaatcccagctactcgggaggctgaggcaggagaatcactggaacccgggaggcagaggtcgcagtgagccgagatggcgtcattgcactccagcctgggcaacaagagcaaaactctgtctcaaaaaaaaaaaaaaaaaaaaaaggtggcggggagcagaggccagtgcgcaggctggactttgtcctgcagatgaggggtgtgagtagttcttagaagtagggccagcctggtgatcacaccctgtccaaaactctgccacagcagccaaccttgccaatgtcagcccttggccctggacagaccccacacacaggagtgcaccagccctactgaactgacccttggctttggtttttcatctctgagagggacaccattctatcttttgggattatgaggtcgagtgaggtacccccagccatccctcatcagtagaggcaagttgagtgtcctattccaccttctccaggtgcccggagcagtgcccaagctgactcgggttccagtgacgatgaggcagccagtgaggcccgcagcaccgccagtgaatgccccagccttctcagcaccactgcagaggacagccttggtgagagcgggtggaagtttgacaggggcttggtgagggctccatgggctgaggacaagaagcggtgctgaccaggtggccttgcagggggggatgtcgtggatgagcagggccagcaggaagaccttgaggaaaagctgaaggagtatgtggactgtctcacagacaagaggtacccctggctgccagccaactcctacacccagctccaagtgtgatcaagggagggctggcccatatgaccccccttctcgacctcccccagtgccaagacccggcagggtgctcttgagagcctgcgcctggccctagcgtcccgcctactccccgacttcttgctggagcgccgcctcacgctagccgatgccctggaaaagtgcctcaagaaaggttggacctgggggtgtgtgggagacttaaactgggcagacactggcccttgctgcatgggctgactggaaagcatcccacagggaagggcgaggaacaagccctggctgctgctgtgctaggcctgctctgcgtgcagctgggccctggacctaagggtgaggagctgtttcacagcctgcagcctctgctggtctctgtgctcagtgacagcacagctagccctgctgcccggctccacgtgagtgtgcctgtgccccatgaaacccttcctgcaccttatccctcagcagagtggtgggttccccctatcttcagcctcctttactctgaggggagtgagctccagggctgggaacccaggttcacccgctgaccgtggcattgcattgcccttctcccaacagtgtgcttctgcccttggcctgggctgctacgtggctgccgctgacatccaggtgaggggtctttgggcacaggtggtagagcatctagggctgtaactctgcctctgagctcccctgcctctctgtgctcctaggacctggtctcttgccttgcctgcttagaaagtgttttcagccggttctatggcttggggggcagctccacaagtcctgtggttcctgccagcctgcacggcctgctctctgctgccctgcaggcctgggcattgctgctcaccatctgccctagcacccaaatcagccacatccttgacaggtaggggtggctgtccactgggagggggaggggatctcaaagaggcccccaagccacacatatagctcagcctgccccttccctaggcagctgccccggctgccccagctcttgtccagtgaaagtgtgaacctgcggatcgctgccggtgaaaccattgcactgctctttgagcttgcccgggaccttgaggtgcgagggacaaggatggggggtgcttggtgacaccacctgcccatcacaggctggatgcagggggtgccacacaaaacagaacagctttaggtcattatgcagaggaggtggccccaaaacagatttatctcctagatgtcatgatgggtgccctcagcagtggtgtcctggcctgacagaggccaaggaggggtcaaaggggccaggcagagaagagagggtctctcagtgaaaggaggggtttgggcagtgccctgttcagagccagcagagctcaagcatctaccacacaccctccaatgctcccattgcaggaggagtttgtttacgaggacatggaggccctctgcagtgtcctgcgcactctggccactgacagtaacaagtaccgtgccaaggctgatcgtcggcgccagcgctctactttccgcgccgtgctgcactccgtggaggtgtgtgtgagaacatatgtgtcctagcaagggtgcacccccaggcatagcagccaagcccagttgtgttggcacctctaccctgcagggcggtgaatgcgaagaagagatagtgcgcttcggctttgaggtgctctacatggacagctgggctcggcaccggatctacgctgccttcaaggaagtgctgggttcgggcatgcaccaccacctccaggtgcggggacggacagggaggggacatctggtgtggttgcttcagtctggcctgagctcactgccctctgccccccagaacaatgagctactccgtgacatctttggcctgggccctgtgctgttgctggatgccactgccctgaaggcctgcaaggttccacgctttgagaaggtttgcacccttgggcacctttctcttccccctattcccatttcctggaggcctggaattctgtagaggccggaagaggacccccagccctttcccttcccagctccccagggtgtcactctctgtccccactctagcacctgtacaatgctgctgccttcaaagcccggaccaaggctcgaagccgtgtgcgggacaagcgggcagacatcctgtgaagcaggacctgctgaagaggagactttctatgcccttggtccgtatttttaacagaagacagtgcaacaactggtctccaccagtatttgtcactttattttttttaatgacaaaaccaaaaacagacatggggtgggtagctgggggcccggacacttgggaccctgacccctttgtccctgcactcagccctgtggccccttcctgtcctgtctcaggccaggctaaatatgtgccttcctcagggctgtggggcaggcactagggggcctttcccttcctttcctttctcaggccttgctcccccaggatgacccactcttaggggggtggtggcatctggacaaatgccaccacagcaggtggggtggcaaagctacctggaatggatttgtgtgctgatttttaaggattattacagataattaaacagaacggtcagccttctgtggtcttaacccctgggtatttttctgttctccctccccatctactatccca

SEQ ID NO: 37143 - DNA, 3139 bp, Homo sapiens
gacggcagccgccccggccgacagccccgagacgacagcccggcgcgtcccggtccccacctccgaccaccgccagcgctccaggccccgccgctccccgctcgccgccaccgcgccctccgctccgcccgcagtgccaaccatgaccgccgccagtatgggccccgtccgcgtcgccttcgtggtcctcctcgccctctgcagccgggtaagcgccgggagcccccgctgcggccggcggctgccagggagggactcggggccggccggggagggcgtgcgcgccgaccgagcgccgctgaccgccctgtcctccctgcagccggccgtcggccagaactgcagcgggccgtgccggtgcccggacgagccggcgccgcgctgcccggcgggcgtgagcctcgtgctggacggctgcggctgctgccgcgtctgcgccaagcagctgggcgagctgtgcaccgagcgcgacccatgcgacccgcacaagggcctattctgtcacttcggctccccggccaaccgcaagatcggcgtgtgcaccggtaagacccgcagcccccaccgctaggtgtccggccgcctcctccctcacgcccacccgcccgctggaaaaagaaaccgctcggactgagtttctttctccagctgctgccagcccgccccctgcagcccagatcccaactcgcatccctgacgctctggatgtgagagtgccccaatgcctgacctctgcatcccccacccctctcttcccttcctcttctccagccaaagatggtgctccctgcatcttcggtggtacggtgtaccgcagcggagagtccttccagagcagctgcaagtaccagtgcacgtgcctggacggggcggtgggctgcatgcccctgtgcagcatggacgttcgtctgcccagccctgactgccccttcccgaggagggtcaagctgcccgggaaatgctgcgaggagtgggtgtgtgacgagcccaaggaccaaaccgtggttgggcctgccctcgcgggtgagtcgagtcttcctctaagtcagggtcgtgattctctcccagggagggagtcctaactgtgccgaccgaacgggggaaataccttatccaggcgttttacatggtgtttgtgtgctctgctctcgcagcttaccgactggaagacacgtttggcccagacccaactatgattagagccaactgcctggtccagaccacagagtggagcgcctgttccaagacctgtgggatgggcatctccacccgggttaccaatgacaacgcctcctgcaggctagagaagcagagccgcctgtgcatggtcaggccttgcgaagctgacctggaagagaacattaaggtacatgttctgctcctattaactatttttcacaggaaaaacagtggataggacccaacttagggctcttgccacgcttgttagtataagcccgttatctccaaaactatctaaccattgagctgttttgctggaatgagagcttgtgtaatagcaaccaccagttttccactacgaaatcttccacagggttagttaattcaagacattccaagagaggctctggctatttttggacatagcaaatgagactcaaacttcctcccctcaaaatataaacagaagtcagacaacagaagactaaaacacagagggttgaagaaagccactcctcttgtagagtcgctgatttttttttttcctctctcttttcccttgtcttccttagaagggcaaaaagtgcatccgtactcccaaaatctccaagcctatcaagtttgagctttctggctgcaccagcatgaagacataccgagctaaattctgtggagtatgtaccgacggccgatgctgcaccccccacagaaccaccaccctgccggtggagttcaagtgccctgacggcgaggtcatgaagaagaacatgatgttcatcaagacctgtgcctgccattacaactgtcccggagacaatgacatctttgaatcgctgtactacaggaagatgtacggagacatggcatgaagccagagagtgagagacattaactcattagactggaacttgaactgattcacatctcatttttccgtaaaaatgatttcagtagcacaagttatttaaatctgtttttctaactgggggaaaagattcccacccaattcaaaacattgtgccatgtcaaacaaatagtctatcaaccccagacactggtttgaagaatgttaagacttgacagtggaactacattagtacacagcaccagaatgtatattaaggtgtggctttaggagcagtgggagggtaccagcagaaaggttagtatcatcagatagcatcttatacgagtaatatgcctgctatttgaagtgtaattgagaaggaaaattttagcgtgctcactgacctgcctgtagccccagtgacagctaggatgtgcattctccagccatcaagagactgagtcaagttgttccttaagtcagaacagcagactcagctctgacattctgattcgaatgacactgttcaggaatcggaatcctgtcgattagactggacagcttgtggcaagtgaatttgcctgtaacaagccagattttttaaaatttatattgtaaatattgtgtgtgtgtgtgtgtgtgtatatatatatatatgtacagttatctaagttaatttaaagttgtttgtgcctttttatttttgtttttaatgctttgatatttcaatgttagcctcaatttctgaacaccataggtagaatgtaaagcttgtctgatcgttcaaagcatgaaatggatacttatatggaaattctgctcagatagaatgacagtccgtcaaaacagattgtttgcaaaggggaggcatcagtgtccttggcaggctgatttctaggtaggaaatgtggtagcctcacttttaatgaacaaatggcctttattaaaaactgagtgactctatatagctgatcagttttttcacctggaagcatttgtttctactttgatatgactgtttttcggacagtttatttgttgagagtgtgaccaaaagttacatgtttgcacctttctagttgaaaataaagtgtatattttttctataaa

SEQ ID NO: 37144 - DNA, 4494 bp, Homo sapiens
attgggctgagtcggagacttcctttcctgattggccgtgttgtacggcggcttctcgcgcagctgatgacctggaagtgatgcctaaagctgtggaccgcgtgggctcgcctccctgggactaggtttcagcggccgctgcgatgaccaaaataaaggcagatcccgacgggcccgaggctcaggcggaggcgtgttccggggagcgcacctaccaggagctgctggtcaaccagaaccccatcgcgcagcccctggcttctcgccgcctcacgcggaagctctacaaatgcatcaagaaaggtgaggcggacggcggcgtggccgggatgggtgcgcgggtgggatgggtgcgcgggtggctgagcgaggcccccgaccgactcttctgtcgttgcagcggtgaagcagaagcagattcggcgcggggtgaaagaggttcagaaatttgtcaacaaaggagaaaaagggtaagaaccttccttcctctggattttgcatttctaaacgttaacggagaaatctctacttagtaggcgcgcagtaaaaaggttaactctgacctagccccatatacagaagccaatcaagcagtcggtaaagtccctttggtacaataccggtacgacaataccggtacaccacgtataccagctcaaagtgaattccaaagtgaagcgaattgtgtaagcaaagtcccttagagtaaacccaccttcattaattcagggaccctcctccccgggctccgctccttgcctcagattacctccggcccccgccctaatcctctcagccctgaatctcagtcctagggatgacccctctccggctctgtatttaaggaactgaacgttaacgtttttgtttgtttttgagatgggtctagctctcacccaggttggagtgcggtggtgcgatcacagctcgctgcagcctcgtccccctgggctcaagcgatcctcccacctcagcctcccgaatagctgagaccaccggcttgcgccacgcctggctgttgttattgttgttttgcagagacagaggagtctcgccatgttgcccgggctggtcttgaactcctgggctcaaggaatcctcctgcctcagcctcccgaagcgttgggattacaggcatgagccaccgcgcctggcagccttaacaattgaatgtactctttttcaggcactgtgttatgggggaaacagtgacattcattcatcagataatgacacacacacaactaattacacgttgtgatagatagccatgaaggaaaataacagagtgcaatgataacttcatcaccccacttttcttaatggcatttatcaaagtttgaaccttgtttacatttttcttccctttatcaccctctcaggccagatggtaagctccttcagaacagggcctccttgctttatcccaagaagtgaaactgtaggtgctcaagagatcaataatgttgggcagacttgatgctcaacggcatctaacctagctggggagggcgcatctggggaagtttccctcagcagtcacatttgagctgaggtcttaagacacagggattaattggggggtgggtgggaggattctgccagaagaaagagtgggcctctgggcaggagagggtctggtgagcagaagtgctaccttcttagggggccttgtaggacacagtaaatttagtttttatactcagcactttggaggctattaggggttaaagccaggaagtgacataatttttattattttttacaccctaagatttttctgacaattgaagaaaggattagagaggtacgagtaggtttgggaaagttcaggtagtagactactgtagtcctggagaggtgatggtggagacagagttaaaggggacagatttgaaaggactttcagatgtggagaatggggaggtattgacgacttctaggttctgacatgcccagctggagggacagagggcccaatcttgagatgtgaacagtggagggggaccagatttgtgtagaaagatcacaaatttgggtctgggtaagtttttgaggtgctgtagagacacatgacttccaccccgccccacaccaggagaactgtcaaacaggcagatggctataggggtttggagcatggaagagagagggccaggctggagatagtacatctgggagttttcagcacatagatggcacctgaccccatggcagtggctccggtcagccaggaagaaggtcctgagaggagagggcagccgaggacaaggctgtgaggaacactcacagtgaaaggcgcttaacagaaggggagccagcagagggcccagaggagcactaggagtgcggaagcattctttcagccgagggctctgtccttgtgtgtccgcctgttatccagcatgggagagcagacttttccttctgtgtcttaggctcctgaggcccttgccccccagccttgacacctggccagctaggaaccctggctgagtctctggcaagctttcattgcctcactgtcactcttgggacagagcccatgcttcttagcctggtactcaaggtcttgggggtgtcccctgccagtctctcggctgtgtctggtgccgttctgattctcacaccacatgctctcccccgccccagcccctccgtgggctgcctgccacacagtcatccatcagcgtgctgttcaagtgtcacctcctggttgaacccttttttgactctccaaagagagctgagctcatacaccttggcacccatcctgtacttcacctgtccgagcactacatcactttggtggcacctgtatgttgccaagaggtagagatcacccccaaatagtgtgctcaccaaacacaattttgtctctatccctaagacccagcccagggcagcacttaaaactgaaagaaggaaggagcaagccagagatgacagtgttttctctcatttcaggatcatggttttggcaggagacacactgcccattgaggtatactgccatctcccagtcatgtgtgaggaccgaaatttgccctatgtctatatcccctctaagacggtaaggagcacgtggccccctgaccttgctcagcactggggtgtctgggatagtctgccatagcaggagagtgtgggaaagagccaggagtgttggagctaagacaggcctggatggattctcagctccacatcttcttagttttgggactacagatatgttacttcttgcatttcagttcccatcttgtaaagtgggaatcccagcccaggcgctgtggctcacacctgtaatcctagtgctttgggaggccaagacaggaggatcagttgaggacaggagttcaggaataacctgcgcaacaaagtgagactccatctctacaaaaaaaatttttttaattagctgggtgtggtggcacatgcctgtagtcccagccacttgggaggctaaagcaggagatcacttgaacccaggagttcaaggctgcagtgagccatgatcatacaccaccacactccagactgcatgacagagtgaggccctgtctcaaaaaaaaaaaatagaggctgggggtggatcttgggtacctacagtatcacttcttgggataaagcaggaggccctgttctgaaggaacttaccgtttggcctgatggtaagaaccaaatagtcagttatctgtggactatgagaataaagagatagatgtatgtgaaagagctttgtaagctaagatgcttcacccatgttagtccggttaggtgggtttaggctcagagggacctgtagctgtccttatcttacgtaacaggggccagatctgaggcacaggaagtgggggtggcagggaccgggacagcccctgctgggctggagccctttcatagttgccatgtgggaatgtaggccctgtgtggctggaccatgccttcaaagtctgattgagtttaaatgatggcaaccaattcaagatgcttttaaatagaacatggaccgaacagaacatggttgtgggccagattaggctggtgggtcatcagttggtgacttcctggcatacaggttgtacagcttttttccaaacagcacttctttcccctctgtaggacctgggtgcagccgcaggctccaagcgccccacctgtgtgataatggtcaagccccatgaggagtaccaggaggcttacgatgagtgcctggaggaggtgcagtccctgcccctacccctatgaggggctccggtagcacctgggcacctgccgctggaagctattgggctggcagcaggacgactggctgtcctcctgcccacccacactgacggcatcttcccagttccccaaggcacgccttcttcccaggcagctctaacagccctttcatgaaggtaatgctagtcttctgtccatcagtgccatttcctgtagaactaaaggctgttccaagaatgtggggtggggaaagtaaatgctaagact

SEQ ID NO: 37145 - DNA, 7317 bp, Homo sapiens
gggggttcaagggggtacggaaaagccggggaggggactcggtccggggccggagaccgacggcaacagcggctcaggacccacgctgcccccacccctcccgagcaggtcagagcctgagcaccctgcgcgtccccgtactcgtgacctcctccttccccaacagcaccaagggcccccctattccacccttctgttgccccctcccccaaccttcctgcagaactcccttccggtcttcttgacacccacccacgtcccttccctgcccggttcccccgcgcctgcctgactctccacccccaccccaccccgtctctccccaggcgcccccatggcccgaccccgctgattccttcactcggccatgctcccgcggcccctgcggctgcttttggacacgagcccccccgggggagtcgtactgagcagcttccgaagccgggaccccgaagagggtgggggcccaggtggcctggtcgtgggcggggggcaggaggaagaggaggaggaagaagaagaggtgagacgcgggtggtgggaggtagggggcgtatgtatttctgaagtctccacttttctcttgtctctgggtccctacatctcctcctccttgcctcagttattctcgcgcctccctgggtgtcggcccgtttctctgctgcggggagtcctggcgtctccgtggttctctgtcagtgtgactcaggacctgcccgcaggaacctgccctgttcctgcctggaacttctggctggctgtcctgtccctgcgggtctttggccctccacctctgcctgcctgagtgtgcctacctctctgagcagtcgtgtcttggtccctgtctccctccttgtttttgtttggcggggaggggtttgtttccacagtaaccagctcctctgactctgggattggggagggaaccctcagatttcgtgacccctccttccctctctcccccttccccccgcccccccgccccgccccggtcctgggtagaggccgggaagccacggttctgggacctggaggaaagatcctagggtgggtagagagtggtcatctgttttcattagggattaatggtggtggccaggagcaggatttcgggcctcaggaggggccagaatttggatttggggccccgaggccctaaactcctaggtccagatcctaggtgagggcaggttgactggcagggctggtttttcgggatcggtcgggggaggggctggggccacgtgactctctgagtctaccgcccccaaccccctatcatcccacttccccttttccttcctgtactgggattggagctgctaccttcgggggtcccttagggctgagatagtggaggcgctacccgagggaccagggtgaaaggggtcctgaaaaagactaattctctgggctggtatagtccttggccgggaggggcggggcatgcggcagtgcctggactgaggtttcagctacccctagtcgctgcctctggcttgctgcctctcgcttccctctcctgccctttgtaccctgcttctctgtcgtgtgtgggttcagctctggggagaaggggctttgggggtctccaggatcagaattcctgtactccatccacgcctccactgcagccccttcgactccaccggggccctgaggcggctggggtggggctgtctgggccccagtgggggagacctggggtcaccagctcccccaacccttcctcgcactcgctggtactatgccctgccaccacaggtgaggggtacagagggaggagcagggcctggggtgaaggctgagggcaatggggggtggtgtggaactgtctgacttccccttccttgctcctccaggcccctgtgtccgtctgggatgaggaggaggatggtgccgtgtttaccgtcacaagccgccaatatcgacctcttgatcccttggtgagatcatgactttagcttctcacctctgactcttcattcccagttttccttcctctggctgactttctggccagagtgctaggttggagttctggagtcctggactctgctgtgtgacataggccaagactcttgccctctctgaatatcagaaaaatgagtctggaacatctcctgggtctgggattgtcctcagaaatctaggtgcagagtgggagaaagggttagcgatcatctctctgtgttctccaggtccctatgcctcccccacgttcctcccgacggctccgagctggcactctggaggccctggtcagacacctactggatacccggacatcagggactgatgtgagcttcatgtcagccttcctggctacccaccgggccttcacctccacgcctgccttgctagggcttatggctgacaggtcagagtcataagggacgcagggtagtggagtatctgcccggatttcctaaagccgcaacatcccaccaaaatagtcaaagccactgagggtttgggaaaaatggacagatagatcctcttctccccctcaggctggaagcccttgaatctcatcctaccgacgaactagagaggacaacagagtgagtgacccctggttcttaatctcacagtcccctctgcccaggctgcagctttacctctcacccttggctgattcccttctcccagggtagccatctctgtactgtcaacctggctggcctctcaccctgaggattttggctctgaggccaagggtcagcttgaccggcttgagagcttcttacttcagacagggtatgcagcagggaagggtgttggggggggcagcgctgacctcatccgcaatctccggtcccgggtggacccccaggcccccgaccttcctaagcccctggccctccccggcgatccccctgctgaccccacggatgtcctggtgttcctcgctgaccacttggccgaacagctgaccctgctagatgcggtgagaccctgacctctggcccctatgccccctgaccccttactaacctctccttgactccagatcctttccttgcttccaccccttcctgatccagctcctagcctcctccacctaccattttgattctccccttttccctttggtcgttacccttcaaaccctgtgcccctctggttccttggccacctgagatcctcagatccctgatattggaaggctgacctcacttgactatgaactttaacctctgacctctaccctgcaggaactttttctcaatttgatcccctctcagtgcctgggaggcctgtggggtcacagagaccggccaggacattctcacctctgcccatctgtccgagctactgtcacacagtttaacaaggtggcaggggcagtggttagttctgtcctgggggctacttccactggagagggacctggggaggtgaccatacggccactccgtcccccacagagggcccggctcctggagaagtggatccgcgtggcagaggtgagagagaagattgccctacggtttgtggccatggaatggagaggcctcccatagccttagctctcttctttgacccccacaggagtgccggctgctccgaaacttctcttcagtttatgccgtggtgtcagccctgcagtccagccccatccacaggcttcgggcagcctggggggaagcaaccaggtgcggaggctgaggcattggactggggtgggggttcctcagaaggcggggaagagggggtgacagagccaggcctgtcctcagggccacttttctcccttccccagggacagcctcagagtcttttccagcctctgccagattttctccgaggaggataattattcccagagtcgggagctgctcgtgcaggtgagagcctggtttgtggcattcccacctctccttgttccctactgctcccccatgtctcttttattttgtcaccaccaggaggtgaagctgcagtctcctctggagccacactccaagaaggccccgaggtctggctcccggggtggggtgagtgactagcggggtggtgggcgtgggggtggtgattatgaaggggtgaggagtatgttttgggggagcagcctgaaggatgggtaagggaggcacagaggggtgaggagaatgaaatctgttctctgaggcaatgaggagggcaagtgcggagggatggagggccctcacgtcaatggcaggcacttctgaccctgacccctgacttcagggtgtggtcccataccttggcaccttcctgaaggaccttgtgatgctggatgcagcctccaaggatgagttggaggtcagtggtgtgtgtgtgtgtcattgcaatgatgtaacaagtgggctgcagggtcggacagacccccccgccccttgcaaggggctgtaaggcacaaatagctgagtgtgggacagagccagatctgtttctgtgccaagtcgcctcagtgatctgtaaatgggaaactagaaatagcatctacattgatctgttataagggttaaatgaatttgtatttgtcaagtgcttagaacgtgcctgaaacgtaagcacatctaggttttgtgatgggctcctgctctattgctagagtttgttaaataaacaaatactgagaccttggacaagttccttatcctctctggataaggaatcctgtcgaattggatactatccagtcctctcatctgcaaagcagactcgttgtctacctgagaaattcaatttaaagggtcaagtggagtgcttaggccatgatagattgaggaggaaggcagggagggatcgaagagtcagagaggctggagggaagtggttgtgagttggatgtggctgtgtgtgtttaagagaggggatattctctctctgtggccggaaggtagggttggaactttcaccccatccccattttcctcgcagaatggatacatcaattttgacaagcggaggaaggtgagcggagtgtctgggctggatgctggacttccctatccatgttccaggaaggggagggggaaaagtcaggggtccctgagttttggctcctgcagtttgagggctccttcccaggagtttgcagtcctttctgagttgcgacggctccagaatgaatgtcgtggctataacctccaacctgaccatgatatccagaggtggctacaggggctccggccactgacagaggctcagaggtgactggcgggtgaggttgggactccagggttctggccaggtgtgggggattggtgtcatgtcctgagctctgcctattgcccccctaacccagccatcgtgtatcctgtgaggtggagccacctggttccagtgaccctcctgccccacgggtgcttcggccaacattggtcatctcgcagtggacagagtgagagattcactggctggggggtggtttcttgggacttccacttttctctgatcctcccaatctcctgccactgcagggttttgggctctgttggggtccctaccccgcttgtgtcctgtgaccggcccagtactgggggagatgaggcgcctacaactcctgctcctctgctgactcggctggcccaggtgagctctgctcctgactctgaccttgacgctgaccctcactctgtaaatgtttcttccttaaacctccctgccttcatgccagtcccatgttgtttgttcctagcacatgaagtggccatctgtctcgtcactagactctgccttggaaagcagtccatccctgcacagtccagctgaccccagccacctctccccaccagcctcctcccctaggccttctcgaggtcaccgccgctcagcctcctgtggctccccgctgagtgggggtgcagaagaggcctccggggggactggatatgggggagagggatctgggccaggggcctctgattgccgtatcatccgagtccagatggagttgggggaagatggcagtgtctataagagcattttggtgagggagccttgggatggagttggggtgaaggatggtgtcttgttggactataaatgttgtctgaggtttgggcagccaaatggaattgaatgtagttttaattttgacctttggttttggcagttatgttttatttttaattttatcttctaaactctagtcttcaatagaagctgaaatttgttttattttgatggctattttgcattagttgctacaccttaaacttttggtcgccgtgttaaaatttcagaatcaacagcagtttccccacagggaagcagctctgtttcactgggcaccatgtgggctggcttatggggtataggaagccaccatattgggttttcctgttcattttaaagccttggacacaagtaacattttgtggttgggttcagtggctgagggtagaaggatgggaaatcatggctgattgattgctcttttggtctcctgttctgccaggtgacaagccaggacaaggctccaagtgtcatcagtcgtgtccttaagaaaaacaatcgtgactctgcagtggcttcagagtatgagctggtacagctgctaccaggggagcgaggtcagaggccatgagggaaaggcagactcgggaggagagtggagtacttccacatctgggcggctgtggggggaacaactgtgtgtgtgctttacatccatcccctgaaccttcagagctgactatcccagcctcggctaatgtattctacgccatggatggagcttcacacgatttcctcctgcggcagcggcgaaggtcctctactgctacacctggcgtcaccagtggcccgtctgcctcaggaactcctccgagtgagggaggagggggctcctttcccaggatcaaggccacagggaggaagattgcacgggcactgttctgaggaggaagccccgttggcttacagaagtcatggtgttcataccagatgtgggtagccatcctgaatggtggcaattatatcacattgagacagaaattcagaaagggagccagccaccctggggcagtgaagtgccactggtttaccagacagctgagaaatccagccctgtgggaactggtgtcttataaccaagttggatacctgtgtatagcttcccaccttccatgagtgcagcacacaggtagtgctggaaaaacgcatcagtttctgattcttggccatatcctaacatgcaagggccaagcaaaggcttcaaggctctgagccccagggcagaggggaatggcaaaatgtaggtcctcgcaggagctcttcttcccactctgggggtttctatcactgtgacaacactaagataataaaccaaaacactacctg

SEQ ID NO: 37146 - DNA, 15989 bp, Homo sapiens
gcgtcgcgcagtcgggaggtccgggaaagtttctttggaggtgaaaacagccgcggaactccgggccctgagagggggcgggggtgcaggggtcccagggccgggccggggtctttcctggcccgggggaaaccggcccaggcctcccggggggggcaatcgcccaacaaaggattcttggggcgcccgccctcgaggacttccctgcccctggatccggcccccccagcgctccgggcccggcatcccggggctctccatcgcggggtaccccagttcgcggtctgccatcgggcagcccgggcgctactcacctccgcccgcgtccgtgttccaggtccggcccggagcggccatgtcccacggccccaagcagcccggcgcggccgccgcgtgagtgcactgatcccctccccacgccctcgctactttcccggctgcagccctagctcctgaacccctgacccagtccctcccgccggagtcttgactcccccacctgggtcagggggcttctccctccacccaattctgcaccccccacctcggcctccagtccctcccaggagccccgcttgtcccaccttccccggatactgaccccatcagaccctgcctcctcgggctcatgcactctcgctgcagccccgccgtcgggggtcaaaacgccctggggtgggcttttgggggaggggagattcttgggacggggctgaccgcggtatccttggctccaggccggcgggcggcaaggctccgggccagcatgggggcttcgtggtgactgtcaagcaagagcgcggcgagggtccacgcgcgggcgagaaggggtcccacgaggaggaggtgagagtccctgcgctgagctgggggaggccccgggctcccgccccagcctcgaagccccgccccaggctggatttgaattgcttgtggctccgcccacagcccattttcctctggaagctgagaccccgccccgtgccagctgccacgcccctgacaggtcctctgccactctaagtccaggccccgcccaccgcacaatgccagctctgcccactctaaggtcccgcccacttccactccttgggggcggcaccctccccttggtcctgtgggcccgttctccagcagaaaaccacgcccaccaagcagaggccacgcccacaaccgaagtcaacgccaaccctgtactcaaacctcggcccatagttcctcagatcccctcacccctggccagggatccctctaacccaccgtgtcccgactgctgaccgggccctacctccatcttttccgggttcttcctcccagctaggccccgcccccatccccgcccatacgcgttaggccccgcccatgcccctctgagccctgccccagtacgccaggcccccctcccaacgacgcagcccggttctgcagccggtgaagaaacgcggctggcccaagggcaagaagcggaagaagattctgccgaatgggcccaaggcaccggtcacgggctacgtgcgcttcctgaacgagcggcgcgagcagatccgcacgcgccacccggatctgccctttcccgagatcaccaagatgctgggcgccgagtggagcaagctgcagccaacggaaaagcaggtgggcggggcggggcgccgagcagggctggcggggtccacggactaccccccagtagccccgacccccaaaggattccacgtgcagggtttttccttcttcctggagaaatgcccacccataaccaactttttttttttttttttttgtgagatggagtcttgctctgttgcccaggctggagtgcagtggcgtgatctcagctcactgcaacctccgcctcccggcttcaagcaattctcctgtctcagcctctcaggtagctgggattacaggcgcgtgctaccatgccctgctaatttttgtatttttagtagaaatggggtttcgccatgttggccaggctggtctcgaactcttgacctcaaatgatccgcccacctcagcctcccaaagtattgatattaaaggcgttagccaccgtggccagcccatgaccagcttttgggggcgcggctagcaagaggcaagacagattgaaaactggatgaccaacaaagatatgtctaagaagtcaggatggggcctggattttttgcgaaacccgattttcatatcctgttagtttaaaaattgcaaaaacatcacggaaatgtaacaaaagccatcactgctttgcatccctgtaagtgagatttcaaagagagaaacgggtgcgggagggagtccaggcatccgcatacgctggaggttgggttcctgcccatgactctggcgtccgggagtggtttgtcagggctggaggtggggaagagtccggggcatgggaagtgaggtgggagctcggaggtccctgagcaacaggctgaggagccggttctgtctgcctggagggaatagggagctatagaaggttcaggagaggggagggtgctgtgaaagcagagtgataaagactggatcctggcgttggaggcttcccctgcttcaagccttctggtgctgccccccagcggtacctggatgaggccgagagagagaagcagcagtacatgaaggagctgcgggcgtaccagcagtctgaagcctataagatgtgcacggagaagatccaggagaagaagatcaagaaaggtgggaggggtcgggcgcggtggctcacgcctgtcatcccagcactttgggaggccgaggcgggtgtatcacctgaggtcagaccagcctggccaacatagtgaaaccctccccctctactaaaaatacaaaaattacctgggcgtggtggcgggtgcctgtaatcccagctactcgggaggctgaggcaggagaattgcttgaacccgggaggtggaggttgcagtgagccaagattgcgccattgcactctagccagggcgacagggcgagactccgtctcaaaaaaaaaaaaaaaagaaaaagaaaaatgaaaggtgggaggggccggtgcgagcagttggggtcctgctctgtggggtgcgacctcagcccaggcagggcctccctccgtggggcacagtcccgtgggttgggcgggggaaagatacatagccagacaggagtgaagggggctcactcggtacagcgatgggggatgcccagacgcggggcactcaagtggggagctggagccggctgagcagcgctgacctagggtgcagggcgtggtccctggaggcctgggaggctgaccctgcccttcccctcccccgccagaagactcgagctctgggctcatgaacactctcctgaatggacacaaggtaagcgaccttcttcctctcaaagcacctgggggagaaaggtctggaggcttctagaaccctgagtcagagccagtgctcgcccagatgtgtgcaagcaggggcggtgccactgcaccgtgggatcgctgttgattgtactcccaccggggtgtcccaggagaccctcctaggcttggggcacacccagagagcgtggctgcctcctaccaccagtaaattgccaccttgtcccttcgtcttagggtggggactgcgatggcttctccaccttcgatgttcccatcttcactgaagagttcttggaccaaaacaaaggtgagcggtaactgcgctcctgatgcgaactccgtgaaactgggtggtagaggggggcgtgggccaggagggccccaagactgcaggaggcggatcgggaggttccctatgagcgtccaggcgcacgctgtcgctccagaggctgatgtggagcaggaggcagagggcgcagtgagggaaacctgggcaggggcacgtcccgggcaaaagcccggaggtaggggaaaggggaggcgcaggctttgaccccgctccccccggcgcagcgcgtgaggcggagcttcggcgcttgcggaagatgaatgtggccttcgaggagcagaacgcggtactgcagaggcacacgcagagcatgagcagcgcgcgcgagcgtctggagcaggagctggcgctggaggagcggaggacgctggcgctgcagcagcagctccaggccgtgcgccaggcgctcaccgccagcttcgcctcactgccggtgccgggtgcgggccacgcccatctcccagtcccgccccggtcacccggccccgcccgcctccccccccctcctcccttccccccttcccctgtcgcccggcgccgcccatcgccccgtcccctcttccccagtcacccggccccgcctatcgccccgccctcatcacccccagctccgcctcctccccgacccccgcacccctaccccatagctccgtctggttcttcccagaccacacccgagctccgctccgcgccccgttactcggccggctccctgacctcgcccccaccgaccgcgcctcccggccacgacctctcccgacgcgtccccgcttactcgcttcctcccgcagcccctttgtgcccccacccttcgcgcccccaccgctccctaccggccccaccgtcgctggcccctctccctcgccagcccccgaccagcctgagcactgacccagcctccccgctcgccacgccacgttcccattcaccccacctccccacgcccccgtcacccatccctccccacgccccgctgacgcctgagccccctccaccaccccagtcacgtcccacgcgaccccagccccccggtgtcatccccacctccccgacctcgttccctccgtccgtgactgtcctcagcggaccctggacgcccgccgctctagccccgcgtccccaccctgtccccgtcctcgccatcctcctgccccggcttaccttagcccaccctgcgccgctcctgcgctggcggtgtccggacctctgagcgcccgcgcgacccgccctgagtcaccccctaccgctgcccctggagcccccgccccgcgactccccggcaccctcgcctgaccttcccgcctgtcccccaggcacgggcgaaacgcccacgctgggcactctggacttctacatggcccggcttcacggagccatcgagcgcgaccccgcccagcacgagaagctcatcgtccgcatcaaggaaatcctggcccaggtcgccaggtgtgtgccgggcgaggcggggcggggccggggttcaaggcccggatgtgcccgccctggggttccccaggtccgcgagggctgctgggtgggactccgcagcttactagagatcacctcccggaggggcctacctgcggtcgcccctgatgcaccagtgctaggatggccatggagaaccccgggccggcgggacccactcgggggcaccagaacttccctaaagcttctcagggtggatcccagcgcccgggttagataggttcaacgcctgtcccccaaccctggcatctgttggagcagctgatgggccatggtctctggggttccccagggccggggtgggggccagagatgatgagggcctcatcccgggccctcctctctcgtttcagcgagcacctgtgaggagtgggcgggcccacgatgcagaggagaagctgtgggcgcggccctgccacaccccaccccgtggacgagaggctgggggtccaccctttggggcctggtcccatcctgcaccttgggggctccagcccccctaaaattaaatttctgcagcatccctttagctttcaatctccccagccccctgaacccggaaaaagcactcgctgcgcgatacacccagaagaacctcacagccgagggtgcccctcctcggaggacagccacgcgctacactggctctccgggccacccccaggacacagggcagacgaaacccacccccagcacacggcaggaccccccaaattactcactacggggggctgtgccataggccacacaggaagctgccttgtggggacttacctggggtgtcccccgcatgcctgtaccccagatgggtgggggccggctttgcccatcctgctctcctccagccgagggaccctggtgggggtggctccttctcactgctggatccggactttttaaataaaaacaagtaaaatttgtgttttaagcttgtgagtgtgtaagcttgtttggggtggtgtggagggttcagaaggtgcagcctgggccccccatgacattccctgctgggggcgccaggcctgctctctttacctctagcagagcctcagagtttctcagatagggagacgggagcccaaacttgccggggttcacagagcaagtcaatggctgggcaggtgtctccatccctcccctacctaaagttgggcattgtgggctcagcacacgtgggggacttgaagcacaggggacagtcacggctgctcagttcatccttcaacttgtgtccgcacgggggttcaagtccactttgtagcacagtgactttgggtgggccacggttttgtttattgtgtaaaatacgcaacatgaaccttaccatcatagccattttgtttatttattggagacgcggtctcactctgccacccaggctggagcgcagtggcccgatcatagctcactgcagccttgaactcctgggctcaagcaatcctcctgcttcagcctcccaaaccctgggattacaggcgtgagccaccgcgcctggccattttagccattttaaaatgcacaattcagtggcatttagtacatcacaattttgtgcagtcatcacctttatctaatctcaacgcattctcatcacccccagaggaagtcctgtcctcatcaacagtcactctcatcccctccccagctcctggcacccacaaatccccttcctgcctctgtggattgacgtgtcctggatatgggaccacacactgtgtggccttttttttttttttttttttgagacagagtcttgctccgtcacccaggctggagtgcagtggcacgatctcggctcaatgcaacctccgcctccctggctcgagtgattctcctgcctcaacctcctgagtagctaggactacaggcgtgtaccaccacactcagctaattttttgtatttttagtagagatggggtttcaccgtgttagccaggctggtttcgaactcctgacctaggtgatctgcccgcctccgcctcccaaagtgctgggattacaggtatgagccaccgcacccggactatatgtccttttgtatctggcttctctcactgagtgtgattgtcctccagatttatccacgctgtggcctgtgtcagagcctcattccttttggtggctgagtcattgtccagtgtgtggatgaatccgctgtattgaccccatctatctgtcaaaggacacttggctatttctaccacttgtgagtcatgctgctgtgaacattcatgtacatgtttttgttagaatgcacattttccattcttttggagatacagattgctgggagttctgcatttggcttgttttgtgtacgtgtgtgtgtgtgtgtgtgttgcttattgagaaacctttccagggacttctgcgtttaatggcatacataagacatcctaaaaaattcggagaataatctgaaccccagaacctctgaacgtgaccttatttggaaatagggtcactgcagatataattagttaagattaagtcattactggagtagcataggccctaagtccaagatgactgctctccttataagaagataaaatctggacacagacacagagaagagacagccaagtgacaacagaggccgagactggagtgatgtatctagaagccaagaaacgttaaggaaggccacccacagccagaagctgtggatgccaggaaggattcttcccaggggctccgagggccctgccaacaccttcattgtgggattctggcctctggagctgtgagaggataagtttctgctgtgttatgtctccctgtttgtgatgctttgtttttgtttattttttattttttaggggttgggggggggtctcactatgttgcccaggatgatcttgaactcctggctcaagtgtcctgctgcctgggcctcccaaagtgctgggattacaggcgtgagccattgtgcccgcccacctccatcccacactgcttcttcttcttctttttcttttttttttcagacagagtttcactcatgtcacccaggccggagtgcaatggcacgatctcggctcactgcaacctccaccatccaggttcaagcgattctcctgccccagcctcctgagtagctgggattacaggcgcccaccaccatgtctggctaattttttatattttagtagagatgtgatttcaccatgtcagccaggatggtctcgaactcctgacctcaggtgatccacctgccccagcctcccaaagggctgggattacaggcgtgagccaccgtgcccgacagctttttttttttttttgagacagggtcccactatgttacctaggctggagtgcagtgtcgcaatcatagctcactgcagcctcgacctcctgggctcaggtgatcctcccacctggttctcgtgagtagctgggaccacaggtgcctgccatcactcctgcctaattatttatttaatttatttatttatttatttttctgtgagacagagtctcgctctattgcctaggctggagtgcaatggctggatctcaggtcactgcaacctccacctcccgggttgaagcgattctcccacgtagctgggattacaggcactcaccatcaagcctggctaatttttgtattttgagtagagatggggcttcaccatgttgcccaggctgatctcaaactcctgacctcaagtgatcaacccacctcagcctcccaaagtgctggaattacaggcatgagccaccatacccagtcaatttattggtatttgtgagatggggtctcactatgttgcccagactggtcttgaactaccgggttcaagcgatccatctgggccagcctctcaaaacgctaggattacaggcataagccactgcacccagctgtttctttgtggttgagacaggatcttgctctgtcacccaggctgaagtgcagagatgccatcacagctcactgcagcctatacctcctgggttcaagcaatcttcccatctcagcttcccaagtagctgggactacaggtgtgtgccaccacaccccgctaattttgtattttttgtagagatggggtctcaccttattcctcaggctggtctcaaactcctgggctcaagtgatcctcccgcctcggcctcccaaagtgctgggatcacagtcaagagccacctcaccacacccagtttttggtgctttgttacagccatcatgggcgagtcagacaacctgatactgccaacccccctcactccccaccccagtttcaccctgtcctggcacaggtaccaccaccttaaatttagagtttctcatttctaggcaggcctggaaaatagcattttgcagcagttttttattaaaaaaaatttcagtatacaattcagtaggttttggtacattcaaaaagctgtgtgggctgggcacagtggctcacgcctgtaattccagcagtttgggagaccgaggcaggcagatcacttgagaccaagagttccagaccagcctggccaacatagtgaaacccggtctctactaaaaatacaaaaatagccagggatggtggtgcatgcctgtaattccagctacttgggagactgaggcaggtgaatccctctctctctctctttttttttttttgaggcggagtcacgctcttgtctgtcccaggctggagtgcagtggcgcgatcttggctcactgcaacctccgcctcccgggttcaagtgattctcctgtctcagccttccaagtagctgggattacaggcacatgacaccatactcagctaatttaatttttgtatttttagtagagatggggtttcatcatgttggccaggatggtcttgatctcttgaccttgtgatctgccttccttggcctccccaagtgctgggattacaggggtgagccaccagacctggccttttttttttttttttttttttgagacagtctcactctgttgtccaggctggagtgcagtggcatgatcttggctcactgcaacctccgcctcccaggttggagcaattctgcctcagcctcccgagtaactgggactacaggtgtgcgccaccacacctggctaatttttgtgtttttagtagagatggggtttcactgcgttgtccaggctggtctcgaactcctgacctcaagcaatccgcctgcctcagcctcccaaagtgctggattacaggcatgagccaccgtgcccggccttacataaaatttcttacctcgtccaaaccctcctgccactttcttttctctccccatgttcagtttgtgaggctcctcctgggcggaggctgtgactggctctgctgtagggcccgccactgcaggcaggatggctgtttattgagccgacattcctgggtaggaatctgatggatacgtaggtgtttctgacattgcactccagcggatttttaccaacgcctcctggtgcctggggtctcctccttcatctgtgacctggacatccgttcattcctcaccaaagatcactgggcacctgctgtatgccaggcactgtgccctggacactgggcatggggacagagcaggggaacagcccccaccctcctggagctgacattcctccagtcctggggacaaacaggacaaaagatgaaatgaaatatcagcagggggctggggctcaagcctgtaatcccaacattttgggaggctgaggcgggaggattccttgaggtcaggagttcgagaccatcctggccaacatggtgaaacccccgtctctactaaaaatacaaaaaaaattagctgggcatggtggcaggtgcctgtaatcccaactaatcaggaggctgaggcagaagaatcgcttgaacccgggaggcagaggttgcagtgagccgagatcgtgccactgcactccagccttggcaagagagagagactccgtctcaaaaaataaaataaaataaaatatctgatatgtcagatggtagctttaaatgctgaagagaagctgggcacagtggctcacatctgtaatcctagcactttgggaggccaaggctgaaggatggcctgaacctcctggtcttgagtttgagaccagcctgggcaacacagtgagatcccaactgtacaaaaaattaatcatgtttctaaattaaattttaaaaaactgaatgcggccgggtgcggtggttcacgcctgtaatcccagcactttgggaggccaaggcaggtggatcacctgaggtcaggggttcgagacaagcctgaccaacatggtgaaaccctgtctctactaaaaaatacaaaaattagccaggcatggtggtgtgcgcctataatcccagctactaggggggctgaggcaggagaatcgcttgaacccaggaggtggaggttgcagtgagccgagatcacgccattgcactccagcctgggcgacagagctagactccgtctccaaaatcaaacaaacaaaccaaaggctgggcgtggtggctcatgcctgtaatcccagcttttttggaggctaaggtgggtggattcctgaggtcaggagttcaagaccatcctggccaacatggtgaaacctcatctctattaaaaatacaaaaaaattagccgggcatggtggtatatgcctgtaatcccagctactggggaggccgaggcatgagaattgcttgaacctggtgggcagaggttgcagtgagctgagatcgtgccactgaactccaaactgggtgacagagcgagactccagctcaaaataaataaataaataaaaataataaaataaaataaaacaatgacctcgcctagcagagggtgagtgctccagcaccctcagctgtccctgtccttttttttttttttttttttttttttgcgacggagtctcgctttgttgcccaggctggagtgtaatggcgccatctcagctcactgccacctccgcctcccgggttcaagagatctcagcctcccgagtagctgggattacaggcgcccgccaccacgtccggctgatttttgtatttttggtagagacggggtttcaccatgttggccaggctagtcttgaactcctgacctcaggtcatctgcccgcttcggcctcccaaagtgctggaattacagacgtgagccaccgctccaggcctgtccctgtccttatttgtggtccctgttcttccagggtcctgagctcaggcccccccggactgcgggtatccccggggagggcacagctggccctggcagggcccggacacctggggcccgacccacccctgcgcaccccgcggtgtcgccttcccgggaggctcgggttcccagatccccttacccgggcgtctcggctgtcgcgccctgggccgggggaggggaggctgcaggaagcggcggatccggcggcggcggcgagggcccgggtgggtggccgaacttctcccgccatggagggagcagcggcccgggaggcccgggggaccgagaccccgcgcgcgtctgcgcccccgcccgcgccctcggagcccccggccgcgccccgcgcccgcccgcgcctcgtcttccgcacgcagctggcgcacgggagccccacgggcaagatcgagggcttcaccaacgtccgcgagctgtacgccaagatcgccgaagccttcgggatcgcgcccaccgaggtaaggagcccggacaccggcgcccaagaccacccgcctgatggggtgaggggtagggagcttggaccctggacgggagaccccagatccccggatcccagacgtcggggtggccgcctaatcgccggatctcagagacccagccctcagatcccggggtgccacactcccaggggccccctttgcacgctctgcgcaaaagatgggcaggtcttaggactagcggacccctagatattccagaaaatcctctgcgcagacctagcttggagcggaccccagccctcggggaagcgcctctgtgcttcctgggcgtagctggggtctggggttccagatggcccccttagggatgggaagtttgaggccgccgtggggttggggggttcctgggcgtttttccaatccgggttcgtttggtttgcagcccccagggggcgccagcagattaaacctggaggtctgggggctggaggtcccggggtatggagaggggtctccacctgctggaagtctccttctccctcctctctctgttctgggggtcccacgccctgccctttcccatgggctgggatcctggtcgctgggggcaggggcctgcgcagacagggtggctgcgtggggggatgcatgccctggctaactctaggctccttctcccccgggaagattttattctgcaccctcaacagccacaaagtggacatgcagaagctcctggggggtcagataggcctggaggacttcatctttgcccacgtgcgaggcgagaccaaggaggtggaggtcactaagacagaggatgctctggggctgaccatcacggacaacggggctggctacgccttcatcaaggtgcccgggagggggtgggcgggtggcttcctggggtccagcaactgccccccccactctgggtcgacgtgggttctgcggattggaggcgggtggctggggttgccctgccagcgacgctggatccctgcagagaatcaaggaaggcagtatcatcaaccggatcgaggcagtgtgcgtgggtgacagcatcgaagccatcaacgaccactccattgtgggctgccgccactacgaggtggccaagatgctccgggagctgcccaagtcccagcccttcaccctgcgcctggtgcagcccaagagggccttcggtgaggcgggtgggctggcgggagctcttcccgaagtgcgttctacggatgcctggggtggaggagggtcggggatgggacgggctggaaggttctaggtgcacccgctgcgtgccaaggagctcctggcagggtatcagaaactcgtaggtagtttctattaatagattgttatggagtcagcctgtgggggaggggtgggggagagactgggtaaagtggagttggaggaggacgcgtccagaaccactttggagccaggctgggagacttgtttttgtttgtttgtttgtttgtttgtttttgagacggagtctcactctgttgcctgggctggagtgcaatggcgcgatctcagctcactgcaatctccacctcccgggttcaagcgattctcctgcctcagcctcccgagtagctgggactacaggcacccaccattgcgcctggctaatttttgtatttttagtagagacggggtttcaccatcttgaccagtctggtctcgaacttctgacctcaagtgctccacccgcctcagtctcccaaaatgctaggattataggcgtgagccaccgcgcgcagcctgggaacttttaaagcagtgctttgaggtcatggtggattgtagagaatgagaatatgagaaaaaagttttctttcttttcttttttttttcctttcttttttcttttcttttctttttttttttttgagacggagtctagctctgtcgcccagactgcagtgcagtggctagatttcagctcactgcaagctccgcctcccgggttcacaccattctcctgcctcagcctcccgagtagctgggactacaggcgcccgccaccacacccggctaattttttgtattttagtagagatgaggttttaccgtgttagccaggacggtctcgatctcctgacctcgtgatccgcccacctcggcctcccaaagtgctgcgattacaggtgtgagccaccgcgcctggccgtgccagctaatttttaatttttttctttttttgagacggagttttgctcttgttgcccaggctggagtgcaatggtgtgatctcggctcaccacaacctctgcctcccaggttcaagtgattctcctgcctcagcctcccaactagctgggattacaggcatgtgccaccatgcctggctaattttgtatttttagtagagatggggtttctccatgttggcaggctggtctcgaactcccgacctcaggtgatctgcccgcctcggcctccgaaagtgctggaattacaggcatgagccactgcaccctgcccattttttttcataactagactttctcaatgaagaaaacagtgtattgatttacacactagcacattctcctcatgtagccatgggttggccctttggatagcgttgttctatagaacagagacagagattctagaagtgccccagcacacatggagagacgtcccagggagagtgagctgtatggggttctagaatctgccctgccgtggctgtgaactccaaaagccatgcctaaaaatagagtttaggccgggcgtggtggctcacacctgtaatcccagcactttgagaggccaaggcaggtggatcacctgaggtcaggtgatccatcgtatcaaaaaaaaaaaaaaaaaaacctggctgggtgcagtggctcaagcctgtaatcccagtactttggaaggccaaggcgggtgcatcacgaggtcaggagttcgagaccagcctggccaatatggtgaaaccctgtctctactaaaaatacaaaaaattagctgggcatggtggcaggtgcctgtaatcccagctactcgagaggctgaggcaggagaatcgcttgaacctgggaggtggaggctgcagtaagccgagatcgtgccattgcactctagcctgggtgacagagcaagacaacatctc

SEQ ID NO: 37147 - DNA, 5419 bp, Homo sapiens
gtgagagccaggcgtccctctgcctgcccactcagtggcaacacccgggagctgttttgtcctttgtggagcctcagcagttccctctttcagaactcactgccaagagccctgaacaggtaatgggatagggatacagattatcctgtgaagtgatatcgatctggaaacaggtctggggagctggaggggctctagtgagggttctgggagggtctggggttagtgtgggggggagcacaggatatacaggtgctaggaaagagcatggagtgacctgcagtgtgggagtcaggctgggtgtgcaggtggaggaacctggggtgttaggatctcagagtgtcaggtgctggtggaggtcctgggtagtatagaggggtaagggtgttaggatagaaactgggaaaaggtctgtgtcagaccaggtacaggagaagcttggtgagatatgggttcaggatcctggggtctggcatatctggctgaatatctgaagccagggccagcccaggtgggcccaggggaaacaaggccctaacttgcacatgtctacctcccaggagccaccatgcagtgcttcagcttcattaagaccatgatgatcctcttcaatttgctcatctttgtaagtacggacattgtggactctttggggctccctataggagcaggtcacaagctgagtagagactaagctggggaatgggagactgctatgcccaggcttcgtcctgcatgtgtccccttatgagtgggatgcaaaggtctccccaaatgctgctgattcctagtcccagcagcagccaggctgccatacaggtgcgtgtgtgaaaaaggggatggagaagctaggggcaccccctctctcctacaaagctttagcctaggcttcaggcagggcagagtaagctaccaggaatgattctccaccctttataggcactgggggcccagaaaatagaagggctccacccaagtttacctaccacagaaggaaattcagtacagaggaaattcttctgtatgacggggagctgaaaggagggagggcctacctctcatcagagcaacagtccttattcattcgacaaacattcattgtctaggataccatgatgggtgctggggtggcaggtaagcaaagcctttctctgccctgaaggatctcagctccgataagccagataggcagataataacaacacagtgtgtttgggcttaggacggaggttatgggagcctgaactcagcctggttggagaatacttcctggaggaaatagctgaagctgggaaattgcacttggtgggggagttataaagcatgcataaagggccagaagtagtgaaacttgatatcgttcagaaaaccagaaacagattgcatagggcatgtttgagaagctgagccatgaggcgtaaatcctggagatggtggtggagatagggagaaacggacaaagtggacaaaggacaaagctctaggatgatggctgaggggtagaagaaggggcaagggagacagaggtcttggagatgacgcccatatctctggcatgagcaacccagatggcagggggtggggcctggtttgtgggaaggggtgtcccactagcagatgtgtacccagtggaggtgcagctcagattggagctggccatgggtatttgaaaatcatgtgcgcacaggtagccactgaagccatgggagtggatgagaacacttggaaagtgaactctgggaaacccaatttattagggataagcaaaaaaaaaaaaagccactgtgaaggagatggagaaggagcagtgggagggggagaggaaaacaaggagagtagtacactaaccacattagagtaggttagtgtaagtgaaagtgaggaagtgggccaggtgcagtagctcacaactgtaatcccagcactctgggaagctgaggcgggcagattagttgagctcaggagttcgagaccagcctggccaatatggtgaaaccccgtctctactaaaaatacaaaaattagctggatgtggtggcgcatgcctgtaatcccagctacttgggaggctgaggaaggacaatcacttgaacccaggaggcggaggttgcagtgagccaagatcacaccactgcactccagcctgggcgacagagtttatgtatgtattgattagtttagaagcgtgggtagactctctagttctgatgtggtctgtgccttgggcttccttcggctgcagggaacttgtgtttttgttgttgttgttgttgttgtttgtttctttgagacaggatcttgctttgtcaccaaagctggagtgcagtggcatgatcatggcttactgcagcgtcaacctcctgggctcaagggattcccctacctcactcagcctcctgagtatctaggactacaggagtgtgccaccatgctcagctaattaaaaaaaattttttttgtagaggcggtctcactatattgcccaggctggtctcgaactcctggacttaagtgattctcccacctctgcctcccaaagtgcggggattacaggcatgagccactgtgccagtcctgaactagtctttatccctgtatctggaggaagcaataggattccagggatttggacaggagaggctctgccctgagagggttaaaggcaaatccggtttgatttctggcctctgttacccagaccttgccaggctgggcaaagcaggatagggcagacctccagctccatgaaatttgaccctgcaggctagaagtccagctttctgtccttgggcaaacatgcctggaatccagccacaatctgccacctcacttcccgttctagcctcagtttttatagctggcaagtgaggactagtcaccaaggtggtgtcaggctgattcatccactgaagccctgggccgggaggctttcctctaagatctgtgggaactgcgcagggccctcctcaatctaggcctcagaattccccctgaggtttggagttgagctagacagcctttaagagaagctctggctgtattcccactggtacctcactttcctcttgtgaggcaaggaggtcttgtctacatgaggggcgggcctgaagttggattctggaggggagccaaatggggcctcaggtgggtgaaccttctcaacctcctccctctccaaggttgccagcaggtggaacctcagcctcgcctccattactatggtgactattgagcctgttctgctaccacccccgtctccacctatcagaggacagaggtgttctaggcacccatagcccagaaaggaaataggaggctgggccctcacctgcctgttttcaatcctagctatgtggcaggaccctggcagcagtgagggaaagtcttgcccctctgcccaccctgaggatatttctagaacccctgatctcctttatatctgcccaggtgtgcagcctggtcctagctatgcatatcccagctcccatttttctggctctagaggatgtttccctccttacaggatgaggttttagactccctagccaataaagagggaagtttctcggctcccatccttcttactcagctgtgtggtagtaagctacttgccagcactgtttaaggcctgcctgacctctctctccccagctgtgtggtgcagccctgttggcagtgggcatctgggtgtcaatcgatggggcatcctttctgaagatcttcgggccactgtcgtccagtgccatgcagtttgtcaacgtgggctacttcctcatcgcagccggcgttgtggtctttgctcttggtttcctgggctgctatggtgctaagactgagagcaagtgtgccctcgtgacggtgtgtgaaacccagctccacaggctgatgaccaagagtcccctcgcccttgacaccaggccctgggattcccaaaccctgctttggacccccctaggctcaggcttctgtctcacttttccgggggggggattagggcaaggagggcatgagggactgtctctccctaaaacccagacccctgttccccactcagttcttcttcatcctcctcctcatcttcattgctgaggttgcagctgctgtggtcgccttggtgtacaccacaatggtgagacactgggatggaggaagggaagaagattgggcaaaaccctgggagtgggctgtggcctgtgaatggccaccttctgtaccagcccctaaacactggcctgcctcacccaggctgagcacttcctgacgttgctggtagtgcctgccatcaagaaagattatggttcccaggaagacttcactcaagtgtggaacaccaccatgaaaggggtaaggttggctgggggaggttttagggtggagagaaagaagcaaggccccacctccaccctcatcttgtctccagctcaagtgctgtggcttcaccaactatacggattttgaggactcaccctacttcaaagagaacagtgcctttcccccattctgttgcaatgacaacgtcaccaacacagccaatgaaacctgcaccaagcaaaaggctcacgaccaaaaagtagaggtgtgggctggcatgagtgggtggggactgttttcatggcctcagagtggcaaacggggatgggagtagggcagctgccaactataaatgctcttttctcttcctgaagggttgcttcaatcagcttttgtatgacatccgaactaatgcagtcaccgtgggtggtgtggcagctggaattgggggcctcgaggtaagcagatgaggaggctgggactgggacatgggcatgagaccagggctgctcaacccatctgaggcctctctggaggaaacagacttctaactgggcctcaggtagggtgtctgtgggacaggcttcaggatccctatcatgttccctcatctctccctgttcctccctctccagctggctgccatgattgtgtccatgtatctgtactgcaatctacaataagtccacttctgcctctgccactactgctgccacatgggaactgtgaagaggcaccctggcaagcagcagtgattgggggaggggacaggatctaacaatgtcacttgggccagaatggacctgccctttctgctccagacttggggctagatagggaccactccttttaggcgatgcctgactttccttccattggtgggtggatgggtggggggcattccagagcctctaaggtagccagttctgttgcccattcccccagtctattaaacccttgatatgccccctaggcctagtggtgatcccagtgctctactgggggatgagagaaaggcattttatagcctgggcataagtgaaatcagcagagcctctgggtggatgtgtagaaggcacttcaaaatgcataaacctgttacaatgtt

SEQ ID NO: 37148 - DNA, 4282 bp, Homo sapiens
aggttctcttacatcgaccgcctaagagtcgcgctgtaagaagcaacaacctctcctcttcgtctccgccatcagctcggcagtcgcgaagcagcaaccatggtgagaatcggcttcggctctttgtggccgttgggtggagtcagcgcccccaggctctacttggaaaacctttaagctcttttctttcgtaagctctctgggcgagggtggtggtatgttttgtgaggtttagcttagccccaaatcctcaagccccgccgccgccgcagtgcgggtgcaggaaccgggccagtactgcgcccagggcgcagcagagcgctggggaggaacaaaggcggcgcctaggcgcctgtgttatccgagagactttcgggggccgcgggcagcccgtctgccgcgaccgaggggtctggggcgtcccggctgggccccgtgtctgtgcgcacggtttcgctgatgctgaggggccactttctgtctcgcgttgttctctggggaccgggagaggaggaggcacccaaaaagagcgggggcgttgggcgagctgggggacgtgggagggggaacgggaacaaagcgcagcctagggttagcgtgggaagaccctccgcggtctttggcgttttggaaagatacccacacattcccgggaaaacatggtgagtttctgccggagcccccggcagcgggtgtcagggcggcgcaggggcggggttgtttgtttctggcttctatggcgttggagccactgggcggggttcgccctcactgaacctcttctgtcaggagctgactgaaaaaaaaacaaaaaaacctttcatcattgcggaactgtaggctccaaaagggttttcttcactattataagttagatgacttttttttttcttgagcaaaatcataattcacttcacaagctctttaatgtctggtctggggacgccctgccctgaccgactgaagtgtgtgtgtgtgtgtgtgtgtgtgtgtgtgtgtgtctgtgggacgccctgccctgaccgactgaagtgtgtgtgtgtgtgtgtgtgtgtctgtctgtctgtctggactgcacgttcagcgagggagaaagcccactttgtgagccccagggtaccctgatggtcaggacccagggaaacgcccttccccgccgcccccccgccccgcccccaccacatcagcgaatagacaatgaaagtggtagccctaaagaccacagagaagaaaacctctattggatgcaaagaatatgaatattatgtgatgggtagagaatctcaggatgaaaatactattttgttgttttaaataaatatttcattatccttccactgggcttttattctttggtaccttttcatgtgatgcttgtttctaacttaggaacttttgtgtgtgtgtgtgttaagatacggataatttttcagcttttacagtggagaagatctggaaaaacctttttttttaaaaaaaaaagtaatgaaattgctacagacaaagaagaattatactccgcatcccgttgtcttttgttccagtgcatcttaattaattcatttcaattcaggcacatggtcccgggcggggtcagaggaggaaaactggcaaaacagcacaatgagatcatgtaggcagctgctggaaatagagcttgctctgttaaataatgtagcagacagtacaggctagcaccaggcacagcaaatacagcaatgcagcaatgcagaaggcagaccttgtctaaactcctagtattgatggattctgcagacagactgcagaagggtgtggcttcttgcctcagctgcagtacagatgtccggattataatatcaagtcctattcagaggaaactttcatctttatttaaaagggaagaaagcagtaaaattaatcccaattaagtcataattggatttacttcattttacaaaatttgtgctttgaatactgaatactttttaaatatgaaaaatcttctattcaagcatggtagtaggcacaatgggctggtaccacgtgctgaacagggccaaggcgacatcattattcagaccacacccatatgcagcatttgtagcaggtgattttccttaatctttgtatcgtgctggggatatgacctcaaataatttagaaaaatatctgtatattattagaaatatttttgaaatttcctataagtttgaaatgctaatacaccttaattttacgattttttcacttttcctccccacagcgtgagtgcatctccatccacgttggccaggctggtgtccagattggcaatgcctgctgggagctctactgcctggaacacggcatccagcccgatggccagatgccaagtgacaagaccattgggggaggagatgattccttcaacaccttcttcagtgagacgggggctggcaagcatgtgccccgggcagtgtttgtagacttggaacccacagtcattggtgagttgacctcagtaacccaagtgagatcccagggtgctgggacaggaggtctgtcctggggggctccgctggtcactcacccactctccctccccgctcctcgtccctcctcctcctcccccctgctcctcccccatcatgttctccagatgaagttcgcactggcacctaccgccagctcttccaccctgagcaacttatcacaggcaaagaagatgctgccaataactatgcccgagggcactacaccattggcaaggagatcattgacctcgtgttggaccgaattcgcaagctggtatgtttcttttcaagaataaagtaaattaatgagcctaaagaacacatttgaaataatgctttttttttcaaacacagaattgaactgttattttaataaagagtggaatgagtcattcttttggggtttttaaaattcagttaaaatgaactatttgatgtcattttgtaaatgttaatgagaattttttaaaaagcatttgtcaaaataagatctaagtcctggaagatgtatgaaaagtgaaaatatatttactatgattgtactacaaagaataaaaacttaacctttcctctgttcctctcttttgttataggccgaccagtgcacgggtctccagggcttcttggttttccacagctttggtgggggaactggttctgggttcacctcgctgctcatggaacgtctctcagttgattatggcaagaagtccaagctggagttctctatttacccggcgccccaggtttccacagctgtagttgagccctacaactccatcctcaccacccacaccaccctggagcactctgattgtgccttcatggtagacaatgaggccatctatgacatctgtcgtagaaacctcgatattgagcgtccaacctatactaacctgaataggttaataggtcaaattgtgtcctccatcactgcttccctgagatttgatggagccctgaatgttgacctgacagaattccagaccaacctggtgccctatccccgcatccacttccctctggccacatatgcccctgtcatctctgctgagaaagcctaccatgaacagctttctgtagcagagatcaccaatgcttgctttgagccagccaaccagatggtgaaatgtgaccctcgccatggtaaatacatggcttgctgcctgttgtaccgtggtgacgtggttcccaaagatgtcaatgctgccattgccaccatcaagaccaagcgtaccatccagtttgtggattggtgccccactggcttcaaggttggcatcaactaccagcctcccactgtggtgcctggtggagacctggccaaggtacagagagctgtgtgcatgctgagcaacaccacagccattgctgaggcctgggctcgcctggaccacaagtttgacctgatgtatgccaaacgtgcctttgttcactggtacgttggggaggggatggaggaaggtgagttttcagaggcccgtgaggacatggctgcccttgagaaggattatgaggaggttggtgtggattctgttgaaggagagggtgaggaagaaggagaggaatactaaagttaaaacgtcacaaaggtgctgcttttacagggaagcttattctgttttaaacattgaaaagttgtggtctgatcagttaatttgtatgtagcagtgtatgctctcatatacaattactgacctatgctctaaaacatgaatgctttgttacagacccaagctgtccatttctgtgatgggttttgaataaagtattccctgtcttaaatg

SEQ ID NO: 37149 - DNA, 25691 bp, Homo sapiens
attcggagctgcgggagccgggctggcaggagcaggatggcggcggcggcggctgcaggcgaggcgcgccgggtgctggtgtacggcggcaggggcgctctgggttctcgatgcgtgcaggcttttcgggcccgcaactgggtaatgctgcgggctggggctgctgggtctccgcgggggtggccgggggctttcgtgtggaacccggcggggggcagtctagaggaaggtgggggcccctgtgcaccccctgactcgtgttgcttgcacgtgcgcgcacaggtctacgcgtctattcctgtttccgagtgcgtgcgcacgccagtcccagggcgctgggcctttgctgtgcaaggaggtgctccgtgggcctccgccagacccaaaaagtccggcgtgactcgggagagaattccaaaggggaggaacgggagcaggggtgagaggacggagagagagtgtagaaggaaggctctagaatgagacagcccagtcccggttactagtcatgagaccgcgtattgattacctaacgccgtaggacctcggtttccccatttgtacaacggagattctgacagtgagagttgggacgattagatgagataattggtgtcgttgcacataaattacctgacgcctggtaaaaactgtttaaatgctgtctattaatgttactattactacccacccctgttcttttagccccattggatctgacagtttgaaggctcagcacggaaaaacgctgacggcttctttgctctgcaaagactatttcaactactttgcatagtcaggtgtcaatttccaggaggcggcaagtcggagcagagctgatacatggccaaagacccttgacctcagccgctcagcaggcctcagcaatttcccggtggagacactgccagcggcagcgttctgggagcttagttagcagcagcagcacagcagcctgggcaagagttcccctgggaccagaaaaaggctttcaggattttctttaaaaaaaaactatctaatttttatagatgaagggggcaaaagtacagtttagttacatggatatgttgtgtagtggtgaagtctgggcttttagtgtaaccatcacccaaatagtgtacatttaccaaggttttcttgttgctcagaatctggtacaggaatatgcttctgaagaattcagtcacaccactcccttcctgccacccatctgctcagtgcttggggacactgatgagggcgctttcccaggtcttcagagatgcatggtggtgacagaggcagcacttctgccaagggccaggcactgtgttcccagtaccagagttcccatagactcttaatgcccccaatatctttaaggcagtagatcctgttagcgtcatgtgttagagggtgaaggctgtgctttctcctggtggtggcactttggtttaccttggtcttggcagaatctggagagctgatttacctctggctcttggtctttcccctccgagcttcttcctgccatcttagggagggctaggatgatggagacttttcattgtttcagtatcccccatgggataacaagttaattaataatataacaaatgttgatgaatagatgctgtgtttacagcttaaggtagagataattatctctggggacttcagaccaagagaccctgagtaaggactgaacatcccctgtgccaggagctttagcatcttccatttcatttaattcttacactgaccctgttaatcatcaacaaacaacctcttttgttgggaacctctgcccggcatcggagtgagaaagccactctggcagagctgggattcaaacctgatctgtctgatttccaatcctaaagtccatccctctctgctgcaggacagggatcctttgtgagctgaatctggtctgccacctgtttttgtacagcccaagagttaagaatagttttacattttcaggtggttgaaaagaaaatcaaatgaagaattatattttgttgtatatgaaaattaatgaaattcacatttcagctctgaagatttattggaacacagctgcacttattttttccccctatttattgctgtgttctgttacaattgcagatttgagtaacaacagataccatatggccagcaaagcctaaggtaattgtgatctggccctttacagaaaatttgctggcccttgatgtctctagaagtgcagggtttgtgttttagaggtgaatgtggaggcggagtagagtgtttggaggtaggagggcctgggatggagcccaatatagggtgtgttttcattgaagcctcttacctgtctccactctgctcctttatttttctttctttttctttttcttttatttaaatggagataaggcctccttctgttgcctagcccggagtacagtggtgcgatcatagctcactgagctcaagtgatcctctcgcctcaacctcccgggtagctggggctacaggcatgtgccaccacacctgactaattttaaaatttttttgtagggactgggtcttgctatgttgcccaggctggtctcaaactcttggcctcaagagatcctcccacattggctcccaaagtgctggcattacagacgtgaaccactacacctggccaactcccctcatttctatgtgtgactctttcatggaataacaactcactgcctcttaaccaaagctgttttctccttccagtgggttgccagcgttgatgtggtggagaatgaagaggccagcgctagcatcattgttaaaatgacagactcgttcactgagcaggctgaccaggtagtttcaaaaaggcccccaaacattgtgaggggaaccctggggagaggtgaccactggctgtatgttcttcctttggctgtatgttcttccttttatttctttttttccccgagacggagtcttgctctgtcgcccaggctggagtgcagtggcatgatctccgttcactgcaacctttgcctcctgggttgaagcaattctcctgcctcagcctcctgagtagctgggattacaggtgcctgccaccacccccagctaattttttgtattttcagtagagacggggtttcaccatgttggccaggctgatcttgaactcctgaccttgtgatccgcccgccttagcctcccaaagtgctcggattacaggcatgagccaccgcgcctggcctgttcttccttttttttaaagctgttgtttctctaactaggaaagccatttgtgttcattgaggaaaatttggaaaaagtgaaaaatgatacaaagataaattatataatcattttgagttagttcactgttaacattttggcctattgtctttttctatgcatattgtatgttactccttttacaagtttaggtaattttgtattttatagtttatggtaagctttgtttttttttttttttatacttaaataattctccagattactgaaaaaacctctttgtagatgtgtgatattccattttatggaatggccacaatttatttagtttgtttattgtacatttgagttttttgcaggatttttgttttactattgtcaagaatgttgtgatgaacgtctttgtctacatatctgattattattgttttttgttttaagagagtcttgctctactgttgacactggagtgcagtggcacaatctcagctcactgccacctctgcctcccggattcaaacaattcttgtgcctcagtctcctgagtagctgggattacaggcatgcaccccaatgcccagctaacttttttgtatttttagtagagacaggtttttgccatgttggccaggctggtctcgaacttctgacctcaagttatccacccaccttggcctcccaaagtaatgggattataggaatgagccactgcacctggcccacatatctgattatttaggatacattctaaaaagtggagttacccagttcacagcaggaacactaacaaaacaggttatttttaattataaaatgatatgcatattataaaacaaaagtccaacaaaactacgtaaatatagaaataaactgtgaaactgtcccttttctccccatcatagtatcatttcccagaaggatgcactattaacagtttgatggatatcctggtataaatatcttagatgctctaggctgggtgcagtggctgacacctgtaatcccagcactttggaaggctgagatgggcggatcacgaggtcaggagatcaagaccatcctggccaacatggtgaaaccccgtctctactaaaaatacaaaaattagctgagcgtggtggtgcacgcctgtagtcccagctactcgggaggctgaggcaggagaatcacttgaacctgggaggcagaggttgcagtgagccaagattgtgccactgcactccatcctgggtgacagagtgagactctgtctcaaaacaaaaaaaaaaaaaagaaagaaaaatctttgatgctcttaagcagtgcttaactttcttgagaagcccttctggtgagctgcctggatgacttttgagtcaggttctcactgtgttgcccaggctggactggaactcctgggctcaaaggatccttctgcttcattctcccgaatagctgggacttcctgagtagccactgtgcgcagctgactctgtgtttaatggtttttagtgctgtagcccacattcccaaggataacttcacatcactatgtgaagcgccttattttcccaaccactcagtgtggcaggcaggcaggccattttacagctgtgaagacaagtttgcgcgactaagtgacaaggccaacaagctactcagtggtggagtcaggatcataggtctccagatacgaactttaataagttcaggtgccacttggtctgtacgtgggtctgcttttcatttagttgcactttccttggtaatctcaatactgatgttttatgatccttatctggtttttataacaaatttttaaaattttagaagtgatgcatgtatgatatagaaaatacaaataagcaaaaagaaaagggaaatcatttatagttctaccatatagttaatcatttatttatatttccttccagtctgtctctccaaaatatacatgtataaatctatacattttgaacataaaactgtgagcacaactctgctactcatttgctctttctaaagtgtcagtttgacatagattggaatgtaaaagccagatgacttattttagcacttcatttttgttgttcttatttttctcactgtggtctcaatgttcccatacctaagtcatacagattgaccttagtgaatttaatagtgaaagttgacatggcatcattgttagttgccaggcaccattctcagtgctttattttcattaacacgtgtagtcttcattacatccccaaacaaagcttctaattttatcctccttttaaatgggggtaactgaggcacagaaaggccctggtatttgtccaaggtcaaacagataaaaggttgcatagccactatttggacatgggcagtgggggtctgacggctgttctcttaactgctatgctaagctgccttaaagcaaaatagtttcatgtgaataaagtaataaaggccaaaatggctgggtgcagtggctcatgccagtagtcccagcacttcaggaggctgaggcaggaggatcacttgagcccaggagtttaagaccagcctgtgcaacatggcgaaaccccatctctacaaaaaaatacaaaaattagctgaatgtggtggcacacaactgtagtcccagctactcgggaggctgaggtgggagggtggcttgaggctggaaggcagaggttgcaatgagccgagatcatgccactgcactccaatctgggcaacagagcccaaccttctctaaaaaacaaacaaaaaataaagtaataaaagccaaaactaaatggaagggcggttcctgggcttggagagcagcagccctgccaggtgcgggtctctgtaattggtgtctcttcagtgtctcttctgctctgattaattataggtttctaatgtccctgtagattgaatgtggaggttgtccccacccaaggcttggcagtagagtgcatctctaagacagagattgagagatgcgtttgtgcttataaacttttctttgaaaatctcttccttcttctactactccaccaaaggaagaggagtaccttctccaccatacccccaaccttaagaatttctgaacaaacagcataacattcagttttgtcatgaaactggggaaagaggtaatcaactgaaatgttcctactgggagagacacagggtgttgatttaagtcttttttaaaaaaaactaaatgtagagatgaggtcttgttatgttgcccgggctggtcttgaactcctgggctcaagtgatccttctgcctctgcctcccaaagtgctgggactactggcatgagccactgtgcccagcctgatttaaatcttaagaagattgggccaggcgtggtagctcagtcctgttgtcccagcactctgagaggccgaggcaggcgaatcacctgaggtcaggagttcgagacaagcctggccaacatggcgaaaccccatctctactaaaaatacaaaaattagctaggtgtggtggcaggcgcctgtaatcccggctactcaggaagctgaggcaggagattcgcttgaaccggggaggtggaggttgcagtgagccgagatggcgccatcgcactccagcctgggagacaagcgaaactccatctcaaaaaaaaaaaaaaaaaaaaaagaaatcttaagaagattgatcttaatgaagcaattgggatttgtcatctcagccattccagagaaatacggaagagtcgtggtggatggccagaattgcctgtcctgacagactgttcttttcataaattataacaagagggcatacatatattttcaatgctttaaaatctcaaacaaacagaagcagagagatcattaaagtgaacccccatgtacttaatattaccaacatattgctattgactgtattttttcttggctcatgatttttcttacaatttttcgttggcatttttttcagagttgcagttaaagggatttttggattggggtggggaaaacagggttgatcttctttttggattataattctgtgatttgtgaagagagtctggaaagaaatacaccaggatgttaactatgtgcaggcagtgaagctctaggtgcttttttcttttttttttaacctttccctacttttatttattaattgttgtatttcaagggatgctcatgtctctacctttcagaatgtatacacagagactctagattgttttttaaaaatcacactgaagtgtacttgggcttcaatgtctaaaatgctcatcagagcttagtcttccgtctaattctcaaagcattaattgccaggtactgtaaactggcttaaaaagaagagaaaaagaaactgagtatccgtaaagatgctagcctgtgttggcttaccttacagtttatacatttttttgttcttgtgttgaaggtgactgctgaggttggaaagctcttgggtgaagagaaggtggatgcaattctttgcgttgctggaggatgggccgggggcaatgccaaatccaagtgtgagtcctttcctgagtcactcatttgttctgctctgctctttttccagctgacaaggattgggtttgcactaggtgacaggccagctgtttttttgtgtatatcccggaatctttacagttgctcggggagagagtgattaatgctcttaatccattttacggataaagaagaagcttcccctggaggacgtgaggggacggggggcattgagtttgagtttaaagtagaggcagaatgaaatcagcatggcctgtgccccaggccatgtgctattcaggcattggaggatgtgtaggaagtgcagagatcatttagaaagtcagaagaagtcaaacttgagattttactaaagctgattccttttttcatcttttcttttcccttcccttccctcccctcccctctactcccctaccctttttcttaagacagagtcttgctctgtcaccaggctggagtgcaatggtgtaatctcggctcactgcaacctctgcctcccaggttcaagcgattctcctgcctcagcctcccgagtagctgatattacaggtgcccaccaccaagcccagctaattttttgtatttttagtagagacggggtttcaccatgttgcccaggctggtcttgaactcctgacctcaggtgatccacccccttcagcctcccaaagtgctggggttacgggcgtgagccagtgcgcctggcccatttttcaacttttcattatgaacatttctaagcataccagaaaagttgaaagaacagttcaatgaacacccttatatgctccatctagattcagtaactgttaacatttgctgtacttgagttgagcttgttttcttgtgcctgtgtactttgtgcattgttttttgttaactgtttgaaaataagtttacacctcactatatttccgcgtgtttctccaaagaataagcccgtcctacattattatggtaccattgtacctaagaaagttaacagtgattatctaagattaatgatattgagcccatattcaaatttccccagtttattccatgtctattatagttctttttccctaaacatattccactcaaggtttatgtactgcattatgttgtttttagtctcttaatctagaaaatctagaatttttaaaaaaatcccctgtgataagactttttgtcaagtccttgggagttttcatatagcatgtctcacattctgaacttgtctgaacttttctttaaggggttgtttgacttgttcctctatccttggtattccccgtgaactggaatttgggtctagagactcagttagatttagcataaacattcttgtggtgcgaattcttcctgagtgatggtgtgtaccttatatgacatcacctgggaagctcagcatggcagcttgccctacccttagggatgccaaatttgatgcttggttgagatggcaactgccagacttccattataaaggtactttttttctgtttgcagtaagtcagtcatctgtgggatgtgtggtattgtggtattgtgtgtgaatgtcctgtttcccaagtattatacttttcacccagtggttttagtccttcgttgataatctctgcctgaagcacttattcaggggttggaaaatggtagttttctaattctgtcatcccttctacatttattagccaaagccatttaaaaagacgttgacattctgtgacccacatgtcaatgtgagagtggtgctttgtgaggtgatcaggttagcaaaacagcttgataacctttttgtatgttttgggagcaagaaatgataaatgtggatccatcaggtttttttcctagtcttttttagtggggaaatgcaatttcttgtttatcacctaccaacccctcctatatcaggaggacatccttttttgatcaccaggtaccacatgcccttcgagttgcccagttggtggtgtgacatatgttaccatttgttcttccttatgtctctggcaaggccggggagttaaaacaagtgtaaaatggttgttattttagctttcttttgaagagtctttaaagctaacattaaactttcagacataaaatatgtagctcagtaaaagctctctttatagctgtacagtaataggcccttggatttttatcacagagaaaacctgacgtagacatataggttcttattacaaatctgataccattcataaaataaaacaatctttgaattaaagccagtccagcaaatcagtaaactccaggtttattttgtaaaatttattggccaacattttgccagtgtataggtaaggaagctgaacctcaggcaatcccatggcctggatttgaacctgtgtctctgaccactgagccctgtgctgtttgtgttagaccttgctgtagatagggacctggggaccaggagggagggcctccctgagtgtggggctgcatgagttgagctcaccttttggtttctttcctgggaatgctgagcccacatgtttttttcactcagctctctttaagaactgtgacctgatgtggaagcagagcatatggacatcgaccatctccagccatctggctaccaagcatctcaaggaaggaggcctcctgaccttggctggcgcaaaggctgccctggatgggactcctggtaagcctttatttccctatctgtggagtggggttgcttaccttgcttgctggggctgctgggcactttcatgggatgaggactgttaaagcctttaccctctaagctgcttaacagatagatggattttgtcttcttttgggcctgaatcattttagggagaagagttctgatcttttgtttgcctgtccttatgtttatggtggtggtaaggaacgctatgatctggtaacccccatttagtttatttatctgtgatctacactggaatgaatggtttagtggatattaattaattaataaacatggattattattatcacattgaatccatgtgttccagggaagcagcttagcagctggaaatagcataagtttaaaatgagagaggttcatttggccagcacagtggctcacacgtgtaatcccagcacttttgggaggctgaagcaggaggattgcttgagcccaggagttcaagaccagcctgggcaacatagtgagaccctatctctacattagaaaacaaaaagagagtgagagggttgggggtggattctttatcctagatgtgtgaccctgaaccagttcttcagtctctgaccagatgtctactgtagtttccttaattgtaaaatagtgacagtgacatctaacttgaagagtactgtaaaactgtagaggtgtagctatgtagaaagtgcacatggtaggcacccataaatggcaagtcttactgttattcacaataaatggtaggtcttatagtcactcttttcatttcacatatattctcactttaatctcatcaatattatctttttcagtttacaggttaggaaactaaaacttggagagttaagtaacttgtctgggtttgtgcaggaagtaagttgcagacttacttgaaccaaaaccctaatcatctaccaactgtgtattttttccattatgtcatttcttttgcattttttatgacctgtattagtttgtttgggtagccacagactgggtggcctaaacaacagagatttattttctcataactctggaggctaaaagtctggagatcaaggtatctgcagggctggctccttctgaatcctctttttttatagatggctgccttctccttttgtctgcatgtggtcttccctctgtgtgtctgtcctcgtttcctcctcttctaaggaaaccaggcatattggactagggcccatctcaatgggctcattttaactttgttgcctctttaaagatcttcgaatacagtcccattctgaggtactgggaattaggacttcaatatacgaatgttggggggatctatttcagcccataacactccctgtgggatagggctaaaggaatttaagcaggggtagaaaggggcagcatagggaggcagaaagtgtctacctcaactacctaagttgaactcttcttttaaaaaaatgggagcttttggccgggtgcagtggctcacacctgtaatcccagaactttgggaggccaaggcgggtggatcatgaggtggagattgagaccaccctggctaacacgatgaaaccctgtccctactaaaaatacaaaaaattagccaggcgtgatggtggctgaagcaggagaatggcgtgaacccaggaggtggagcttgcagtgagccgagatcgcgccactgcactccagcctgggcaacagagcaagactccctctcaaaagaaaaaaaaaaaaggtggggggagctctttttgactctcttgtaagtggtagagaccttgggacccttctcagttgtttatttttttagagacagggtctcacccaggctggaatgtagtggtatgatctagctcactgtagcttggaactcctgggctcaagcaatcctttgcctcggcctcctgagtagctgggactgcagacacacactgccatgcctggctaatttttgtattttttgtagaagcagggtctcgctatgatgcccaggctggtctcaaattcctggcttcaggtgatgctcctgccttggcctcccggagcactgagactactggcatgagccactacgccaggccccttctcaattttaatgtaactcactgaactgtgaggctgtgactactagcaataccttccctctcattttcttcttccatttcttagagcatgtgatgttacaagtccatggctatagcaatcattaaagctgtgtaaatgttagctgtctggttggttgagatctgatttttatttaagatgacacggaacagaggcagtagaaagtaaacagagaaatgagtcttagcttgacattttaaaaaacaaaaccctaggaccaaaagactgatttttctaaatgacagaagagtctcctactttcctttggtttgcaggtatcctttgattacattttgggtagtggttaagactgcaggctctggaactgtgcacgttggacttctcttaaggctctgccacttactgtgacacgttcggcaagttacttcgcctttctgagtctgcgttttgtcatctgtaaaataagataaaatagtgtctcctttatatatatggtggttgtaccttgtaaatgtctcaatggatctaaatggatgagaaaggtattacagagagtcaatagtaagtgtgagccattattattatttactccaggcttatttctgcccagctgttctgcctcagatgttaatgaatttgttcatctttaacctcttaagttagattttgttaagctattaataatttgagtcatgagatcttttaagtatgctgcagacctcagaaaaatctggggaaatagatctacaatttgaaagtaaatgatgaatcaggcttagtagtccctcaaactcaagaagatttgtttgcacatcagaagtttttcacttggaaggatactgagaaaacctcaccctcctatttccaagtttgtatttctagactgtcttctgtaggacaaacagtattaaaatggtgttcacttttgtttaccattaaaggatctgtgctgtgattggaaatcagttttgggggaccacactgatcattcagtaatttggaagtgttgaccttcttagtgaaatgtcttttttttcatatcttgcaaataaccccttttgtgtccccaaggaaaggtcattctttagaattaagccattacggttgctatttgcttgtttctttcctttgtcagagtccctgctcttgtgttgtgttgttcgaatggagtcaagagagagctctgggattttgaggaccagggctgggttaatgagcacttatgccctggtttattttaatcactgaagagtttgttatgccccctgattaaacagagaagctaaggatggcgaaatattcttcttgtgcttccaaatagctctttgagaccttgaccctcttttgcaatttgaggtagttgttgaagcagttttgtgattggtcccttggctgggctgtcatccccccacctcccgctggacttgcgatgcctccacagcaattacatcttaaacagtgtgtgtgccgaggattttagggagcctgatgacctctagaagaaatagtggttttcagaaggtggagaagtttacagtgactcatcattccttcttgctatcattattctgtgatagcagcatttagtgagcagctacagttgggcacagtgggggaacataaagaggaaagactccattcctgccacatgcctgcggggcagagggaaacctaccttaataaaagacatcccttgcttctgtcagcaaatatccatcgaatagtgggaggaaaggaagaccaataggtagcaggtatacacaatgtcaaaatttgctcaaatggtacaccctaaatgtgtttaagtttattgtgtttcagttatacctcaacagacttggcgaaaaagaaagaaatatttttaggcatctgtcttctgggtgcttggcttgttgggctaagcttgatcttatttcatcaccagaggtatctgtaaagtaggtcctattattttcccttgattatggaggaaaaaaagttcagtgattttaggtgccttgtctaagacaacctagctagttagtagcagattggtctgagtaatacattgatcagtaattaatatataattataatcagtaattatagcaattactgataatataattatatagagataatataattatattcagagcctcctccggcagcaagggtgcgggtggtgtgagtgtgagaccgggctacattacggtctaagcggagtgctcttggtgggggtgagtccacctctgaaaaggttttgttgagggagctgattcaaacagggtcttggaaaaggacttgctttgacaaatagagcttatgggaaaagacaaggcactgtattagtttttatttaaataatttaatcagtttttaaattggaaaactaaccaatgcatgtagtaaaaattcacatggcactaaaagaaacacaatgaataggaagactctctcctactcacaccgctgatctctatggcactccctcccaggcccaactacagtgatggcttctcaggtgtcctttgggaagcattctgtgcccattctagtgtgtgcccatgtcacattcacatactttttaaaaagcaccataatttggcagggcgcgatggctcatgcctgtaatcccagcactttgggaggccacagcgggtggttcacctgagttcgagaccagcctggccaacatggtcaaaccccatctctactaaaaaatacaaaaataaccagctgttgtggcagtcacctgtaatcccagctactcaggaggctgaggcaggagaatcgcttgaacctgggaggcggtggttgcagtgagccgagattgcgccactgcactccagtctgggtgacagagtgagactctgtctccaaacaaacaaaaaaagaggctgaggtgggaggattgcttgagccctggaggtgaaggatgcagtgagctgagattgcaccattgcactctagcctgggcaacagagtaagcttgtctcaaaaaaaaaaaaagaaaagcaccataatttgatgactcgatagaggcttttccatgccttattcttttcacttcatcatagattaaataatttaaaagttagtttgtctggaatattgagaaactcacgagttactgagaatcacctaccatagttttaatgaacagagctaccagtttgttcttttttttttttttttttttttttttttttgagacagttttgcccttattgcccaggctggagtgcaatggcgcaatcttggctcaccgcaacgtctgactcctggttcaagcaattctgctgcctcagcctctggagcagctgggattacaggcatgcatcaccacccccagctaactttgtatttttagtagagacggagtttccccacgttggtcaggctggtcttgaacttctgacctcaggtgatccacctgccttggcctcccaaagtgctgggattacaggcgtgagccaccgcacctggccccagtttgttttttcattcccacagtttttgagtggccaccatttgattaagccccattatcctcctttgagaaacccacctattgctcttttctgaaagcagtgaataaagtatttatttatttatttatttatttattttccttttttttggagatatggtctggctctgtcacccaggctggagtgcagtggcgtgatcttggctcactgcagcctcgacctcccgggggctccagccgtctttccacctcagcctaccgggtagctgagactacaggcgctcgccatcacacctggctaatttctgtattttttgtggagacagggtttcaccatgttgcccaggctggtttcaaactcctgggctcaagagatccacttgccgcagcctcccaaagtgctaggattacaagcctgaactacctcacctggccaaataaagtatttattgattgccaccttttggtttgggatacattggtgaacaaaacaataaaaatccctgcctctgtggaacttacattcttctgggaatgaaagagccctttcgagtttatgagatgtgtcacgtttcatgtcgttttcaggaaagcctatttagcttagcattggatcccatttagcagggaagaaccagaggctgaaagagctgctcgcccaagtcacagtggtgaggaatcacctgggttccaacccctggcctcgaagtccagattctgggttctttctggtgtgctgtgccgttcctgggagccagggagctgccttgtgcttcttcgtctttctaacactgagcctagggattcccacatagaagaggctccatgacatggggtggggtaagtgggttttgatgcccgggagcaggcagaccctggcagcccctttccaggctctggctttacaggcagcagagtgatggcaggttggtttgatggtgttaaggccagagttgtcaccatccccgtcatgccacagtccttccactgctgataaggaaggaaatgccccggatgggccgcagatgactgcttgatctggagaggaatcatctatgataatatgaataatgatgagctgggagagtgggagaagcatcaccccctccctgccgcagtcactgggagaacatctccctggcaaggtgctgagcaaagcccctcctacaccaggctgggctccctccgccctgatcgggttctgtgcgtgccctccatggtttccaaggcccttgttggatgcagtctccttccatcctcagcagagccttgtgaataaattgtgatctgagttaccactcccactgacagatggaaaagcaggcccacagaacctgtgattttttttggtggctggaaaaacaggagttagggctgcactttttgaattccaagttgatgaccctttttgcaattccttattgctgtccgaggaaaaagagttgccagtgacctgctgagagtcatgaatgacaataatggccaggattgagtgttcctctgtgctcagtactgtacaaaggggatttgttaacctggaaaaaaaacaatcaatggagttttattacttgacataattaaggaggatgctggaagtattctccaaagcagcgtctctcccaggagggtttcatggggtgatggagaggggaaagggtgtgtcattgcatgtggaggaggggtcccagtggcacagatgcagtgagtcatcacgccagcacatagtcacatgttctggtgatgaagctgtagctcctcccgggtggagactgtagcatggtaatgaggaaagtccacttgggatcatctctataagttgctggtttcacctgacttggtgactgcattccatgcaagttgtgggaaaaaccaggctgaagggcaggagcctgtgaaacaggctgattgttcaagctgatgaaactcctatagtccttggagaccctccctgtctgctacacttgtacatggtattttatttgattgttgtattatccttaggatttgggattgtcattcccatttcacgaaatgggaaactgaggattccaaggtttagtagcctctcccagtgtcagtcactagcaagcagcagagcctggacacgaagccaggtagtcgggttccagggcacattacttctattgatttgatgggaaaccttcattgagtgcctgtcctgtgctaagggtatgctcacaattaagtactctattcctgtgtgtcgttatgagcccctctggatcacacctgagtttatactgataaggtgattagtaggttggggcccctagacagcctcaggatggagctacttcttagaatgaccaagcaattaggaggttagaactttcagctccacctaccgacctcctggaaggaagcaggggctggagattaagctctataaaaacttacagatgtgataagcatctgggttgaacacatggagggcactgggagggtggcgtggctggagcaggcgtggaagttccatgcccaccccctctcctaccctgcctctgtgtcattccacctggctgttcctgagttgtatcctttataataaaccagtaactataaaaaaagcgtttgcctgagttcttcgagccattctagcaaattattgcacctgaagagggggttgtgcaaacccctgattaagcttgttggtcagaagtctaagtggcccaggacttgtgactgccatctgaagtagggtaggtcttgtgagactgagcccttaaatcagacgggagtacagtgacgtgatcatagctaattgcagccttgacctcccccaggctcaagtgaacctcccacctcagcctcccgagtagccgggaccacaggcatgtaccagcaggcatggctaatttttgtagagatggggtcccactacgttgcccaggatggtcttggaactcttgggctcaagggattctcctgcctcagcctcccaaagtgctgggattaaaggcacgaggcaccacacctagctgggagttctaattgaattgtcagacacccagttggtgtctggagacttagagaattgactgtgttagaaaacacctcaaacccattttacagatgcagcaactgaggattagagaggttttgggaactttcccagaatttatttagtggtaagtggaggaactgggatttgaatgtgtgtaatttgactttaagtcctatactccaagtgactgcttgattttgctgtcccattgagtacctctgtgtgccaggtgctcacaagcatttagtgatcaaaaggttcagaacccatttcttgcctgggctttaacctctccatcagctttggcacaagtctgtgtgtgagcctggcatgtactcaacctgtcttgagtcttggtttcctaagaataaaaataagatcaaccttctggcttttgtaataaatgttaagtgttagatgaatagtaagtacacctgaaatgtcatgtctcctccacttttctctccataaatgttcatttatcttttcttcctggcctcttctggaccctggaatgctgcagcttggatgcaccggtggcctgtgtgaagcctgtgtgttcttggaaactggccagaggccataattcccaacccacgtgttcccatcccctctttctcgtggctctctgccattttttgatgggggttggtgagggcgtctgacctgaaggaggaggccagatgcagctatttataaagtttttagggaatagagatctcaagagaagattgcatgtccttgctgtccccctggccgccagtggtcactgagccatcttctccccatttcccaggtatgatcgggtacggcatggccaagggtgctgttcaccagctctgccagagcctggctgggaagaacagcggcatgccgcccggggcagccgccatcgctgtgctcccgtaagtgcttggggttccctggctgctgcccacctctgccccactgctgcaggtgaccgtttgtctgactgtagctttccacaggcgacctgggtgtgctctcacctctggttctgaaacacaccaaagtctcttaagatacttattatcttaatctgtttgaattgctctaacaaaataccttagactgggtgatttataaacagcagaaatgtattgctcacagttctggaggctgggaagtccaagatgaaggcaccagcagatttggtgcctggcgagggctcattcctcatagatggcgccttctatatgtgctcacacggtggaaggggcaaatgggctccctccagcttcctttataagcatgctaatcccctcctaaaggcccccacttgtctcctgcagaccccacctcttaatactattatgttgcagtttgtgttttgtatgtgagtttgagggggatacattcagaccatagcaatacttccagttttgggttctcctgggctgtccagaatgtttgattggctggttggatgggtctgtcttttttgcctctttttttcctctccctttcttttctcccttcatttcttcctttaaaattagactacacattttacttttttatatgtagttctgtctttcaagtcattatatggggtatgtatgtgtgagagagagagaatatgggaaactgttggaggtgtttctgttggtcatcgggggactgtcccccatcagctgtcccaggcagaggcagctgctttggagggaggctactccttctcgctggaaggcttccagcaccagcaggcttgcctcttgcctgtggtcctataaagggatgctgagactgtagggactgcactgattgactttctggttcccttttagttgtgaggttctgtgattctgtgacatgattcccacagctgttttgaatgattcgaatgattcctgaggccttgatgttcttgggagattcatgcatatctgaattctatattattctgccaaaaatcttaaggttttgtggaaaatagccacatatttaaaattttagtattttagtattctcatatttaaaggcatataactatcttaaatccttagaaatgagtgtgctgcatgttagggagtgaataaagacacagcaacaaagcagtttaattcagtgaagactcttttttaaaaaggcaaaatgtggctccttctgttttgttcttatctgcctaagtggtgagccacagcgcaccttattgaattatgctcagatctggcctttgctagcggggacagcttcctgctctctctctgcttatctttctgtctgatctttccatgtaaatagcaccctcagtgccagaggctctaggttgtcctgctgtatgtttgcgttttcctggccaagggggactgggcacctgttgttagaaaggagcgacatgaatgacgtgcttatctgtgtccattgcagggttaccctggataccccgatgaacaggaaatcaatgcctgaggctgacttcagctcctggacacccttagaattcctagttgagtgagtattacagacatgtccatgactgagcagcttccagcccctattctctgcctgctgtggtccagaggacaagtctgtgttccctgagatcgtcaatccgggtggtcttgggaggtctctgggactctgaggatgcattgcacatcagacggaatctcagagtagctggacttggagacaggcagcacagtggcagaatgggtagtgccgacatgaatcctggctcgctccctcaccaccggccatgctgagcacattattgacctgctgaggcctcagtttccccacctgtatcatgaggtccatcatgcttgttaggattaaacgtgatagtgtgcggcaagcactcaacacagtgtctggccataacaagtgctcagtgatccccagctgcagtttgtgtccttactgctgtgatgaggagactccatgggggagggggacaccacgtagatggcctgggggcacatatctgaatctgtgtcaagccacagacccacagaaagtgccctttaatttccgaaatcctttttgcccatttgtgaatatgggtggcatttgaacgctcatgggacagagagctgaattcctcttttgtgtttgtttaggtatcagttcctcaagcccctctagttagtaagcatgtgttcatcgagcacccactatgggccaggtgctgccctcggctctggggtcacggtgaggacaaagatgggatccctgcccacagggagcaggggtgccgagagggtcaaggtgacagcctgacccagtagtgcctctgtgtaaactgctttgacgactgtttataagagatgtttgtgaagttagcagtgtgcttctggcctgatgtcacaatctcatttaaattaaatcgggagaaatttgggacttgcgttttatgtttgaaatgtgtacttacagaacactttttatgtcccagtcaccattctaagcacttcataactcttatttaatgctcatagcaaactctgagggaggagctgtcatttttatttaaggcttagagacttggagggatggcaggggctaagtcactcgcctaaggtcacacagcacagccgggatctgacacaagtggtgtggctgcagaacctatggtcttaactggtgtgctgacagttatttctgtctatgccaggaatcatgcttcatgcttgatttgcaggaaaaaaattgaagttgtagaggaaatcaagctttgaattgtgtttgtgtttgaatttctttttaaaggccgacactcccaccacacttgagatactgatctaagacctactctagatggaacatctgggatcttgtgtctgaactcgtgctgagccacagacccacagaggacgggctgtcacaggcccccttttgttctagagatcacatccacccatttgtggtatttgaaaactctcagaaaagctggcataaagtttgctttgagatgtctgtgagcacatccttcctctaccatccctggttagaatggcgttctcactcacctatccacgctgcagatgagggtgaagaagtaaaaccatttaaaacatgcatcgcagcaaaccaacatggcacatgcatacctgtgtagcaaacctgcacgctgtgcacatgtagcctagatcttaaagtataaaaaaacaaaacaacaaaaaaacatgtgtaaccaacacacaaaaccctacacaaccaaacggcactggtctctttcagagccttccctcaccaagccctaccctgtccccagagatgaggccatgacatgacagtactttagagagttttagcaacgctttgttttttgagcccatgtgctcatatgagcttgttcaaaccccagagtaggggcctgaatgactggacctttacacatcagcgctggcccagaaggttacagattggcactgggagtctcccaggaaggaaatgctgagcactttttagttaatgaaggtccgaagtctcagctggtgaattgtcaaaatggatgatgtactcaaatgtaaatgttttgtgttaaagaattatcatctacttcttgtttcttgtgaatttcttttgccctttttcattcctgtcttcttagagggtctttttgactgctgcaagtggggtcagttgctcctctcctcagatttgtgaaaggccctgttactgtatttaacattttattgtaatagtctgtttttttctatctctttttccattgtttggtgcagctgtgggtactctataaatgtttgattaaaaaaatgccaaataaatgaattgcatctgtttctctcataaatttatgagaaggtaatatagcaaagtattgtgcatgtgtctctctctttgaatgaactaattaaaatctttaaaaacaattttttttttttttgagacagggtctcactgggtcacccaggctggagtgcagtgtcacgatcatggcttaccctagccttgatctccggggctcaagcaatcatcccaccacagcctcctgagtagctgggactacaggcatgtgccatgcccagctattttttgtatttttttagaggtagggtttcacccagttgcccaggctggtctcaaaaactcctgggctcaagtgatccacctgcctcagcctcccaaattgctgagattacaggtgtgagccaccacgcctggccaaattagaatcttttaaaatcacaaaagaattccaacaatgtagaaaaataccaaaatgaaagttaaacttatgccaaatcctgccactcagagattagaatgagtacaccactgaactcactgggggcctgggtatgtgtccatcatgcctactggcttttattaattttttattattttttggagatggaatcttgccattgtgtccaggctggcctcaaacacctgggctcaagcgatccgcccgccttggcatctcaaagtgctgggatcataggggtgagccataatgcctgacctttagtggcttttatttatttatttatttattattttttgtgagacggagtctcattgtgatgcccaggctggagtgcaatggtgcaacctcggcttacctctgcttcccgggtgcaagtgattctacttcctcagcctcctgagtagctaggattacaggcacgtgctaccacggccaatttttgtatttttagtagagatggggtttcatcatattggccaggctggtctcgaactcctgacctcaagcgatctgcccgcctcggcctcccaaagtgctgggatcacaggtgtgagccatggcgcccagcccttagtggcttttaaacagtcgctgctgtgccaccccttccccccaccccacaagccgtcactgtgaaggtcagcatgtgcccagatttttgctttgagaatataaaaaaaacttttattttctgttccagaactttccatgactggatcacagggaaaaaccgaccgagctcaggaagcctaatccaggtggtaaccacagaaggaaggacggaactcaccccagcatatttttaggcctcatctcagtgcctatgaggggcctgccagaaaagtcactaacctgtctcagtgtggccttgtccagccttgtgttttctgtaacccctgtttgtggtacgagataatgagtcctatttttctctcacataatatgcatttgctctcctaggacagtgtaatacatttatgtgaagtaaagacatgcgagactggtggcctgcaaatagcatccgttgatctgtgttaactgcatagggagggctctgcatagcacctgctatagcggtgtcatgttggatcgcttttgtgactgttcatctgtccttgacagtggctgtcatcttgactactttgttgatttgttggtattggggacattttaaaggctgagttatttttgaatgtcatgtttatgtcatagacgtagttttcgcatccttgaattaaactgccttaactccttttgtggtataagcaaaactacatggactctgtcctggtatccttttcctgtgtggttgccccgtgtcctctggcctagggttaagtgtgcaagataactactcgtgagtattcagaatgttgttcctaataaatgcacttgttgtctgtcttctttaatcaaatcacatcttatatacagcagtcagagatgagtatactagaatcatggattgctggaggtcttttaatctgatgttctcagaagggggtggatttaaatcctgaaataaatatttcaacac

SEQ ID NO: 37150 - DNA, 6038 bp, Homo sapiens
acgaggtgcgggacggaagagggggtgaaggccagaggctcggggcttcaagaccgctgtctggagtccccctttccaggccatgtcggggcccacctggctgcccccgaagcagccggagcccgccagagcccctcaggggagggcgatcccccgcggcaccccggggccaccaccggcccacggagcaggtaaggcagcccttgtgagacagaagagccacccagctgtggcgctcacctctgtcctaccgctccagcctcccgccctggctgcttcctcctgccccttccccaagccgaggcggggggaacagccgcctgcgctctcttgggaccctagatttgggggaggaggtaacgagaggcggagagggtggctcctcaaatatacacccctcctgtcctccgccaccccacctttgatttctcttccctcaacccagcactccagccccaccccagggtcaatttttgcccccttccatctgagcagtgttaccaggccccagggggaccggaggatcgggggccggcgtgggtggggtcccatggagtactccagcacacgcaggtgagacccgggatcgtggggtgggacatgtgggatcccccagaaccgagtctgagggacccaggacaggagaaggcctatggtgatttgcattcttcctgccctggctccatcctcaggggctccctgcagacagggggggccttcgccctggaagcctggacgccgagatagacttgctgagcagcacgctggccgagctgaatgggggtcggggtcatgcgtcacggcgaccagaccgacaggtgactctgcccctcctccccgtcagcaccctgcccccttctctggactctcagacccagcctgatcgatcccccatgtgtgtaatgtgcaccccagcatggaggaagcgtggctgcaagtaccaacatgtcagccacttgaggacgggaccttgtcaaatgcaaaaagcctgtgcttccccacagccagggtcatttccacaaatgtgggtcttggagtggggtccttgcttacgacttctggcctgcgtttctcctcaggcatatgagcccccgccacctcctgcctaccgcacgggctccctgaagccaaatccagcctcgccgctcccagcgtctccctatgggggccccactccagcctcttacactaccgccagcaccccggctggcccagccttccccgtgcaagtgaaggtggcacagccagtgaggggctgcggcccacccaggcggggagcctctcaggcctctgggcccctcccgggcccccactttcctctcccaggccgaggtgaagtctgggggcctggctataggagccagagagagccagggccaggggccaaagaggaagctgctggggtctctggccctgcaggaagaggaagaggaggcgagcacgggccccaggtgagccctggggaactgggatttcaggccctacagacaatgggacaccgactgggtggggtggctggtggtgttttagggggcttttttgttttttgagacagagttttgctcttgtttgcccaggctggggtgcagtggtgccatcttggctcactgcaacctctgcctcccgggttcaagtgattctcctgcctcagcctcctgaataactggattacaggcacacgctgccacgcttggttaatttttgtatttttagtacagacggggtttcactaaaaccccagtttgttggccaggctggtctcgaactcccgacctcaggtgatccgcctgcctcagcctcccaaagtgctgggattgcaggcctgagccaccgcgcctggccaaggggctggttttggagcagagtcagaggtctgggacgtggaataggtaagggcagggcagtgcgggggagcaggatagaactgcccattggggctgagcgcggtggctcatgcctgtaatcccagcactttgggaggctgaggtgggtggatcacctgaggtcacgagttcgagaccacactgaccaacatggagaaacctcgtctctactaaaaatacaaaattagccaggcatggtggcacatgcctgtaatcccagctactcgggaggttgaggcaggagaatcacttgaacctgggaggtggaggttgcggtgagccgagatcgcaccactgctctccaacctgggcaacaagagcaaaactctgtctcaaaaaaaaaaaaaaaaaaaaaaaagaactgcctacgggcccctgggctgagatgttctcagatgagctttctagctggaactgcctggccaccttcagagacattatagcagtccccaatctttttggcaccagggaccagttttggggaaaacaatttttccatggactggggagggggatgggagggggtgggagggggatggtttcaggatgattcaagcacattacattcattgtgcactttatttctgttataataataatagaatatatagtatatataattgtttcggtatatattacaatgtatattacaatgtaatatataccgaaacaattatacaattcaccatcatgtaggatcagtgggagccctgagcttgttttcctgcaactggacagtcccatctgggggtgatgggagacagtgacagatcatcaggcattagattctcataaggagcttgcaacctacatccttcgaacacacagttcacaatagggttcatgctcctatgagaatctaacgccgctgctgatctgacaggaggtggagctcaggcggtaatgcaagtgatggggagcagctgtaaatacagatgaagctttgcttgcccattgctcagctcctgctgtgtggcccagttcctaacaggccatggcctggcggctgagggccctggtattacagcatcaggagctagagtaggaccgagcccgattcccaccttccaggtgcccctgagccagcctccagaggatgagctggataggctgacgaagaagctggttcacgacatgaaccacccgcccagcggggagtactttggtgagctgaggctgtggggtgggtgggacgtgggaagggaggctgggagacagaggggacagtggcttcctgggtctgtgaagactgatgctgtttctccctgtcctcaggccagtgtggtggctgcggagaagatgtggttggggatggggctggggttgtggcccttgatcgcgtctttcacgtgggctgctttgtatgttctacatgccgggcccagcttcgcggccagcatttctacgccgtggagaggagggcatattgcgagggctgctacgtggtgagtggctggggctgggaggagggagtcagtggctggatgcagggggcttccatccaaggtggtaactagagcgtccaagaccaaaggaggaacggtgctaaaagccaggcgactgaaagtgatgtacaaacagggcggaattctgcaagtatcaagcaagtagcttaacactggtggctgaagggaaggacgcagctcttacaagtgtggagcatcttacagttaaagagaatgtgttagattcccatgacacccctgtgaggcaggtattactactgattcctggttttgttttttgtttttttttgagacagtctcgctctgttgcgcagactggagtgcagtggggtgatctctgctcactgcaacctcagcctgccctggttcaagcgattctcatgcctcaggctcccgagcagttgggattacaggtgcccaccaccacacccagctaatttttgtatttttagtagagacagggtttcgccatgttggccaggctgttttgaaactcctggcctcaagcagtccgcccactctggcctcccaaagtgctggcattacaggcgtgagccactgcacccagcctgattcctgtttttctcatagtgtttaaataccgtgtatagtgctgggacctgaactcagatctgctcaagtctgcctttcaccgaatcacatgcaggaggctgcatgcaggaggctgcagaaattagatggctgggttgctggggttcctgttgagctgccatggctcccgcccgctcccagatcttcctgccttccttcccaacaggccaccctggagaaatgtgccacgtgctcccagcccatcctggaccggatcctgcgggctatggggaaggcctaccaccctggctgcttcacctgcgtggtgtgtcaccgcggcctcgacggcatccccttcacagtggatgctacgagccagatccactgcattgaggactttcacaggtcaggcctggcctccaccttgtctcacaatgtctgacctttcctgtctctctcatctcttcatgccccaggactgtctcttcctgtttccaaccctggccctccttcgttctttgttattgttattttttagagacggagtttcactctgttgcccaggcaggagtgcaatggcatgatcatagctcactgcagcctccaactcctgggctcaagtgatcctcctacctcagcctcctgagtagctgggactacgggtgcacacgccaccatgcctggctagttttcttcgtttttttttttttttttttgagatggagtctcactctgtcacccaggctggagtgcagtggcacgatctcagctcactgcaacctccaccacctgggttcaagtgatttgcctgcctcaacctccccagtagctgggattacgggcgcatgccaccacgcctggctagtttttttttttttttttttttttgtatttttagtagagacaggctttcatcatgttggccaggctggtctcaaactcctgagctcaagcgatccacctgcctcggccgcccaaagtgcagggatagcaggcgtaagccactgcacccagtcttcttctttgtattttaataaagacagcgtcttgctgtgttgcctaggctggtcttgaacgcctggcctcaagtgatcctcctgccttggcctcccaaagtcgggggattgcaggctagagccactgcacctagcctctctcattctctttgacatcgtcccttccccaagacctaaggccatacctctggcctctctgattccctcctgtgccccaccttctctgggttccattgttggtgccctgcaaccccaaggcttgatggccttcttggttctcttcccctgcaggaagtttgccccaagatgctcagtgtgcggtggggccataatgcctgagccaggtcaggaggagactgtgagaattgttgctctggatcgaagttttcacattggctgttacaagtgcgaggtcaggggcccccagcacgtgcaaggggctggcagtgtctagggtgctgggtagagcatgagggggaacacagaggtctggggttgatggaaacctgttgcttctttcttttttttttttttttgagacggagtcttgctctgttgcccaggctggagtgcagtggcacaatcttggctcactgcaacctccacctcccgggttcaagtgattctcctgcctcagcctcctgagtagctgggattacaggtgctggccaccatgcctggctaatttttgtatttttagtagagacagggtttcaccatattggccaggctggtcttgaactcctgaccttgtgatcctcctgcctcggcttctcaaagtgctgggattacaggcgtgagccatcgcgcccggccaattgttgcttctttttcaacaggagtgtgggctgctgctctcctctgagggcgagtgtcagggctgctacccgctggatgggcacatcttgtgcaaggcctgcagcgcctggcgcatccaggagctctcagccaccgtcaccactgactgctgagtcttcctagaagtacctgctgggttctcagttccagttcccatcctttgattgatcactctccctgacatccacctgtatgactttgtcaccaaatgctgtcttctctttctccaatcaagaaataataatccctcgagtttacaaaac

SEQ ID NO: 37151 - DNA, 37422 bp, Homo sapiens
cgcgactagggtgcagcgccaggtccggtgttggggtgtccgagttgccgccggagaggagtggcctcgcccgcttggtgagtctccaggagtgggacggagggagctggccgggatgaagtctgagactatgtcctgagaagaaagagtgtatcgtattggttgaaaagttggtggggtcgggcttaagcggaggagggggctctctggcccttactcggcagatgggcccggagagaggacgggaggtgccgggagaacatcgagggaccagtggaggaagggtagctggatggtaattctctggacccttcctcgaaattaaacagagatcactttccgcccctcacccttactgtgttgctgtagttgacattaatagactgcctgtatggtgaccacagtgatcagatagctctgagataatggcttgaggaaggactctgaggttcctggtattggatagcccttgctctctagaaaggttcagccttacctcgcggcattactgcacaaattagaggatcaggaaaagaatgaatttcacaattcgggattggagtggtggggggaaaaagtactgtaaagtgtagtttcatctcgtcctttttttcttctttaatcagtcaccacaatgttaggaaaggcagttgatggtaggaggaaacgtaaagacataaaagtgggagaggaaaaaaaagtcaagaagggagtatcattttgccttttgctatttgtcatctcctggaatggggtctgtattagtgcgttctcacactgctataaagaagtacccaaggccgggcttggtggctaacgcctgtaatcccagcactttgggaggtcgaggagagaggatcatatgagatcaggagttcgagaccagcctggccaacatgatgaaatcccatctctactaaaaatacaaaaattagccaggcgtggtggtatatgcttgtaatcccagctactccggaggctgaggcaggagaatcacttgaacctgggaaacagaggttgcagtgaaccgagatcgtgccactgagcttcagcctgggagacagagtcaggctccaactcaaaaaaaaacaaaaagcaaaagaaatactcgagactgggtaatttataaaggaaggaagtttaattgactctcagttctgcatggctggggaggcctcaggaaacttataatcatggtggaaagcaaaggagaagccaagcaccttcttcacaggatggcaggagagagacagtgaaggggaaaaagccccttataaaaccagtatcatgagaacagcatgggggaaaccacccccataatccaatcacctctcaccagattcgagatgagattatgaatagccaaactgtatcattctgcccctggcccctttctttctttctttctttttttttttttttgagatggagtctcacactctgtcacccaggctggagtgcagtggcgcgatcttggcttactacaacctccaacacttcaagcgattctcctccctcacactcctgagtagctgagactacaaatgtgtgccaccaaacctggctaattttttttttttttttttttttgagatggggtcttgctctgtcgctcaggctggagtgcagtggcgcgatcttggctcactgcgacctccgcctcccagggtcaagcaattcttctgcctcaacgtcccaagtagctgggattacaggcacctgccaccaggcctggctaatttttgtatttttagtagagatggggttttgccatgttggccaggctggtctcaaactcctgacctcaggttatccaccggcctccgcctcccaaagtgctgggattacaggcgtgagccaccgcgcctggctaatttttgcattttttagtagagacggggtttcactctattggccaggctggtctcaaacgcctgacctcatgatccacccacctcatcttcccaaggtgctgggattacaggcatgagccaccacgcccagattccctggcccctttcaaatctcatgtcctcacagttcaaaacacaatcatgccttcccaacaggcctccaaaatcttaactcattccagtattaacccaaaagtccaagtccaaagtctcatctgagacaaggcaagtcccttttgcctaggagcctgtaaaatcaaaagcaagttagttacttctaaagatgctatgggggaataggcattggtaaatgctcccattccaaatgggagaaattggccaaaacaaaggggctaccggccctatgcaagtccaaaatccagtgggacagccattacgtcttaaaacttattttaatctccttagactccatgtctcacatctagggcacgctgatgccaagggtgggctcccaaggccttgagcagttctgaccctgtggctttgcagggttcaggcccagaggctgctctgctgggctggcattgagtgcctgaggcttttccaggttcatagtgcaagctgtttgtagacctgccattctggagtctggagaatggtggccctcttctcacagctccactaggcagtgccccagtggggattctggggggtgggcggtgtccaatcccacgtttcctttctgcagtgccctagcagaggttctccatgaggtctcttccactgcagcagactttggcctggacatccaggcatttccgtacatcctctgaaatctagacagaggttcccaaacctcaattcttgacttctgtgcacctgcaggcccagctaccacgtggaagctaccaaggtttggggcttgcaccctctgaagcaacagcccaagctgtaccttgaccccttttagccaggagctggagcagctgggactcagggccccaagttctgaggctgcccacgaaaccattttttcttcctaggcctcaggtcttgtgatgggaggggctgccatgaagatctctgatatgccctggagacatttttcccattgttttggtgattaacattcagctccttgttacttaacgcaaatttctacagctggcttaaatttcttctctttgctttataaattacttggtggtctcagctcagtgatccagtgatctgagtgatctcaggaaaagaaagaaatattagcaaataagagaaacaccttacattgccatactcctttgacaggtcatgtgaaagtaatttaagtgatcatatcacttagcctgcagcttgaatatttgtctcaggctaggttttactttaggtgcttgtagtatgtgtttatgcactagaaagttagtgttatcatagttccagcataaggatgtcttactgtgccaaataaacagtggaattcctatatgtatcttgatatttgtttcttgtacactgaatgaacttaggtacaatacacacaagcccacttaactaaaggtcacatctttttttttttttttgacagagtttcactcttgttgcccaggctggagtacaatatcttgatctagggtcacctcaatctccacctcccgggttcaagcgattctcctgcctcagcctcccgagtagctgggattacaggcaggcgccaccatacctggctaattttatatttttagtagagacggacggggtttctccatgttagtgaggctggtctcgagctcccgacctcaggtgatccgctcgcctcagcctcccaaagtgttgggattacaggcgtgagccaccgcgcccggtctaaggtcacatcttttctaatcatttagaacacaacctagaaccagaaagaaagtaaacaaaaacaggcctgtactcatgggacagctgtggagtcttcacctatgagtcataccaccatcataatttttgccatttagagtactgttgttattttacttcatgtttaatgggttttttaaaaaaacattgcccacttccaaagtgataatctgtgaaatcatggtttttatgtattttatagcttttttagcatccattataataaatacataactattaaatatataactctttcatatgtaacagttaaaatcatattcttgctcagcactttggaagatactgctttgggcctaatcagctcatttttaaaatgaagattgaactaaagcttatgggcttgaaaattctgtgatctctatgatgatgttcattatcataacacaattctagcaaagtttactggttccaccagatgaaagtagattagggccgggcggtggttcatgcctgtaattccagcactttgagagtctgaggcaggaggatcgcttgagcccaggagtttgagaccagcctgggcaacatgccaagactgtctctacaaaaattttttaaaaaactagctggacctggtgcccagtgcctgtggtcccagctactcagaaggctgaggtggaggatcgcttgagcctgggaggtcaaggctcctgtagattaaaataacaaaaaggaaaaagaggatgtttgctctttgatatcagctgcctttttttttccctgaattcaggctttcccccgcccccgccccaatttggttcctttatctgcaacactctggacatctgtttttgagctatgtttgtactccacattgtgtatatattagcatgtataatattataatgttgcttatctccaagagtgctgaactttttattccattactatattttgtttccagatctgtaggttgacagacgggcagatgacaaggactgctcttttcttttcccttttttttttttttttgagacagagtattactcttgttgcccaagctggagtgcaatggtgtgatctcggctcaccgcaacctctgcctcctgggttcaagtgattctcctgcctcagcctcctgagtagctgggattacaggcatgcgccaccacgcctggctaattttttgtgtttttaggagaaacgaggtttcaccatgttagccaggctggtctcaaactcctgacctcagatgatctgcctgcgttgacctcccaaagtgctgggattacaggcatgagccacctcacccggccaggactgctctttttctttgctgtgataggtagaaacttgaaacagaaggatccagtgcctctaacaattagaggaagtggattatggagccaggaaacaaaatgtactgtgtttttttaaatagtaagagtagaagaagcccatttgtattcatttagattcactgacattttggtttgggtttcaatttaggttgtattgctactaaagtatttaaatcactgattcctatgtttttccagaattctctcttcttgttgctttctgtaagttctgtaacttagatgtaaagtttgtttaaatttattttgacagtgttttggaaattgaaattactttcgatggcctttcaatacttataaaactcaagccaggtgtggtggtgtgtctgtagtcccagctacctgggaggctgaagtaggagcatcagttgaggtcaggagttcaagaccaacctaggcagcatagcaaaataaatttcaaacttcttggtatagtatacaaagctcttcacaatatgtgttctgtcttgaaagccatcccctgccctccatacatacacacacacattatattcctgcctcaccactgaagccttacattgtggctttttcttcctttttgataatttaatttaaaatcataattttttggacttgatcatacttggattttgacccacacaaatgagaatcagggtgtttgtgtttttttgtttgtttgttttttaagacagtcttgctgtgtcaccaaggctggggtgcaatggcatgatcatagctcgctgcagcctcaaactgctgagctcaagtgatccccctgcttcagcctcctgagtagctgggactacaggtgcacgccaccaggcctggctgattttttttttgttgtttaattttgtgtagagatgggggacttgctttactacccaggctggtctcaaactcctggctttaagcaatccttttgctttggcctcctaatgtgctgagattgtaagcatgagccatcatgcctggccaaaatcacgagagatatttcataattattatgaaaagttataatagttttattgagcactgtgtgccaggcactgctctaaatactgtgcttgaattagctcaatccatgtaacaacacttaaagtaagcattattctcatttaatgaggaaactgaagcacagaaaagttaacagtaatcaggatttgaaaccattatgccttcagatattgggcacataactactatactatgttgtcttttgtataagcaagaatgccactcttttctgttgggggtatcctttccagggacgtgagtgcttatattctctctttttttttttttttttttgagacggagtctcgctctgtcgcctaggctggagtgcagtggcgcgatcttggctgactgcaagctctgcctcccaggttcacgccattctcctgcctcagcctcctgagtagctgggactacaggcgcccactaccacgcccggctaattttctgttttttagtagagacggtttcaccttgttagccaggatggtctcgatctcctgacctcgtgatccgcctgcctcagcctcccaaagtgctgggattacaggcatgagccactgcgcccggcagagtgcttatattcgctgtctgtagcttctgactcttaatatcggaatatttgaaaaactaaccagaaagcatcaaagtggctgggtgtggtgtctcacgccttctggcattttgggagtccaagacagaaggattgcttgaggccaggagttcaagaccagcctgggcaacatagtgagccaccctatatctacctaaataaataaataaataaataaagcatctaagtgaacttaatcagagctaaactatgtggatggtttcggtgaatatttcattcaggcagggtgaatccttgccaattaatctcaccccgtacttggtatctccctggcagataccacacttatgcctgccacattgtctcttcctgggtagattgccagcttctggctcttgagccccgttcttatctttcacatagaacgtcccctttctgttcacataaccattctcattgatagggttaataaaattgattacaatcaaacctacatctacctccccagtattactcctgggtcacttagagtagaattgtggaagttcctaatttgacagggacttgaagaccaggcgttggacatcaagcaattaagttaccataggtgcttctgtaaaactgaagtttaattttttttgtaattagagtcagggtcttgctatgttgcccaggttacatttaaactcctgggctcaggtgatcctcctgcctcagcttcctgagtagctgggactataggcctgaaaatgtaattttggttttctttttggttcctgatttttagtgggactttcccatttgttaatatgatttctgtcttgaatcttgtgcttcagtgtactttgaaaccaagctgatttttgtttgttttgttttttcgtgttgttttttaagatggagtctcgctctgtcgctgaggctggagtgcagcggtgcgatctcggctaactgcaacctccgcctcccgggttcaagtgattctcctgccttagcctcctgagtagctgggattacaggtgcccgccaccacgcctggctaatttttttttttttttttttgagatggtgtctcactccgttgcccaggctggagtacagtggcacaatctcgactcactgcaacctctgcctcctgggttcaagtgattttcctgcctcagcctcccaagtagctaggattacaggcacatgccaccacgcccagctaatttttgtatttttagtagagacggggttttgccgtgttggccaggctggtctcgaacccatgacctcaagtgatctgccctcctcagcctcccaaagtgctaggattacaggcgtgagccaccatacccggcctttggtattttttagtagagacggggtttttccatgttggccagtctggtctcaaactcctgacctcaggtgatccacccaccttggcctcccaaagtgctgggattacaaatgtgagccactgcgcctggcctgaaaccaagctgtttagtagatacgattctgtgatgtacttagtatatttgcatttgagttatagactttgtatggtaaaaagaaaagagtttttaaaaagagaaaaaaatatgtatgtatatttgcatagttttggggcctatatataaaaatggttaaagttgtttgtgtagaaggagatagaaaggaaagcccagagaggaagtaaaaggaggaagccatccttaacataaaggagacccttgccaggcaaagtggctcatacatgtaatcccagcactttgggaggctgagccaggagcatcacttgaggccaggagtttgagaccagcctgggcaacatagtgagaccctgcctctacaaaaaaaaaaataataatataataaaagggccaggtgtagtggtgggcacctgtaatcccagctactcgggagactggggaaggagaatcacttgaaccctggggcagaggttgcagtgacctaagattgcaccactgcactccagcctgggcaacagagcgagactccgtctcaaataaaataaagtaaaataaaataaaataaaaagtgagactctgtctcaaaaaaaaagttgtatatagcctatactttatatcatcaactttaatattcaaatttagccttgcagatggaactattaatatttagtagctattactttcagctacatttacataaatgtgactcatattcaacattgttactttccttttgttttgcctactatttatttccacttcagtaaaaatattaatataatggctaacattgaacaccggccatgtgcaaggcattgtactaagtactttgtgtagatcatctctttttaatcttcacaaaaaaaacaaaactataaaatagaatgttatccttgttttacaaatacagaaaccgagttttagtggtgttaggtaattaacttggggtcacacaacaaatacattgtgaggctggaatttatatgctggaattcccactcacccactatgctatcctgctataaacagaagtttcctcttgctgcggatgcattggttaccatggacgtagacttctatcaagccaaagagaatgctgaacttaaaagtacagtaataaaccctttgagtgtaactcattgaggagctttattgtgattaattttcagagaaggaataaggcaggaaactaatttggtagaatattttagctgcaaaatccttgtttaccagtataaaaagaattatcttataaaatcattctttgcaagaccctgtgaaattgatggtgattttttttttctttttttttcagacagtcttgctctgttgcccaggctggagtgcagtgagtcttggctcactgcagcctctgcctcccaggctcaagccacagacgtgcactactgcactcggctaatttttgtgttttctttttagtagagctggggtttcaccgtattgggcagtctggtcttgaactactggcctcaagtgatccgcccacctctgcctcccacagtgctgggattacaggcatgagccaccacgcctggcctgatggtgatttaaagtgctctttcttcattacttcttgagtagctcaccagttttacaaatgaagccacatggatcttccaaggccttatttaaattccagggccttttttctgtgtatttctttccaagaagctcatttacttttcctttcttcttttcttctcttttcttttacttcctttctgcttgcattttttttttttttttttgagacggagtcttgctgttgcccaggctgaagtacagtggcatgatctcggctcactgcgacctttgcctctcgggttcaatcaactctcctgtctcagcctcctgagtagctgggattataggtgtgcatcaccacgcctggctaatttttgtatttttagtagagacggggtttcaccatgttggccaggctggtcttgaactcctgaccttaggtgatctgcccaccttggccttccagagtgctgggattacaggcgtgagccaccgcacctggcctcttgcttgcttgttttcttatctcctcccttcctccctccctcccttccatttcttttccttctttcttttcttttctttttttttctttcttttttattttttttgagacagagtcttgctcttgtcactcaggctggagtgtagtggcatgatctcgactaactgcaaccactccctcccgggttcaaacgattctcctgcctcagcctcccgagtagctgggactacaggcgcccaccaccacacctggctaatttttgtatttttagtagagatggggtttcaccattttggcaatggctggtcttgaactcctgagcttgtgatccgccaacctcggcctcccaaagtgctgggattataggcgtgagccactgtgaccggcccatttcttttctttctttggggtcttgctctgtcaggcaggctggagtgtagtggggatcatggctcactgcagccctgaactcccaggctcaagtgaacctcctaactcagtctcccaagtagctgggactacaggcactggtcaccacacctggctatttttgttgttactttttgtggagacagagtcttgttgtgttgcctaggctggtctcaaactagcctcaagccgttttcctacctcagccctcaaaagtgccagagttacaggcatgagccgctgtgcctagccaatagacttcttttcattttctaaattaatgtagattattttcagcttctgaaataatagaagacagttgaaaaccatgattactgtggtctatttctccttcaatttaactgtcttctttgagtctgtagaagagataaaatttcatggtcttatagaaagcatctgaaattttgaaatgagccatcatataggattgcttgacctattttccaatattcagcagctctcatatgatctattgtttgttaagggggcggtggatacagtcaacagaaaaaactttttttttttttttggaaacagggtcttggtctgttgcccaggctagagcacagtgatgccatctcggctcactgtaccctctgcctcccaggttcaagtgattcttgtgcctcagcctcctgagtagctgggactacaggcatgcgccccatgcccagctaattttttgattatttgtagagaacgggtctcactatgttgcccaggctggtcttgaattcctggcctcaagcagtcctcctgccttggcctcctaaagtactgggattacagacgtgtgccaccactcccagctccagaaagactctttatcagaccatgaattatacttaatttgcgagtagatcccgacttgaataatcaatctgctctttactgacacagccgccttgggtaagttacctaaactgagccttagtttctccatctgtaaaatagtataatgaagataatgatgtagataaatacttagtagggtatctggtgcctaagaggtactcagtgaacttttctttccctgcctaggtttaaattagaaaagaaaaaggtcaaattaggagtcttttagtaagcccaagtgaaccatagcatgagaaatagggtgtaaaagcactgagaaaaatcttgcattttcctctgaaaggcacactattagcatagtataagttcccagcagcactggaaaaatgacacaagtatttaatagattagattaaatctgagaaaagtacgtttaatggcatctttgtatcaactgatgttttatttttcatcccaccccaccagttctcttttctgtaatattctgggtaaccttttcctgattccgtaaggaaaatgtctgcagagaataataaatatgagtaaggctatgtagctaattataggttacattctctctgactcgtctcagcaaacttacaaagaccaataagaacttgaggagtattattccttgtctgtctttgtccttccccttacaattctactttgactctgttactttcatatacagttgacccttgaacaacatgggcttgaactgcgtgggtccacttataggtaaatttttttttcagtaaatacaatcagccctccgtatcagcaggttccacatctataaccaaatgcagatagaaaatatggtattcagccaggtacggtagctcatccctgtaattccagaactttgggaggctgaggtgggaggattgcttgaccccaaaagtttcagaagtttgagaccagcctggataacatagtgagaccctgtctctataaaacagcttaaaaattagccgggcatgatgcatgcacctgtagtcccagctattcagggggctaaatgggaggattgcttgagcctgggagggcaaggctgtagtgaacctgattgcaccaccgctctccaacctggatgacagagtgaagccttgcctcaaaaaaaaaaaaaaagaaagaaagaaagaaaagaaaatacggtattcatacatgcaaaactcccgtctacagagggcggacttttatatctgcaggttcctcagggccaattggtatccacaggcagtactgaatccaaccctctgagcgacagccacactaaacttgtgctcaaaaccctcaagaacacagagtaatcttaggcagctgcatcctggcgttagcatgccaaacttgggagtagatatctgttacttgtcttgcgtgttgtctggtcagggaagaaaaaaatattaagcagaacttcgagttcacatggaaaggatgtgtccttcagaatgacctcattgcgatgtcaggggtgattcctcacgttatccatctcccagttatatctgctttcttttttcttttaaagaaggcagcacagaggtcaggagtgcattcactcctaactctggagttttgctttttttttcctaggaagctagcaaagactgacttgtaattggcaataatcacctctaggaatagaattacaaaattacataatttgtgatatttgggcttccttaccccagaatgtctcccgacccacaggatactatatctgaaaacctcactaagggtgccttttccaggcactaatggattagtgtatattatttttcatattttcttctctgtcgggcattgaggagttacacatgacaggaatagataacttcagagcattactgcctggggagggcaggctttggagaggtatctcggttggggctttaggaagtgatggaaaagcatgaggctacctgggcagatgtggggtattatagaaaggaaaggtgtgcaaaagtgtggaggtgagagggtacaaaaaataatctccatttactttttgtagttgcaaataggaaagagtgacaaaagaggaacagtagcatggacatgtgtatgtatgataaagcttaagactcaaacaattagcaaattaataaaatacctggttccttttatgcttgtatctaatgaatgatatctttatatcttgattatatcttagtgtggaaactttttgcctgaagcacagtctatggcaagcaagatagaaacttaaatttggaacttaaaatgctttttttcatgagcactaatggctttaatcaaggctcaaaatctttttttttttttttttgagatggagtctcgctctgtcacccaggctggagtgcagtggcacagtcttggctcactgcaacctctgcctcccaggttcaagcaattctcctgcctcagcctcccgagtagctgggattacaggcgctcaccaccactcccggctaatttttgtatttttagtagaaacggggtttcaccatgtcgatcaagctggcctcgatctcctaaccccgtgatccatccgcctcggcctcccaaagtattgggattacaggcgtgagccactgcgcctggccctcaaaatcttaaaccataaaacagctatgacagtagaattataaacaaggccaggcacggtggctcaggcctgcaatctgggcactttgggaggctgaggtggatagatcacctgaggtctggagttcgagatcagcctggccaacatggtgaaaccccatctctactaaaaatacagaaattagtggggcgtggtggtgcatgcctgtaatcccagctccttgggaggctgaggcaggagaattgcttgaacccaggaggcagaaggtgcagtgagtcagggttacaccactgcactccagcctgggcaacagagtgagactccatctcaaaaaaataaaaaaaataacatgatagtagtggttcaattaaaaacaactgaaaagatttaaatttttttgtttgtttgttttttgagatagggtcttgctctgtcacccaggctggagtgcagtgccatgatcttgacttacttcagcctcaacctcctggactcaagcaatccgcccaccccaacctccccggtagctgggactacaggtgtgcgccaccatgcctggctaatttttgtatatttggtagagatggggttttgccatgttgcccaggctgaactccaactcctgagctcaagccatccactcacctcagcctcccaaagtgctaggattccagtcatgagctaccacacccagccaaaaatgactgaaaagatttatatgtgatcatatcatacacttgcaatagcagtttttggtttgtggctctagtgattctttgcgagctttgtgctactgttacatgcagctttgtttctaagagccatgtaaatactttgagagtacaccctgtttttctacttatttgttcattcagctatttttggagtatctaccatcagatcctattaggtgttagagatacaaagataaaatctctgccttccaagaattcagtccagtacattcttggggaattaagttttctgcttatcaaagagtatatccatggcaaggtttctcacctcaaattgacattttgggtcagattattctttgctggagggctttcctgaagagtgttgtaggatgttaagcagtttccctgcctctacctactagatgccattaaccagccccatcacctggcccaagttgtgacaatcaagcaactccagacattgccagattcctggggtcaaatctgtaataagaaccagagtttatctgtgtcattgaccgtgagttttgataaatgagttttgagaaaattcatacaaagctagcaaatgtaacaaagaacctagatccgttgcacaatgcttgttattactccacatgacttctcaaagaggaattagataacagccgtgctgagtaacacctacgaaatgttttattttttagcttggatgtctatgagatctccttctgagttactgtgtataggagaataattgtttggtttcttagggactccagtaaaacaacaaaacaatataagccactggaggggaagagtctaatgcataataaaaaccttagtcttttccgagctgtttgtaccagcatttcccttttcttgttaagagtgaaagtattttctccagtgagtgtcctggacaactggcatatttagaaatgtttcctgtgttcttcaggcacataacttcaaattttgttactttactaaattggacttttcttcacctactgcttttccatgttcagacaacacatgaagaacattgaacaaccaaaaattcactttaatagtcttttaatgcttgtcttccagtaatgccttgcttctctaagtagaggatccactttcctgttggaaagagtacttccctagaagtcctaaaacctgtattttaggttcacccttggcactcttattaaacattcatttagcctctctcggtcttgatttctttacttgtggtagactaatagatatagaaagaggttcttttatcctgttttcctgataagttcctaaattccataaatctacactttttgctcacacaaacttttatatatccttattcttatacaatatccacatttccatttctgtgcctaatagagttttgattcatcatggataatctgtcatcagaagaaattcaacagagagctcaccagattactgatgaggtaaatgttttacctaaaataagtaaataattctatttcagttttcatattggaggagtgagagagccttcttagggacattttggcctcttcctagtccattaatatcaaagaacacatttgctccttagtgccattgctggtttttattttctttttaactcaccagaaaactaaagtgaaaacaatttgtatgatttttattttttaggtaattattaatattacttaagtgtaacaaagatactctactatgtatttgagaaatgctagacttctatttaacaatttcctaatatctgtaatttacttagatttctacctacattaaatttttattcccatgaacttcaccatccaaatattctcttttttaaaaaaactttttctttcaacatcacactggaagtccttacacattttctcttaaggagcgcctgaaaataactaaaaatgtagtgatcaacttacttttttttttttttttttttttgagacggagtctcactctattgcccaggctggagtatagtgatgcgatctcggcttattgcaacctctgcctcctgtgttcaagcgattctcctgcctcagcctcctgagtagctgggattataggtgtgtgccaccacgcccagctaatttttgtatttttagtagagatggggtttcaccttgttgggcaggctggtctcaaacttctgacctcgtgatccgcccacctcagcctcccaaagtgctgggattataggcttgaaccaccacacccggccattgttttgttttaaagggaaggataggctggcaattctttttgttttttcctttaatggaaacagtctcactatgttgtctgggctggtcttgagctccggtactcaagaaatcctcctgcctcggcctcccaaagtgctgggattataggcatgagccactgtgcccggcctgagctggcaatttttaaagatagaatagcatcatgaatttggcctgtgatcagatttttttttctacatattttggaatgctaaaattctgtgttctttcctagtctctggaaagtacgaggagaatcctgggtttagccattgaggtaagaaaatgttagtcatcaacttaagtatagaaatttataggagcgatcctaatacttctggctggaattagtattaaagggtaatgtatcaatatgctttattatttgaaattaacagttgctgaaatgtcaaaccatgcactaatgggaattttctgtttttccctttaacagtattggaatatgacagggaagatgaattcactatgagtttgtgacttaattattttgggggctgctatgttaaagtgtgttagtttaagaatactagttctgtctgtagctctaatcctctgagagcttgggtttctaaattattctgtgttgctcttgtaggttttgtttctgttgtttttggtttgttttgttgtactatcagcttttccccccttgtcttagtctcaggatgcaggaatcaagaccatcactatgctggatgaacaaaagggtaagttaaattattagcagaaattcttaatttgactgtgatgccaaaaagccctatcaaattagccacatacaaatttcagcctttgggagagccttccctttgtaaaataagaatgttatgtttacttcttgtcttctgatttgaattatatatcatgttcactgtctatttgggatggcaggcaacaatgcccaattgtatataccaagtatgtgttaggccagcatggcttattttgtgtattggttatatgtgccttagacattatgatagtaacatagctgggattacaggcacctgccaccacacccaactatgtttttctttttttttggggtgggggacggagtttcgctatttttgtctagttttgggggtgggggatgaagtttcgctcttcttgcccaggctggagtgcaatggcgtgatcttggctcactgcaacctcctcctcctgggttcaagtgattctcctgcctcagcttcctgagtagctgagattactggtgcccaccaccacacccggctaagtttttgtatttttagtagagacggggttttaccatgttggccaggctggtctcgaactcctaacctcaggtgatccacccgccttgacctcccaaagtgctgggattacaggtgtgagccaccgtgccgggccttttgttttgttttgttttgtttttttaatttttattttttgagtcggagtcttactctgtcacccaggctcgagtgcagtggtgcaatcgtggcttactccaggatcctctacctcccacgttcaagtgattctcctggctcagcctcctgagttgctgggattacaggtgtccaccaccacacccagctaattttttgtgtttttagtagagatagggtttcaccatgttggccaggttgatgtcgaactcttgacttcaagagtcacttgatccgcccacgtcggcctcccgaagtgctgggattataggcgtgagccaccgtgtctggccagacattgtgatattcttacatcatcctcagaaatcaagttctaaaacagatctagattcaggtatgcttggaaacacttgagttgagttggccctgagtaatcaggtctagtttttattactcttataatagccctcaggttttgaacctattatagaaatgatggggatttgacctcgtcaaagtacccttaacttggttgtaaggatgatctctaaataaccgtcccttggtcctactatacaagattctttttttttttttttttttcgagcgggagtcccactctgtcatccaggctggagttcagtggtgcaatcgcagctcactgcaacctccaactgccgggttcaagcaattctcctgcctcagcctcccaggtagctaggattacggcacccatcaccacacccagctaatttttgtatttttagtagagatggggtttcaccatgttggccaggctggtcttgaattcctgacctcaggtcatcgcccacctcggcctcccaaagtgctgggatcacaggcgtgagccaccatacccagccatatacaagctttttagaacaaatttttccacagcaagaggctaggtgcctccggatcagtacgtgaaagattgttatcatgttgaatcgcttctaataccttttgacactgacatactcactgtggggagttattggtagattcaaggttgaagtttgctgttccataataatagcattttctggttgacactgtgaatggaacacaaagtgttaacttcacaacttattcttagaacaactaaaccgcatagaagaaggcttggaccaaataaataaggacatgagagagacagagaagactttaacagaactcaacaaatgctgtggcctttgtgtctgcccatgtaataggtgagttgataaattaagatggtttcaaaataagtaatgagagtaccccaccttctcccaccagctaaggtcagaagtatgactgggcttaatgaggaactctattagataaatctaagttgtctctccttcaggcagattaagctttttgtgtaaatactgcgtgttcactgaaaactgtgacttacatttgaccaatcctgggatcaagtccaatttcaatttgtagtaatacatgaaaaggttaggaagtatagggaaatgtatatctggatgatggaaagcaggatggagttattttcttttcctttcaaaggaggagtattaacaaaatatatattttgtggtaggcacatgagggatggccaaaagagtagaagagttgggaaagaatggcaaaacataaaaaatacataaatctaatgttagattatatgatagtgagcaaggctaaatctaatgttagattatatgatagtgaccaaggctaggtatacagaactgataaaggttgggttggagagcatcttatagaagaggtaggatgtggattgggctttgagtgataagaaggatttggatgaacagggaggaacagtgagggcatttcctatgaaaggttcaaaataaagattaacaaggagcttgacttaactgagctgtgtgactcatgtagatgagaagtggaaagtaagatataagtaggtagtagaggaacttgaatgccaaactaaggagttgacagattggagtggagtataaaaagaaacgacagtatctggagattgaatgactgtactcactgctgaaagttttgttttgttttttttctgagacagggtctctgttactgaggctggaatgcagtggcgtgatcacagctcactgcagcctctctttcctgggcacaagagatcctcccaccttggcctcccaaagtgctaggattacaggcatgagccactgcacacagccaaagtatccttttttttttgagacggagtctcactctgttaccaggctggaatgcagtggcgcagtctcagctcactgcaacctccgtctcctgggttcaagtgatttctcctgcctcagcctcccgagtagctgggactacaggcgcatgccaccacacccagctaatttttgtatttttagtagagacggggtttcactatgttggccaggatggtcttgatctcttgacctcatgatccgcccgccttaacctcctcaagtgctgggattacaggtgtgagccaccacacccggcctcaatgtattcatttttaaagaggttcttagacattaatatttcatccagttctcagctggtcttgtaaaccaacagcggttatatttttatattttcagtaagtgtttttatgaaacaacatttttatgccatttctgttatagaaagtagagattaattgcttgtcagtcaactttagtgtttgttttggccatgaggaaaggtttgacagtgttcttcctagtcttatccattggcttcctattctaacacaagtctgttgacctgtttacaccttggttgaccaactgaaagttctgtattttttgagacggagtctcgctctgtcacccaggctggagtgcagtggtgtgatctcggctcactgcaacttccacctcacgggttcaagtgattctcctgcctcagcctcccaagtagctgggattacaaatatgtgccaccatactcagctaatttttatatttttagtagagacagggtttcgccgtgttggccaggctggtctcaaactcctaacctcaggtgatctgcccgcctctgcctcccaaagtgcggggattacatgcgtgagccactgctcccggccaaaagttcatattttaataactatgacttgtcaatcagagtttagcagattactttaagcaaacaagttaaaatgtacagattatttgatacaaactcttagctatgttttacaaacataattgtacctttctcttgtgttccatgtaccttcttggaagagtacagaagagaggaagtagatgaattttcttgagatcagatgttaggagaacaaggagaaagaagtctcccctaaaatcttagaggaagatcagctctaagtcacgtgttgataaataggaagagcactgaattagacctaagatggtctaatatcatagaaagtgggaaatgcagctacagagtattaattttatgtctctttgtgtatcccagccaagcataggcaagcttttcttgaagactggtgggaaacaaggtagggtatggtcctgaatcagcattcttcagcctctaacctcagtagaaccctttctcagtggatcaagagaaggcattacttttttagagatggcctctccctctgtctcccgggcttgaatgcagtggtgccaccatagctcactgtagcctcaaacatctgggctcaagcaatccacccacatcagcctcccaagtagctaggattacaggtgtgtgccaccatgcccagctaatttttgaaattttttgtagagacaggggtcttgctatgttgcccaggcttgtatcaaactcctggcctcaagaaatcctcccacttcagcctcccaaagcactgggattacaggcttaagccactgcacccaactggcacttctttctttttttttttctggcacttcttgagagatggaatcaaggggctgctgtaacaaaacagttcccttaagagaagaaagtattatctcagttaaagatgtctgattgtaattgtctttcttccacctatttctttcttacaccattgagaccttggccagtatgatatctcttatcctcagctctgttcctatcattcttgcctgtgtcttgatctttctaatctgctagtctgtgtttcagttaggctcgtcacatgaataaccataacatgagcttcttaaaggtagacatgagatcttagtcctatgtgtaaggcctagtcttcataccagcagtagcagtaacaacccaggtcaggtccagagttccttatttgccatttggaaatactttttcttttctttctcttttttttttttttttttctcgagacagggtctcgctctgttacccaggctggagtgcagtggcagtcatggctcactgcagcctcaacctatcctccagcgtcagcctcctgagtagctgggattacaggcacatgccaccacacccagctaattttgtatcttttgtagagacaaggtttcaccatgttggccaggctggtcttgaacccttgggctcaggcagtctacccaccttggcctccagaagtgctgggattgcaggcatgagccattaagccctgctggccattcagaaatctaaaaaactcctaaagttttgttttatttttgctgtaatggtgccacaactcattagggtataaaatgtaacctgaactgaagctatgtttagtctttattacttgctgtagatattaattggtttcactacagaaatactctttttgagtcagggtctcactctgtcacccaggttggagtacagtggtatgatcttggctcactgcagcctcgacctcctaggttcaagtgatccccccacctcagcctcatgagtagctgggactacaggtgcatgtcaccatgcctggtttgtttttaaaaacttttgtttcttcttctttttttttttttttttgagacggagtctcactctgttgcccaggctagagtgcagtgatgcagtctcagttcactgcaacctctgcctcctaggttcaaccgattctcctgcctcagcctcccaaatagctgggattactggtgcctgccaccacgcccagctaatttttgtatttttagtagagatgggggttcaccatgttggccaggctggtcttgaactcctgacctcaggtgatccgcctgcctcggcctcccaaagtgctgggattacaagcatgagccaccatgcctgaccctgtttcttttcttttctttttcttttttttttttgagacagagttttacgttgtcacccagactggagtgcagtggtacaatctcggctcactgcaaccttcgcttcctgggttcaatcgattctcatgcctcaaccacccaagtagctgggattagaggcatgcaccaacaccttgctaactaatgtatttttagtagagacggggttttgccatgttggccaggatggtcttgaactcctgacctcaagtgatccacccacctcggcctcccaacgtgctggggttacaggcatgagccaccgtacctggactttaaaaagtttttgtagagatgagttctcactatgttgctcaggctggtctcaaactcctaagctcaagcaatcctcccacattggcctcccaaagtgctggtattacagaaatgagccaccacacgcaacgtcactacagaaatattaatgtatttaattatgtggtactgtccaaaacatcttgcccccaatggattggggtaacagttgtgggcctgtgcattaatttaaggtactattctgaacatgttaatttaatccttaaacagtagccttaatatgagatagatgttttttattattatcattttacatccaggctacactatgtagtggaagagctgggattcaaaaccaggcagaacccccttgcttttttttttttttttttttttttgagacagagtcttgctgtatcaccaggctggagtacagtggtgtgatctcagctcactgcaacccctgcctcccaggttcaagtgattctgctgcctcagcctcccgagtagctgggattacaggcgtgcaccaccacgcctggctaatttttgtatttttagtagagatgaggtttcaccatgttggtcaggctggtctcgaactcctgaccacgtgatccatccacctcggcctcccaaagtgctgggattacaggcgtgagccaccgcgcacagcccacaaatccttttttaaaatcacatatcttaggcagtaattgataaattgtaattctaattaacaagaatttgaaagcagacagatttaaaatgggaagtctcagaatagtaaactgcttgatgtcccagtttaaacattctttttttttatttttatttttttgagatggtgtctcgctctgttgcccaggctggagtgcagtggcacgatctcggctcactgcaagctccgcctcccgggttcacgccattctcctgcctcagcctctcgggtagctgggactacaggcgcccgccaccacacctggctaattttttgtatttttagtagagacggggtttcaccgtgttagccaggatggtctcgatctcctgacctcgtgatccgcccgccttggcctcccaaagtgttgggattacaggcgtgagccaccacacccggccttaaacattcttagataaggtattcttctgtcttaacttgcctgttttataaagtctaacaatggcacatagtttgaagacaaattggcatttctggaccacttactagagaagttccaaattggcactacaggtttactgctattccgatcttaagtcataccaaggtgtaaaaattcagctccgactaattaaaatgaatattgaattatatttcattcagtggtttagtgcttcttccatcctgctcactggagacacaaatatgagtaaggcatacctctggccctgcctgttttatttatcatgacatgattttttatacctcacatagtattggatatacagtagttactcaataaacacttgttgatttgagtgtccttgagaaacttgttggctggtgggagagtttgacgtgtaaaaagattttttaaaattacaatgaaaaaatatataagaaaataaaatacataatagaagtcattaagagaaatcttaatcactaagaggaaggagtctcaaagcactccattggtttttgccttctctcatattgtctaattttaggaaagaatatcatcacccaaaattctgaggaaaaatgaaatgtgctctggtttaaatagttttcttatttttctttttatctagattctcagatgttggttgtttctatgaaaccaggcaggaaattgaatgcattatgtttttaaaactttaaacctgcttctgttctgtttgactggcatttactattttctgcatttcattctctcacctaatctcttcctttctaatctgcttactaaaaatgaagatttaacatcagaagccgggctcagtaactgatcaaagggaactttaagatgcagtcttgtggcgcagtttgggctgctaacctgctatctaaaggtgatgcttcaaatggcttttctgtgcatgtgcatggattttgtgaatggtgaaaactgtctctaaactgtgtggtggtgtgtagtgtaaagtgaatttgttcttgatgggtgctatctcacaaaagatggacttgacaaaaggaccttaatttataataccatcctttgacaaatgtctctgataactaagtttttgctaaataacatttaagattaccaaaataacaatactcctggagtttcttaagaaatttaaaataggttgatctttgagacagctgctgcagtctagttctgataaaaggtaagggaagtcatgctaaatgcttctctgtcttcatagactttgattttagcatcctgtcttccattaagtttccctacttttttctggttcttgagtcaagatttcctctattaaagttttgcttctaatgattaggattacccatgatttaggccactaccaaattaaggaatcaattgccagtctagtcgtctcaaatcctatttggaacaaggtgggatataaaattttaaatgctaccatatctggtatcttctttccttaaataagggtttcccctctacatatgttataaactattctataattcctgttacatcatgtgttaacttgctgtgatttcatgttgaattaatacaaaactaactaatattaatttttcatgggaggtaagttttgtcagcttactgtttattattgtgtctgactcttaagtttagatctttatgagaattatgaacatgattaaatgttaaaaaattaagtatttgatttctaccctttgtttcctgccctccttttttcttcttttcttagtttgactatccaaagcatacacacactcacattcactctttattattagttaatagttatttggtcccttttctccttgatgtgaaatagtcacagctaatatttagttttatttttgctatttttaattcagttaaaactaatattgatgcaaccaaaactaaaaaaaaaaaaaaaaaaaagaaattatcgtttttgtgctcataccttgatatttacagttttatgcttgataccagcttcctgaattgactaagggatatttcagattcttacttaaaacttgcctttttttttttttttttttttgagacagagtctcgttctgtcccccaggctagagtatagtggctcagtctcagctcactgcaacctctgctcccaggttcaagcgattctcctgcctcagcctcacgagtaactgggattacaagcgtgcgccaccacacccggctaattttttgtatttttagtacagaataggtttcaccatgttggtcaggctggtcttgaactcctgacctcaagtaattcacccgccttggcctcccaaaatgctgaaattacaggcgtgagccacacacccgaaaacttgccatttttgaatgagacgtttaagtgggaaaaaaaaaaaaaaggttccagttaaagactattagaccactcagaactaacagtcagttgtaaatctaagtttctagatggagttctgaacttcattaaaatttatcacaaatttacttaggcattttatcatgaagactaatttcttcccagaggggctgtacattttattttcaagagtcctgtcacagattagaactattctttcttactgtagactaaaacaacctggtcctagtaatctttcatgtcacgatattccaactacattcatgtacctgtagatctcaaagccaagaaatggtaatggaccaaaaagtaaacatgccagttggtaacccatgcacttacaggcatgaactgttgactaaaggtcaggttgaagttgaagccaatgaatgaaaatatttatccagtgatttacaaagcagttttatgtctgttatcaacagaacattttacagccctgctaaacattaagtattgttattatcctagttttacgtacaaagaaagggatgctctgacactgaagtttgctcaagattctgtagcttctgaatgacatgcctaggattgggatttagttattttactccaaatgctgttacttttttgttttttgttttttgtttgtttgtttgtttgtttatttttagatggagtctcactctgtccctcaggctggagtacagtggcatgatctcagctcactgcaacctccgccttccgagttcaagtgattctcctgcctcagcctcccaagtagctgggattacaggcacctgccactgcgcctggctaattttttgtatttttagtagagacggggtttcaccatcttggccaggctggtcttgaactcctgacctcacgatccacccacctcggcctcccaaagtgctgggattacaggtgtgagccaccgcgcctggcttttttttgttttgttttaatcctgacatgtccctttgcttcttctagattaattatttagtgctccaatatatagactactagagtctataatagactaccagagtaatctaaagtactcctcctggatcgctaaatgtcccactgaccttatataaaacaacaacaaacgattcccaggctatactccatgtgtattggagtagaatcttcagagtgcagcctactatctatgtgttctacagcaggggccctcaacccccccagccatggaccactattggtccacggcctgttaacagaaactggtcctcatagcaggaggtgagcattattgcctgagctctgcctcctctcagatcagcagtggcattacattctcataggagcaagaaccctattgtgaactgtgcatgtgcgagatctagttgtacgctccttatgagaatctaactaatgcctgatgatctgaggtggaacaatttcatccccaaagcatcccctggtccccattcgtggaaaaatagtcttccatgaaactggttccccagtgccaaaaaggttggggactgctgaggtcactctgatactcagtcaagtttggaaggtattacctttaaagcatctaagaccctttggaaggaaagtaaattagtttaaaaacatatttatatttgtgaacattttttattttattaacttagataagcagctatctgacaatgccttaaaaacaggttccaacttggtggaggaaactccagggtgatggccagtaacagggtcttgagcaaccaaaaggcattacctagagtggacatgctgaatgagacgcactgaactgtcccaccaccccttcataaacacgcagaacatactataactgcaagaaaaacaagtagtttttttccccatcccatttgaaggtaaacatgccaacacaatgcaaagctgtaaaaaaattcaaagtcagctgggcgcggtagctcacttctgtaatcccagcactttgggaggccgaggcaggcggatcacgaggtcaggagatcgagaccatccctggctaacacggtgaaaccctgtctctactaaaaatacaaaaaattagccgggcgtggtggcaggcgcctgtagtcccagctattcgggaggctgaggcaggagaagggtgtgaacccgggaggcggagcttgcagtgagctgagatcgtgccactgcactccagcctgggcgatacagcgagactccgtctcaaaaaaaaaaaaaaaaattcaaagtcagctttttgtgtcttttccccttgttacagaaagaacatcttcaaagatccagtcttcttttttttttttttttttttttttttttttgagacggagtctcactctgtcaccaaggctgcagtgcagtggcacgatctgggctcactgcaacctctgcctcccaggttcaagtgattcttctgcctctgcctcctgagttgcggggactgcattcgagcgccaccacacccagctaagttttgtatttttagtagagacagggtttcaccatgttggccaggctggtctcgaactcctgacttcgtgatctgcctgcctcggcctcccaaagtgctggtattacaggtgtgaatcaccgcacccggccaagatccagtcattttaaagacagcagagtttgataaccaatctgattctttgtttatagactatgtttcaattaaaaatcattcacatgatcatttttaaacaattcatttgcattttatgcccttatatctaattgtggaaagaagaattctcataagtgtaaagaattttttcaaatattgcctcttaatgttgggaaggaggttggaatgcatatatattccttaatagaccagaacccaaggtcatgtcccagtccactcctctttttgtgctgtcagaaacataatatctcattagttactttggaatttcaaccttctctcttgcacctgttccacaatccgaaattctaataaaagccccacttctgttacttctgttaatatttgtggttattaactttctgataaactaatatattgcttttgttttatttactagcacttactctgctctagaattttgcctgggacctttcttattattaacaaagaatacatgtgaatatttattttaaaaatatatatcctaccttgttccaagaaaaatttaacatggcttcttaataaataaatgggttaattaataaaaacagcatagaaacataattatgataacttaaagtggtaccatgaaacacacttggagaactagctcttcagtgttcataaatttgcctttgcaatgcctctcacaaaaaaaaattagtagtatcctttctgtaatgttaatgataaagtctaagattcaattctaggtttgccgaaaatgaatcctcacatgcctattaaggaagaagtcacttttttcataaaatctcttccctacctttttaatttttgcaattttaaaacttccttattaatgtaaaatgtagaataaatcagagatcaatatttgagcaacatactatttcgtttttgtttatagaaaagtgaaaactaaaattgaatgaaagcttgactttagccaaataatcaagaaaagttttgtgtcacttttccgtaacagccatttttttttccctgtaatagccactttttctttctttttaagacacttagacttatgatttttttttttttttgagatggagtgtctcgctctgttgcccaggctggagtgcagtggtgtgatcttggctccttgcaacctccgcctcctgggttcaagcgattctcctgcctcagcctccccagtagctgggattataggcacgtggtgccacacccagctaatttttgtatttttagtagagatggggtttcaccatgttgcccaggctggtcttgaactcctgacctcaggtgatccacccaccttggcctcccaaagtgctgggattaccggtgtgagctactgtgcccggccttgatcgtttttttaaagaggaaactcttaaatgaaaaactcctacactacaggatttatgaatgaccgcttgtgtggtcaaggtacttatttgtccgctgattgtccaatttggaaattattcatgcctttctttcctgatggctggtttgtttgtaagaaaccattgtttaaaatttcatggaaaattctaataaaaactgatcagctggaactacgctggttcaaattcagtcttcttattttaaaattttatttatttatttaagattaggtctcactctgtcacccaggctggagtgcagtggcactatcatggctcactgcagcctcgaccttctgggctcaagcagtcctcccacctcagcctctcgagtagctgggaccacaggcgtgtgccaccacacccagctaatgtttgtatttttttatagagatggcattttgaggcagggagcagtggctcacgagcctgtagtcccagcactttgggaggccgaggtggatggatcacttgaggtcaggagtttgagagatgggtttttgctgtgttgccctggctgatcttaaactcctgagctcaagcgatccacccgccttggcctcccaaagtgctgggagtacaggcgtgagccactgcacccagcatcagccttcttattctgtcatcccttgtcaacctctgagatgccttcaaggaacctcttaaggtatcccagaacaccttttctaagggacctttttttaagtaatgtgcattaacctcttttctagatagtgctggatacactaggaagagaaaagcaaaacgatagtgccagaggctaagggaacctgaaaaatcaaatagttgccttttgctacttgctaacagcctagtgaagatttggtagaagtagtatttggacctttttaaaattttttttagtgtcaatgggtttacataattcatctatttcctattccatattgccatggagcatagtgtagatcatctagacttagctgtatgcagcttttctactagagttattagtgtcatcctcaaggtaacaggcactaataattagaactctccgtcttcttttttttggtatctccctacactcctgactcttatatagaacaaagaactttgagtctggcaaggcttataagacaacatggggagatggtggagaaaactcaccttgcaatgtagtatctaaacagccaggcccggtgacaaatggtcagcttcagcaaccaacaacgggagcagccagtggtggatacattaaacggtatgccaactcctcctgatattcctgtacctttcttaatgaatggttcacttaggagatgagtttagcagtacatgacccctaataaaacaaataaaaattgtatttattccatttttaaaatgcatttaaaaatctgcccactgacaaaatgtgggttttttttatttgttgttttgttttgagacagagtcttgctgtgttgcccaggctggagtgcagtggcgtgatctcagctcactgcaacctctgcctcccaggttcaagttattctcctgcctcagccttccgagtagctgggactacaggtgtgcgccaccacgcccagctaatttttgtatttttagtagagacagggtttcaccatgttgaccaggctggtcttggactcctgacctcaggtgatccacctgcctcggcctcccaaagtgctgggattacaggcataagctaccacacctggccagacaaaatgttgactgtggtggttgaccttgggtgatggaattaacttttctttatacttttcagtactttccaaattattgaactagacatattttacttttatatatagaaaaaaataggttttaaaatgtgtcatctagaacaagggtcagctagattcctgtaagaagatctgtaacgagccagagagttaatatttcagacttttcaggccatacagtcccttgcaattactcaactctgttgtagggttaaagcaggcataaacaatatgtaaacaaatgagcacagctgtgtttgaataacacttgatttacaaaatcatatggtggccagatttggtccttgggccgtagttttccaacctctctcttagggcagtgcttctttagatagacttaactgtgcattagaaccacttgaggggcttattaaaccgtaggtttctgggatgcacttacagtttctgattgagtaggtctggaatggagtgtgagaattagcattctcatgtctaacagcttcccaggtgatgctgggaattaagctttgagaaacactgtttcagagtttctttcttttcttacatggctttaagatactgtgctctctttgatgagtctcccagtttttattatagaatgtttcccaggaatggtaacctatattcttttggatcttatacttgctgagagtcattttggttacttacttttgtgaaaagtaaatccagacttttatttaaattcaacaaaacctatggaattaactgtcttcttgtgatagcataactaatgatgccagagaagatgaaatggaagagaacctgactcaagtgggcagtatcctgggaaatctaaaagacatggccctgaacataggcaatgagattgatgctcaaaatccacaaataaaacgaatcacagacaaggtaaaagctttttattgccacaagaaaatgagacacccagttcagtgtttcagtaatagacatctgtgctagatactgtgggggacacggtagaataagctcctgtcctcataggtcttaattctgatgaggtggtggttctaacacataaaacaagagccaagtcctccctgtcatggtagttggtgcattttgaaaccagagttttggaatatagtagttttacttaaaccttcacacatgaagcttagtatctactttagcttttgagcgtgtttttttctctcccaaatgagttttattttgttaactaattttttaattgagaatggggtcttgctctgtcgcctagggtagtgtggtggtacaatcacagctcactgcagcctgcctcctaggctaaagcgttcctcccacatcagcctattttgttaactaaaaataaattaagttcctgaatcctcatctcatgaaagagtccgtaggtgaaaatctgttctgcagaatagttcttatggagtggacacacgaaatagagtcatgtgagtgaaagaaagttgtgattcttttttttcccccttaactttacatgatataaatatagtgaaagcgaaattgttttcagtgttttgatgtgtcacatgtaaagtcataccttggccaaccgtggtagctcacacctgtaatctcaacactttgagaggcggaggcaggaggattgcttgagctcaggagtttgagaccagagcaagacctcgactctactaaaaaaatttaaaaattgaccaggcatggtggcatgtgcctattgtcccagttactcgggaggctgaggcagaaggattgcttgagtgtaggagttgaaggctgcagtgagctgtgattgcaccattgcattccagcctgggcaacagagtgagaccctttctcaaaaagaaaggaaaaaaagaaagtcatacctcattaaaatctcagtgaactttagggtgagtttttaagcttggctctctgttaaatcacttttgatggatttaattgaaacagtggttcacaagatgctttaaatgctgcagtctgggtttaggctatatttacctgtcattttaattcagatgttggtgaggatggtaatagattcgtttcaaagatctttggaaaggttatttcagtctctccaggttagacttagggtgtctgaatccagatgagattctatgattcagttcagaggactcacacaaggtccagatctttaacagagaagagcactctttcatatttcattgcatcaaaaaatgccattgattacaggatgcatcccagtttcaggcatgttaaactatgaaaaaatgcgttatagaatttatgaaatattggcaaggtcttatatgttacacctttgtcatgtttatataccaggggttttccaaatgaatttcatattctgttacttcttgcccaacatgagttttgtaatgtaacttcacgtggtttcttggattttcttggtgtgtcagttactccaagtgtaaaaagtttaatttttattagagttacttaccttgtaaagctgatatctttcttgtttttcaggctgacaccaacagagatcgtattgatattgccaatgccagagcaaagaaactcattgacagctaaagctactgctgttcttctttatcatttattcacttccgtagctcctccttgaaagttattaccttttcagagtttaagttttcggttccacgctcttctaattgggagataatatggaagaagggccagagcagttacagccctccttcttttttgttttctgttgagggccgactgctgctctgccttccttctagtattttctttctcaattcatacgcttagattggttttcatatgtcatgtttagtgttttcatcctcctcatatacttcagcaggttcttttgctttcaagatttggaagcattgccaaagacagccatgaagaaggaagctgtagaggtgttttttgttgttgtttatttttgcttttgtggttgagggaaggacaagagataagaggttgttacctcagtaaaaaccttcaggccacaaagcaaaaagttgcatagccacaacgaagatctagttggatatagtttttgatttaagttgcagttatagccaatttaggctaatgcttggttttggagcttttatacacaacgtttttgttaggcatcacagttttgcaacctctgctccaaagagaaaaatagaatgagttttctttcttttttttttttttggagtcagagtctcgctctcttgtccaggctggagtgcaatagcgcgatctgggctcactgcaacctccgcctccctggttcaagcaattctcctgccttgcctcctgagtagctgggattacaggcgtgtgtcaccacgctcggctaatttttgtatttttagtagagacagggtttcaccatgtcaagctggtcttggactcctgacgtcgtgatccacccgccttggcctcccaaagtactgggattacaggcgtgagccactgtgcctggctgagttttcttaaagtgagcttaatttctgaactcttagtgattcatatatgtacataaatctgtgatcccatttcttattgcaccattcaggaacactttatataaatgagtggctttttatttcatattattagtagtatcatggttccattacaggcctattaacatcatacattgtcattagtctttgaagaaaaaatatgtaaatatatatgtgtaacatgagaatttctctctaaagcagggcttaaaattttttggaaaagtttgacaaagcataccacatgaattcagatttacctcaatgctaagaattatgtttagttaggaaaaaggaaagtcattttgacctcaggtagaaaaatagattgctttgagttttatgtagctttagactttaaaaagttagaatttattctgtaactaaaaattatttgaaaaaattatgcctctggtttaattattggtgattacacactctttctcttacccttgtgtattgaactatgtccataatcaagttgatgtggatcctgaaaagtgttatgaacatctgattggtatttgtcacatttattttaaaattagcatctgaacacttcaaagctgtcagtgtgtattggtttcaccaataaccactgcttgatccttacaattaaattttttaactaac

SEQ ID NO: 37152 - DNA, 5869 bp, Homo sapiens
agaaattcccgggccctggcttcttggcgcgatggtgaggcactaggggcgaagcgaggcttgggctgctggagcgggaatgagggggcgccaagtggctccggaaactgggggaggttgtactggcctctccgcaaacacagtgtgtgcgggcgtgagggctgtgagtctggtagggaaaagtccaccactctcccgctcccgagacgggggcgggggtacggggcgggtaagacagagcaggccggccggcttagagtcccggtgcttccctggcggaaggaagggcccctgcctcccggggcaggaactagggcttgtctggagctgggagtcctttcaggtcttccccatccccaagaggacctcccaaggatacccccttccccagccctgccgtggggcttgtacaagaaggtgcttagaatcaggctcactcttccacactgttaggaagcccctccgctctttccagagccagaaagtagtagttttggggttgagacttatccatccatccatccaatccatccatccgtacgttctaagcgcctggtctataccatgaagtgtgctaggcactgggaggacttgagctgccaagggaaggggaaatcggaggcttgaattggagtcatagctaaggctccaggggcagagacctaactgcgccttgtgtgtagtgctaagggggcttcctaaggatgccatcaaacttaaaggcggatggatggcaggagctggctggctgaagtacagtttgtgtaccaggggtagggaggcaagggtgggagacgtgtgtcttcagacagggaacagcatgtgcagagacttcaggttagagagagtatggctccccaggaatggatgcatttcccatagctgggagagtatcatctgcaggttagggaaagatgaggctggacaagtagagaacaaatcttcctggctcttggatcaccacaatcaagataatgaacgtatccactggcctccataatttccttgtgtgaggggctattttaagaagtataatcaagaaaggctgttctggctgggtgcggtggctcatgcctgtaatcctagcactttgggagagtgaagagggtggatcacctgaggtcaggagttcgagaccagcatggccatggcactccagcctgggcaacagagggagactctgtcttatttttttattttttaaaaaaagaagggctggtctgatgtgtcacttaaaggatagcaagccactggccaggcgccgtggctcacgcctgtaatcccagcactttgggaggctgagggggacggatcacttgaggtcaggagttcaagaccagcctggctaacatagtgaaactctgtctctactaaaaatacaaaattagccgagtgtggtggcacatgcctgtaatcccagctacttgggaggctgaggcaggagaatcacttgaacctgggaagcggaggttgcagtgagccgaggtcgcgccattgcactccagcctggggaacaagagtgaaactgtctcaaaaaaaaaaaaaaaaggatagcaagccacacagagagtgcagcaggcatggaggcgggagcaaggctggtgtgccccagcagcagcagggaagctggagtggctggagttgtgtgggtatggggaagaggggagagagttcactcgtctctgtgaggcccaggactttgttttatcccatgctgtacccccagcacttagagtgggagctagcacagagaaggtgcttaattgatgtttgctgagcagatgaatgcctggagtagacctcagagcagggtttggtggcagggtgggtcagggagagagtttactcaacagcctggtgataggggagaacaagaggccagagggtatccatctatgtcggggaccaggggtccctggtgggcagcagtgtgggagacacacggatcctggccacacctcaggcctccctccagcctgattacctgcctccctcccttgcagaggttccggttctgtggtgatctggactgtcccgactgggtcctggcagaaatcagcacgctggccaagatggttgagtgcacagggtctagtctgggtggaggaggggtgttgggggtggggattgtgggtgtagaggatggtgaggtttctctggggctagggcctcagtgctctcagcctgtgctaccatgctttgtgaccttgatcagtggctggcctgctctgagccagtccccaggaaggaggggtgaggtttgccagcctggctgatgtaaggacttcccttccagtcctctgtgaagttgcggctgctctgcagccaggtactaaaggagctgctgggacaggggattgatgtgagtacaagatccagcaccccattgtcccatgaccttatgaccaccactgccctgaaactctgcactaggcccagggagacgggtgagccagcctctcaacctctctgggcacctcccttccttctttccagcctgtctgttccttatcgcaggatccaggctgggggtgaggggctggtgagcaggggcctggcaccccctgaaggtctcctttccccatagtatgagaagatcctgaagctcacggctgacgccaagtttggtgagtatcccgctgagtctataggccccaggcaaccctgggaacttggcctggtgcctggtacagaggggccccccacccctcccagcagcatccttaacttaccttccctagtggaggagcatgagggaaagaaagaccgacagtcccaccttcctgtcctctgccagctcctggtggagcagtagcagtgcctgtggctccaggaggcctgggggctttgagctaaagttaatagggcaacagggaggtggctggacccacagtgacaccccctgccccacccacgggtccctcagagtcaggcgatgtgaaggccacagtggcagtgctgagtttcatcctctccagtgcggccaagcacagtgtcgatggcgaatccttgtccagtgaactgcagcagctggggctgcccaaaggtacgggttgtgggtgggcagctgggcagcctgtgggccaagggctgctagagaaggggacaggccctgtgaccctgaggtgtacctgccctgtctgggccaggagcccaagccaggccccgacatgctacctccagagctactccattctacccccagagcacgcggccagcctgtgccgctgttatgaggagaagcaaagccccttgcagaagcacttgcgggtctgcagcctacgcagtaagtatgaggccagccagggtccgggctcattctagaaggtgcacgcagcacacaaagtgcatggagagtccagggagacgacttaaccacggtcacatggttactagcagccgtagagctgggacctggccctgggtctcctgactccccacaaggtttcttgtcactgaggtctgctgtgggtgatcagaactgattatcgggcacctgccctgttctgagcctgggtcagcaggatgggagcttcttagaggccacatagccttgaatggttgagagctgagccagggtgtcggctgaggtctacttggcttgcctgctttgatcctgagagccacccaccccatctcacagtgaataggttggcaggtgtgggctggcgggtggactacaccctgagctccagcctgctgcaatccgtggaagagcccatggtgcacctgcggctggaggtggcagctgccccagggaccccagcccagcctgttgccatgtccctctcagcagacaagttccaggtcctcctggcaggtgaggctcagctattcctcgacgggtgagaggctctcccagatccgcctgactgcctcccacctgcccacctcttccctctgcagaactgaagcaggcccagaccctgatgagctccctgggctgaggagaagggtgttccaggcctgtgtggagccgccctgcccgtatggagtcacgccctctgaactgctcttcgggaggcagccctggttctaggatgctgaggccctggcccggactctggcctcccagatccccagctgcctcacttctctcttgagaacttggctcagggctcctgaggacctttcccagcattaccttcccttcccttgaaaggcaattgttggctgttttcataagcaggaaaaataaacagaagtataaaggaatgtgtgcagggggttctgtttgggttcagatcaagggtttttgtgagagaaacacaagtgacatacaggccttcttggtccatcactcattttcttttctcaattgctgattgagggaggtcataggtaaggccaactgaggaccaaaatgcatctgcttgtctggtgagaagaaaatcagggttctagctcccagatctgggatgctcttggctctgctgtctttgccccctggccatgtcctcaggctagcagcacgttggtggccccaaagccaaatgccccttgtacagaaaggagattgcccttgtttcactgccatcttctatttatttatttatttatttagagacggagtttcgctcctcttgcccaggtttcactgccatcttgttatttatttattttgagatggtacagtggcgtgatcttggctcaccacaacctctgcctcctgggttcaagcaattcttctgcctcagctgcccgagtaggtgggattacaggcatgccccactactcccggctaattttgtttttttttttttttttcagtagagatgaggtttctccatgttggtcaggctggtctcgaactcctgacctcaggtgatccacccaccttgccctcccaaagtgctgggattacaggcgtaagccactgcgcccagccactgccatcatctttaggaagagagaagtgaccatgcctgaaccagtcattggcaagaggaacggtgttatggactgaatgttcatgttcctccagaattcatatgctgaagcctctgtccacacatgcacaccagatgagggccatgtgcgcacacgaggtggctgtctacaaggccagaaagagggctgtcaacaggaactgcgtctgctggcaccttgatcttgaacttcccagcctccagaactgtgagaaagaaatctctatggtgtaagccactagtctgtggcattgttatagcagctcgagaagactaaggcagatgggcttccaggactggcccagaccagccagggctccttgtagaaaaggctgatgccagggttggcacatggagggtacaaggaggactcgcctggagtatcttaaggaacctatcgaagaataatggcttgttccactggccaaagatgggacaatttgaacatcaaaagagatacttactgactccactcctgacttctgcttctgaaaaaatgaagtaggtgttttccctattcctcccactaagtacagttaacaaccctggatgttacatataaaacaaacaaaaagactccgagcgatggagagaaggcaccctagcctggctgggatcctcaggacctgaggctccacagagagaaattcctggaatctggaccccatggcccagtcaggttacacaaaactgatcatcacagatctgtagaactatacaaaagtgctaacattcatgattagggtctcagaaggtaaggaggaagagagtggaatggaaaaagtattcaaaaaaataatcactaaaggccaggtgcagtggcccatgcctgtaatcccagcactttgggaggtgggacaattgctttagaccttgcaactggcctgagcaacacagggagactcagtttctccaaaaaaataaaaaattagccgatcatg

SEQ ID NO: 37153 - DNA, 95846 bp, Homo sapiens
ggcagtctcagcgcgcctgcgccgagcggccctgcgcgcagtgaggcagtggcgggggaaggcaccggtggggccgacgggcgggttgaaggagggaagcgggcgagcgaagtcccagtgcgcgccgcggcagcccgggcaccctccccttccgggcgtgagtcgctgtgaaaagagctgaagcgagcggactcgcaccggcagcgaggcgccgctcccgccgcctcagcccggccttcctcggctccggcgctccggtcgcggggcccgggttcctcggcacaccccgctccagccgcccccagagcctgtccccagcccttcggaagccccggcgccagcccgggccctcggcagggaggatgacggagctgcagtcggcactgctactgcgaagacagctggcaggtgagcaggcgggcggcggggcgccgggcccggccgcgatcgcggacagccgcagcccagtccctcttctcctcccgggccagcggccgtactgccgaaggggcccgggcctgcgagggtggggacctcgaggctccggtcccggccgggcccagccgttctcgcccggctcttggagggcactgggggcggggacgcgacccagctccggcccagggactgggcctggcgcccggggggtcggagaggaggaggtcccctcccccaccgttctgtaggacgttgcgggggaggggctgtgtgcgggtccccaggccggggccgccagcttggaggggcgggtcccgggttcaggtgctgccggggccgccggaccttcggggccggctggagcgtccggacccagtgcggctgcgagtccccggctcggtgtctgagggcgggcggaagggaccggccctggcgggataggtgaggcgcacaaaacttctccccgggcggcgctgggtccgcggagttggggccgacaacaaaagcgctggcctcggcggcctccacgcgggcgcgagggtgccggagaccctggcggagtgcggatcgccgcctcgcctgcctccgcctggcacgggctccggctgcgccgcccggctgggggagggtaggagcgggccgcggggagagccgctcgctggccggctccgggctttgtgctcgccgcgattccggctgctgcgcaggcctgcaaaccccggagctgcgcccgcaggctctggcccggggcggcggccgggtcggcctccccgaggagcctgcggcccccctcccccattgtcccggcctccggccgtttgcggcttccaggttgactttttagggggttggctcctactctgctaggactgtgtgcgcggagcatgcgcagtggagacgtccgtgtgcggagtggaaggggggaggcgggttggtggcttcacaatgcagccccacgtgctgccagatttaaagagaaatgaaccagcacttacccctgctgtacaacacccggcgtgtgtcattctcagttcaagcgatcttccccctacccactctaaaaccagtagcctctagccctcagcagaagccaaagactggagtgatgaaatctgtttttgaaatacatttactaagagtttgaggtgttcgttaaatcacctttatggcttcttaaggaaaaggttgtcaggggttcttacagattgtataattgggtttattattagaccatgagcaagcaggtttggacaagtattaaagttctagatgctcagggggagttagcttgcagtaaatggagaagttctaatgatactacaggatactcataaaaattatgtgctggaaaagcactgaggccgggcgcgctggctcacgcctgtaatcccagcacttcgggaggccgaggctggcggatcaccttaggacaggagttcagggccagcctggccaaagtggtgaaacccccgtcactactaaaaatacaaaaaattattcgggcgtggcggagggcgcctgtaatcccagctactcaggaggctgaggcgggagaattgcttgaacgcgggaggcatcgttgcagtgagctgagatcgcgccattgctttccagcctgggcaacagagcgagactctgttcaaaaaaaagaagggccgggcgcggtggctcacacctgtaatcccagcactttgggaggccgaggcgggcggatcacgaggtcaggagatcgagaccatcctggctaacacggggaaaccctttctctactaaaaatccaaaaattagccgggcgtggtggcgggcgcctgtagtcccagctaatcgggaggctgaggcaggagaatggcgtgaacccgggaggcggatgtgcagtgagccgagatggcgccactgcactccagcctgggcgacagagcgagactgtgtctcaaaaaaaaaaaaaaagaactttattgcatttttttttttttttttgaggcagagtctcactctattgcccaggctggagtggagttgcgcgatctcggctcactgcaacctctgcctcctgggttcaagtgattctcctgcctcagcctcccgagtagctgggattacaggcgcgcggcaccaagcttggctaattttttgtatttttagtagagatgggattttaccgtgctggctaggctggtcttgaactcctgacctggtgatccgcctgcctgggcctcccaaagtattgggattacaggcgtgagccaccgtgcccgtctgcatctttttttttttttttttttttttttttgagacggagtcttactctgttgcccagctggagtgcagtggcgcaatctcggctcactgcaagctccgcctcccgggttcacgccattcccctgcctgagcttcccgagtagctgggactacaggcgcccgccaccacgcccggctaattttttgtattttcagtagagacggggtttcactgtgttagccaggatggtcttgatctcctgacctcgtgatccgcccgtctcagcctcccaaagtgctgggattacagacgtgagccaccgggcccggcctctctgaattcttacataatggaaaagataaacatttaaaaggtgtgaaagaagttatgcattactaagaaagtaaaataagataacaatgtcagcagcagcaatgtgtgaaaggatttcctatccgtttgtgaaccagctctagattttgatggtcatctggttccgttttgcacttttttttgacaatgtatatagcaaatattaataaaacgtcccaaagctctttcttaatgattgactttctgatggggcatactaaaatacactttaagatagaggagagaacaatttaatttgtattttttcaggcctcattgtaaagttacttagctgcagatttaagttttcctgccttcttgatcagaaacaatgggattgtttttaatttttttttaaaatttgaagcatgttaattaacatgctcaaaatgtacaaagtagtagggcaaggcaaatgaattttaattgaaatgtaaacatatcaaatttattggaaagattcgataactacacacagtgaaataaaagccttgttttattttatttttgagacagagttttactttgttgcccaaactggggtgcagtggcgagatcttggctgacgacaacttctgcctctgggttcaagtgattctcctgcctcggcctcagagttgctgggattacagaagccctccactgtgtctggccaatttttgtatttttagtagagacagggtttcaccatgttggccaggctggtctcgaactcctgacttcaggtgatccacccacctcggcctcccaaagtgctggaattacaagtgtgagccaccaccacctttcacccagactggagcgcagtgacataatctcagttcactgcaacctccgcctcccaggttcaagcgattctgctgccccctgcggcccccagtagctgagattacaggcatgtactaccacgccaggctaatttttgtataaaatttccaaaaacttaaaacaacaatggctacatttattgaacctctagtctgtcaatccttaaggatttaaattaattacttggtagaatatatcgggtatgttttgttgataacataatgaagaatctggttactttcagaattgaacaaaatggttccttgggttgtggagtgtctcagtcttggcgctactgacgttttgggttgagtattgttgtagggcctattctgtgcattatagatagaatgttcagcagcattcgtggccttcacccactagatgccagtagcatactcccttagttgtgacaaccataaatgtctccattgccaaatgtctcctgagggacaaaatcatcccagattgaagattactgagttaaaatgtttcagagaagaccattatggctaattgttaagcaaataaagacacctaacagattcatgaaatcagataggttgtgtatttctctgtggatattattagactatgacttactcctttgcaaattgagcggtggcaattcaagttttgcagtgccttatgttaaacactaaaaaatccctcagcacaggagatacttttaaaacattttatcttttgaaaaggtattataagcattggttaaaaatgcaaagagtacaaaaaaacatagtcttttcaccctggccataagttctttttgtggaagcaacccatcattgacaaatatgtcttttttttttttttttttttttgagacagtcttgctctgtcgcccaggctggattgcagtggcccaggctggaatgcagtggcacgatctccgctaagtgcaacctccgcctcgcgggttcaagcgtttcttgtgcctcagcctcccaagtagctgggattacaggtgtgtgccacgatgcccaggcttattttttgtatttttagtagagacagggtttttgccatgttggccaggctggtcttgaactcctgatctcaggtgattcacccgcctcagcttacgaaagtgctggaattacaggcatgagccatcatgcctggctgacaaatgtgtcttttcagagaggttcttgtatgtatgtttatataggctaacgtttactgaggactaacatgtaccaggcactgtgctgagtactttatatatttattttattttatttttatttttttgagacggagtctcactctgtcacccaggctggagtgcagtggtataatctcagctcactgcaatctctccctcctggattcaagggattatcttgcctcagtctctgtagtagctgggcttacaggtgctggccaccatgcccagctaatttttgtatttttagtagagatggggtttcaccatgttggccaggctggtcttgaactcctgacctcaagtgatctgcccaccttggcctcccaaagtgctgggattactggcgtgagccaccacccctggcctctattgcattttttttttcccaacacagagtcttgttctgtcacccagtctggagtgcagtggtgcgatcttggttcactgcaacctccgcctcctgagttcaagtgattctcctgctttagcctcccaagtagctgagattacaggtgtccaccaccacgcccagctaatttttgtagttttagttgagacagggtttcgccgtggtggccaggccgatcttgaactcctgacctcaggtgatctgcccaccttggccttccaaagtggtgggatttacaggcaggagccactgcgcccagcccgtctattgcatagatgtatattttttgagacggagcttcactcttgttgcccaggctgtagtgcaatggcatgatctaggctcaccacaacctccgcctccccaggttcaagtgattctcctacctcagcctccccagtagctgggattacaggcatgtgccactacacctggctaattttgtatttttagtagagatggggtttctccatgttggtcaggctggtcttgaactcccggtcttaggcgatctgcccgcctcagcctcccaaagtgctgggattacaggcgtgagccactgcgccgggccagttttattatatagtttgttaatacacattatatgttgtgatatttccatatatagttgtgaaattaggtgcatttatcattatttaatagagtggatctagggtggaaaatctgataatccagtgactatcattatattgttgccttttgacttccttttctcaggtgaagaatgtttgattgcactgtcaagatgagtttcaatccttcgcctcttttggtcttgggtacttcagtacaatttttttgttggcaggagggtacagtgtgggcattcctttgctttaagcaagtaaagtattaattaagcactcttttaatgagatcagtttgatttaggataaataatttggcatttcttaattattgaaaccttttttttagatttaaatttttgttagaatttagatgacctctaagggtgtgtctaatgttacctttcattggtttgtaggaaataacttttcagagaaggaagtgtgggcttatggaaacaaatctggcaaggtaaacatagtgtagttttatatggttaatagcatttcaggtacagaaaagtacaaatcagaaaaagcaaacattttccaaattttggtaatgaatatgaattattggtataaacagataaatgataaagaataaaatgtagtttcaggaaataagatatttaaatgttacaataaaacattctaaactttttccccctagtgcaagatagtattgggctaatttgagttaatcagcagtttttttttgtttgttttttttttttttttgagatggagccttgttctgtcgcccaggctggagtatagtggcgagatcttggctcactgcagcctctgcctcccgggttcaagtgattctcctgcctcagccttctgagtagctgggactacaggcacacgccaccacccctggatcatttttgtatttttagtagagatggagtttcaccatgttggccaggatggtctccttggcctgccttggcctcccaaagtgttgggattacaggcgtgagccatcgcgcccggtctaatcagaagtttttatcagtgctgttccattgatagattctggccctcatagaaacttctggaagaaatactgtactgtattgctgttgctgtagagatgtatacctctttttataaagttatgttctagatttgcaacaagttaatttttgtaagcggaaatattttattttaccttttatttaacctttatacccatgtccagtgacttagaaaaactgctattgctgtatctttgctttttttcctttagctattcttatttactcttctattggctagggatatgttaaaaatacaaaaaacaaagaccttaaatttttacctggcagctgtttgttgtttgtttgctttaatcttgtaaaacaagactgcttttaagtaagtttatcaaataggaatttttaaaaaagttctttatgtcaggagacacttttccttttatcaaataggaatttttaaaaaagttctttatgtcaggagacacttttcctttgcttttgaatgtacatgcattttaattacattatcatattcttatgtaaggtatatattttctagggtttctatgttaagacagagtaatgctaggcaaagagttctttttccttttttttttttaattttatttttttgagatggagtttcgctcttgttgcccaggcttaagtgcagtggcacgatctcggctcaccgcaacttcttgccacctgggttcaagcgattctcccactgcagcctcccgagtagctgagattacaggcatgggccaccacacccagctaattttgtatttttaatagagacagggtttctctatattagtcaggctggtcttgaactcctgacctcaggtgatccacctgcttcagcctcccaaagtgctgggattacaggcgtgagccacgcgcccagccaagttctttttcaacttgatgccaaaagcatgagccataaaaggaaatattagtaaactggacatcatgaaaattaagaatttttacctgattaaagactgttaagaggatgcaaagacaagctacaaactggaagaacatttgcaaatcacatatctggcaactgattgtatctagaatatttaaagaaccctcaacagtttaaaaaaaaaaagtcaattcaaaaaaatgggcaaaattagacaggtgtggtggctctcatctgtagtttcagctactagggaggcttgaataggagcatcgcttgagatggggattttgaggcggcagtgagctgtgacttcaccaccgctacactccagcctgggccacagagcaaggccctgcctaaaaaataagggcaaaagacaccaagaaacatttcactgaagaggacatacaaatagcaaacaagtgacaacatgttcaacattattagacatcagggaaatgcaaattgaaatcaccgtaagatatcactacttacctgttagaatagttaaaattaaaaaaactgtaacactaaatgctgccagggacttggagaaacttgaacttttatacattgctggtgggaatgtataattgtatatccactatagatagaaaacagcttgcttttttttttcttttttaagagacagggtctctctctctttgtgtctacatatatcttttaaaaattttttataaaaatagagatggggtcttgctgtgttgcccaggctggttttgaactcctgggctcaagcagtcctcctgtcttggcctcccagaatgttgggattacaggtgtgagccaccacatccagtctattttttttgttttttttgagacagagttccgctcttgttgcccaggctggagtgcagtggtgggatcttggctagattgtccttctttatgggtggtcttggcacctttgtataaaattcttgaaatgacagaattacagtgatggagaatagtggtgttcagggatttagggacatgagggatatgtggtatacagtaacatgagggatctttgtggtgatgaacagtcttgtatcttgatagtgattacacacatctgcaaatgtgataaaattgcatagagttatacacccaccccccccccccacacacacacacacacaaccgagtgatgacatctgaatacagtagtcctcccttatctgcatgggataaatactttccaagacctccaggggatgcctgaaaccactgatagtcctgaaccttgtgctttctcctatatatgcatacctatgataggatttaatttatgttagtctaacaacaataataacacagagcaatgataacaatatgccggcattactactcttgcactctggggccattattaagtaaaataagggttacttgaaaccaggcactgctaagtgataggcaggagggacagtgtgagatttcatcatgctacttagaacaacacaaaatttacaacttaggaattgtttattttttctgttattttccatttaatattttcagactgggcttgaccacaagtaattgaaaatgccgatggggcaggggtggggggactataaagtatatggattgcaccactgtcgatttcttgggtttgatattgtgctagagttatacagggtgttagcatttgggagaaactgggtaaaggttacaggaaacctttctgtacagttcccccttgtcctatgggactgtatttcagaataagaagtttttaaaaaaagtcacctgtaaccatgcattattatcaatcctttttcaaataaagaacttaatatttgtagttataaatacaactacatggttgctctattaacatgttcaaggaacaggaagttgaaatagagaaacctgtagtttaagacagaaattccgtcttaattttatttttttgttattatttttgagacaaagtcttgctgtgttgctcaggctggtcttgaactcctggactcaagcaatcctcttggcttggcctcccagagtgctgggattacaggcatgagccaccacgcacagctaccatcctaattttaaatagcagtcttcatttaaacttgtgtggttgcttggaaaatggaataaaggatcagcataaaagtttatttattgagcccttatatgccgttgtattgagatgctgcgggaacgcaaaggtaattgatgtgatatccctaccttgaggtgctacatttagtagcactatgtaaacaacgttttttatttatttatttatttaattttttttttgagacagtttcgctcttgtcgcccaggctgaagtgcagtagcaccatctcggctcactgcaacctctgcctcctgggttcaagcgattctcctgcctcagcctcccgagtagctggggttacaggcgtgtgccaccaggcacagctagttttttgtattttttagtagagacggggtttctccacgttggtcaggctgttctcgaactcctgacctcaggtgatctgcccgcttcagcctcccaaagtgctgggattacaggcgtaagccaccgtgcctggccttttttttttttttttttttttttaaagtgaaacaagtttattaagaaagtaaaggaataaagactggctactctgccaggtgcagtggctctcgtctgtaatcccagtactttgggaggccgaggcgggcggatcacctgaggttgggagtttgagaccagcctgaccaacatggagaaaccccatctctactagaaatacaaaattagctgggtgtggtggtgcacacctgtaatcccagctactcaggaggctgaggcgggagaatcgcttgaacccgcgaggtggaggttgcagcgagctgagatcatgccactgcactccagcctggggaacaagaaattccgtctcagaaaaaaaaaaaaagaatggctactccataggcagagcagccagtagtaaatgaattttttttttcttttttttttttgagatggagtttcactcttgttgcccaggctggagtgtagtggcacgatctcagcccaccgcaacctcggcctcccaggttcaagcgattctcccgcctcagcctcagaagtagctgggactacaggcgtgtgccaccacaaccggctaatttttgtatttttagtagaaatgttgtttcaccatgctggccatggctagtcttaaactcctgacctcaggtgatacacccgcctcggcctcccaaagtgctgggattataggcttgagccatcgctcccagccagtaaatgaatttctaaggaaatagtctggcaggccgggcttagtgactcatgcctgtaatcccagagtgactcacgcctgtaatcccagaactttgggaggccgaggcaggtggatcacctgaggtcaggagtttgagataagccatggccaacatggtgaaaccccatttctactaagaatacaaaaattagctggtcgtggttgcacatgcctgtagtcccagttgcttgtgaggcaaatcacatcaaatctttgttttgttttgagacagggtcttgctctgttgtccggactagagtgcagtggcaacatcaaggcccgctgcaccctccacttcctcggctcaagcaatcctcctccctccctccctatagctgggactataggcatgcaccaccacacctggctaatttttccttttgataaagtcttgctctgtcacccaggctggagtgcagggatgtgatgatggcctactgcagcctcaatctcccagacccaagtgaacctcccaccttatctgcctccgtagctgggactacaggcacgcgccaccatgctcagcaaattaaaaaaaatttttttttggtagagacagggttttgccacgttgcccaggctggtcttgaactactgggttcaagcaatcctcccaccttgaaccatgtgtcaaatctttgccccagccaaatatttgaagaaaataaagaaattgggtaatttctccaatctaaccctcctaaatgctgatggagctggctagtagaaacagttttattttctgataaaactcgagccctttccttctcagccttctcagagtttattttttttcttttgggagttcttagtttcctttgagaatctagcaagagttaaaagacctcctgagaaaagcacacatgcataatttggtatgtaatttcggagggttctttgatctgtggagtgaagctcatttatgcagatctaatgctgtctcttaaatcagcaagtttgatgcccattttgtgtactattgggatgctgttttggtgtttcaggaacttgtagtctgtagaaaaataaaagttccataatacagctgctttagggttgttattacagaaaaagtcaagagaagctggcttctaccagtctggttcatggagggctttgaggaggagttcatggcacttgtgcttgacctttaaaagatctgtcaaatttgacacacagaaaaaggaaaatatttaaggctgagggaaaagaacaagcaagacaaagtttatgctgaaagaagttgtgtagttggagtatatgataaactgaactagtgggaaaactatctggaaaggttgacgtttgtggaagaccttaaaaatgctggggtaggccaggtgcagtgactcacacctgtaatcccagcactttgggaggccaaggcaggagaatctcttgaacccagaaggcagaggttgcagtgagctgagatcacgccactgcattccagcctgggtgactgagtgagactctgtctcaaaaaaaaaaaaaaaaaaaaaaatttgaccgggcacggtggctcacgcctgtattcccagcactttgggaggccgaggcaggtggatcacgaggtcaggagatcgagaccatcctggccaacacagtgaaacccgtctctactaaaaatacaaaaattagccgggtgtggtggcacgtgcctgtagtgccagctactcgggaggctgaggcaagagaatcgcttgaacccaggtgttcaagaacctcttgaaccgaggttgcagtgagccaagatcgccactacactccagcctggtgacagaacaagactctgtctaaaaaaaaaaaaatgctggggtgtgacattatatgtgtgtgtgtgtgtgtgtgtgtatatatatatatatcaacgaaactctatatatatatggggtttcgttgatcgacactagtttatattagttggtaatacaatatagctacttcaccacaatattatacacattcttcccccttcttacatatttttcttttccatttacttgtttaagcaagtgacacttgttgagacaccttcagtgtctcatcaaggtccttatttttctttcaaagtttttgttgttgttgttgttgttttcgagatggagtctcactctgtcgcccaggctggagtgcagtggcgtgatctcggctcaccgcagcctccgcctcctgggttcaagcaattctcctgcctcaacctcctgggtacgtgggactacaggcgcccgccaccacacctggctaattttttgtatttttagtagagacggggtttcactgtgttggccaggatggtctcgatctcctgacctcgtgatccgtccgtctcaccctcctaaagtgctgggattacaggcgtgagccagtgtacccggccacacccggctgatttttgtattttagtagagacggggtttctccgtgttgcccaggctgatcttgaactcctgagctcaggcagtctgcccgcctcggcctcccaaagtgctgggattacaggggtgagccaccatgcccggcctcatacaaaatatttttgaatgagctggattcaaacattttctctgtaggaatggtgaaaatgtcattatcaggaaaatgatctagctgtattatctataatacagccaccacgcccacccctgaagtattttctttaatgaacaactctgtcatgactatagcttttctgtataatttaaaaaattactacaaaaattaacattgttttcttcttggcttttcctcccacatctctgaagttcctgtctggtcctctgccctagcagccttaaatttcctacccagctttctgaccgtagtttccaaaagagaatactaagtttcacttatttgcaatagcagaaccaagacagctagacttcattaatcttcaaacttgtcatttaacaaagtttaggcctggtgcagtggctcacgcctgtaatcccagcactttgggagactaagacaggaggatcgcttgagcccgggagttggaggctgcagtgagccatgagtgcatcactgccctccagcctggttgacacagcaagaccccctcttagaaaaacaatgtttaaattagatctacatagagaatgaatataaaattaatgttgatacgatgatcccttttctacttaggtcctggggagcctgtggggtcatatgatcctttgattttgtcactttttttgaggatgtgtcaaatatatttaaaagacggagtttcaccatgttggccaggctggtctctaactcctcacctcacccgcctcagcctttcgaagtgctgggattgcaggcgtgagccactgcacctggccaagaccaccgcattttataccactgcacactgtctgttaaactctgaagtctttgtaacttttggaaggggaactaataactattggtgatggccgcatctggtattttgagtctgtttgccatcttttgggctttaggattctaaaactaaattacttatttaaggtttatatagagagaggagtgttattccgaggtcttccttgatactctttcaccctaggtaaacagaggattgtatttccctatttttttgtatttagcagtgcgtaaggtttatattatcctcattagtactttaggctgtgctaatttcttttttctgttcattcttttttcttcttttacttggcactgacaaagctcagaataatttctgattttcagactgctgtgaacatttatggtatgatagttcccctaggaaaatactgtatttttgctatcttctctggttatttctacatctctcccttaggatgacacctttgctcttcttctgccctgagcatttgccaaatggatacaacaaaattctcgttatccagtttggtttatatttaactcttgcaggtgcagcagtggcacagacgagggtattgtgttgcctgctaccctcttcagcctctaagccatatggcatggctattggggaagcaatatgactgtgataggatttttgtttttaaataaacctttttagaagagtttcagatacacagaagaactgtgagaatagtacagtgagttcttacataccctgcattcagtttctcttatttttaacctttcccccaccccccagcccccgtgagacagtctccctctgtcagccaggctcactgcaacctctgcctcctgggcagaggtgattctcctgtctcagagtcccgagtagctgggattacaggcacgcaccactacacctggctaaattttttttttttttttttgacgaagtcttgctctgtcgcccaggctggagtgcagtggtgagatctcgggtcactgcaagctctgcctcccgagttcacgccattctcctgcctcagcctcccgagtagctgggactacaggcgcctgccaccatgcccggctagtttttttgtatttttagtagaggcggggtttcaccatgttagccaggatggtctcgacctcctgacctcgtgatctgccctcctcggcctcccaaagtgctgggattacagacgtgagccaacacgtccagcctcatactatttttaaatgagctggattcaaacattttctctgttggaatggcgaagacatcattatcaggaaaatgatatagctgcatcatctaagagtgatttaaatagataaattataacctaaataattacgtctaagttgctgggtgcacatttttacaattagtttaatttggagactgacactgttcagagccagatgttctctgaattctttattatttattttgaaatgttcaaggtgatacttagttttaactgccttgacagtgttcttttttgttttttttgagacagggtcttgctctgttgcccaggctggagtgcagtggcacaatctcagcttactgcagcctctgcctcccaggttcaagcaattctcccacctcagccacctgagtagctgggattacaggcgcaccaccatgctcagctaatttttgtatttttggtagagacgaggtttcaccatgttggccaggctggtcctaaactcctgacctcaggtgatccacccttctcagcctcccaaagtgctgggaatacaggtgtgagttaccacgcctggccaacaatgttctaagttagttacattagccataatatgtaagatagaaatttgctcatttgtatataagaagattctgaaaaagttttaagcgctgggtgcagtgacttaacttctgtaatcccaacattttgggaggccgaggcaggaggattgcttgagtccaggagttttgagaccagcctgagcaagatggtgaggtcccctctctcccactttgaataggtatgctataagtaacaggcctttgaaactcattttgggtattgtgaagatgttatattacagtgtccttttatttatttaatttgaggttaaatgtaattttttttttttttgagacggaatctcgctctgtcgccgagactggagtgtagtggcgcaatctcggctcactgcaagctccgcctcccgggttcatgccattcttctgcctcagcctcccgagtagctgggactactggtgcatgccaccacgcccggctaattttttgtatttttagtagagacggggtttcaccgtgttagccaggatggtctcaatctcctgacctcgtgatccgcccacctcggcctcccaagctgctgggattacaggcgtgagccacagcgcctggccaattaaatgtattttatttttagacaactatgtgacgtgttttttttttaaaaacaatgcctccattccaaatcaaaataaatgaagagttcaagatgacatcagttccatttgttttaagttctggtgttgtgtgaatgacaagcagcagccagttatgacggcaggtgatccaaagtaattgccaaatttgttaacatttttccatctctaaaccatccttaaagaaaaacatatatggtgtcacaccattctcatggtagtcctaggctggagtgcagtggtgcaaatttggctcactgcaacctctgcctcccgggttcaagcaattctcctgcctcagcatcctgagtagctgggactacacgcatgcgccacgacatctggctaatttttgtattttagtagagacagggtttcaccatgttggtcaggctgttttcaaactcctgacctcgtgatctgcccacctcggcctcccaaagtgctgagattacaggcgtgagccacctcgcccagcctaatttttgtattcttagtagagactgggtttcaccatgttggccaggctggtcttgaactcttgacctcgtgatctgcctgccttggcctcccaaagtgctgggattacaggtgtgagcgaccgtgcccggccctattattattaattaattaatttttatttttatttttatttttttgagacggagtcttgttgtgtctcccaggctggagtgcagtggcataatctcagctgactgcaacctctgcctcccaggttcaagtgattcttgtgcctcagcctcctgagtacctggaattataggcacatgccaccatgcctagttaatttttgtattttagtagtggtggggtgtcaccatgttggccaggctggtcttgaactgctgatctcatgatctacccacttcagcctcccaaagtgctgggattacaggcatgagccattgcccccggcctgttctttaatttttttttttttttttttgagacggagtctcgctctgtcgcccaggctggagtgcagtggcgggatctcggctcactgcaagctctgcctcccggattcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggcctatttttttctttacagacagggtcttgctctgtcacctagactggagtgcagtggtgtggttatagctcactgcagcctcagcctcctgggcttaggtgatcctcctgcctcagcctcccaagtagttgggactacaggtgcacgccattgcgcctggctaacttttaaaatttcttggccaggtgtccactaatcttaatcgtttctagcgtttgatttaaagtgagaccacttgaacatttagaggccattctagggttattatttgacttaatttcagtattgttgtgtctcaggataattgggagtcctgagaatcagggagacagacaggaactggcagttggtggagcagtcagaacacacacaacgtttattaagcttgctttctcatatgggcacaattcgtggtgccccaaaacaattataatagaaaaaccaaagatcactgatcacagatcaccataacaaatatagtaataatgaaaaaaactggccaggcgcggtggctcacgcctttatcctgtcactttgggaggctgagatgggtggatcacttgaggtcaggagtttgagaccagcctggtccacgtggtgaaaacctgtatctactaaaagaatacaaaaattagccagacatggtggcatttgcctgtagttgcagctatttgggaggctgaggcatgagaatctctcaaacctaggaggtggaggttgcagtgagctgagattgtgccactgcactccagtctgggtgacagagcgagactctatgtccaaaaaaaaaaaaaaaaaaaaaagaagaaatactgtgagaattaccgaaatatgacacagagacatcaagtgagcacatgatgttggaaaaatggcactgatagacttgcttgatgaaccttcaatttgttaaaaacacagtaactgaagtgcattaaaacaagatgtgcctgtgaatgaaacataaataaattttgtgtttaatagacttgggttacatttccaggatgtctcattatgtgtatgcaaatattccaaaatctgaaatccagaatgtttttggtcccaagcattttagataagggatactcaacctgtggtacatttattattatttttttgagctggagtaactctgttgcccagggctggagtgcagtggcatgatcttggctcactgcaacctccgcctcctgggctcaagcgatcctcctgcctccgcctcctgagtggctgagattacaagcatacaccaccatgcccggctaatttttgtatttttagtagagacggggtttcactgtgttggccaggttggtctccaactcctgacctcaagtgatccgcccgccttggtctcccaaagtgctgggattacaggcatgagccaccgcgtctgatcctgtgctacattatatcactagcacataacacaatactgggcatatatagatactcagcaaatatattttgaatgaatcacagagtttaagtttcctctgtcttcctttcttgacttctattgaaaatgtaagctggagctggacgcggtggctcacacctgtaatcacagcactttgggaggccgaggcgggtggatcacgaggtcaggagttcaagaccagcctggccaacatagtgaaaccccgtctctactaaaaatacaaaaattagccgggcatggtggtgcacacctatagtcccagccacttgggaggctgaggcaagaagaatcgcttgaacccaggaggcagaggttgcagtgagccgagatcgcgccactgcactccagcctgggcaacagcgcgagactctgtctcaaaaaaaaaaaaaaaaaaaaagaagaagaaaatgtaagctgtatagatgagactgcagtaactcatctactgtgaaggaccatacaaaacaagtgtattagctatctaatacatatttaggattatttcggtataagtctggataaggagcaacaaagggtgtggaggggagtctgtgtggtttttacaggtaaggatttaggcttttagtctgagtgaggcattcatggttattgttggttagtactaacatttgatgtttatttaattagtgtaaaaggctttcagaaggtagaaagtatgagttaaaattggtcttcagattactggttgtaaatcagactgtattttaaggttagtcatttttataaagaggaagttgtttagcaattctgaatcctatattgttgcaatatcaatagcagatgctagaatcctattagtaatcccaaggtaaaatgaattctaaaagtgcaatcttgaattattcaacacttggtatccaaattatatgaaatataatcatccattttatgattttgaatagaactgtaggttgttttcttaaataagagttgttcttcctccgccttctcattttgagtccctggaatctgttctatttttacttggggatctacatactaaagctgtctctgatttcatgctctgaagatcaacaagagaccttcccttgtaagatgagaattgtgtagtaggtgactattagaagagtaaacaagtcttaagtctgtaaacattttttcagtaaatgcaatggagtaccagatatctctcgttactatgactaaagaaagttcaatggtaaattcagtagctgtttatttgccttgataagtaattgctagaagtaatagtaattgtttttatagtgttaccgaaggtttatttactgtatgtgtgatttttaaagttttaaagggatcaatgaaagttatgtatagggaatatttgtaagttactggaaataagccaggaattgaatttttaaaagtgcctttcagagtaaattatattttcattttctttatagaatgaaagtggaacaatattgtttaaaattcaaattgagcatcatttgtacttttcaggccattagaatctgctcgaggcttgtgtgggaaagattatttgattatttattagattacctttggctaaacattgcagagaaaagttgttgacaccttttcccctcaaacaaagtaataaccccctgaatctaaaataaaagttggaaaaaagtcatgaaaactaagttgctcatgaggggcttggacttccttgtatttctggctgcccatttggtgctgtcactctgcttgtcccttctgggcttcttgctttaatgtgacatcatatcagacttttagttctgaattaatgtatttgcaaagctcatttaaaattttcagtaattctgtttgtaatttgaagtttgattcttcatttcttagccacataaacatttttgaattttgaattgtgggaaatttctgaaggcaggtaaaatacttattttttaataccttaactctcatcccttttattttttatttattttttatatatttagggacagagtctctgtagcccaggctgcaatgaggtggcacagtgatagctcactgcagcctcaaacccctgggctcaagtgatcctcctgtctcagcctcccatgtagctaggactataccaccacatggtacaccaccacacccagctaagttttatgtttattttttgtagagatgggggtttctcattgtgttgcccaggccggtctcaaacctctggcctcagcctcccaaagtgctaggattacaggtgtgagtcaccgcacctggctgagagctttttcctttccttttttttttttgagagctttcttcatatggcgtttcactcttgtcgtccaggctggagtgcagtggcgcaatctcggctcattgcagcctccgcctcccgggttcaagagattctcctgcctcagcctcccgagtagctggcactacaggcccccatcaccacacccagctaattttttgtagttttagtagagacggggtttcactgtgttagtcaggatggtttcaatgtcctgacctcgtgatccgcctgcctcggcctcccaaagtgctgggattacaggcgcgagccaccgcgcccggccgggcttcttgattgtagattctttgaggtacagacttactttgtataacactcagtgttaacagctctaagtacttaactcttgattgctttttttcttggtatgcaatttattcctcctatgaacttgctttacgattgattgagaataaccttggctcctccttcaataaatgaaggacttagtgctgttttagaagcctgttggagtaccattgtatttgtttgcctgtttttgtcttttggctaatagtcattgctatttttttccagaaacatccccagagctttagtctccagagtttgtatctgttgcaactgaggagaaatctaccagtataaatgtttctgctcctcttgaaaaaaggtttgaggctgggcgcggtggctcacgcctgtaatcccagcactttgggagaatgaggcgggcggatcatgaggtcaggagatcgagaccatcctggcaaacaagtgaaaccctgtgtctaattaaagtacaaaaaattagccgggcgtggtggtgggcgccagtagtcccagctactcagaaggctgaggcaggagaatggcgtgaacccaggaggcggagcttgcagtgagccgagattgcgccaccacactccagcctgggcgacagagcgagactccgtctcaaaaaaaaaaagaaaaaaggtttgaagaagagtatagtgaaatgccacccaaaccaaccttcatatatatgaaaagagggcttggacataaaatttttttttgagatggagtctcactcttttcatccaggctggagtccagtgtcatgattttggctcactgcaacctccgcctcctgggttaaagcaattcttctgcctcagcctcccttgtagctgggactacacctcaggtgacccacccacctgggcctcccaaagtgctgggattacaggcgtgagctaccgcgcctggcctggacttgttattaatataaacttttagagcctttaagccataggatcatgtaaaaattaccttatgttggtactttgaatttaaagtgctggcagatcacacataatcttcaaattgaattctacatttaacaaatatttgagtgcctacttttgtaaacatagcagtacattaaagaacaggacatgaaagttttgctggtacaaagttttgcagttattgtgggaagacagatggtaaactagataattaaattaaaaatgtggtgtattaggtagtgataagtgccctggagagaaaataaagcggggaaagggaatgaaaagttgagggtggagtactgatgtcttgaagagctttccaggccaagagaagaacagtacaggggcgctgcagtgggagagaggcctggcaatgtcagaggagcagcaaagggtgtggaggggaggctgtgtgattttttacaggtaaggatttaggcttttactcagagtgaggtacccgtgaggtttttcagcactggagtgatatgacctgatttacattttaatgagatcattcttggcttgctatgctgagaatatagactgcacggagagtcagatgagacatgatgctagcttggacctgtattggagccgagaacaaagtggtttaattcttgggtgtatttcctaaatagagctgttggaatttgctggtggaatagaattcttttctttttctttgaggcaggatctcgatttgttgcccagcaggagttcagtggcacaaacatggctcaccacagcctcgaacccctgggctcaagcctcagcttccccagtagctgggaccataggcatgcaccactgcgcctgactaatgtttaacattttttgtagaaatggggtctcactttgttgtccagcctggcctcctaaaatgctgggattacaggtatgagctactgcgcctggcctagaaggaacacaatatttgaagggtagagtgtgtgagagaatgtgtcaaggatgatttcagggtttttggcctgaacatctgaaaggatggagttgacattaactgaaatggaaaagaaagacgcaggacaaggagagataatcaggggcttggttttgaatatgctacttttgatttgtctattagacactgaagtagagaagtcacataggcagcttactatatttgatctggaattcagtgaggaggtttagcttagagatataaagtgggaaattgttagcatatggattgcatataaactatgaagttggatgggctcaataagggagtaactgtagataggtgaagaagattgaggactaagtcttgggacacactggcattaagaagccagataagtaaccagaagctagtgaaggagtgtgagcggcgtcagtgaggtgtcagaggaggcaaaccagaatgctgtggcctttaagccaagtgaagaaagcttcaagggaagagagatcagctgtgtcaaaaaagagtttgggtaagataaggactgatgagtgaccactagaggtgaatggtactttgagaaaggcagttgcactggacggattggtatgagcctgagagaatggaaggagagcagcaagtggagataaggaatgaagacaactcttaaagttgtaccgtgaaggggtgttgagaaatggtgcagtaactggagggcttgtgggcttcatttgtgtatgtgtctgcatgcgtgtgtgtgtaaagttggagaattgctagtggcatgcttgatgctgatgggattgaatttagtagagagaagaaccgatgacacaggagagggtaggaatttctggagcagtgtctttgaggacatctgagtgggaagaatgagatcagatctaattactggccagtttggaagccttattaggagcaagggcagttgatccagagtaacatgagagaaggtagagaagtaaatacatcggcagagattcaggttagacgatatgtctgggtaaaatggggaacattttcatacttatctcatgatttttgtgagtattaagtttaatactttataaagggatgattacagaacatagtacccagtaagcgttgactgaaattgttaagtttgtaatatttataaagttacaatgtgatttgcatgaccagcttctttcagtgtgtgactaatactctgaaaatactggcttttcatttgagccagatggctcagtcagtaatttctagttatgccatctttttttttttttttttttgtaaagacactgggcaccaaaggtgctactcacacagaatatcaacttaaaactcaccctggaaagacaagattttcatagttctaatcagaaacattgtaattttgttatattcatgttatggttttgaaggttttgttttttttttttttttttaaatacgtgaattaaggggccgggtgtggaaggccgaaatgggagggtcacttgagaccaggagttcaagaccagcctggtcaacattgtgagaccccatctctatttaagaaaaaataaaaaaaaatagtatgttgggtattagtttgttctcatgctactataaagaactgcccgagactggataatttataaaggaaagaggtttaattcacagttctgcatggctggggaggcctctggaaacttacaatcatggcagaaagggaagcaaacatccttcttcaacatggcggcaggagagagaagtgcagtgcgaagcggggaaaagcaccttataaaaccatcagatctcgtgagaactcactatcacgagaacagcatgggtgaatgcccccatgatctaatcacagcccatgaggtccctccctcaacatgtaattgtagttttaggaccagttgtaaagttagtgcagataaagtgggaacattagaaggagagttggaaccgggagatgcttggaaaatctactcaaactctcactggatttaagtatattcctattttgaaaattcagtagctatgttctctaagaacatcagaacctcagtatcagtttagggcaagacggaggatgcaaggatgaaagaggggatataaataagttttattaggttgggcatggtagctcatgcctgttaccccaacattttgggaggccaaggtaggaggatcacttgagcccaggaatttgagaccagcctgggcaacataggggagaccctgtctctacaaacagttaaaaaaagccatatgcacctgtgttcccagctaatcaggaagctgaggtgagaggatagcttgagcccacagccagggctgcagtgagctatgactgcaccactgcactccagcccgtgcagccccaggctgagagaagtgagactccatcaaaagaaggaaaagaaaagaaaaaggaaaagagagaaggaatacgttttattgttattttaggaaaatttggctttgactttttttttttttgagatgcagttttgctcttgttgcccaggctggagcgcaatggcatgatctcggctcaccgcaacctccacctcccgggttcaagtgattctgtggcctcagcctcccgagtagctggcattacaggcatgtgccaccacctgcctaattttgtatttttaatagaggcatggtttttccatgttggtcaggctggtctcgaactcccaacctcaggtgatccgcccaaaagagttaagagcttgagccaggcgcggtggctcacgcctgtaatcccagcactttgggaggccaaggcaggtggatcatctgagggtaaggagtttaagaccagcctggtcaacatgctgaaaccccgtctctactaaatacaaaaaattagccgatcgtggtcgtgggtgcctgtaatcccagctacttgggaggctgaggcaggagaattgcttgaagccgggagtcgaaggttgcagggagccaagatcgcaccactgcactccagcctgggcaacaagagtgaaattccgtctcaaaaaaaaaaaatagagaagcgcttgggtctgaacccacacattgaggctccagcaattaggcacttaacctctatgctatgtggcctttctaaaataaaataatagtaaatataacccaagaagaaacttaaaaggtgtcaatcttccacaaactcaggtttaatctcttgatctaacatgatgttaatgtcgaaaagaaaaagcgttcgttgttactgttgttgaaaaattttcataaaatgtaatatacattcctgatattaaaaggaaagaatacctgtaaaatagaggtggataataccattactatggtattgtgactgactgagaactactcccgagcggtaccagtcccagacatttcccctgagcagggagtagtgctcggtcagtaggcactagcaccgtcattgtacaggtcgttaagatacttgccccttccttggttatctagccgctgaagggataattatgtttggcacaaagaggatggtgctgcagcagagcctagctctggcattttttctgattgatcggcatctattctatacctgctgttaaatattttgactctcactccagatcatcaaattgttttgagagtaaatgagttgaagcatgcatactgcctagctagaccagtgtctgagataaatataatacagagtttgctattataatttagaatttttattgagtatactctgctgtctatacacagttggcttaggaaatgaattgggaagcttttctgtttcataggatagtttaataaaagaattacctttgaaattacctttacttactatgaaaatgtctgggactggtatttggagttgaggggggagctaactgtgtaacttatgcgaatcttcggaagttattggagtgttttctaattctgttagatgcttttgacaatttatattttcccagaaaatcatccattgtatctgtgtttaaaatttagcagcttaggatttactggaaacatattttatacttatttttatttcttctctattatcttacttccttttcagtccctaatttcatataattgtttttttagtccagctaatagtttgtctgttttttttcccctcccatcaaaatatagcgcctaagttgttttcgtttttttttttttgagatggagtctcgctctgtcgcctaggctgcagtgcagtagcgcgatctgagctcactgcaacctctgcctcccaggttcaagcagttctcctgcctcagcctccccagtagctgggactacaggcacgtgccagcatgcctggctaattttttgtatttttagtagagatgggttttcaccatgttagccaggatggtcttgatctcctgacctcgtgatccaaccgcctcagcctcccaaagtgctggaattacaggcatgagccaccgttcctggctgctcctaggttttagaattaattctgcaggcttctgttatcttacttgagtaactttgaattcccttgttcttatttttaaatgtttattttctaaccttgagttgaatgctcatttaattcttgctcagttgaaggtgtttaggctgtggctctcttcctctgagtatagctttattagtgtaccaaagatttttttctcttctttttattttttcttttctttttttttttttgagaccgagtttcgctcttgttgcccaggctggagtgcagtggcgtgatttcagctcattgcaacctccacctcccgggttcaagtgatcctcctgcctcagccttccgagtagctgggattacaggcatgcgccaccgcacctggctaacatttgtatttttagtagagtcagggtttcaccgtgttggccaggctggtttcgaacccctgacctcaggtgatccacctgcctcgacctcccaaagtgctgggattacaggcgtgagccactgcccccagccttctttttccttttctttctttctttcttttcttttcttttttttttttttacacagattagagtgtagtggcatgaacacgactcattgcatccttgacctcctgggctcaagggatcctcccacctcaacctctcaaatagctaggacttcaggcacgcgccaggatgcccggctaactttttttattgtgtgagccgctaggcccagtcgtaccagagatttttatatgggcagtttttatcattgttattttctaggtaatctctattgattttgatttacattactccattcaattacttgaagtaatttaaggagagagagtacataaatgtcaagtctactgcattaaggggagtagcttaattgtttcattgtcagattgtatagactatttctactttcctgaaatttttgaggtgttaatggcctaaattgatgatcagtttttataactgttgcatagagacttgatctcattctttcacatgttcagccattttgtcgtttatgtatttgatctttcaggaaatgatactcttatattcttacttctgcctaaaagtttttcttagatttctttgaaatttttgttctggctgggtgcggtggctcacatgtaatcccagcctggccaaaatgatgaaacctcccctctactaaaaatacaaaaattagctgggtgtggtggtgcatgcctgtaatcccagctactttggaggctgaggcaggagaatcacttgaacctgggaggtggaggttgcagtgagccttgcaccattgtacttgagcctgggcaacagagcaagaccctgtctcaaaaaaaaaagtttttgttgtaactatatattatgaaaattttggtatatatagttttataacatatctttatagattgtaatcttgatcattataaaaaatgacccttttctgcctcctttaatattctttcagtttgaattcagctggttttgaaagggtgttgatgcttgctatgtatgcttttatctaaccttttactttaacttctcaaagtctctattttagatttgtctcttgtagacccttgtagttggataaaggttagtcttgactcaatttgagatgcttttaatcatttacattaatgttatatattttgctttgcttatataatattagtgtatttgttttgttgtcatctatatgtttgcttttggttttctttcttttcttttctttttgagacagtctagctctgtcgcccaggctggagtgcagtggcatgatctcgggctcactgcaacctccacctcccgggttcaagcgattctcctgcctcagcctcccgagtagctggaattacaggcgcctgccaccatgcccggctaatttttgtatttttagtagagatgggatttcaccatgttggccaggctggtctcgaactcctgacctcaagtgatcctcccgccttggcctcccaaagtgctgggattataggtgagagctacagtgtctggcttggttttcttcctttaaactacatggtttgttttctttatttgctatcccttctgtctcattttgtaagttatatactgtatttcgttatgtctaagataccgttggtggttgtgtgcttcgttattttgtataccattaatacagttaaatgctgtcaaagaaactatgacgtaccattgattgaaatatgcatgctgatttcagatagacaaaaatgtgaaaaaggtacatcttagaatagattaaacatggtagtttgtagttctatgggtattataaagctatagctttaatatatttaaatctattatgtttatcaaatagttttttcaggagtggttgtttgagtgctcttatgttcaaaaatgtctgttagtggctttcacaagcaacgtgatgttttggctggttacagaatttttgggttacgtttccctttctcttaatacccagcagacactattccattatcttctggcatctagggttactctagagaagtctggggccagcctgactgtttttttccctttgtaggtgacctacttctgcctgagtattgctagaattctttctttatccttgaagttcagtaacttcatcaggatataactcggtcttggtgtgattctcttacattttcctgttaaatggtaagccattcaaactgcagattcaggaatattttcttatacaccttttaatatgcattcatttttatttttctttactcaagaaacatcagttttatgattgtttatcttcatttcctgtcttccatttcattacttttctaaatgcttcctttgttcttttctgctgtgctcgatgtgattttcttgagattttgtttgatatcatgtttgttttcatcagtatcaggttgactacttcctatatatgatggggttttcattttgccagtggcttcagtacttcattcaattttatatatttatgtctgtgagttgctctttcaacttgtctcatttatttcctcttttaaaaaaaacttttacttaacagtaaaaacaggtaaaaccacctgtaatcccagcactttgggatgctgaggcgggtggatcagttgaggtcaggagtttgagaccagcctggccaacatggtgaaagctgtctctactaaaaatacaaaaattagcccggcgtgttggtgggcgcctgtaatcctagctactcgggaggctgaggcaggagaatccgtttgaactggggaggcagaagttgcagtgagctgagattgtgccactgcactccagcttgggcgacagagactccctctcaaaaacaaacaaacaaacaggtaaaaccacattgtttttgagaagatgggttaaaaccagttacaagtgactaatattaaaatttactctctaagaagtgatgagtaaaatggttttatcaagtcttgtgttttattaatggcatgaaatatagaaaagcaggcttagagatactattttttacagttggataaacttttgtacacagtagaaatctgattttgccatgtgtttttttgtttatgagggagaagtgttcaatgactttttcccaaagatttttttttttcattcagtgaattacaaaatgtgctagaaaaatataatggaaatgtaccttgcatggtggcttatgcctgtaatcccagcactttagaaggccaaagcaggtggatggcttgagcctaggagcctaggctgcagtgagccatgatcatgccattgcactccagcctgggcaacagagtgagaccctgtcaaaaaaaaaaaaccatggaaattataactgacatgttctgccattcacgtgccacaattcaagacctgctatgtgattttctcctgaatgccagtctttgttttcttctgaggaaatgaaggtgatcagtgataagccccctggtcttcattcagggttgaagggaatagtgaaaactgtgaacgtgtacaacttgtggttactaagagtgagactttgactgcgaattaggcaaaaggtgtaagtcttttactttttttttttgagacggagtctcactgtgtcacccaggctggagtgcagtggtgcaatctcggctcactgcaacctctgcctcctgggttcgagattcccctgcctcagcctccccagtagctgggactacaggtgcgtgccaccacacccatctaattttttgtatttttagtagagacggggtttcactgtgttagacaggatggtctcgatctcctgaccctgtgatccacccgcctcagcctcccaaagtgctgggattacaggtgtgagccaccacacctggccagcgcccagctaatttttgtatttttagtagagatggggtttctccatgttggccaggctggtgtcgaatttctgacctcaggtgatctgcctgcctcgacctcccaagtgctgggatcacagacagagccaccgtgcccggcccgtcttttacattttacatattttagctgtttagggaacagcttcgcccgtaagtttttttcttctcttcttttaaaatgatggctgagatacacacattctttacattacttttgatgtgaacgaaggtcatttcagtagacttgcacatttagagtatgccagcaacttactcaatattgcgataggtggaatttacggtctggcgtctgaattgtagcttatcctcaaccatcaaaattcctacccaaatttcttgtgttccaaacttaagaattgttgtgtttcattgccaataacatggctttttcctaaagtgatacatatttttaagtaattcatttcttgggcaaatatttactgccagagactgtcacaggtcctggggctatatcagtaaataaacaaaaacccttgttcttatagagcttgctttgtagttagggtaggggagagaagaattaatagaaagtgtagagtgctgtgtggaaactagaacagggaaagaggataaaataaggagtgtgtaagggggtggggtttcattaaaaatagggtgacagtggaccgaggaactcaggtgaatgagtgaatcatgcagaggttaggtgaggcaagcacaagggccctgaaatggggctgacctgaacgctggagggaggtggcagagcggttagctgaaggttggagagagatgctggttaaagcccctgaacgctggagggaggtggcacagcacttagctgaaggttggagagagatgctggttaaagcccctgcggtggcagagcggttagctgaaggttggagagagatgctggttaattctgaaggaccctataggccatcacacaggccattgctctgagtgagaatgggaagctgttggtatagtgacatgatgtgactcacatttttccaggattacttctgcctgctgggttgagagtagatacaatagggaaggtattttccatagtaccccagcacatgcatttttattaaacatttgtggctgaaatgaaagcttcaccaacaataaccctattttattttttgtttctgttaggaaaaatgagtgctggttatgttccactagatctatttcatgactgtgtgacttacggttgaaaaacactgccaaatagaatatagcctctgacttagtggacaagaagtaaaattgaggtttgtgtatgaaagcaaagtgaacacaatgtaaaataaaaaaagaataaaaacttaaaaatcaacattatgtatatgtatatatacttagctttaaaaaacccaaataatcaaataccagtgattcaagaggcctaatagtgaacaatgcattcagtgaaggataatgaagaattccccagaggcaactgctttttaaaaccttttaggttcagatctcctgggggcttaactccatgcttctaaataatatatttatagtgtttatgttttggtttatcaactttagacattctctgttgacttcttgctatgacagatgttttcagtcccacttctcactactgatctccctcgtacgacggtcactgaactggcgcctctctggggttctgcccagaagattagccttcctccttcgctgcagctcctctgtgagtattctgctctctgctccctccactctgcttactcagttcacgttcttccatccgttttcatctttcagagccatgggcaatccacctggtctttttaatatactttaaattaaaaagttattttttaatttctttagaaaaatttatttaacttcttaggagggaagaggagataagcacatgtgcccgcactgacaccttgaactagaagacacgattaggccaaagctttttgttgtcaaaagtgtgtagtgtatgtgttttaagagttagatatattcagaatatcttatcttttaaaaattgtaaatatttccccatgtcctgaaatattcttgtaaagtattttaaatagatgcatagcattccttcatatgctgctactatcatattccccacatcttgacttctgggttttcaaattatagttgtaaaccacttaaattataattagtgcttctgtggattttccttatgaaaacatttatacataatccttgattatttctcttcggataaatttctggtcatttcttagttaaggaaaataaatatttttgaggttcttcataaatattactgattgccttctagaaaggctttgctaatttgtatttccactattaactgtatcaaagtgccactttttattgtgttcttcataccaccaggaactttaaaaaatgtttgattctgctaggtaaaaagaaaattattttaaaaattcccaagaaaggtgaacaccttgacagtttggaatgtgtgtgtgtgtgtgtgtgtgtgtgtgtgtggttttaaaggtttataagagtaattatttgccttttaattttttatggctattttggcatttagaaattttatttttctggccagggcacagtggctcatcatgcctgtaatcccagcactttgggaggccaaggtgggtagatctgttgaggtcaggagtttgaaaccagcctggccaacatggtgaaaccccgtctctaattaataaataaataaataaaatatattttatttatttgagatggagtttcactcttgttgtccaggctggagcgcaatggtgcgatcttggctcaccgcaacctccgcctcctgggttcaagcaattctcctgcctcagcctcccaagcagctgggattacaggcatgtgccaccatgcctggctaattttgtatttttactagagacagggtttctccatgttggtcaggttagcctcgaactcctgacctcaggtgatccgcccaccttggcctcccaaagtgctgggattacaggcatgagccaccgcgactggctgaaattttatttttttaaaatcatccagctaagtaggctttcccatttatttattttttgacacttagagtaatgtttcccattcctaaaatcaaataagagtatgcaaaatgtgaagatagctttgaatttggagtggcgtatggaaaagtgcctgggagaaacttggcggcagttgatttagaaacaattaggctttggcttgtgttaaaaatctgtggatcatttagattttcgattgttgctgtccccatgtctcctgttgccccatactatagatggtgttaaattgttagacacttccatgaatgtacttcatacatgtaaaacttcgtagatgcatgactcatggctctgggtggtctagctaaactagtcttttacgtcatacgtgtaaaactttgtagatgcaataactcatggctctgggtagtctagctaagctagtctttccactcaaagagcacgatacttaagctttctcctggtgagtcatgaattgtcatcagggaatttctcactgtttggcttaattcgattaggaactgctactggtgatagtttagtccttatttagttttagtctaagagaaccttactgacgttactataaatctaaaaaaaaaaagcatacctttaaaaaagcctaatggcaatggactagtcaggatagtaagaaaaagttatactggaaagagagagatggtttatgaattggttacaaaaaatacatcagtattattttgaagacaaccctgatttcagtcatggttgaaatccttaaccaaccacaaaaatgtcttacattttaaatatattaaagtccttaaattatggaaatagtgtcttctaagaagttgtttaatagtggaaagaagagtctcagtctcttttttttttttgagacagagtctcattcacccaggctggagtgcagtggtgccatctcagctcactgcaacctctacctcctgggatcaagcgatcctcctgcctcagcctccccagtagttgagaccacagacacatgccaccatgcccggctaattttttttttgagacagaatctcgctctgtcacccaggctggagtgcaatggtgcgatctctgctcactgcaacctccgcctcccaggttcaagcagttctcctgcctcagcctctggagtagctgagactacaggcacactccaccacgcctgactcattttttgtatttttgtagagacggggtttcaccatgttgcccaggctggtcttgaactcctgagctcaggcaatccgcctgcctcggccttccaaagtgctaggattacagaagtgtcttttttttttttttttttttttctttttgagacggagtctctctctgtcacccaggctggagtgcatggcgcgatctctgctcactgaagctccacctcccgggttcacgccattctcctgcctcagcctcctgagtagctgggactacaggcgtccgccaccacgcctggctaattttttgtatccttggctaattctttgtatttttagtagagacggagtttcaccatgttagccaggatggtcttgatctcctgacctcgtgatctgcccgccccggcctcccaaagtgcggggattacaggcgtgagccaccgcgccccgcccaccattgtcatgttgttagtgcagcacagaagcccatcaagtggcagtcaataatttcctaatttgtttttgaaaaaaacttagctacattccaattttctacgtgcttaggtttcttttataagtttgaataaatgtataaataacttcagggttgttttatgggttcttggtacctcacacagataaacttgtaaatggaataagatgtagaggaatgcaaaagaagctaaggagcaagcatgacagcatcctcttattttatcgccttctcctctgcagtagtcagggtacagggcactgaattcagatcaaaatcatagactttactgtatctcttgctggcgaaaatatttaagttatctgacatttactaggtctattaaatcacccaagggaagaactttttttgtatgcatacggtagtaaagggcttttgcaaaaccagtatgttgatattttggacaacataaaacaatatacaccttgtacatttactttaaaaattaacttgtgaaaagcatttctcattttgtttacttagtttttaaataaagccagactagtttagcttaatatatgggttctcagctgggagaaccagattaaccatcattctagtcaaggctttgagtttccattctctgaaatgatgacttgcaacttggtggaatttgatattctttccaaaactaagaaattttggtgatccattcggagttatttctgctctctttctttaacagtgagactgagagtatcggtctacttgcactgcacatgggccaaaatgggcctttcacaggagaagctctacacaaaggaaaggagaaagggttcctgcagaaggaagagaagggcagatttgttctcagaggtcacttatgttaaggcaaggatggcagatgtctcatcatggatttatttggcgggtgtggctgctgagtactgtattgggaggaatcctaagtacgtgataggttattaatggtgctgtctttgggtgtgggccacgtcgaaggcttgagggtgattcagagtaatgacacagtccgtctgtattttaggacctgccacacaaggaggtaggaatatgcttggcttccatttgatgtgtcccacacttctgatatgtatattggactttttaactactccattctactcttcccccttctcactactgtacttaactaagtcttaataaacaaacacacaaaccggtaactcctcatccctctttatcctgagcccctggcaacccccattctattttctctctctgagtttgacttctcaaggtattttcttttctttttctgtttcttttatttgtgacagtctcgctctgttgcccaggctggggtgcagtggtgtgatcttggctcagtacaacctctgcttcccggttccaagcgaatctcctgcctcggcctcccaagtagctggattaggggtgcccgccactacgccactacggctatttttgtatttttgtattttttttgagacagagtcttgctctgtcacccaggctggagtgcagtggcgcgatctcggctcactgcaacctctgcctcccaggttgaagcgattcttcctgcctcagcctcccgagtagctgggattaacaggcatgagccaccatgcctggctaattttgtatttttggtagagacggggttttgccatgttggtcaggctggcctcgaacttctgaactcaggtgatccacctgcctcggcctcccaaagtactgggattacaggcgtgagccaccgtgcctggccaatttttgtattttagtagagacgtggttttgccatgttggcctggctggtttcaaactcctgacctcaggtgatctgcccaccttggcctcccaagtgctgggattacaggtgtgagccactgcacctggctgcaaggtattttcatgtaagtggactcatacaatatttatccttttgtatctggcttattgcacttggcataatattttcaagttcattcatgttgtagaatgtatcataatttcattcctttttaaagctgagtaacatcctgttgtatgtatatactgcacattttgtttatccattcatctgttggttgacaattgggttgtttccacgttttgactgttgtgaataatgctgctttgaacattggtgtacaaacatctgtttgaccccctgctttaattcttttgcatatataaccagaagtgaaattgctggatcatatggtaattctaagtttaatattttgaggacatgccatgccgcctttcacaatggttgcatcctcttacattcccattagcaatgcatggggttctaatttctctacattcttgtcaacacttgtcattttctgtgtgtgtgtttaatagcaattctaattggtgtgaagtggtatctcattgtggttttgaatttcttctattattagtgatattgagcatctttgcattgtgcttgttgaccagacatctttttatctttggagaaatgcctattcaagtcatttgcccatttttgcattggttttcttgttgttattgagttgtatgagttctttttgtattctggatattaatcctttatcagataggtgatttacaatatttttcccatttttttgggggttgcttttgatgaactaaagttttaaattttgatccagatcatttattttttcttttgtctctattgctcttggtgtcatgtccaagagtttgttgctaaatccaatgtcttgaagattttctcttattttttcgcctgagagttttaaagttttagctcttacgtttaagttttcagttcatttagagttattttttgcatatcatgtaaggaaagaatccaccttcattcttttgcttatggatacccagtttccctagtgttgtttattgaaagattttctttcctcattgagcggtctagtcaaccttgttgaaaatcagttggccatatatgcaagggttttatttctaggctcttattttgtttcattggtgtatattatgtctgtctttttgccaataccacagtgttttgattattgtcgttttgtagtaagccttggaatcaggacatgtgagttctccaactttgttcttgttttcaagaatgtttcggcaatttggggtgtgaattttaggatgggttttccaaaagttgttgggattttgatacagggattacattgtatttgtaaattgctttgggtggatttttttgtgtttgaggaaaagattcagttgtttagaagtctcttaagctctctttattttacttttgtctttccagcatatgtctctttcatatattcacttatacagaatagtgtacatatgtgtgatacatgcaatgtaaatatgtacaattttaagagttatttaaaaacaaaaaccatgtaactgctagcaggtgaagaaatagttggttgaagttttaaaactactgaaatagagttatgactgatggactacattgacacgtcatcacccacaatcccatcatttatatcagggttcacttttggtattgtacattctatgggtttagagaaatatttgacgtgtatcttaccattatagtatcatacagaatactttgatggccctaagaatcctcttcagattgaatttttgaagattttaaactactttttttttttgttttttgttttttttgtttgtttggttggtttttttgagacggagtctcgctctgtcccccaggctggagtgcagtggcgcgatcttggctcactgcaagctttgcctcctgggttcacgccgttctcctgcctcagcctcccgagtagctgggactacagaagcctgccaccacgcccggctaattttttgtattttcagtagagacgtggtttcactgtgttagccaggatggtctcgatctcctgacctcgtgatccgcccatcttggcctcccaaaatgctgggattacgggcgtgagccaccgcgcccggccttaaactagttgttaaatagagtatcctattcaacattgtggatttttctaattattttctcaagaaatcatttaactggctggacatggtggctcatgcctgtgatcccagcattttgggaggctgagttgggaggatcacttgaatccagcagtttgagaccagcctggacaatatagtgagacccctatctcactttataaataaagcaattgtttcacttatttccacatcccctagatttcctgcaaactgtagcagtactatctaatagaaacatgggaaccacacatgaaagcctaatgtgtgattttaaaattgtaaccacatttagaaatgtaaaaagataggtaaaattcattttaataattcatttaactcaatatacccaaaatataatttcaagatggaatcagcataacttttttctcacaaagtcttcaaaaatccagtttatattttacatttgcagcacatgttaagtaagactagccacttcttaggtgctcagtagccacatgcgactagtggctattatattagaaagtgcaggtctaacctaagaagcttgatttgattcagtgtaaacattttgggggaggggcaagagtatgtcatagatgaagcttgtgtataccattttgcatcaaataagaagatacacattcttgggttaatggttctaaattcgaacaattatttggtgattgccagatttctccgttgcgaagatgcattatctctttttactggtgagtaatctgtggggtgatgcttgggcatcatattctgttctccagtgaccttttcacttaatggttttagcatccattgatcatccttgcctggattattacattaagggttgcaaatgaaatgctctaaatatatctatgtaacaaatttccacccctttcttccattatataaagcattaaaaatactagttactggccaggtgcagtggctcacacctgtaatcccaggactttgggaggccgaggtgggcagattgcttgagcccacttcgagaccatgatgcccatggtgaaaccctgcctctacaaaaaatataaaaatgaattgggcatggtgccatgtacctatagacccagctactcaggaggctcgggaggattgcctgagtccaggaggtcaaggctttagtgaactgtgattgtgccactgcactccagcctgggcgacaaagctgttctctcagcccagtctccttagtaagatctaataatttttcctttgggagatgactttctctaaactttggaggtcagcaataaattgaaagggactagtttcttatctgattaattcattttcattttgatgaattcgtatgccttcttaggttcttccttaaaatccttaattaaaggagttttgtcttcatcatcatcctgcatcagaaacggcatcagtaattgatatttaatctcataggttgtgatgagtccttacttttgttttacaggttgctcttaagtattgttgggttttcagagtatatcagcaaaggctttagcttaacatcgctcaattttttaaatataaaagcaatgttagcctgacacgttttctttttaaatttcttaccaaagcacaagatggcattctttaagaaaggtctatttttgtcagttataaatttgctttccaatatttctcctttattaatagttttctgcaattcattgggggaaagtttgttgcagtctcgctatcagcagaagctaatttatttatcagtgatatttaatgttatgcatttatgtactgttcttaaacctctcaaacaattcagggcttgctttgcaactgagctgctcaccaaattctcctgtttctctcctttcacctccatcacttcggagatatgaaatgcacattgctgttgccacagtgctcggtggttccatgctgctggtggttatacatttttgtatgaagtattaccgtaactgttagacatcaacattgccttccatttgtatttctgttgcatagaaacagtcttatgtgtgatacaggggatatacttaaagtcaggggctcagcttttggttcccttgcctttaaataaatgcattacttccaattttttctttcagtgtttgtactttcctaggcctcttacataggttcacctgtattttcccaggacaccccattttcttagaagccatttttacttaatgtggagaagatcatgtacaagatgcctttcagtagaagttatatttcatgcacaacatttctgatcatgcagcagggctctcttcttttgctaatgtgattataaggagaagaagcacatacaaataaatagttatttgaattagagaaatataatctcctaatgccatcttagggaagagtttgaggaggagttcaaggcatgataggaagatacaacagagggtgagttagtgtcagcagatcacagctactttgacataatcacacctgttgttcccctttggaagaaatcttggattggacctggcatggtctgctgcttacattattctttctttcttatgtcaagaagtgggtggagactacttagaggaatgaggaatcaacaccatcttaatatgtgtttgtgagtagaacatcttgtatttgtattacctgttccagtttttaactttgtgcattttatgtgaatccacttcttatacttccattaaaagtagtttaatacttggtcatatgttagaaacctgtcattcagattgttgcatttcaaaatgtagacaaagctgtcattctgacttgtttggcttttgagtttcataccacacttagtccaatcaaaatataaaaaagaaaaattatgttgctaattttcaaatttcaaacttttgctttaattataataaactttatagacacacatttgaatcgcacactaatagcctaggaaaattaggggtttaaatgtaaatattgccttcatcccttagactctaagtaatagcaacaaacattgggcaaattggctgggttcacctgtaatcccggcacttgggtgggcagggttggggggcgagctcaggagttcaagaccagtctgggcaacgtaggaagaccttgtctctaccaaaaatacaaaaaaaagacagacatggtggtttgtgcctgtggtcccagctactcaggaggctgaggtgggaggattgcttgagcccaggaggcggaggttgcagtgagccatgaacacactactgcgctccagcctgggccacagagtgaaactctgtctccaaaaaaagaaagaaggccacaatgcttaaaaagcccatccaaataatcagaaaaaagagaatcactcaatgtaaaaaaaacggggtgggggaataaaaatatgtaaatgcaccaaagataaattgccagtggcagaaggatgcccagtgttagccagcagtaaaagtacccagtgttagcaaggctgtagggaaatagttgcctacagtgtttctgggataatacattgaagtaaacattttgtggcttgatatatatgttcctttgacttacagttcagtttatagtttatattctagatatacttccacagatgtacaaggagagtgcaaagtattctttttaaattaatttttttttaagatggggtcttcctctattgttcaggctggagtgccatggtgcgatcatagctcactgcagcctcagactctcctgggctcaagagattttccctcttcatcccccagaacagttggggctacaggttcacaccgcctggcaatggcagcattgttttttctttttatttatttttaaaaagacttttaaatattcataatttcttttttttactttttgtttttttcactcctctcagctcatacctaggcagcattatttatatttgagggggaaaacgaaaagaggtatggtggtgggaacgagttatctagtgttcagactatgctaagtggccatcagttatacaaggatgattccatttctgtatagtatatggtggtgtagcctaagtctgaaagaatacacagcaaattgttagcagtggttgtctttggagagcaagaaggtagtgtctaatgccttctattttattttcctatgttactttaggatacatggccttttttcataatttaaaaaatcaaagtacataaaagaaagttgaaaatattctactacttagtaataacaaccaccacctacagatgtctcccaacgttgggcatccttgcatccacctttcagtgcatgcatgcgggctgaaatctgaggttgtaatagatgtgccatttatatactttaagttgcaagttgcatatgaatgacaacccagctaaggtaatattgaagaaattattgacctatagatagacatttatcgcaagaagagattaatttctaaaagagtcctaaagttgagagaagaaaatctataaaaacctctaaatagttttgagactcttgatagaacccactgacttcctgatgtccaggatgagggaataaacacatatgtattccttagtacctctctccctttccctccattcccttcccattttctaatcataaatatagatatatttagtaattggttattcttttttaacatagaaatcctgataatgtaaaattacgacaatacagaaaataacaatgtaaaatcctgacaatgtaaatttatatataaatcctgataatgtaaaaataggaccaatggcaacaagaaaataatacacacacacacacacgtgtgccacttggcaatgacagcatatattattaaatatatatatataaaagcttatagcattcatggtggtttggttttatttatgcatttacatggggttggtaactacactggtccctttcacctgcgtttttctgttactgaattctttattttgattgatttcgcagcatttaattcaaaaagtaccatttcttaagtccttaaagtttacaatacatgtaaatgtgtattaccatcttatttggacttcctgtttgggcttctctctctctcttttttttttttcgacacaggtgcctaggctggagtgcagcagcatgcttacagctcactgcagcctcgacctcctgggctcaagtgatctgcccaccttagcctcctgagtggctggcaccacaggcgcttgccgccatgtccagctaatttttgtattttttgtagaggtggtgtctccctgtgttgtccaggctggtcttgaactcctgggttcaagcatctacttgcctgggcctcccaaagtgctgagattacaggcatgagccaccatgcctggctgcatttctcattctttttatcacattcttcttcaggattccgtatttcttcacgtcactgttacttacctacaatgagtattgtggagaaatctgaggctaacctggttggttccacccacccacctatactggacttgttttttcccttcctgaatatccttgatattatttaactttaaagttcagtgcctcatttgacagatgttttattgtttattctgtaccagttttttctgagttgtgggatatgttttcaatctgtatatttattattatagaaagctttatagatttatgacattttaatattctgatctcttcaggaatgccagtttaacttatgtaaatctcctttgtttattatctttactctttaaaaataactatttatcttttcattagaagtatgatttctgaaagttatgaccatgatttgtttttagtctgtttttcactttcctttaaggtctcctgttgctttataatgttttctttctggtcttctttaaaaatatgtttctgtaatttctttgagactgtttttctgaagtctttctggttttttatatgtattatttggtggttgaaatgaacttaaagtgaattggaaattcaagaatctcatgactgtgcttgcttccttcagcagcagcatgcttacgactcactgcagcctgagaatcacttttttgccccgtataatgtggggaaggtaaaaggacagttgagaaccactggtgtattcgaggggaaactgattagggaccaactgggatgtgaacttaaaaatagggctttacacatgaagaaggtggcattcttagttggaagtgacaggaattcaactaaaataaatttagacaaaaaggaaaactgacttctaactaagtttatagaagggcaggagtagtaccaggtgtaagaaatcaaagatctgtttggatttcttgttgcttattcttcgttttggcttcattctccttgagacttgaattgcggctattggcagctctcaggcctttatggcacagcttcccaactctgaaaaaccactccctcctgtggccttggggtaccgggggccttgtttggcagtcctactagaaacatagttgggcgtgaggtttgaagctgggtagtattttccaaaagaaataattcaggtatgggcttgttctcaggattctgaagaatacagacgtattccttttatgtcctgtagcctaattaatgagcaattttaaaggaagaaaatggacaactaacatttattgtaccttaagctgggtcagactttcgcatatacaatatcttctccgtgttgcaacgttaccaagggctttaccatcctttactgataaggaaaatgagactcaaaaaatagaaatgatctgtttaagttgcccaggctagtaatacataatatcatatgctgtgcccaaattttccattgtgaagtgacattcagaaatcctcaggaatcatctttatcaaatttatttctataaaataggcgagatcaaagtaagctgtttgtgtgacactataaactagtgttagggcataatttcggtattgtgaggagttcctgctgcgacaaatcttggcagagatgcatgcttatgctattgtgtataatttatgcacaagcaacaacgtacttaggacttaatattgaagaaccctgacgcctgtgattgaagaagctgtgataagcagggtgaaatattacaggtagcagaatgtcagtaagtgttattttaggaatgtggtccagaattctgccaagcaaatccctttgggaagcatattgacaaattctttttaagggatcatctctgatctgtttggcttgtctgtttcattttccttatgtttttgaagcacagtaaaataaattgggtggaatattttttgttttgttgttttttgagacagggtctcactctgtatttcccaggctggagtgcattggtgtggttttggctcactgcactttctacttcccaggctcaagcagtcctcccacctcagccttccgagtaactgggactatataggcacatgccaccatgtccggctaatttttttttttctttttgagacgaagtctcgctcttgtcgcctaggctgtagtgcagtgacacgatctcagctcattgcaacctccttctcccaggttcaagcgattctcctgcctcagcctcctgaatagctgggattagaggcacccgctaccacgcctggctaatttttgtatttttagtggagatggggtttcaccattctggccaggcttgtcttaaactcctgacctcaggttatctccctgcctcagccttccaaagtactgggattacaggcgtgagccaccacacctggacagggtatcactatagtgccaagcctggtctcaaatttctaggttcaagcgatcctcctgcctcggcctcccaaagtgttcggattagaggccaccgagcctggccttgattttttttttttttttttttattcaagagacatggtcttgctccaagctggagtgcattggcaccttcttaggttactgcagcctcaaacttccgggcccaaacagtcctcctgactcagcgtccccagtagctaggactgggtctctctatgttgctgttgcctaggctggtcttgaactcctgcccttaagcgatcctcccaccttgacctcccaaagcactgagattacaggtatgagccactgtgcctggccaaaaatgtttttgattaggaaatcagctagccggtagcccgtgtcgtggtacaaataaaaaattctaattttaagcaaatttttaaagtttaccagaaatttgtaaaatttattaacttgatgcatcttgaaatctaaagaggaaatacacctttgtgattgctatgcttgacttttttcagtattaattaatggaaggttgaaggacgggaacgtttttgcagttacttttggtgacttggtttgtggcatttttatgttttaaggtaacagcagtttattcctctgataataaggtcaaaattattttgacaaattatctcaatagttaggagtaattatgtactgtttgggtaaaggggtctgtctatctatgatctcagaagttcaaagtgaagctgcagtaaaaatagttactttacagacatataccttgcagccaactgtgttgtataaataaacttgacaggaactcacattcccggagcaggagaccacagtcacccagacacaaaggaaaatcgttactaggctgtaaacctcagtttgtatttggctttgtagaagttagacttagccaacaattggtcttggcaaagtacacttaggcggtggctcacgcttgtaatcccagcactttgagaggccgaggtgggcggatcacgagatcaggagatcgagaccacggtgaaaccccgtctctactaaaaacatatatatataaaaaattagccgggcgtggtggtgggcgcctgtagtcccagctactcggagaggctgaggcaggagaatggcgtgaacccaggaggtggagcttgtagtgagctgagatcgcgccactgcactccagcctgggctacagagcgagactccgtctcagggaggaaaaaaaaaaaaaaaaaggagcctcttttcttctgtttttttgtttgtttgtttttgttttttgttttttgtttttttgagatggagtctcgctctttcgcccaggctggagtgcagtggcgcgatctcggctcactgcaagctccgcctcccgggttcacgccattctcctgcctcagcctcccgagtagctgggactacaggcgcccgccaccacgcccggctatttttttgtatttttggtagagacggggtttcacggtgttagccaagatggtctccatctcctgacctcatgatccgcccgtctcagcctccgaaagtgctgggattacaggcgcgagccacagcgcccggccaaaagtagcttattttcttagtagtcaagtacaaaatgacgtctagttgggtcttggaatgttattctgagaatttgtattttgctgaggtgcagtgaagttttacttttacataatgatcgacaatactgaaaacattattttaggctatattaaacttatttttagattaaaaaaatcttttgaggaaaattttaaatgcccaataataccaaagtagacagataggtataatgggcctccatgtactcccccagcccctgaagtgattaggtcatggatcagcctcgtttcacctatcttagccctctccctaatgactgtgaagtacattctaaacatgatcatttgtctgtaaatatttcagtatgtatctctaaaaatggtaagaaaacccccagcacaacaccactgccaaactcaaaaaggaaacaacaatttctggatattgtctaatgtctcattactcttcacattttcatttgtgtcataatcgtcataaatttaaaaaaagtttgaattcatttctctcttttgtgctccttgcagtatatttgctgaagattctaggtcttgttctttagaatatcctgcagagtagatcttgctaattgtgtcccagggatgtccttgaacatgtttctctgtttctgttctttgtgaattagttattgtacttaggggctcaaacaggttaggtttgtgaggtgagattacttcatatgtggtggtttgttcatttttcaggagactgtaatatctggttgtcttttaaaatgcctggattaaatgataaaatggccaatgtttcagttatttttcattttttagctggagtatttttatagagagaaacctcatttgatcaaatagtaattactattttgattacttggcaatataatttgtgtaataaaaaaggatcacactaaatgttgattcttttgctttttaaaattggttttcagaataacaaaatggtttcccagcatcctgtagtggtgataaatttgtttcttgtttttgatttcacagttataaactcatggatttaaacttgcatatttcaagcattcgttgttactaactttattgacactcaaattgtcccatatttgaccagtggaggcctcttcaagctggctcttgagtcctttccacaataccatagtattactcgatagcttcctttttgtctgctatgtgtgagatgaacctaacatttcttgctctagacctggagtcagccatttctctgaagagccctggtccgttttagtgataaattcatatttagaaaccatattctgggcactactgggctgttcattttttctagaccttttcagtggatagatctgagaactatatatttgaaagcaatgtcattttatattcatctaattccgattcagaaatgcagcgtttttacttttcatatgctctttctgttcttttttagtcttattcttggtaatgactctatcttagcaagtctgctcatgcattattttccatgacttaacacatagaagtcattactctcaaggacactaccttgtccctgggtttcctttttattcatggcttgtagaccactctggcccacagtgatttccagattcatagcatgcaagcataactcccatttaacagtcactggatactccaggatttactgagttttaaaaattgaagtataacattgacaggaaagtacgcacatattacggacggcatgcctctaccagtacaccagaagtccgttccatgcctcttcccagatactactctcacttcctgctccaaaagacagagagagagagagagagaaatactatcgtcctgatttgtaatactgttggttagttttgcctcctttagaactataaacttttgtgttttagcagtcatgacttttgtgagaaagagaggtctttctagccctttccaactcttaattttatctctagatagcattcagaaaagatgttatcttcatctttggcattctcaaaactcctaataccttaggaatataagtagaaggtcaagcatggtcacttttgggttttagtttcccttttgatttacagaagctctgtttgtattaggaattttaaacttctccctattttgcaaatattctttcccagtcatttgtatttagactttattgctgtactaaccttaaagtattttgtgtagcattatttgactgttgagttttgtgtcctgcataggaggaccacctccactcaaattgatgtgaaaaaacactattctatgttttcttttagttaggttttatacctctttgtttatatctgtaatctgtctggatttggatgtagtgtgaggtatccgtatcaacatttaaacacagataggatgttttaacatctttcagccttttccattaaaataaaacttgcttgaatttcatttacccgtgactactacacttttccatctaccgtcaaacttttagaaaaaatttccacttgggtttttccacttcatcttctctttgtccactcagcgttgcctgcatggattccaccttaccttcacactgacactgcttatgccgagggcaactgtggccttttttttttaattgaatccagtggactgaatatagaccccttcttccctgagctgtatgtgtttatcatcattggatagtttctcctttaaatgcatctcctttagctttaataaaatgttttcttggcttttgttttttttttttttttttttgagatggagtcttgctctatcgcccaggctggagtgcagtggcgcgatctcggctcattgcaagctccgcctcccaggttcacgccattttcctgcctcagcctcccgagtagctgggactacaggtgcccgccaccacgcccggctaattttttgcatttttagtagagacggggtttcaccgtgttagccaggatggtctcgatctcttgacctcgtgatccgcctgcctcggcctccctatttcactggcttacctttctcagtttaccttgtgccgcctcctgttttttgtttctcagttgttaatattttctagaattcattcggttacatcccctgcagtttatattaatgcttatccttgggtgatgcatcaacttacaacctcagtgatcagccatattctgataaccctgaagtctctatcgtcagctcagatttttttttctttcttttttttgagtcggagtttcactctattgcccaggctggagtgcagtggcatgatctcggtgacctccgcctcctgggttcaagcgattctcctgcctcccaagtagctgggactacaggcgcccaccaccacccggctaatttttgtatttttagtggagatgaggtttcactgtgttagccaggctggtctcgaactccctcacctcagatgatccacccgccttggcatcccaaagtgtcgggattacaggcgggagccaccgtgcccagtagatttctttttaaagcaatgtattttttgtccctaacaaaaggcatttaataccaagcccatcaccatttcctcccctctcttgacaaacctcctcctatgtttctcatttcagtgaatgaacagatttctacccttgcacagaaatctggtgtcagaaaaacagggagggaggaattgacattataggtaatggtgttaaagtgtaccactcagtggtgtttcgtgtattcacgatgttgtgcagccagccaccagctcgatctagctttcagacgttctcatcacaccattaaatcgccatccctataccccttaagtaattacgccccctttctcccttccctcattgtctaatctactttctgtctctggatttgcctcttctggatatatcatatagaataagtcatataacatgtgactttatatgtctgcttctttaacttagcctgatgttactgagcttcatatattagtacttcatttctttctgtggctgaatagtatttcattgtatgtatatactgcagtttattcatttgtcgatggacacttgagtttctgccttttgattattacagcaaatgctactacagacattcatgtacaacttgctgtgtggacagatgttagggtatatacctagaagtggaattgctgggtcatatggtaactctgctcaactttttaatcatatgtcattttactttttttaaaaaaaattattttttaaactgagacaaggtctggctctgttgcccaggctggagtgccctggtgtcatctgaggtcactgcaacctccgcctcctgggctcaagtcatcttcccacctcagcctccccgagtagctgggactgtaggtgcacatcactgtgcctggctaatttttgtactcttttgtttcttttttttggtagagacaggggtttgccatgttgcccaggctggcatcaaactcctgggctcaaacgatctgcccacctcagcctcccaaagttttgggattacagcggtgagccaccatgcccagctcatgtcatttttgacttactactttaagccccacttctttaacatcaccaggttaggttgattgattctcttctaaatagccttgttttcttcattgtttcgactactatatactcgaggtacacttttcaagattacttgaattgcttgctttttgtttctttgttctcatcatgcctttttaaacaatcttctacatactacaagattggtttttgcaaatgtaaatctcatgaggtcactccattgtttaaaagaaaaagaaaaaaagaaccacccttcaaaggcttatcattgccctctggataaagtccaagcatgcagggcttacaaaggccctttgctgtccagcttttgacattctgtttagtttcagctgctcccctgccccccgccgttccagtcacatactgattgccctatttcaagtttttgtacatgctcctctacctaaagtagggttcagattctaaaccttgaattccctcacccaaatcctttatttcttttctttttagaagccttttcttattcttcatgattatgttatgtgcccttcttttttgtgtgccctcaaattcttgtactgttgttggagcacattgtaattgcctgtttacttctctggggatcaggagccgatgttggtcaagtgccagaagatgtagatagactgaaagtacaattaataggaatttagcagaagccaaaagattatttgataaattatttagggaagacttcatggagggggctagtattgatagagaccttgaaggaagcattcatgaaggcatggtaaggttctatcactttaaatggattaagcctgttaaatattcatgcatctagacctaggaagattcatgctgggggctgaagccatgacaaaagtgagacattggacatttttcaacattgcttttgtattacttacatggaacaagcaaaggacacaattatgcctgtagaagaaatgcatggaaagaatgggcaaaagatttcaagaacttgggggttttgacaagagtaagaagcaatgatatgctttatggaaagtgtaaggaaattttcaagggtaattttgaccatgtatactaatttcagagcttactcacctatgtttataaaccctggacttctggtggaaaatgcaacaactaggtgatttctggatatattatagaatctttcacaagactcttgtgtacagtgttgtagaaaatggtccgagtaatgtaatggtgtttctctagaaaaaggttggaaatgagatcagtcatgtagaaaataactcctcacagtgcatttgtgtgtgctgcactctgttcctcagttgacaggaaagtgggactttctgttttttaatagaatgtctgcaacatagttggcgctcagtacacatatgcgtgcataaacaaaataacagtgaaaatgctgttcccttcttaatgtgtttgcactttcaatatctttaaaaagtattttagattagccactttaaagtaaaagtacatttcttgtgttttgaaatacagagctgattttaactatttgtaaaagtctagtttgcctgttatgcaaaaatgttagacttataaaaatctcccctcacatttcaagaaaagaagcacttcatgtttaaacataaattttttatttttatttttgagacggagtctcgcattgtcacccaggctggaatacagtggcatggtcttggctcactgcagcctctgccttccagttcaagtgatcctcctgtctcagccttctgagtagctgggattacagatgtccgcctccatgcccggccaatttttgtatttttactaaagacagggtttcaccatgttggccaggctggtcttgaactcctgacctcaagtgatccacccatcttggcttcctgaaagcgttgagattacaggtgtgagccaccacgccctgcctaaatataaattttcactattggctttctcctattttgctggcatgttgttaaatcgtagttgttgaaataataccatctcttgatttccccaaaaattaatatctcctcagttacctaaacattggttcagtcctttgtagcactctgagttatattatactgcctttcatcattagacaaagctgcctgagaatgatggcaggtagtatacgagaattacacacctgttgagactcccagcaagtccttttcaaaccactctactcctgtgtgttctttgtccacactttccaatttgagccaatgagtactcagttccactggccggtaaaatgtgataattgtgtgggtgattgatacatgcattcactattgtgattgttgttgtgttggttcctctggtgtatatcagtacttattaaattgtgtgtgtgtgttttttttctttttgagatggagtcttgctctgttacccaggctggagtgcaatggcgtgatcttggcttgatgcaacatttgcctcccgggttcaagcagttctcctgccttagccttctgagtaactgggattacaggcacacaccaccatgcccagctaatttatttatttatatattttttgagacagagttttgcccttgttgcccgggctggagtgcaatggcgcgatcttggctcaccacaacctctgcctcctgggttcaatcagtttttctgcctcagcctcccgagtaactgggattacaggcatgtgccactacgcccagctaattttgtatttttaatagagacggcgtttctccatgttggtcagtctggtctcaaactctcgacctcaggtggtccacctgcctcggcctcccaaagtgctgggattacaggtgtgagccaccacgcccggccaaattgtataatttaagtatgtgcagttcactgaatgtcagttatacctcattaaagttgtttaaaaatttctcacatgatctgctcaccatcaggaggccagtactttattaagtctggtgtctctggaaacattctgggctctgtaccgctgctcacctgctccttaaggtccctgtcttggcctgtgtgcccccaccttgccagttcctcgcctctcttgtttcccaccctgtcatcctttctccatgccacagcactctctttagaggaggagaacctcacgatgctgcagccattctgtatgctccaggtgttactcttaagctgctcctctgtcccagaagctgtggctctcagagggtcgacatatacagacaagacatatggggcccctgctctccttgtgctcagagatggatgggcacacaggagcacccactgtagaagcaggtccccaagactacagggacaagtcaaataggtgtacaaatgttagtataaatgaaagttattaagcgcagtacattccaatgaaaaggtatgattagacactctgaaagtataccctgaagacagcagcataagaattgccaacatgatttgatttccagggctccctctcaatgagaatctctgggggacgggcctggatatctgcattttaacaagcttccttaaaagaccactgtagggccacttagaatgacaagagcctggctggataccagtagaagttgatcttctggatagtttgctttacccagggctttcttacagtataggcatgaaaatgttttggccatcaagtagcattttgcctggcaaggtatatctatttaatggtttaaaacttacataaaacatgtacgctcaagttctgtaatttatctactggatgcaaattatgtgcttaaatgtattgattaaacttttctttttccacagaactcaacaaaaatccagtggaaggcttttctgcaggtttaatagatgacaatgatctctaccgatgggaagtccttattattggccctccagatacactttagtaagtataatggaactgacatcttcaaaatggagctcttttaatacactgaattaaaaactattttggcaggctgggcacggtggctcacacctgtaatcccagcactttgggaggccaaggcgggccgatcatgaggtcaggagttcgagaccagcctggccaatgtagtgaaaccccatctctactaaaaatacaaaaattagctgggtgtggtggcatgcacctgtagtcccagctactcaggaggctgaggcaggagaatcacttgaactcaggaggcagagattgcagtgagctgagaccacgccattgcactccagcctgggtgacagagtgagactccatctcaaaacaaaacaaagcaaaaccacaaatattttggcaaactgacatgaaattattttttaaggagcaggagaaatggctgtattcaatatcctttgtactgaatttgatcatggaagagtttttgtgttttgcttgaagctctaatgtctaagacctattgctattaaaaataatagtttcaggccgggcgcggtggctcatgcctgcaatcccagcactttaggaggctgaggtgggtggatcacctgagaggtcaggagtttgataccagcttggccaacatggtgaaaccccatctctactaagaatacgaaaattagctgggcatggtggcatgcctgtaatcccagctacccgggaggctgaggcaggagaatcacttgaactcaggaggcagaagagttatataatttttggacattttaattgagaatgtattacacacatcagtgttttaagaaggctaaggagaactttcaagatcgtctcttttcatggttctctacttgagtccccaccgaatactggttagaatctaggtgttcttatcccaaactaaactaatggtcactttctcctagtttattgaaagttattgttatgctctatgataatctattaactgactattaattgttaaaccaatggcttaaggatagacaacaatgtagtggtgtgaaagagcagtagaagaagagaaatagagtttaaaaatatttcatgtcgtacatttctagatgcaaagaccacagtcttcttttctgctctgagtgtttgcagactaacttaaatttactagtatgtattgttttgtaagatgcatctgctggcttggtgcgttggctcacgcctgtaatcccagcactttgggaggctgaggcgtgtggatcacctgtggtcaggagttcaagaccagcctggccaacatggtgaaaccctgtctctactaaaaatacaaaaattagctgggcatggtggcgggcgcctgtagtcccagctgctcaggaggctgaggcaggagaatcgcttgaatccgggaggtggaggttgcagtgagccaaaattacgctactgcactccagcctggtgacagagcgagactccgtctcaaaaaagaaaacaaaaccgtctctggtctttggtgtacatttttaaaagtgttggctgttgaattgagatgtgaatcacagcaatatttctggcagctctgctggagtgtgtatatgctgctgagaatactggtggtcacttctggactgtgccttcctgagatcactagcctttgctcaggaaagagagagcatattcctagggcaggacctgagaaaggcaaaggaaggtacaggggaatgaagaaaggtttgttagaagtaagccttttagaatgctaccaagaaccatgtacttcatagaatgcttaaaaaatatttgttgtcggccgggcgtagtggctcacgaggccgaggtgggcaggatcacctgaggtcgagagttggagaccagcctgaccaacatggagaaaccctgtctctactaaaaatacaaaaaatttagccaggtgaggtggcatatgcctgtaatcccagctactcgggaggctgaggcaggagaatcgcttgaatccaggaggcagaggttgcagtgagccgggatcgtgtcacccactccagcctgggcaacaagagcagaactctatctaaaaaaaaaaaaaaaaaagttcttaaaaaacttcttagcagaaagtagtgaggttcttgtaattatttcagtggaatggagagagtagaggccatcttggaattgtttgaagagcactattggaagtgaatatatacaccttacgtttaaataactgcctgtgaagggaagtagaggcttgtgctggggggaggggtgttataggattgaaaataaattagtataggctcagatggtacccagacctaagtgattaattcaccactttataattagataatagaaatactgtaccaaaattctgtaaaagctgctgtgattatctctctgtgccatcattagccctcatgtagtcactagagggcgctccactctcttttcagtctatgtgattgataaccggtaccgttcaaggattactttgagactcctatagttgccacaagtcttaattcagtcatactcatatttatatagcattacatttttatttttattaatgagtctttccagtgcagtagtccctaaggcctttctatgaaatgtacattctgaaactggtgtggtataccaactgttttcagactgattatcaaacagtatggataaccactcatatccacagaaattaaaatttcaggtagaagtggcaataggtttgtagtacggaagtttagggtggatacagtggctcacgtctataatccctacactttgggaggccaagggtggatcgcttgagctcagacgttggagaccagcttcggctacatggcaaaaccctgtctctacaaaaaaaaatacaaaaataagtcaagcatggtgatgcatgcctgcagtcaggaggctgagcccaggaggtggaggctgcagtgagccaagattacgctactgcactctagcttgggcaacagagctagaccctgtcttaaacaaacaaacaaaaccagaaagtctaagaaacctggatatcactgtatcattataacattttataaattattaatgaatgatgactgtataacttttatctctcttttcctttcatcaccagtggctggtctgttcaaggagtatgtcttatttatttattttgtttttaagcactggcaatgatatgaaaaatctggagaatcttaagattatgtgttttgtagtattgccttgggtagatatagaaaatgaagaatcagttaaccaaaactctgaattacattcttttacagttgcaaaattctattccagttataaattattttccagtcctgtgtgagacatagaggcagaagccatctcttctgtaatgaagttctggagggaatgaacctagtgcctacattgcttggaaatggaatgatcagtggtaatgccatgcggtttatcacgtagtgttcaagaacatggactttggggactgcctttggttagctctctaactctaccactcttcttagttgagtgactttgaacaattacttaaatttggtcttagcagtttcatttctagggtaaaaaccctatgcttaggaaatgtttcaaatgttccatgttctattgcttataatagcaaaaaaaaaattattttttccccttttgcagttttattatttatttttgtaaatgtcaattataattcgaaggacactttgtagttactaattagactatatgaaaaactgtacagactgtttgtactataatttgtgtccctaagagattaggggactcagtaacagaaaaatcaactcagaagggtcactgctcagcagtccacataaccacatagtagagcccaagctactggttgtgagtagaaagagacttcatacaaatatcttcacatgtcttctagcattatgcccctaccaggaaagggaatgtctgtcacaattttttttttttctgctgtaagataaagaaaaggctgtatcccttagacacatacttaatgaagacaatctcaaaagaagctcctgtgtttttctgttttcactgttcttttctgaagttcacctggatgttccagagcagttttctaaacctttcattgttggttggccttttgtagaattcttcagcaacacacaatacagaagacacaggctaaaatagttctcacaaatacactttgaaataggtgtatttggatataaatacaacttgccattccattattttttttctcatgactaaactctaaatttttaaaaatggagattttcaaaccagtgatgtgcaaaagcccattctcatgacacagtcatttaaacttattaagtatgggaaaattttatttcttccctttgtcttgtggaataatttaggttctcaccctgggcatgattcacaaaatagagtaagaccacagataaaagtcacatagaatcacaggcaatgaagaaaacttctaaaaacaaatatcccccagtgtccagtatcatccatcccagcagtgatggaaatgatggccaccccaagattctgaatggagtgcgtgaagccatatgcagttcccagttgatgttcaggaactacagatgccactgttggccaaaatgcacaggcaagcgatgaataggagattcccagaagacacagcaacccaagggctccacatcataaaggccagcatcatgtgggacacaagagtggctgcaaccacacgcagaacccagatgctgttcttccccgtgtcatccactgggagcccaaatactggggtgtgggagctgataacgacatatacaacactgttcattgcacttgctgcctggaaagaaaatccaaatttgtctgtaaagaaaactttcccaagtccaataaaagggaacatggcaacacaatagcagacacagatgataaatatgagccacaggggtaaggagaaatcctttacatcagttaatgtaaaaacttcccccccctttttttgttgttgttgttctttatgaaggattctctctgctctcgcatctaagtaagcaagagccaaggaaggcacagattagtgaaagaatacattttatacccccaatcttaagtgtgaccccaggggttgtgtgaccagcagaaccccacgaagcttcaatcttagaatacagccaactcacgaagttcatgtttaccgtacttccaattctagccatgctaaattgttggagtccagacaccaggtttaattctttgtctttaaaccagctgacagcatatgtcctgggcaactgctgagcactccccaccaatccaaacacaagtctttcaaattccatcagccaaaaaacattaaatattccacccagaacaaaacaacctgtccagtgcaaataaaacagctaaaagtaattgtgccccatcatattccaaatactcggtcttttaaaaagccaccaaagaaacacaaaactacattgggccaagaataccaggcatatagcagcatgaatttcatggtgttcacctgcctgttccgtttatcctgagtctgaagggcagcaggattattatagcaaaaatagctgctgaagccaaggaaacacatcaataacagcatcaaaagtcatagccaggtgactggaggccacagaagggccagcagcacccatgctttctcatccttctcctccattgcgcccgtgggaggctgagaggcaaaaggggtgacaactccaggacctggcagaaaagcagtgcccacggagcacagccaagtcagtgatcacatgactatgtgattctgactatcatagaataatagtgaactgtggcggatagaatgaatggacaagagacagctacaacaggactatagattaatagaacaatgttgagcaaattgcagacggcagcatacagcacattatttacataaaataaatatggcagtatggtaggatttgatccttgtaagatttttataatttaactcaaaaacagtaatggaggcctcatggaaaaaaattgaactaggcctgggtttttaaacactttcaaatgtgaaactgctggttacatatctctctctctcttttttttttgtttgaaaacagagtctgactctgttgctcactgcaacctccgccgcctgggttcaagtgattctcctacctcagcttcctgagtagctgggattatgggcacctgtcaccatgcctggctaatttttgtagtttttagtagagatgggatttcaccatctcggccatgctggtcttgaactcctgacctcatgatctacccgcctcagcctcccaaagtgctgggattacaggtgtgagccaccgtgcccggcctacatacctctttttaatatcatgatagtacttatactatagcatctgtgatgaagataatatgtaatgaaagatattttgaattaattggtgcctttttaaattttattttatttatttatttattattattatttttggagacagagtcttgctttgtggcccaggctggagtgcagtggcacaatcttggctcattgcaacctctgcctcccaggctcaagccattctcctgcttcagcctcctgagtagatgggattacaggcacctgccaccacgcctggctaatttttgcatttttagtagagacggcgtttcaccatattggtcaggttgttttcgaactcctgacctcaagtgatccgcccgcctcagcctcccaaagtgctgggattacaggcgtgagccaccttgcctggccacagtcacatctttctatatttgaaaaatagtggatatgtgacatgttaatgtgtagtctacagtgttattctactctatgggttttgggctttctctttgctaacttggctgctcggtagaagtttgcacgcacaagttgggtactagttagttaagcatcaaaaaaaaaaagcaggtaggccaggtgcggtggctcagaaggtcaggagttcaagaccagcctggccaacatagtgaaaccccgtctctactaaagatacaaaaattagcgggacgtggtggtgtgcgcttgtaatcctaggtacttgggaggctgaggcaggagaatctcttcaacccgggaggcagagcttgcagtgagccgagatcacgccactgcactccagcctgggcgacagagcaagactccatctccaaaaaaaaaaaaaaaactaaaaaaaggaaaagaggggaggggcaggtagaatttccacaggtaaaatagaagaagaggggtccacagataggagaaaaactcagaaatgctatggttgcttcagagtgggcaaggccattttcagatagagtgaaaattgtgtgctttaaatttttagggctactcttttagttgaatttggttgacattttagagattgaaaacaatttagagggtctaagtcagtttttcatgatgaggattccagtcagctattatgaagctttttagtgaatgtaaccaatcaaaagtaagtgacgtgggaaagctgacttaatgttgtcaaggaatcaagtggcaagtggctgccagtagaatcaagtgcaggggctttgtggcagtggctttgatgtccttttacattgactctttttttgttgttgttgagacagagtctcactctggcacccacgctggagtgcagtggcacaatcttggctcactgcaccctccacctcccaggttccaacaattctcctacctcagcctcccaagtagctgggattacaggtgcacgccaccatgtttggctgttttctgtaattgtggctttcaaacccataattagaaatactttacatcatgacgcagtgcatacatatgtatatatagattagtgaataaaacacatacatagattatataactgaaactacttgtgataaactctgttttctatttttgttaacaaaaaaactttgatagtgactcattaaattgcttttgcagccctgtttgaaaaactagtccatgtaatcagtatatcctaagacccattttggcactaacttacacagagcaacaggatcagtagataaagacttaactctttttggtgtaatgcactcttcacaacagctattccagtctctattccctcaagccctcatgcttcttcctttcaatagataacctcatcagttgtgaaaagtaaggcgctatggtgggccttacttcatttctacatttcttcgaatatctcttttaaagcgcttgttttgtacagtttccccatctagttactatcttcaactgttaaattttttgtataaattgtcctgtttattatgcttaagtactttactaccctgttctttaaccctttacagctttttttcctattgctttttactaaaaaaattgtattatcaaggtcactgactttatactctgagtcctgtggcatttcctaattattcagaaatgtttggtgttaatgatctgtctctttttttaaacttaatctgcaccttccccatgtcttatgatcagaaaaagcaataaaaattcatacttgcttgtgaacagttcaagctatattaaaaagagcagagagtaaaagatctcgtaacactaactattgttagttaactattgttatgtattgatgtcctgtttctggacatttttctatgtgtatacaaacacacccccaatttttcacttgttctttcctttcttttcttttttcttttcccaggctggagtgcagtgcagtggtgcaatcacagctctctgaagcctcaacttcttgggctgaagggatccttcccccctcagcctctcaagtagctagaattacaggcatgagccactgtgtccggcctcccactttttctttaaagacaaattagcttgttttagaaatacctgcttttaaaaatgtaacaatagattcctcatatcattccatgacaacacttactactgatatttttcttggtagatattttccttctgccactaaaatgataagctccacagtgctctttaatgctttgttctctgttgtatccttttacgtagaccaatggttagagtaactgggtaatcaatgtatatttgttcagtgaatgaaaaccatttaatgagctgagaatttcatttctcactgatctgaaacaaccacaatcatgattctaatggttggacacattgaacaacagaagaatcagatgtgcaaatggtactgcaataaagaaatttaaagaggtcaatgtactagaagggacctggtggctagtttagattttagtcaaataaaatctttctagaggtaacgtttaagctgagtaccgaatgataatcagaagacaaagggagaaaagtatttccaacagaggaaatatttagtaccaaggccgcaagacagaaatttagtatttttgccctttaaggctgacttgatctctgtggttttagttaatgtatacaactcattgtattgttcttttgatgattccttaagaatgactgctgattaagtgtcagtgatctggaggtgtattgtctaaaatagcagtcacagggcatatttcaagtggttggtggctacattattggacagcacaaatacagaacatctccagcattacagtttggttttacagtgctgttctggaaagtcactcttgagattttttttgctgctatacccctggagtttgacacataaatgccgagtaaatacttgttaaatgatgaaatgaataaatggatagatggaggcaatatatctattcctagataaggaaaaagaaaatgtccataagttttgagatgagaaagggtttgatgtgtttgaggaatagaaagacgactggctagtttcaaatcaacatagagaaattggtgatgttaaaccttctgaattttgttttaagtgcactgggaagtgatggaagggtttgtagcatagcagtaatatgatctgatctgatctggtgtgaatgtctttttagcagatgatttcattttaccagctctcttgaaagtttaatcaatgtgatagccatgacagtttattaaactacttatttgagaaagtaactgcctgtgggaatccagattatttgtttacttcatttttgatgttagtgctagcacccttgttttatatttgttttaacacttctatacttaaaagcaggaacttataggcaagaacttctttttgttcttttttccagtgaaggtggtgtttttaaggctcatcttactttcccaaaagattatcccctccgacctcctaaaatgaaattcattacagaaatctggcacccaaatggtaagtttatctagttttacttttacatttgcagatttgatggcctgttattgaagtgttcaaggtcaataagaaagatctgtttctcagtgaaattgctttggcatttttgtactgttcattgtgcacatggctgtgtactaaaacctttaaaaggaggagaggccaggtgcagtggctcacacctgtaatcccagcaggccaggcaggcggatcacttgaggtcaagagttggagaccagcctggcaaacatggtgaaaccccatctctactcaaaatacaaaaattagttaggcatggtggcacacacctgtaatcccagctacttcggaggctgaggcacaagaatcgcttgaacccgggaggtgcaggttgcagtgagccaagatcacaccactgcactccagcctgggcagcagagtgagaccgtgtcccaaaaaagagaaggagaaacagagatcatgtggaaaaagttattttttatttatttacttagttttcagtttggtttgagactcgtgttttaaaccagagggcatggttactgagggataacatcaatagaactcctataattgaggggataattatcaaggtattagatgattcactggctattacaaagaacacagaaattatgaaacctggttctgtaacttatagtttttcatattatttttataccatggacaactcttctatgtgtattcataggtgtaagattactggcagtgtcatatgaaacaacgtattacattttttaagcctggaaagcatctagtatggctgtgcacgtagtgatgacattgactttttttacttaaagaagagctaccacttcaaatccacacggtggcagttctcctgcctagccagctgccactggactctctcccctgtatataagcccccaataactacgtcttatttaaaaattaaaaaaaaaattctctataaagtaaaataaagtccccaaagtttaggccagataagctatatttataaaacagtctctctgaacttttggctttgttttgtatgatagaacttgcagagatttcttttctaattattttgactatgtaatcagagttgtctctttaggctattatactaatttgcatttggcttcgcatcatcaagacttctgggtgcagggaatagaaacatatagattagtttaagctggaatcagcgagacaggaatgaatgattgaatgaagttaaacaaggatttatcggaaggatatggaatacgtaatagaagccaaggcttgaaaaccagatgggcattaggagagactggaactggcaaatggagaactactgggagccaagggacttagcgtattttattgcatctaaggcagcagtgatcgtaaaagatagtgatttttcctaccagtaagaagaggaaaatatctctaacagttgatggcagaatgcattaaccgtattcctgcatgatgcgggcatgcatgaatgggtgacgcttgcctcttgtgctttggcttttcttttatctcttcctaggctttcgacagtttcttctaccttcacttgcattacttgattataataggcaatcgttttgcacctatttcgaagatgtaacagattctgaatgttggcttcaccacagactagctgtgtaactctaggcaaaccctgttggagccttaagctagctagcttgccttcctccctccctccgtctctccttcccccactctgcccctccttttccccttctctccctctctcgctccctccctccctcacgtacgtttctcccattccgtcctttttttctaagacagggtctcactctgccacccaggctgcagtgcaatggcatgatcacagctcactgcagccttgacctcctgggctcaagtgatcctcccaagtagctgggatgacagggacacgccaccacacccagctaatttttgtttttttttgtaaagacggggtttcaccatgttgttggccaggcaggtcctgaactcctgggcacaagtgatctgcccactttgtcctcccaaagtactgggattacaggcattagctaccacgccaggcctatgttttctatctgtgaaaattagatgaaaacatacatgtaagcaaatacatgggagacttcccttctggtaaaaagaaagagagcaatcacctaggtagtttaagaggacagctgataaaatggtggtgtgttttgttttaaggttgaagagacttttttttcttttcttttcttttcgtttctttctttttttttttttttttttttttttgagacggagtctcactgtctcgcccaggctggaatgcagtgggactatcttggctcactgcaacctctgcctcctgggttcaaacgattctcttgcctcagcctcctgagtagctgggattacaggtgtccactaccacgcctggctaatttttgtatttttagtagagtcggggtttcaccatgttggacaggctggtcttgaactcctgacctcatgtgatctgtctgcctcagcctcccaaagtgctgggattataggcgtgagccacgcgcctggtcttagatggaattttgaatgaagatgatgcttggcttgaacttcattctttaggctgtgaggactcatttaattcatgacatttaaagctgtacatattgtcatgacaaaaagagaaaatgacaaaaaataaaaaagctatgtaataggtttctcttatattttccttcttgaaagattacactcatagaagattggaaggggaagtcagagagatagcagggaggtagagcattttagcaataatttgagtaaaaaacaataaaaacttgaactaagaatagtgttgcaggaagggtaatttagtttctttgacttgactgccagaggtgaatggtaaaggagaagtaagagtttaggattgactggccatttacaaaaataattatagagtgaaaaccataatgaaataccactttttacccactaggattcctataatcaaaaagataataacaaatgtcaatgaggaagtagagaaattagaactcccatgcactactggcaagaaggtaaatggtgcgggtgtttggagaagagcctggcagtcctcaaaaggttaagcatagttaccataggaccctgcacttccatcctaggaacctaaccaagaaaactgaaacacatgtccagaaaaactcgaacacgagtgttcacagcagcatttattattcataacagccaaaaagtagaaacagcccaaatgtctatcagctgataaatagaaaaacaaaatgtggacccatataacggaatattatttggcaataaaaagaaatgaattacatgatattgttttctaaagaaaagaaagaaatgaagtagtgatacttgctacaacatagatgaaccttggaaacattatattaagtgaacaaagtcagtcgtaaaaggtgacatagtgtacgattccctttatatgaaatgtcaagaatagacaaatccatagagaccgaaagtaggttagtggttccctactgctggaggggaggtgggggggattgaggaatggttgctaactggtactgcgtttcattgtagggtgaaaaaatactctaaaattgattgtggtattgattgtacaactctgtagacatactagacagaaaccattaaatcgtgcttttcaaataggtgaattgtatagtaggtgagttatagagatgttataaaattattataggggaatagttttatgtgactgaccttacatatattcagcttttcttgaggtatacttgctacacccagttagataattagttaaaccagtccagggttcagcaatgagcttaagggccttggaagttactgtatcaggatgatagataacatgataatgaatgggttagttttcctacggaaaatatagttaatgttggagattaggataacatcaaaagtcaaattaaggaaaatgaaaactagaaagtgactgagagaatgttcaagaaccaggggaaaacaagagtaccacagatgccaggggaggaaaatgtatccagcaaagtgttgtcacagtattagttgtcttggcccagaggggtgacttcaggtagctgaaagtacccaggagaataaatatgctatccagaccacttgtggacacagttgtagcatcctgctagggagaagccagtttctaggagaataaaggaatacctgagtagtaagtaaatagagaagatgagggtaaatcagtttttcagaattttaggtgcatggcctcaagaaaaaggaggtagctagaagtatatgcattgtttaggcagcttagttttgtttgtttggttttggtttgggtttttttttttttttttttgagacagagtctcactctgtcgcccaggctggagtgcagtggctcactgcaacctccgcctcccaggttcaagcaattcacctgcctcagcctcccgagtagctgggattacaggtgcgtgccaccaagcccggctaattcttgtatttttattagagatgggttcaccatgttggccaggctggtctcgacctcaggtgatccgcccgcctcagcctcccaaagtgctgggattacaggccagccatacattacagtgggccgagccactgtgcccggcccaggtagcttagtttcatctctaatgaacactgaaatgaaagaaaaaagtaacaagcaaaaattatatggggaaaactaagaaacaccgtggcaagaggaaagtaaacattaagtacataactggctaaaggataagaacagacatttcacaaaagaggaaggacatacaggttatatccatggaaagttgtcaccccaaaagcatttagaaaagtgaattaaaccagatgttatatatgaaatttaaacagcatcaataaaggaaaatgttcatcctgaggaggcaatgaaatggccatctcagattgctgatggcagtataaattgatacaatcctttaaaatatggtttgataataggtattaagcctaaaaatcttctcattctaaaataaatggtatgtttaaaatgacatgagaaggttaaaaatgtaaagatcctggattagtgataacttgattttttttaaaaaggaaaatggatcttatatagtggtggtagaattctgtacacatatttaatagcatgtttttaaagaaaaatgacttggaaaaaatccttattacacagtaagtacagaaaacattgtaaaatagtaatactctatgaaatttttatgctgaattttgtagtgttacaagttttgatgttattccttttttttttttttttttgagatggagtttcgcccgttgcccaggctagactgcagtggtgtgatgttggctcatggcaacctctgcctcccggcttcaagcaattctcctgccccagcctcccaagtagctgggattacaggcatgtgccacaacagccagctaattttgtatttttagtagagatgggatttctccatgttggccaggctggcctcaaactcctgaccgcaggtgatctgccctcctcggcctcccaaactgttgggattacaggcgtgagccaccacgcccggccctcggtgttattctggccctgattctattttagtaaatagattttactagcagatagggatgggttgggaagaggaaccttaattatagaaaacctcatacataaaacattgaaggcacgggccttgcctgtcatatattcactgctgtacttctctgtcagatgtgtgcctggcatgcagtaggcattgaaaaagtatttgtcggccagcgcaggggctgtttcctgtaatcccagtttgggaccagcctgggcaatatagtaagactatatctctaccaaaaaaaaaaaaaaaaaaagccaggaatggtgccatgtgcctatggtcccaactacttgggaggctgaggtgggaggatcactagagcccaggagtttgagaccagcctgggcaacatagtgagacccccatctctaccaaaaaaaaaaaaaaagtcaggttagccaggcatcatgccatgtgcccatggtcccagctacttggagggctgaggcaggaggatcgtttgagcctgggaggtcaaggctgcatagagctgtgatcataccactacactccagcctgggtgacaaagtgaggccctgtctcaaaaaaccaaaacagcaacaacagacaacaccaaaaaataagaatttgttgaattaagagagcaatgatattgattggtagatacaaactttgattctgattacccagagttcataacagcagaaatactgatgttatgaaacgaaaaataagatttagcattatatttattcacaaatttgttagactatataggataagttaggaatgaaatatacataaacattgtcactactcaaattcctttctaaaatttcttcctcaaagtatgatttttaaaaaaatttacggtgggtaaatgttaccataaaagattagtttcacaatagggattatttatatgatgtataaatgaattagtggattaggacctttttttaatgaataagtaatattttacttttttgctaaactgcttaaatagttatgtcaatacatgtctcctaaaaataaggatgttttcttattaaatgtgtttatagaaaggaggcctcttgagtgtcgtatatgttgatgagttttcattggcagtatggcatgtttgttttgtgaatttgaatatactcctttctcagaaaatacaattttggctttatatgattgtaaaaatatatttcttaggaatagtctctgggcctttgactattaccaatttaagtcggtaagttagtggggaaactaggaggccattacatagaaactcagttgctagtttttggaaaaatatgctttctgcaaatgaagaacacatccaatagttgctatttattcatttattatattatacttaagacatgtaaatgttaggcaccatctacgtgctagatatcttcatgttttacataaatgaaaaagatagcttgtattcctattgggtttgtcagatggatcctgtgtatgtagtacaatctatactatagtcttcttaaaaagtcaacacattgcattttggacattaacttctgcgtatgtgtcatgtttgataaaggtactgtgtgaatcaggatcacatttgtaattgatatttcatgtataaccaaattagtaatatatgaaacaagcctcttcttgaattttgcagttgataaaaatggtgatgtgtgcatttctattcttcatgagcctggggaagataagtatggttatgaaaagccagaggaacgctggctccctatccacactgtggaaaccatcatgattagtgtcatttctatgctggcagaccctaatggagactcacctgctaatgttgatgctgcggtaaggtggtcacacgtcttcccttcccttcactttcccttgtaataaaacctgaactatagttagtatgtatgtaagtatgcatgaatgtatgcatgcgtgtgtgtgtgtgtgtgtgtgtgtatctcttcccatagttcttatttttgacaaaataaatatatttatttacgtatttattttattttttttgagacagggtctctctgtcacctaggctggagtgcagtggcacaatcataggtcactgcaacctcaaactcctgggcccaagtggtcctccagccttggcttcccaaattgttccgattacatgtgtgagccaccatgcctgaccaaaagtgcatatttattgtatacaacatgttgttttgaaatatggatatgttgtggaatggctaatttgagctaattcacatatgcattacctcacatacttactaattttattgtgagaacacttaaattctcctctcagcagttttcaagaatactatacgtcgttattaggatgtaaactgtgacaccaaatttagaattgggggtggaatgggcagagcagaagtgtagtttttcaatgcaatcagatttttatcagcttaaaatggcttgtcgtaactgtgaaatttttttgtaagcctcattttaaccacagagcaaagtcctacagtagttaacacaaaagataaaaagtaaggaatcggggctgggcacggtggctcacaactgtaatcccagcactttgggaggccgaggcgggtggatcacgaggtcaggagattgagaccatcctggctaacacggtgaaaccccgtctccattaaaaatacgaaaaattagccgggcgtggtggcgggcgcctatagtcccagctactcgggaggctgaggcaggagaatcacttcaacctgggaggcagaggttgcagtgagccgagatctggactctaaaaacaaaagcgattgtcatacctaagacaatttaatgcctggtctgaagttcatattattatccccaagttttcaattttcaaaagtttcacatctatagaaaaaaatgtattagttaaatgaacaccagcatacctttcacctaggttcaccagttgtagaaattttgcaactttttttcctaaacagtttgagagtagtttatagataccataacccttcaccccaaaatgtttcaggatctgttccctaagaacaaggctgtctttccatatacacagtacaagtctgtcgttaatgtagtactattattgtttatgcatatataatctatattcacattggattggattgtccagtattctttatagctgccacgcccctatcctgcagttttttttttctttttaaatccagaggctagtctaggaacctctgttttatttgtattcaagttttattagtcggctttaatctagaatagttcctagttccttagccttctctccttctttgaaaagcctttttttcttattcttagaacctttgttagtactatataccaaagccagggcataaaatttaccttttttcttaggttaataacaacttgggtggaatcttatatacagactgagacactatagataactccctttgaaagctatgactgaaattaataatagaattgaactaaaaactggcagaaaactatctatttaatcaagtattagtctaaacaatgtaagacatgataagggagaaggggtgatagctgcattaaaagaaatcctaggaaatcattttgagagagacctgatgaatgtttatatggttcatgctcaactatcagcaattttaataataagatcagagttggccaggcgtggtggctcacacctgtaatcccagccgtttgggaggccgaggtgggcagatcacaaggtcaggagttcgagaccagcctggccaaagtgaaaccccgtcttaactaaaaatacaaaaaaattagccaggcgtggtggcaggcgcctgtaatcccagctgcttgggagactgaggcacggagaattgtttgaacctgggaggcagtgcttgcagtgagcccagattgcgcctctgcactccagccagggtaacagtgcaagactccatctaaaaaaaaaaaaaaaaaaaatcagagctgacaagttgccctttttattttatgtatgtatttatttatttttgagacagagtcttgctctgatgcccaggctggagtgcagtggcgtgatctcacctcactgcaaccacaacctctgccctctgtgttcaatcgattctcctgccttagcctcccaagtagctggtattacagacgtgcggaaccacgcccagcaatttttttgtgtgtttttagtagagatggggtttcaccatgttggccaggctggtctcaaactcctgacctcaaatgatctgcccgccttggcctcctgaggtgctgggattacaggcatgagctactgcacctggcccttttatcttaaagaagagtaaattaatagccaataaccaagaccatgaatatgcaaaaattactttattaacccttcaaaatagctgaatctaaaaagagccaaatgtactgccagagtaaagtcattctcttgatgctaaacattttcctaagtgttgaaataggccttaatgtgaggttgaaatatgcaaatatgagttctagtccaaataccacaaattgtgcaaaatctattccttttttttcttgaatcccactggttcttccttctgatttaactagttagttgtctcatattaaaaccaaaaaccatgacttataaacagtttaccattctttttttttttttttttgagacagagtctcactctgttactcaggctggggtgcagtggcacaatctcagctcactgcaacctccacctcccgggttcaagtgattctcctgcctcagcctcccgagtagctgggattacaggcatctgccaccacgcctggctaatttttgtagttttagtagagacagggttttgccatgttggccaggctggtctcaaactcctgacctcaggtgatccactcacctcggcttcccaaagtgttgggattacaggtgtgagccacccggcccagtttactattcttacttgctttttcttctctcatattacacctttgatcatattttcatagtattgattttctgacctctcagtctgcagtacctattccaggaaacccgcatttttcttagccacctctctcctgggtccctttcttctttggctccaatttttttttttttttaaagatgtagtctcgctctgtcgccaggctggagtgcagtggtgcaatctcagctcactgcaacctccacctcccaagttcaagcgatcctcctgcctcagcctcctgaatagttggaactacaggtgcgtgccaccatgcccagctatttttttgtatttttagtagagatggggtttcaccatgttggccaggatggtcttgattacttgatgtcgtgatccgcctgcctcggcctcccaaagtgctgggattacaggcatgagccacctcgcccggccgctttggccccagatttgattgactctctcagcctggggcttagttgatttgctcagattaccccttcactgctcttctcaattgaatcttttgtttcatggatcccatttcttctttttcttcttggttgatttcttccttcatcctagagtaatgttttagggtatgtggcaattaaatccttagtctatttatgatgtaaggtgcttttatttttcccttatacttgattgatactttgtttctaatattatagggagaaaatcaaatttatatagaatttatattttactatttcttattgctgatgtgaaaattggtactaggctgattcttttccatttttaggtgacttgttcttttttccttttctttttttccccattgtacttaggttcttttctttatgattggtctttggaaatttcacagagttgtgtgaactctttttgatttgccaaattaaaatttgctttaattttaaagataccagccctgggaaattttcgttttaaattattttgaggctgggcatggtggcttacgcctgtaatcccagcactttgggaggccgaggcaggtgagttacttaaggctaggagtttgagaccagcctaggcgacatggtaaaaccccatctacaaaaaatacaaaaatcagctgggtgtggtgatgtgcacatgttgtcctagacgcttcggaggctgaggtgggggattgattgcatgagcccaggtgttcaagcctgcagtgagctatgatcaccactgcacttcagcccaggcaacagagtgagaccctatctccaaaaaaaaaaaaaaaaaaaaaaagaaagaaaagaaaagaaaagaaaaagaaaaagaaatgacagtctcggggggaaaaaaacaaatggtatttatgtcactcaaagctatatggctatttggatgacaaagctactaaactgaaggtaagggtaagggttggaggaagaggtgtcttttaaattccaaaatgaaggagtaattgtttttggcaccaatacccacactagcagttcttttatttattttttgttttttttttgagacagattctcgctctgtcgcccaggctggaatgcagtggcatgatctcggctcactgcaacctttgcctcccgagttcaagtgattctctcacctcagcctcctgagtaacagggattataggcacgtgccaccatgcctggctaaattttttgtatttttagtagagatggggtttcaccatgttggccagtctggtcttaaactcttgacctcaggtgatccacctgcctctgcctcccaaagtgctgagattacagatgtgagccaccacacccagcctagcggttctaattatagtattcttcagtatatttatataaagtttatatattattattttgggaaagttaaaattttggatataggtgagggaaaatgttgagtatacagactttcaattaatctctattttcaggccctcttttttttttttttttgagagacggagtctcgctctgtcgctcaggctggagtgcagtgtcacgatattgcctcactgcaacgtctgcctctcaggttcaagcgattctcccacctcagcttcccaagtagctgggactacaggcatgcaccaccacgtccagctaatttttgtatcttttagttgagatggggtttcatcatgttggccaggctggtcttgaagtcctgacctcaggtgatcctgaggtcctgcctcggcctcccaaagtgctgagattataggcgtgagccactgtgcatggcctcagccccactttttattcaggctcttctcagatttgccatttccaaattttagcttctctaggcctctgtttaatagacccttttccctttgtttcctctctcctccaactcctctctctcctgctcttccctttccctcccctcccttcattaccccactgttctgttccatttttgtatgtcaggcagtgacagtgataattgtcatatattttcctctacagtagaaatggtacttagtatcatctcaatatgatgcatcccacctatctaccttatgttgcagacacttttatgtttattttctggttgtttccaatagggagagttggtaatccttcagattaccaactgaatgtctttttttgagatggagtctcgctctgtcgtccaggctgcagtgcagtggcaccatctcaggtcacagcaagctccacttccccagttcaagcgattttcctgcctcagcctcctgagtagctgggattacaggcatgtgccaccacgcctggctaatttttgtacttttattctcaccatattggtcaggctggtctcaaactcccgacctcgtgatccgcccacctcggcctcccagcttgctgggattatggacgtgcgccacggcccctggcctgaatgtcttattggtatattttagctttctatttcagtgtaatacaaaactgtaaatgttcttttgtgacctttttcttttttaaagataatttttaatgtagaggtaatttgcataggagatttctgcctgtatatcctggtagtgtcttgaaaaagtatgtctaactgctttctaccttttcaactctataatgtttctgaagtgtacaaatcaccaagggattacattcaaaattaaaataaatatttgagattataaaggggagtttgcatgaaatcacttgatactgcttttttaatctacagaaagaatggagggaagatagaaatggagaatttaaaagaaaagttgcccgctgtgtaagaaaaagccaagagactgcttttgagtgacatttatttagcagctagtaacttcacttatttcagggtaagtttattttaaatatcatacttttgtttttttgtaagtatcctattagtttttggaaattgtgtgatttgggtatttgaattacattttttcattgacttcattttttaatggtattatcctgtagtctcgttctcaaaactactgtataatctgcttgcttttctcctaagacacccagctgtttttgactagatattctgcattcatatggttagtatgctggtctgtttcttttcactgatggtaaagtttctaatgataaggttgttatttcagtttagtttctttgtttgactttttgatctagcatcctgatcacttgggcactaatgtatcttcatatactgtattatgtagggtataggcaagactattagtcatctacctattcctttaaggttggtcttctggccaggcgtggtggctcatgcctgtaatcccagcactttgggaagccgaggcgggtggaacacctgagatcaggggtttgagactagcctggacaacatggtgaaacctcccctctactaaaaatacaaaaattagccaggcctggtggcgtgtgcctgtaatcccagctactcaggaggttgagggaggagaatcgcttgaacctgggagacggaggttgcagtgagccaagattgcaccgtggcactacagcctggacaacagagcaagactctatctcagaaaaaaacaaaaaacaaacaaacaaaaagttggtcttctatctccttggtctttacagatagggccagtagttaaaaacttcccttttattgtataacatctgtccacagttttatgttaggtctagaaaggagtcaaagatggaaggcacccatccaccttagaagaggaaataatatagattaattgctcacatgtgggttatttggtctcttcttttaaaattaaatattgaaatgatagaaactgaagtgaagactatcctttcagggatcatttctatagtttgttactatagaagttttctgaaggtgtagagcaccaaaggatacaacattgagctggtttcaaattcagctgctttgattcagcaagctgcaacagttaaaaacatagcagaaaattgttattgaatatctatgtctctgaaaacggaatagttctgcaagttggtgaataaagtctaagagttgtccagctacagaaacaagatgccagatgattcgtaagacctattcgtgatatttaaattactcaataaaagacctattgatttgtgggggttgagggagaaaccgaaatacactgtctgaaaaatcacaatccatggcacatcttgagtctacctattttaagaaaatgaacattaccattatcttctgtcccctacactccgctgctttcttctgtccctttctcatattcctaactctgggtttactattgcttttcttcataattttaccaaatttgcatgtttaaacaatgtatttcatgattttgaactgtttatatgtggaatgataatgaatgcattcttctgttacttttattgctcaatattcttcaaattgatctgtgttgcaaataggtacatttcacctgtgtgctattacactgggtaaattaccgctctactccttattctcattgcagttattttctgaattggtgtaggggtgtttgttctttttctgttatagagggtggctatccttgtttcctgatttgcatgtactgtaagaggttctctagggtatatacttggggtggaattcttaaatcaagggtacgcgtatttcattttgagtagataatgccaaattgttttctaaagtgttccttcttttcatagtcccattggcaaggataaagatcccctttgtggccaggtgcggtggctcacacctgtaatcccagcactttgggaggccgaggcgggtggatcacaaggtcaggagttcaagaccagcctggccaatatggtgaaaccccatctctactaaaaatataaaaaattagccaggcacagtggcgtgcgcctgttgtcccagttaggaggctgaggcaggagaatcgcttgaacccgggaggcggaggttgcggtgagccgagatcacaccactgcactccagcctgtgcaacaagaacaaaactccgttccaaaaaaaaaaaagattcccagccgggcatggtggctcatgcctgtaacccagcattttgggaggttgagatgggcagatcacttacaagaccagcctggtccatgtggctgaaaccccatctctaccaaaaaatataaaaattaccaaggtgtagtggtgcactcctatagtcccagctactcaggaggctgagatgggagaatcacttgaacccaggaggcggaggttgcagtgagctgagattgcatcattgcactccagcctgggcaacagagcgagactccatctcaaaaaaaaaaaaaaaaaaaaaaaaaaaagcccaggtgccgcggctcacacttgtaatcctagcacttgtgggagctgaggcaggtggattacctgatgatgggagttcaagaccagcctggccaacatggtgaaacctcgtctctaccagatatacaaaaaattagccatgtgcagtggtgcacacctgtaatcctagctactctggaagctgaggcaggagaatcacttgaacccaggaggcggaggctgcgatgagccgagatcacgccactgcactctagcctgggctacagagtgagacttcatctcaaaaaaaaaaaaaaaagtctatctatctaaatctggatattgtggacttaatatgaattgccctagttaccagtgaaattgcatatcgtttcatgtgtttgaccattgaggttttctctgtgaattgcgtgttcaggtttttagattactttttcagtttgttgatttgtgtacttgtccttttattttctttgtggtatcctttggacaaactgaggttcatatatatatatatatatatatatatatatatatatatatatatataacttttttttgggggcagagtttcgctgtgtcgctcgggctggattgcagtggtgcaatctcggctcactgcaatctccgtctcctgggttcaagcagttctagtgcctcagcgtcccagagtgctgggattacgggcatgagccaccgcacctggcctgaggttcttaattttaatgcaggtgaattgattagtcttttcctttatggattttacttttcgtttcttggctagagagcctgttcttttttaaccaccaaaaatctgttttgtttcgcttttcatatttgtgttgaatccattgaaattgatttttgtgtatggtatgaggtagaggttgaacttcactcaccccactttcccctgatgtgtaactgttgactgtaccatttattgacaagtccttgctttcaccactggtacacagtgcctgttatgttctacaatcagatttccaacacatcagccagtacgtgttgatctgttttgggcatttttttttttttttttgagatggagtttcactctcattgcccaggctggagtgcaatggcgtgatctcagctcactgcaacctccgcctcccaggttcaagcaattatcctgcctcagcctcccaagtagctgggattacaggtgtgtgccaccactcctggcttattttgtattttttagtagagatgggatttcaccatgttggtcaggctggcctcgaactcctgacctcaagtgatccacctgccttggcctctcacagtgctgggatgacaggcatgagccactgtggctggccatgggcttttgtatttttcaatggttggcttgtttatcttaattttaatttatttttgtgattaaatgtatcaaatgcaaaggtttaagtccgaagtaaagctaaagtctgtccaccatttatcctgttttcatgtttgatatctctggtttctagaaaaaatttagatgtgctttcagatctccttattataaccagaagtgctcccctttactaccagatataccatgcagtctaaaaattattcctattttcaccatcttttaaaaatctgcttaggaagtaaatgcctcagtaagtacctaaaccaatcattagttgaactaaaagtgtaatcatttaaaaattgaattaaatatacatcacaccaaaatcactaatgtgttctaacaatgggtctatatttcactcatctgtctgatattcagagtatagtatgctagcttgtccagcctgcagcctgcgggccacatgtatcccaggacagctttgaatgcagcccaacacaaattggtagaatttcgtaaaacatcaagatttttttttattttttcttttttaagttcatcagctgtggttagtgttagtgtattttgtgtggcccaagacaatttgtcttccagtgtggttcagagaagccaaaagactgggcacccctgctgtagacaatcaaatgcttaaataaatgagtcagtcttctttttattgagatgtgcacctaatttttaaatgtcattgccattacacaatttttttgtattaaggctttataccatggaaacctgtttccttaggccgggcgcggtggcgcatgcatgtaagcccagcactttgggaggccaagatgggtggatcacttgaggtcaggagttcaagaccagcctggccaacatggtgaaaccccgtctccactaaaaatacaaaaagtagctgggcgtagtggtaggcgcctgtaattccagctacttgggaggctgacgcaggagaatcacttgaatcccggaggcagaggctgcaggaggcagaggcagtgagccaagagagtgagactccatctcaaacaaaaaaaaaaaaatgtaaaagatacctgtttccccaaggccggctttgtagactgaatagtcagcagcctcacctgtctcttcttgaaggctggcttttctcacggctttatcaccatgcactttctgagtattttttgtgttttcagtcatgtgataggacatagacgtgaacgaaaactcactataaacacttgaaaaatgtattgtctgtctgggctgaactgaaagtgaaatcaatttaagattatttgaaaatacatatttatctacattcaagtccatgacccacacatattttctcaaaatgcacggattactgtgggtgccacttggcccaggctttatctcacattttgttagtgtttataccttgtcctatatagagattattagtacccttatgttctaattcagctgtggggtaggaagaatagagaggaaaaggaaacaaattctccccttgccacagatgagaaccatggctactttgtgtaccactggacaggaggactccgttctgcaccaaggctagagggactgtattggttctttattgctacgtaacaaattactaaaacttagtggcttgaaacaacatttattatctcatgatttccatggccatgggatctgggtgtggcttggttgactccgggtctctcataaggctgtggtcaaggtgttgactcaactggggtgcatctggttccaggcacgactgagttcctcctcactgcctgttggctggagttctccctcagttctgtctactgaagacctctccataagtcaattcacaacatggcagttggcttcatcagaggcagcaagtgagagagggtgagccaggtgtgggtagactgccttgagggaggcagtcattcccaagcttcgggaaccttgtctgctgtaaagcacagctgagttcccctgtaggaatcgctggtgcttacctgcattcagtgactagtggattagacgggtggagttgggttggtacaaaggcttggtcaactggctcttttgtcttgtttgggaattctcgggaaggtcattctaacatagtattgactgaggcctttgtttcaactgccttgagttagttcatcttctccctttgtctaagcttgcatccctcactcttgtttttgagagcacctcctgacaaacctcaaatctctgcctcagaatccgtttcctagggaacttgacccagaataagtactacggattgcgtaactcagcacagtaaggtagaaggctgcctgcctgccttacttagttgcagatgtggggcatgaatctatagttatttctaacacatttgcaaaggcactgtcctcttggggaaagaaggaacacatagaatgcgatagatacactatactgacctgtaaagactgtttgcctagccaggtagaccaagcataaaacaaagtaaggttaaaccacattaaaaacttcagtggaggccaggggcagtggctcacgcctgtaatcccagcactttgggaggcgaagatcggtgggtgggagtttgagaccaacatggcaaaaccgcttcctactaaaaatacaaaaaaaaaaattagccagtacggtggtgtgcgactgtaatcccagctactcgggaggctgaggcaggagaatcacttcaacctgggaggcggagattgcaccactgcactccagcctgggcgacagagggtaactctgtctccaaaaaaaagggcgggggggcttcagtgggagtagaagcagaccatgactcaatttgaggtggttaggatagaggttagaagtagggctgctggtgacattgcaagtctccagagtagagatgaagatctgtttggtgtagagagcagtacttaccagggcaaggacaacttggagactgcacaattagggtacagaaggaagagacagagactggcttggtaacatgcaggagagttaggagagtgagttctcacagagagctcagaaaggaagttggtgttagagctactcaccaatctcatggtagaagacgacgagcagcacggtcccagtgtgggggaaaaagtcagcggattggtgacggagcaggagtacactgggtggctgtgtagggtgatttggaacttttggaagcatttttttgtgaagggtaatggggaaaacttaattggtattggctgttttcacttacaagatcattgaaacacttaagatcattgaaatacttccctatgattgaagaattacttttatttttgtcattaacatcaaaaagtggcttctatttgggagcacattggtctgttttatatttttttagatctttttaaaagattaggttttgtagccatatggaaaattaaagacgactctagttttagaaatattaataaatggaataagacactcaagttctttggaggtaaaccatctccagatttttaggttaaaaagcaggcataattctgagaagatatgaggcaaatgacaggtgcaattgatataatttcaattaatattgaaacataaattctgcgaaatggatatgcttaaaatgtaaatgactgttgcaagtcagcaccatttatttgcagtgttgtgctggttaattcagtttcacatttatctttctggagaaaagaatgacaaaacctgccttttctgtactgaggccttgtctctatttagaatttagtataacttttattaaaagggaagagggatagattttctttttcctctgctgaaaagggtaatgctgtttaaaactggatctttgctattaaaaggctaggtcgcctgattttagtgttgtttttttttaagacgggagtcttgctctgttgcctaggctggagtgcagtggcgtcctcccctgccctgttctgttccttttttgagacaaggtctcactcttactgtcactcaggcttcagtgcagtggtacactcatgtctcactgcagccttgaactcctagcttcaagttgtcctcccacaggcatgtgccaccgtggctggctaattatattatttattgtacagacaagggtctcctgttgcccaggctggtctcgaactcctggtgtctaacaatcttcccaccttggcctcccaaagtgctgggactacaggcaggagccactgtgcctggccatctcttgggtttcagtgtatgtcttttgattttctaataaaaatatgtatgtgcatacgtgtatctggtgaaggtgatatatttgttacttagtacatttcatgctttgctaagggccatttacattgattggtacatgtcttttggaaagacatatagcagtcgttctacctctcaggatcttgtagggaggttgtctaaatggctttctttctccccacaacagagcttttggtatggttgcatttgagtgattgtaagatagatcaatttggccaggcgtggtggctcacgcctctaatcccagcactttgggaggccgaggtaggcagatcacgaggtcagaagatcgagaccatcctggctaacacagtgaaaccccgtctctactaaaaatacaaaaaattagccgggcatggtggcaggcgcctgtattcccagctactcgggaggctgaggcaggagaatggcgcgaacccgggaggtggagcttgcagtgagccgagatcgcgccactgcactccagcctgggcgacagagcaagactctgtctcaaaaaaaaaaaaaaaagaccatcctggctaacaggatgaaaccccatctgtactaaaaatacaataaattagccgggtgtggtggcgggtgcctgtagatccagctactcgggaggctgaggcaggagaatggcgtgaaccagggaggcggagcttgcagtgagccgagatcgcgccactgcagcctgggtgacagagcaagactccgtctcaaaaaaaaaaattggtaagttcatattgggctttagaaggcatgctgaattttgaacatgtctggtgtgagttaaaatttgtcataactctttaggtatatttggcttctctgtgaggaatttaaaattatatcccttgatttcttagtcatcttctgtttcttttgcccaaaattgtgcatggcaatggattcagagtttctgagttctttggaacacttgacctaaagatgcagtcctaataggtgtttccttttctgctgtccttggcgcccccacccacccccctttcaaagcacatattaatataataaagactctgaaaagtctaatagtcaaatgagacttttaaagctttaaccactgggtgcagtagcacatgcctgtaatcccaacactttgggaggccgaggtggcagcgttgcttgagcctgtagttcaagaccagcctgggtgacgtggtgaggaccctgtttctacaaaaaaaaattaaaaattatctgggcatggtggtgtgtgcctgtggtcccagctgcttgggaggctgaggtgtgaagatcacttgagcccagaggctgcagtgagccatgttcatgccactacactccagcatgagggacagagtgggaccctgtctcaaataaataacaaacaaaaacttcaacctagtgtttttctaactttttgaacaggaaactcagccatttattggctatgtgaacttgtctcagctttagaggggagactccttcataatgatgattgtgagcattcaggaaatgagtttgtaaagcgcttagcatgctgcttggcacatcagaactcgatgaggcggtgctgctttttatgtagatgtgttcttgacttacagtctaactggatgatacgaggccaacagatttgaaacacttagaaactgtggttgggatggagggtcatttgtggcaggctttgtggagaaaatgggtttgaagggagctatagtgagttagatagaatttagcaagttgggaagtgtggcaatcttaagttgtttctctgaacatcctcaaatgtttgtaaatttccaaatcacttggcttttaaatcttctcttatggattctagatttaatataagttgaaagacatttgaagtattgaaaaatctaaattagcgctgtccagtagaacgttctgtgatgataaggatacagctgtgctgttcagcttgccagtcactagccacatgtgactactgagcacgtgaaatgtgcttagcatgactcaggaactaaattgtaaattgtacttaatggcaattaatttacatttaaaattaaatatacccacgtggctgtgagctaccataatagatagaaacaaagtgagctcagaatgaaattaaggatttgttgtcaaataaatctaatatggataaaacctacttacagttaattcttttgtaattgatgaattgactatataatgttgtttttgttgttgtaggtctccaattgagaaacatggcactgtttttcctgcactctacccacctattgctggacttctgttgtacaagttggcaaacactggctggaactgggctgcaataaaacatgccagttatcaatgctgacaagagcctaacaagtgccaacttacagatgattacgcattttgaattctaatgaactgttttaaccttcaggaagaattgtaaagacctgtacatagcacaacatgatccggataatatatatactgttcatgtacatccacaaatacaccttgtaccaaataatgctttcttgtagtagaataagaatcgtgtaaattctaagagattttagcaggttttctttcctattcattgtttcttatcagtttaaaaggattcctttaagcatgtcagatgaaaagcaattaggattaaaagtttccatttaatttcccttaaacccttgaggcttcattaaactcttttcacttactaaacttttgtatcttctttgttttgacacactcccctttgcttttatctcttacctgccagaatgttctcaaatgatttagttcaaatactgaaatacttaatgagcaattacttgatttttaatgatgacttcgaaggagtcatcactaggtgctttgtcctttttgtattctagttgcacccacctcttggattggatatagcaataacatttattggccgttgtgagctcttgatcccagtcattacccctgagaactaaaaatagatggttcttaattcaacttactgaaaatttccccaaacaatagcaaatctgacttttccctcttcagttgcctggtattaaggttggataaatgaagcatgcacagctacaggctttctacttaacttctgggtttgctattacaaatcctatttactctcatacccttctccttagtccttcatatttctctgcctctattcttctatactgcagatttttctcacctattgtacaaagaaattgcgatgtatattttcatgtaatttgattttggaattctgtcaccttatgtagtgagttcttccaaaatataattttttttcaataattgtcaagttgttggcttttattgtattgaatgaaggctataatactgagtgccagagaagtggtttaggaaaatctcaggttgattccttatgcaaatgaacttttaatacttgaaaatcacatggccatggcagtatatgtatttggttctatctagattcttctgtgaatctaaaagcattacaggggtaaatgctttgctatttgacgtatagatcccgtcactaacaatagtacacttggatgtgattaatgtttgagcttcaatatatttcatatcatacagttttctaaaacaacttcagcaaatggtaaaatgaacatgtgcagtgttaaaggcaggccttaggctccttcatgtttgttgtgaggttgtgtgtgggaagtagtctttggcttataagggatagaacttgagacagtagcagatgggacatggtgtttgattgtgagaatcagtgagaattcgtgcatctctgctctgtggggtttggagaaatgctttggcagaagagtgaaagaactcctgccaagagcccagacctctacaaacgttgtatgtccttttttaagcagaaataaaatggttgaggatg

SEQ ID NO: 37154 - DNA, 217367 bp, Homo sapiens
aaggggaaggggaagggctcaaaatgagttagattacaggcagttctcatgttgcatggttcttacatgcaccagtttcattaatctggtttagttaaattacatcagttcctcctaacaacatttgttcaaatctcagttaccaaagaatttgaactattagtacttgtaaagtagtagctgctagccctcacttcacaaagcactacataaataacaagtgcacgtgataattagtaaccaatcacataacttctttcaaagtctgtcaatgactggtcactgtgtatgtttttcactgtacagtctgcaaagcagatagttgtgttaactccttgtctcccagtgataaactgacatgatattttacaaaaaatggatacttgaatggggaattgtcaaacaaagtgctacaatgaaacaaaacaataatgcaagaagtgaaatttgaattgaactctatatagagagttataaaagaaatagccaactgtggaaatgttgacactgctgccatacaagagactccagatatgcagctagagaaacttaaggaaggtgagcttatcaacgtgcattcagaaagtggttatgattacaagaatgaagatatcccagaggaattgacattgtcagaaaacttcacattaatcgaattctcagagatgtctcacaacattgaaagcacaaaagatgaaatgttagaagctggtgcacagtaaggataaaggagtatggcagttcaccaaggcatggaaaagatgcctgctccatattgttaagttatacagtgagaagaaggaggcgaacatagttcagactactcttggtaggtttttaccaaaaaataaaatattttaagctcaatatttttgacattgcaatgtactttaaaagatgttggccgggcatggtggctcatgcctgtaatcccagcactttgggaggccgaggtgcgtggatcacctgaggttgggagttcgagaccagcctgaccaacatggagaaaccccatctctactaaaaatacaaaaaaaattagctgggcgtggtggcacatgcctgtaatcccagctagtagggaggctgaggcaggagaatcgcttgaacctggcaggcggaggttgcagtgagccgagatcacactgttgcactccagcatgggcaacaagagtgaaactctgtctcaaaaatatatatacatattttactttttcttcatttccctatacatttataactgacagtaagagtatttaatgttttgacaattgttaaagatcttagaacaattataatttttcccattgattattgtgatcactttgcacagtttcaggttgcatagtaatttttataatctcatactaccctgcaaagtgaggactgtctgtgcttaacttttcactcgccaaaattctcaagttgaattgcttttctggaaagtcacaccagtttatctggagatgtatacgccccattgtgagaagctcagggctggactgagatgggcgttcttaatgcatggtctcccaaagactgaggacatgtctttgcctttcttagtagaacactcagtgggccttgaaatccgtatttcatatgtaaataccataaaatgagttctttccacttagtattaggactagggctttgtagaactattatgttaggttcagctaatacaatttgattcaccttttgtcacttgtggaaactatttttaaaacaaaggcttaaaagcaaaggtttaaatggctgggcatggtagctcacacctgtaattccagcactttgggaggctgaggtggttggatcacctgaggtcaggagtttgagaccagcctggccaacatggcaaaaccccgtctctactaaaaatacagaaattagccgagcatggtggtgggcccctccaatcccagctacttgggaggctgagacaggagaatcacttgaacccaggaggcagaggttgcagtgagctgagatcacaccactgccctccagcctgggtgacagagcgagactccatctcaaaaaaaaaaaaaaaaaaaagcaaaggtttaaatggatttttttttttttactgtcttaattgaaattgggttatgaagtgatggtctacctttcaaaaaactagttgtacttcatgttaacttcttaaaatattaataattactaaggataaagctaacatttatgaagcactatgtgccagcaacattctaaacactttgactatatgtaaatatatatactctctttttgattatactgaaattggcttttatgttagcaaaaatcaacctaaatgggtactatattctgagaaaaactttttgtcatttcatttatttaatgattatacctttaagcaagtttcagtaagtactttgaaagaagtcctgttaatatcatggcataatattttcttgagattaaagtcagaaaatgtaaagcttgccagggactctgaattcataatgtggatactggatcattccaagctcagtaaacaagagtttgaaaatagaaaagaagacaaaagaatagaaaaggcctcctcttctgtataaactatagctggacttgaactaaagacatttgcaaagaaagaaacaaactcctaaataggtgtagtgagcaaattttccaggttttccaagttcaacttcatttcatacatttttttttcccacgaaatgcagtttgttatatgtgtaaatgggatatcatttctattcttttttttttttttttttttttagacagagtttcgttcttgttgcccaggctggagtgcagtggcaccatcttggctcgctgcaacctccgccttcccggttcaagcagttctcctgcctcagcctcccaagtagctgagataacaggcatgtaccaccacgtctggctacttttgtatttttagtagaaatggggtgatccgcccgcctcggcctcccaaagtgttgggattacaggcgtgaaccaccgcgcctggccatcatttctattcttttgtcgtatcttaccaaaaaaaggggattagggagctgaagaccatccaactagtttatcaccagaatatgtagtccctataaccctcctggttgtgtggattgacctcttgatatttcctcattgtatttgaatcagaacctctaagtgcttcttttgtttggttttgttttgtctgtgtttagttgtattaccctgctttgttctttaaaacgatttgaaatacctcatattgtgatttgttatttactttttccttcttcatatgaatctgtggtttacttggctatataccaggagaagttatgtaaatgtttggggtcagtctgtgtggtcagtttctgtcatttttgttagtaaatgctccactgaatagtattttcactatgaacggtacgtggaacaaataataaaccatgtctgacaaacagaatgtgttcccaaacctacttctgggcctgttgtagatccagttttcattctgacttggcattctacctgtctttagttttctaccgtcaaccctgccagccatttcttattcacaagacagagtcagttaccttattaatgtataggcttcttgacataattaccagcttatattgtcgcttgtgtctctttttaaatatattttttactttgagcctcgttttctaaataatagcttttttctatcctgttccattaaatgggctttcaaggctattccattaaataggctatatctttaggcctaatggcttgtgtttgagccagagaatagcaaagcccacatatgtgtatactgttcataagtggcatgtttcccagtgtcatgctaaacctcagctgcttttataataaaagcataatttctgttcattggagtattcagatgaaaacacatatgcagctcctgagccacttttacttaaggtatgttggagtactgtgaaataaaacttttctgattttagtatctcaaaatggaagcatccctgtatgtgttctgttgtatagttgttactcataacttgttacctctctttttttttattattattgtttattaactatgacacaattgcactggagactggtcagctccccatcatagtagctaaggacctgcaatttggaactaaaaagatcttgatttgaatattggtttcaccagatactcactttgcagccacaaacgagttttgtaaccttgctgcacttagtttacatctgtaaaatgaagaaaatgacagtatctacattataaggttgcaatgaggattaaatgagatgacacttgtaatgtgcttagcaatatagcctggcacctacaagcacttaataaagccagtgtggctattattctttatctacatttaccaagttcctcctatgtaccaggcgtggtcctgggtattggggatacaaagaagaaaaagacgtggtctctctcctcagaatcccagagtcttgtggtacagacacatttgaagaaaaaataccaacatgatgcaagaactattaaccttggctattttagggatgtcaagggacattttatttccacttgaaattctttatatcatgcacatggtttacttttataataaaaattaatgactgtcacaatacagtagaatagttgctgaatttgagataagtatatagtgccgtgagaacagagaagcggaagggaaaagtcttgttggaagctgtgcaccatagcctttgcatcttaatcagatttccccctaggtatgctatggtacacttctttgcaagatgtcagaccaaaataacgtggtgatcaggtagtagataagctgaaaactgtctatgggatggtggctgtcccactttacagagagctgtctcaggcccagctgctttgcctcccaagatttttttacaaggctacctctgttcttgagtggcattgagtaggttgagtgtagaatgactttcagccatcataatgggaaactactacttttgacaaaaaagtagatttggcctggttcattgctgttcatcccacacaagatcatgaggcaaccctaggggtgactgaactctggcctcccgtcagacctagagcttcatgaactaaagaggaatgattttgaaactgtgcccggtcatcctcttcctcattcctaagcaattagacgcattttgagagggctggaaccaatctgcataagcctttagctccatgggcttatccaccatctaatttagggtttaaaacccttaacttactttcaagctgattgtcaatttagacctgaccttaagatttctcataacttgttacttgctttttaactgaatttgtcaacattcaagtttataaaactctactacgttagctagcccatttaaggaagaaagtaatccaaaaagtcagaaatgttccctaataccaaatgtccagtttttttattgtgctatcaaatgtttttaagtttatttttttctaatttgtttccttagctttcagagtaatttttgtttaaaatgaaaaatgaataggcttgttgccataatttaattgtgctgaattgtttggccataacttcagtggtgatgaagaccagatttttgagctggggaatctgttctgtttggatctgacagctggctacattaaatatcttggagctttttactttgcatggatatgggaggttgggagggtgggaaccgcaatagaagaaagcagtccgctttatttaatgttctgcatttgtttgctgattccagtaacattgtgcagctgtttgaacagctgccttttgatttccttttgtttactgtttagatttattaagcttgtctttaatactgcttgttgtctgttctttaactagctttctttctttattaaatatattttagtatgttctgctctgctgtggtctaggcatgttttaataatataagttaatttaccaaaggacgaatttttaaaatgttgcagaccatactgaagtggctatgcttactttcttgttgtcccttagctttattattgtagttaaatattttgtaatttggcaactaaattatcttttgaaattaagtcagaatttcagtcatgttaaaccactatgttaacttctaagtctgccaacaggtagcttagtctacatacttcagagtacttttttaaaaaaaattgccagactaattgtaaagtgtgtggattttgttttaactactttctgtgaacaaattgaatatctagaagtatatacacacatgtacaaggtaaaaagacaaattttatatttatttgttagtctccttagcctattaaggtagacttactacaaggttcttcagtattatgggacttttgttctgtatttacaggtgagggacttgtgcattgcttatatgctggtgacattaacttatctctatattggagtcctggtttttgcttcatttccttcaccaccattatccaaagattgtattgagcaggtaaggcaccgtgtaccctctctgtgtgattgtgtacactttcatgtatttatagtaggtagggtgatacagtggcaagatataacatcagataggcctgggttttaataccatctctgctatctactccaagtatgggaatttaggcaccttcccttttctttctgagctttatttttcttttccattaaatagtataataagtacccccatttgatttttagatggactctgagataatgtactacatgccaggcaccttgtggtactcaaataaatgtctactattatgtacatatatttctctttttgtggggaactggtacaagtagttctcatgtagttataaaaccacagagaatacattgaaggaactccctatttttaaaagcctgtatcaggaatgccctggataaactagagtctttgtttatcagactctaatgattaatcagactctcattcttatattgagtgacaggcagcaaaacaaaaaaagagtatttggctgttaaaaaaagagagagagatgtcctatgagtcaccagagggttaaaaaaaaaaaaaaagagagacagagtaaaagaaaaaaatattttaataaaagattgccataactaatattttctttgatttaacccatcaaaaacttagcaatagtatagtctttagttataagtgactgaagagtttctcacaaaaaacaacatttcacaagtgactttctggtcagaagaaattcctcttatagagtacaatggaatatactaatgtgatttattacagctgaattataatggttatttcagcaaaataatgttaatagtgttctcatctttataagagaaataagtttgaattactgctattatggcagcttggaaatgttcttattttcttgatttccttgactccagaagttctttggcagccaaatgtttgctggcaatttccctgatatgaacaaactcatacaaagcctactcccttgggaataggaatatttgtggtatttgtatttgaaagaaaagataaaaattctaagtaattaacttttttttaagataccaaaccaaaatggagaaaagggtcatgaaaggaagtagagataaatccttttaaatttagtgatagactaaacaatgatgtagtaggtgatagacatactctcaccttattctgtcatctttacttcaaaagtgcttacagtgcttcagaggaggaaagcagcagagccagagagggtaaaataacactgaattaaattagctctttacatctttaaagtggactggtattttccttgaaccacataaagcaatgctttctcgatctatctgtggtgaaggacaaaattgtctttgctgttgctttaatgttaaataaattgcaggctgatacttttgtaaaatagaataaaattgtggcaatgtcagattcctgtaaaagtttctgaacactttcggtttctatacttacctcattgaaaaaatacttaacaagtagttgtggatgggcactagtccacaaaccacaatcggagtagcacctgtgttcaaaataagcagaagacattccattttatgaatgtgtgtactgaatttgatttttaacatgacctcattatctttcttggattagaattttttagacaacttccctagcagtgacaccctgtccttcattgcaaggatattcctgctgttccagatgatgactgtatacccactcttaggctacctggctcgtgtccagcttttgggccatatcttcggtgacatttatcctaggtaagggctcttctcttgaccagcaggatgtgccaagcaacaaatgactgtgcaagcaggtcagtttaaagtgtgactgatccttttgctataaaaatgcctaatgcaagtggtgactaaagatagatcattggtgtcctcttccctgaagagctttaaaaatagaagccactcccttgtctagaatgatttaaagttcattccttccagtatagttaattagctccgataccatttatatttatcttattatttaattgctattgatttacatattgtcaagaagtttatagtgtatagtacctatgttggcaatgtgtagctaatgagaagcaacacttttaattattggtcattgaaactatcagggccaagggaaaacttcccctttgccctctgaagttttgttgaaaatgaccgacaagaggcagattaataggcaaaaagggcccggctcagtggctcatgcctgtaatcctagcacttttggaggccaaggtgtgtggatcgcttgagcccaggagttcaagaccagcctgggcaacatactgaaactccatctctacaaaattttaaaaaatcagccgagcatagtgggcatgcttgtagtcccagttactcaggaggctgaggtgggaggaggaggatcgtttgagcccgggagatcgaggctgcagtgagctgagatcacgccactgctctgggtgatacagtgagaccctgactccaaaagaaaaaaaaaaaggagaaaaggcatataaatgtatttgaatgtggttttatgttacatgggagcctttagaaagaagacccaaagatacaggggaaattgtccttttttatggttatgtttatgtgaacagccatgtctaatgctaatagactgagtggggaactccagcaaggcccctctgtctagattcttagcctctctgagcatgtgtttttttcatctgcgtctggggcaggaccctctctggaatgggagtcttatgacctgcagtcaaacaagacaggtcagatcatttctttatggctagtttttacacagaaatagtgggaaattggagtgatatttttaggttttacggccagcttgagggaaaaggtttccatgttccactttggggaagagggattctagtttctaagatagcttcgggagaatgggactgagattcagaaggtcagagaaaaacttttgtttctgaggctttcattttagggtatggttttctgagtccaacaatccttacttttatattcattaacatttatgcagtttttgttgttgttgttgtttgtttttgttttctgagactgagtctcgctctgccgcccaggctggagtgcagtggcgcgatctcggctcactgcaagctccacctcccgggttcacgccattctcctgcctcagcctcctgagtagctgggactacaggcgcccaccaccatgcccggctaattttttgtattttttagtagtggtggggtttcactgtgttagccaggatggtctcaatctcctgaccttgtaatccgcccgcctcagccttccaaagtgctgggattaccggcgtgagccactgcacccggcctacatttatgcaattttacataaatgatcaattgtttagaattgaaggtcagatatataattaatttttatttgatatataacaagtttaaattactgctataattgttaacctcttattagggatgaaggagttgtgagttcttttgaaaatcttttcaaagctggttaccctcatccaagagaaatttctttttttttttcaagagaaatttctatatgtcatttcagagtttcccagcagccttcttgtggacctttggttaactcctacccttacattaagtctttttataggttcatcttagtgaaaagaacctagtccacttttattaggcatatgttcttttaaagaaagataacttaaataaaatttgaaaaaaattgcatttacagtaagcaactaaacaagtggtcttaatcagttcttgtttaaaatgaactgatgtagtctgcttcttcgataaataatttttgccataaatatgttggtttcaaaacaaagcaaaagtcaggagttaccaggtctcaagcactgataagtatagcagcagctatggttctagtgttattatccagaagattggagctcaataaatgtaagcctctgattgtgtttctactctgctgtatttatattcatcaaagaaaataaatacagtgaagtcatagatgaaaaaatgctaagcaaatacattattcctgttttctaccattattttgcagaatgtggctatctttacaataatgttttttcttcttggaaaaagtcagagatttcccttttgttttcacattacagttcttcccctaccaccaagaacacattgtcattttcatttatccgacagttataagcactttatagagtgtgcatactttggagcataatttttggtctcaggaccctttatgctcttaaaaatgtattgaggactccaggagctttagtttatgcaggtatagctatcagtatttaaatattaaaaaatagaatttaggttttttgtttttcgtttttttgagacggagtttcactcttgtcgcccaggctggagtgcagtggcatgatcttggctcactgcaacccctgcctcctgggttcaagcaattctcctacctcagcctcccgagtagctgggattacaggcacccaccaccatgtctgcctaattttttgtgtttttagtaaagatggtgtttcgccatgttgggcaggctggtcttgaactcctgacctcaggtgatctgcctgcctcagcctcccaaagtgctggtattacaggcatgagccaccgtgcccagcaaagtatttttaatttgtttaaaatcaataataaaaccattacttgttaacataagtaacatttttgtaaaaaaacactttcaggggatggataccccagtctccatgatgtgattattatgtattacatgcctgtatgaaaacatcttatgtgccccataaatatatacacctactatgtacccaccaaaatttaaaaaaataaaaataactgctttcaaaaaatttttaatttagccgttcgtggtggctcacacctgtaatcccagcactttgggaggccaaggcgggtggatcatgaggtcaggagatcgagaccatcctggccaccatggtgaaaccccatctctactaaaaatacagaaattagcctggcgtagtggcaggcgcttgtaatcccaggtactcgggaggctgaggtaggagaattgcttgaacccaggaggcggaggttgcagtgagccaagatggcaccactgcactccagcctgggtgacagagcgagactccatctcaaaaaaaaacaaaaacaaacaaacaaaaaaaccctttaatttacatttgcaaaactctgatgtttgttttactagcagacaattgattctcctctctacttctgcattccatgttataatatcctgttttcgtttagatttgtgaagaaaatccagcctcacatagatagttggaaaaagaaggagtacttttaatagctttttcatataattgtggatattcttctttgatactgtgccaaaacctgacgagtggtagcttcttatgagttgcatcgtggaatctgaaacttgtttacattaaaaccaattggtctatcgtgcactttggatcttttacgcatgcatgattttgtaacatctgtttgatcatttggaaaatattggttcactgagttctgtggatcttccaaatgttgacacacttcattttacaatatcaaaacccactttcattaatactatcactaatttcatcacaagagcctttaaacattgggaaactgtcaagctcagggtagcaaatacaagttttccaaaattctagtttttatttgaaaactttaattttatctttggcaacaaatactgccagttgttttccttgaattatataagtgacaagcttatataattcatttttctggaaaatctctgtcaaacacctgagtttgaatgaccatagtttgactgcaattcaagtaaaagtagcatttggtaggcaaaacagctaggtccccttcagctcagccacacaggtacttttcctcaagacttccagcgtactgtactgcagtacgcgcagatgtgctttattatgactttcctatttgatcacatagaatatttaaaggatatatattcaaacatgagatttagcaaaattaatgttctactcctttatcaaggactttttttatactttggagagtgtttggcattaaagaatagagtatagaaagcatgggtgttagccggtcatggtgacacacacctgtagtcccagctattcaggaggttggtttgagcccagaagttcaagccttcagtaagccattattgccccactgcactgcagcctggatgacagagcaagaccctgtctcttaaaaaaataataataattaattaaaattttagaaaaggaatacagatggatgcaactgcctccctctgtgtatacaaagttgtttccgtttataatgcagaaataacaaaagcccagccaatacctcaaagctctgaagcaattttaaggttagagtttctgggtaaacagtaagatctgtaagccctaatatctttctaattcatcagggtatatgactaaccacttatttatataaataattttctttgtttctaattctctgtaatctttatctgggattaattaacctctgatgacttgggcccaaagggttgctttgatgtgtacatttggcttttgagaatcattttcaggggaaatggagttctttcttcagcatcaaattttcatctacattatttttgtttgtgtccaaaattgtttcccaaaccttgaattgttaatatctagttaaagtatttagtaaatattctcttcatggtagtgagtagctttaagttctttctttatggtcaaagtatgaagtatgaccactttctttaagtggttaaatctggaagataaaaacctgcccattttgtctttcccttaatataatgtgtttaatataaaagtaatttgaacactttatgaaaagtttgttaaatatagaaagaggcaatgttatccaaaaccccaaattgtaacaaaatcactactgccttctcagtgtatatccttctgatttttttttccaaatgtttttggggttttcttgtgtagtgaaaacctagctggctttttttctgaattgcctagatagtattttacctgacaaggtaatggtgataagttattttaaataatttttaacatattctgtcaagtaaattattgtcttgctatgtccaggattcttctgttttttcataaatatcttgatattcatagcattttcattgtttggattattttctcaagatattccaaatggaataatagatcaaagaatgtgaattctgatacacactaccagtgtacttctacaaaatttaaccagtataattgcacagaagagctaatttcactttctcgttaccacaattgaggactactgttaccttctatttttgctgtgattttatcaagcttaagacattttgattttaacgatgttaagaatgaactgtagtctcatattagtggttataatttgcctatttttatattttttctttcttccaaactctcttctcaacttctagcattttccatgtgctgattcttaatctaattattgtgggagctggagtgatcatggcctgtttctacccaaacataggagggatcataaggtactgccttgtaagggaatggtgcccttacatatattggtctttattttcaggcttttcctgttgttgttgttgttttaatttaattgtatgaaattcctatgagtatttaaaactagtaatattcaaatgcagccccttggtatcagttaagatgctcattatcttccctttctgtttgttctggtggagaactcactctagaagctccattatcccttagcctcaggcatcattttctttttctttctctcatcatcttccactttatttcctctctatatccaaaataaaaagttatttttaatatatgtataactttttgggattacctgggaggtcctttatttgtcagagcttccttaatccattctaagttccttaatccatttctactcaaaagtatttttcaatgtcaattgtagtcaaaaagtaagagtttaagtaagaatttagaccctagatggctttctttaatatccttttcctaaaaacgtgacaggatgaatagagtaggaataaagttgtacctcaaattctcatgggaaattgggatttagaatgatctgatttctcttactatggacagcaggaaggagtcattttttttggaacactcttacctaagaaagtaacaaggaacaagaaggggagattgttagcctgatgcttattgaatataaagggcttaccagttcctattgaactgttcctcaagaaaacccaagtatagagaaaaggagaagaaagtgcatatttctctgtcacagtctcatgtttaagtatttttgttattatctttcgtaatcatgctgaatgccatggtagcatttatctgttcttatacttaaaccgggatgctaacggtccctcaaaaactgagaatgagtaattagtttataaaagatcaaagataggaggcctagctccagatgtttctgaggaagtagccacaatcaccaaatacagaggaactacagagatttgagggatgaataaaaagtctttgttaagcagatgctataaagatgagcaggaaatcatattttatattaacttagcaagtaaagtaagttttaaacccagatgttttatgtcaacaacaaatgaatcaaaaataatttttgttgagctatcagactgaggaggatttaaattgtactatgtttaccttaattgtaaaaagcaaagtgcaagatgaatattaaccccaaaagcttttattttgcagatattcaggagcagcatgtggactggcctttgtattcatatacccatctctcatctatataatttccctccaccaagaagagcgtctgacatggcctaaattaatcttccacgttttcatcatcattttgggcgtggctaacctgattgttcagttttttatgtgaaatacctcaactgtttttttcaagagctctcatgatattttgagccttgacaacagttctatataaattcacttgtaaatgctgctgttgtgtaattctaaatattttctaagataatttgaaagcaagggaaatagtggccccttaatgagtatttttttattggggtggggaaaggggcaaaaagaatgatcttagtgtctttacctttctcatattaactcacctctttattctgtggtcttttctgaatagaaatgtatgccctaggaagaaatcatgctgggttttgcttttagagataaaaggtggtggatttattttgcctgcagtaaagattctcagggtgtcagagcagcatattgtcaaatcctgcttctgttttatgtttcagtgtattcactttcattttcttacttactagaccatttctgcagtttgcccaaacctctactgtttgggacagtaagccaaatacctcatttttaaaaagaagttttcatggcatcagtgttaataaagtacatttttaactgagtcttaatctctatttgaagaaaaagtagagacaaaagtaatgtcaatgtaatccccaggatcatgaaatgtatacaaaataaataaagtaggagagtttgttgctgtctaactcctcttttatttctaatccagtaccagtgacttagatcgaaattacagttccccaagccagactttgcataagaacaagaatgattgtccccatagacccagggggtgcttttgctttttggatccctgagatcccagcgtaggctgtcatgatggacccagtggggaaagcatggcagagaggagcctgagaggcccataggggagacggcgaacagagaaggggccagggaggaagaggcctcagcccagcatattttgtgtcctctgggggtggactggtttctgcaccacaaaaaaggattgattttgtttgaggtatgaccttcagaaagagacctccatctgcttacttctgtaactggcagtactgttacaggaaaggggtcctgatccagaccgtgagagaaggttcttggatcttgcgcaagaaagaattccaggcaggtccacagagtaaagtgaaagcaagtttattaggaaagtaaaggaataaaagaatggctactccatagacaaagcagccccgagggctgctggctgcccatttttatggttatttcttggtgatatgctaatcaaggggtggattattcatgcctgcccctttcagaccatataggctaacgtcctgacattgccatggcatttgtaaactgtcatggcgctggtgggggtgtagcagtgagaagaccagaggtcactctcattgccatcttggttttggtgggttttagtcggcttctttactgcaacctgttttatcagcaagatctttatgacctgaatcttgtgccgacctcctgtcttatcctgtgacctagaatgccttaaccatctgagaatgcagcctggcaggtctcagcctcattttacccagctgctattcaagacaggagttgctctggttcacatgcctctgacagtacagagttaaaaccctgtgagaaaaactccttaaatctgagaaaaagattaaggaatctggatccttggaatcgacgctcttcccttatttcttctgaactaaaagctaaactagtatccacattcacgttttccaagtaatacagcctctgtgtccaggtcaggatacaacatggtgattttttttttctgaaaaaattagatttctctaattttaagctaaagtttaaaaatctattgtatgttcacctctcagatagtgtatggatttgtgttatttccttcctttgaaaaagaaaaatggtttttgcaaacctagtaaggagcccagattcaagatcagccttaatttctttcagcaaagctttctgtcctattcataaagccatagacctatattaatgatgaactgtatttcctaaagctcgtttgttttaataaaaagtctcattatgaaaatctcaagcccacacaaaagtaacatggagtaatacggtgaacctcacaatgcctatcccctagattaataattataaaacttggctgtatttgcttcacctatctttttttttcttttccactgaaatattgtcaatctcagatgttatttcatcactacaaaccttaatttacagctattagtaatagccttttgaacatagttacattgatggaaatagtctcaaaagtttttgttcacataaattgctggtagtaggagttcggttaattggaaaattctgcagtaggtgtcagatcactgtgttaatttctcttagaaaaggagtataatgaatggagaaagtgcttctctgtgcttgagagcccctgaatctttatgacttcagaatcttattcagttaagagacataggattcaaaagccagacagcactgggagcgatctaggcttaatcccagtttatccccagtcaccttccttctctgtaaaaacttcagaaacagggctgggcactgtggctcatgcctgtcatcccagttctttgagaggtggagacagagtttcattgccacttttcaataatgtacttgaatgttttaacacatggaaaaaatgatttaatatatttttgtccatttaatgaactaagtgaatatgacaatgaatgaggtatttactaaactaaaagacaatgtgaatctttgctattgtttctttaaaagacttgatgtgaggccgggcatggtggctcatgcctgtaatcccagcactttaggaggccaaggtgggcggatcacatgaggccaggagttcaagactcagcctcgccaacacagtgaaaccccgtctttactaaaaatacaagaattagttgggcgtggtggcgtgcacctgtaatcccagctactcaggaggctgaggcaggagaattgcttgaacccaggaggcggaggttgcagtgagccaagatcacgccactgcactccagcctgggtgacaaaagcgaaattccatctcaaaaaacaaaacaaaacgaaaagacttgatgtgggcacagctgtgatcccagctcttggaagactgaggtgggaggatcacttgagcccaggagttcaagaccagccaggacaacatagtgagaccctgtctctacaaaaaaataaatttaaaaaaaattagctgggcacagtgtcatgcagctgtagtcccaggtacccaggaagctgaggtgagaggattgcttgagcccaggacatcaatgagccctgattgtgccactgtactccggcctgagcaacagagtaagaccctgtctcaaaaaaacaatttttttaattaaagaaaaaaataattggctgggtgtggtggctcacacctgtaatcccagcactttgggaggccgaggcaggcagatcacctgaggtcgggagtttgagactagcctgaccaacatggagaaacccccatctccactaaaaatacaaaattagccgggcgtggtggcgtgtgcctataatcccaggtactcagtaggctgaggcaggagaatcgcttgaacccgggaggcagaggttgcagtgagctgagatcgtgccattgcactccagcctgggcaacaagagtgaaactccatctcaaaaaaaagaaaaaaagactcgataatttagaacttctaaaatcttgtattagacttacgctgtatgactttgccttcttaagtttttttttcatgagatcaactctttggcctattatttggcttggtcagagaactctttgtaagtgtgtatatcctggcccacacattagaatgatgagatatgaagtcattcatatctcaactaattttagaccttctttgtctgctgtcatctctttgaattttctaattgaatttctttcactttttgctctcatgcttaactcttgaatttagcttaacatacaactgaggatattattaagtaaaatatggattatttagaggggtcttccttagaaagtctatatatgaatatgtggtatgctaatagccagaaaggacaaagaaaattaagtttgacacctgtgggtgatcatccaaaatcaattttattatcacacccaaaaaatgctttgatgtaaggaataaatttattcataaaaggggactatattaaagggaaatactttatttatattaagtatattttgcaaatgcaatgcagctactaactatagaagtaaaagacttttctgtccagtgctttggaggagataaagatgtataagacatcattcatatctgaaatgaacttttaatctagtaaaggaactgtgtatataattaactatgatgcaaagcaatttatactgaggactattagagaaacagatccctttcagttgggagccttgaggagggttgataaaagaagccgagaggtcaagcagcaacgacccattttcaggttcctcctcataactgtccaaaatttaatatttggtaccttcaccagcaaatgcaatcatataggttaaatgtattcgcttttagtttggtaaatttcctctaagataagttttctgcgacttgtttaatgcttctgtatgctatttattctctttgcattttgaacacattgcattattctgttaatcttggacagcaaagcacaatggattaatagggcaaataattagtaacacattgggtggtacaaacagaaaaatgcataagtttttctcaccaaagatttgacttatttaaatatcagtattcaaagtgtcaaatgtttgaactcattgataagagcagaaaatattgatgttgtatgttttctttacaaagcactgacctaattgctttttagaatctggtggtggtggtttttgttttttctaaactcaatttcatccccattagaatatccaaaaccaaatccaaatctagttgacacctaaacagtagaatgttacattagtttgtgacccaaagtgaaattaatcccctagatgcacacaaactggcctggctggccggttttacagtccactgctgccttcacttcagattatgtaaacacgtgttgtgaaacagctctgacgggaaccttataacctaaacattgttctctgaaatgtaatttgttgtcttttatataaaagaagaaattaaatcaaagataatttgaaggaaaacaactctgggattttgtttaattgaattttgctgggaaatattattgcttggtagcactggccccaaggtcaggaagaagctgggttccatctttcgccgggtcaaacttctcaagtgactttgcccctgtgcctcacatcaggccccaaggagccccgcaaagtgttctgatcctaaagaaaggcattacattatgttaactgaaacctaaaatgactatatctttaggacaatatactgttgtgacctctccctctaagaatatttccgatgaatgttaagtagagcctagttcctggaagagcttgatgtcctaatcctccagagccacttaagccaatagagggctctaattttcccccttctctaagtactattacttcttccccagtattatttttatgttccatctcttcggcaaaaataaaataaggctatgtctttttcaacttctctattctcttttgagatggagtctcgctctgttacccaggctggagtacagtggtgcaatcttggctcactgcaacttccacctcccgagtttaagcaattctcctgcttcagcctcccaagtagatggaataacaggagccagccaccacaaccagctaatttttgtgttttcagtagagacggggttttgccatgttggccaggctggtctctctcaaactcctgacctcaagtgacccaccccagctcagctttgcggagtgctgggattacaggcctgagccactgcgcctggccattcttacttatctcaggccataaagtacaggcctgcgatggggatgggaaattgctcacactccagatttttcctcctttggctctctctcaatcccaagtgatcctattgtttggtcatagtaggcactcaatatacacttgtttaatcaattaattaactagtcaggattctttatggaaaataataaggtaattgctattatctaggatgttgttccatagccccaaaaccattacaaaataaaattggggtcagcaggttcaatattagtcattcagtcaataactaagtactgactggttgccagaccttatgctaagcactgagcatacagtggtgaacaagccagatgtggctctgacactttaatatccctcaccaacctctaggcatcaacaaccaggtcatccttccaggtgtcaccgaaatgccaggctattgccccttcctgctgcctgtctcaactgaatgctgtgctgtggccacatcatacacatgttttgaagagaagaatataggacaatgttgcagtaagtaggtctctgtaaagtgaatcatttttatcaaaataaaactgcttttaaaaagttagagctgggtgccgtagcttgcacttgtaatcccaggtactcaggaggctgaggtgggaggatcacttgaggccaggagtttgagaccagcttgtgcaacataatgagacgctgtctctgaaaataataacagaaagttaaccaggcatggtgacacacttgcctgtagtcctagctacttaggaggccaaagcgagaggatcgcttgaggccaggagttcaaggctgcaatgagctgtgattgtactactgcactccagcttgggtgacagagcaaaaaaaaaaaacgacaacaaaaaacctaggttaatgataatcacataaggttatgtggtcacagaatgaacatgaatgacgttttatgggggattctaagtgactcatttatgttattactttattatttaacagatttttctaaaaagatgtctgtctaagataaatcatggaaaagaagacttgtagaaatatagctacagtcaacccattaaatcaagaacctaccgacggagaacctttaggataggtgagaaagatccttggtgaaaggggtagattcaggttttgtggggcctgaggcttatacagtttggagttatctctttaaggagatacacaacattaggagtcccaaattagaaaggaggccgaccgggtgcagtggctcacacctgtaatcccagcactttgggaggccaaggcgggcggatcagctgaggtcaggagttcaagaccagcctggccaacatggcaaaacccagactctattaaaaatacaaaaattagccaggcatggatgatggcgggtgcctgtaatccctgctattcaggaagttgaggcaggagaatcgcttgaacccaggaggcagacgttgcagtgagctgagatcgcaccactacactccagcctgggcaacaagagtgagactccgtttaaaaaaaaaaaaaaaaaaaggagcccatgcaagtgaggagccttgacagcagctttaaggcaaaccatccacaaaccactctgcgcaggggcaactggaaggaatgttagaaggaggaataagaagaaatgtttcagtcaccttgtttgattatgtcaagctctgagtttctccactacctttaagaactgcaacttttaccaaacctaagcattatttctggaacagttaaattggatttagcaaaatagcatgggatacaaattcagtaatggttgagatcaaagtaggacatttttcttttttagattggaaagtttttacctgggtatgggtcttttaagagatactttcagcaatattgaagaattcaaagaacggtttaattttcaaagagtttctagtattagtctatcttagcgatgaggaaccttttaagggctcttgacgcataaaacaaacaaccaagagcaacattagagtaaggcaacatttctttatactccaccttgttccagaaaggatctaattctactgcacgaaagtgcccagctttaaaggattaatgttaagttttttttagaaactaaattagaaatttatgacactccttgaggagaggaaactaagacttaattcacataaataattttatcactcctcggtgctgtattatatataaaacctttattgcagatagattaaagcccaatccaatgcagtaaacttttactcattgtcctagagttggaaatgcaaagatagagccatcatttctagtgctgccagagttatctttaattaatatgaaactgactatgcctttctctgtaaaatccttcagtgccccagtagaaaaataggcacagggctgaacatggtggctcacatctgtaatcctaacactttgagaggccaaggcaggaggatcacttgagcccaggagttcaagaccagcttgggcaacatatcaagacctcatctctcctaaaaattaaaaaatttgccaggcatggtggcatgtgtctgcagtcctgcatccagagttggttccttccagtgggttcttggtctcgctgacttcaagaatgaaggtgcggacctttgcggtgagcattacagctcttaaaggttgcacagatccagagtgagcagatttattgtgaagagccaaagaacaaagcttccacagcgtgaaaggggacccaagcaggttgccgctgctgactggggcggccagcttttattcccttatttgtccccatccatgtcctgctgattggtccattttacagagcactgattggtccattttacagggtgctgattggtccattttacaaacctctagctagctacagaaaagttcttcaagtccccctcctgacccagaagtccagctggcttcacctctcaatcccccctctaaacatgacaccccaactactgttgggaattgggcaatgaccactctagctacttctgctggataggggcgaagaaggggccctgcagtggtagtgtcctccagaggggaactctctaggccagtcaaagatccaggggtcctcagtagaagttttgagttgagctcatttggggttccatttgtaagaccatctgtagcttgatggcctccatcctggaggaaacaaatttgacaagcaggttaaaaatacagggcccgaaggtgagtaatagcaagatggctgtcacgggacctagaaaggggagaagccatgttgcccaactccagaggttggtataagagtttgaaaggtgttgtctgattcagaagccttttcctgtaaatgccaggcagtgtctcatactatccctgactggttagtgtaaaagcaacactcttcccctaagaaggtgcacagtcctcctttctcagcagtgaggaggtctaggccttggcggttttggagagttactgctgccaaagagtctatttgggattgtagagtaaggatagattttgttatttcttgtaaactgtcagaaatcttttgagagtgtgtggtagtaggatagtgaagtagataaactggctattctggttcctgtagcagtggccattcctaaccctttaagtaggggtattagttgtatggctctgtgctaactgacttgagctttgaggggtactgatagggtctgatttccacaagctttgaagttaggataacacattttatactgttaacttttagcaaactttacttctgttgaaaaccttgtaagtttgggatatcaattattctttgctattaataagacctcattcagtccatattaacttaaaattggtatagatggctccttcctgattctgtaagtactttaaggtttagctgagggcaaacagcttgcgtgtttgagcagatcaattattaggcaattttcctaactctgcttttacaagagtttccttatcacttactgaatacccattgtgtctttttcccttaattgcctgagaggaaccatctatcttcctgtcctgaagggagttcttcctaagtctggtcggacctttgtatagtaattaactaagatttagatcccctgttaggaaacctgctgggttaaggatttttgataggaaggctatgggctgtcagtgcctcagtgtttttgggctacgcccttgtttacactgacaacaaggtggtaatggagtgttatggagtgtcatggagaagacattcaattatcaattataggttttaaatttaccctggcttttaaaggaatagggtacactgttttttctttactacttctatctctctttctctctctctgactccttgtctgtctctctctttctctctgacttcctctttgtctctgtctcttcctctctttccttctctctttgactttctgtcctcccccccattctctttgactttctgtttttgccctctctctctctctctctctctgactccctctttgtctctctgtcgttaagcaccccgaggggagacaactatgcccccgtgaaagtccccattctgtttcagtcgggaatactggggcttaatctgttggagagggttgttctataccaagggtccttccgtaggtatttccgatgggaggttctgcctggcagcaattttggcctcagcatctgcccgatggtttccttctgccttttcttcttcacctttttgatggctttggcagtgtaagactgccagctccttgggtttttgcactgcatgcaacagcttcatgatttccttgtggtatttaacggaggttcccccagatgttaggaattccttttccatattgcagcatgggcacgtaggattagataagcatacttgctatctgtatacacatttatcctttttccctttcccagttctaaggctcaggtaagtgccactagttctgctaactaggcactggttcctcggggaagaggcttacttttgagtactgttacattactaactatggcataacatcactaactatggcataacctgccttccgtatccgattatccacaaatcaacttccatcggtatataagattaggattagctaaggggacttctaagagatcctctccggtggcataagtctggactataatttgttggcagtcatgcttgattggttctccatcctctcggagaaaagtggcagggttgagggccgcacacatgtgtatttgaagcaccggtccctcaaggaatagcgcctggtatctaagcaggcggttgcctgatagccataaacttcctttggcacctatgccatttacatcattagtagtccagacggtgagatcctttccttgcattagtttgatagcctttgatactaagatggccaccgctgcaactacctgtaaacggtgaggccagccttttgctactgtatcaatttccttacttaggtatgccactggttgcggggttgtcccacaagtctgagtaaggactcagagccctttcccagaaagcctgacacctgtgtctttagtctggtggccgcgctagttgcttttaactggccgacaggtgcccggtgtttagcccccagattctaaggaaaaataggacagaatagcaagcgaaaggggtccagttgtgtccagaattggtgggttcttggtctcactgacttcaagaatgaagccacggaccctcacggtgagtgttacagttcttaaaggtggtgtttccggagtttgttccttctgatgttcggacatgttcagagtttcttccttctggtgggctggtggtctcgctggcttcaggagtgaagctgcagaccttcgcagtgagtgttacagcttttaaggcagcgcatctggagttgttcattcatcccagtaggttcatggtctcgctggcctcaggagtgaagctgcagaccttcgcggtgagtattacagctcataaaggcagtgcggacccaaagagtgagcagcagcaagatttattgcaaatagtgaaagaacaaagcttccgcagtgtggaaggggacccgagtgggttgtcaatgctggctccggcagcctgcttttattcccttatctgaccccaccaacatcctgctgattggcccattttacagagagctgattggtccgttttacagagagctcattggtccattttgacagggtgttgattggtgcatttacaatccctgagttagacaaaaaagttctccaagtccccactagattagctagacacagagcactgattggtgcatttacaaaccttgagctagacacagggtgctgattggtggtttacaaaccttgagctagacacagagtgctaattggtgtatttacaaaccttgagctaaacatcaaggttctccaagtccccaccagattagccagatacagagtgctgactgatgcattcacaaaccttgaagtagacacagagtgctgattggtgtgtttacaaaccttgagctagacacagagcactgattggtgcatttacaaaccttgaactagacacagggtgctgattggtgcatttacaaaccttgagctagacacagagtgctgattggtgtgtttataaaccttgagctagacatagagtgctgattggtgtatttacaatctcttagctagacataaaggttctccaagtcgccactagactcaggatcccagctggcttcacctagtggatcctgcacgggggccacaggcggagctgcccaccagtcctgcgccatgcacccacactcctcagcccttgggcagtcgatgggatcgggcgctgcggaccagggagcggcgctcgtcggggaggctcgggccacacaggagcccacggcagtggggggaggctcgggcatggcaggctgcaggtcccgagccctgccccgtgaggaggaagctgaggcccggcgagaattcgagcacagcacctgcgggccagcactactgggggacccacacaccctccacagctgctggcccaggtgctaaacccctccctgcccggggccggtcgcactggccagctgctccgagtgcagggcccactgagcccacgcccacccagaactcgcgctggcccgtggacaccacaggcagccccggttcccgcccccgcctctctacacctccccacaagcagagggagctggctctggcctcagccagcccagagaggggctcccacagtgcagcagcaggctgaagggccagagtgggcaccgaggctgaggaagcgccgagagcaagcgagggctgcgagggctgccagcacactgtcacctctcacagtggtactcactgcttggcgatagtcccatctgggtcaccaagatgtgtccggagttggttgcttccagtgggttcttggtctcactgacttcaagaatgaagccacggaccttcgtagtgagtgttacagctcttaaaggtggcacggacccaaagagtgagcagcagcaagatttatcatgaagagtgaaagaacaaagcttccacggcgtggaaggggacccaagcggattgccgctgctggctggggtggccagcttttattcccttatttgtccccatccatgtcctgctgattggtccattttacagagcactgattggtccattttacagggtgctgattggtccattttacaaacctctagctagccacagaaaagttcttcaagtccccacccaacccagaagtccagctggcttcacctctcagtcccagctactcaggaggctgagatgggaggactgcttgaacctaggcgttcgaggtttcagtgaactatgattctaccactgcactctagcctaggcaacagagcaagaccctgtctaaaaaaaaagaaaagaagagtgggcaagggtcttaacagacttaactgaaaaaagccagatgcaaaagactacatattgtctggttctatgtatatgaaatgtctagaaagggcaactttatagaaatagaaagcaaaatagtggtatcctaggactgggatggaagcagacgttaaatggccagaggggaacttgctagggtgttagaaatgttctaaaagcagattgtggtgatggttgcagactatatattttctaaaatcattaaattgtacacttatattggctgaattttatgataatttatggtaaatcaatggcttcattttatggtattttaatgtaaattgcctctcaaagttgttaaagaaaaaaagttcaacttcactattaaggaaaattttaatattttttgctacttgccaaatctactattactaataccctgaaaaaagtgtggaacatggacactcatacacaaatggtagctgtaaatgtggggacagacttttggaaggtaatttagcaatgtatatcaaagcctcaaaatgcacatatgccttgaatcatttccagtgtaatatcctaatgagaccaggcacagtggctcatgcctgtaatcccagcactttgggaggccaaagtgggtgaatcacctgaggtcaggagttcaagaccagcttgatcaacatggcgaaaccctgtctactaaaaatacaaaaattagccagccatggtggcaggcacctgtagtcccagctactcgggaggctgaggcaggagaatcgcatgaacccaggaggcggaggtcgcagtgagctgagatcatgccagcctgggtgacaaagcgagactctgtctaaaatatatatatatatatatatatatatatatatcctaatgaaataattggacaaatgtagaaacacacacacagatgttcatttctttaatatttgcgatggaaaaattagagacaacctaaacatccaacagtaggaggtaaattaggaaatatttatctcttagaatactgtgtagctatcttaaatggtgatgcagatgtatatatgtaatgtcaaaaagatgtttataaatataagtaaagagattacaattaaatatgtgtaaattaaaaatgtttgtttatatacatatgcatagaaaaagggctggaagtttaacaaatgtgaacattagttgtttctgagtgctagaactattggatgtttcttttttattgtcttttatctgtattttctaaagttttaaagtaaaatgtatcatgtcttatggggaaaaggaaataaaagtttttgcataagaaaaaacctctggctgggtgcggtggctcatgcctgtaatcccaggactttgggaggccgaggcaggcagatcacgagatcaggagttcgagaccagcctgaacaacatggtgaaaccccatctctactaaaaatacaaaaattagccgggcatggtggcacacgcctgtaatcccagttactcgggaggctgaggcaggagaatcccttcaacccgggaggcggaggttgcagtgagctgagttcgtgccactgcactccagtctggtcgacggagcaagactccatcccccccaaaaaaaaagaaaaagaaaaaaatctcattgatttatcacttaaaagtaattataaggacttctttcgacattaataacaaaaatcctttgtaccttcacacaatagtagttgtagttttagtgtttattgattgatagaaataatgacaaaaagctactctaacttctaaaccacttacacacagctttgaatgtattattacagtgtctatggacatttaaacaattacacacacatttcaggcttatttatttagtctatgttacaaaaccttttgaaaaaattctgtggcctgcaggtttggcaggaccaaactagagaataaagtctaaattctttagcttggtatccaggatcctttttattgcaattttcatacttgtccaacttcatgccagttcacacagaactacttattattcctggactggccctgttcctttattgcatctaccatttatataaggtatgtcctgggccttgaatgttctttttcctccacatctttcaggacactgcttgaaaatctcccttcttaagtacttaactatcttatcccagatagttttaatgtttccttttctgtgctctccagaacttaatgcatccacttatcacattggattgtaattagtggcttatgtatctttttccaaatagattaggaacttcatctttgtatccatagggtttagcaagttgcaacagaaagaggtacttgcaataaacctcagttgattgaatgagtgcacagaaaaagacccagtacttgcccttagtggctttcaggctgcttagggagacagatacatgtccaatatatgattagtcttgtaataaaagatgtcaatgagccgggtgcagtggctcatgcctgtaatcccagcactttgggaggccgagtcaggcagatcacttgaggtcaggagtttgagaccaacttggccaacatggtgaaaaaccccatctctaccaaaaaaaatatataaaaattatccacacatggtggcatgcctgtgatcctggctactcaggaggctgaagtgggataatcacttgaacccaggaggcagaggttgcagtgagccaagatcgcgctactgcactccagcctgggtgacagagtgagatcctgtctcaaaaacaaacaaacaaaacaataacaacaacaacaacaacaaaacagaaaaaaaatgtgaatgactacacagaagaggtagtgatacattttgactgggtgattaagaattgcttcccaaagtagggtccatttgaattagactcattttgacaaaaaagaagaaaggacaaagaaaagccttgactttattctatagaaaaatgagggtgactcattttgcaccctcaacctcaactctctagctatcctcactgccccagcttcccttctcatctcaccgtcaaaagtgactgacaataaattccttgtcaggatgctgaattggcactctaatctcctagcagagtttgcttacctggccagatacacatttgagtggtaagaaaaagtgctagatgaagcatgcaagaagaactcttttctcatcctgggttggtcatagtctagctgattagactggatacatgatgcatcacgtagcttcttgattctcagtttcttcttttgcaaaagaggggtagttataataatgacaatcctctctaaagtatatcacagttgttcagaagaatttaaaacatactatatgtaaaagcacttttctaagctgatacactgtaccaatactcagtgttaggattatatcattacatttctgagaatacttgttggaattggccagaccactcctcctgaggggctttccagcttcaggaaactttgacagtggtttggggaaagaaatcctgtctcccttgtataatcagatcagtagtggttttcaagtgaatttaggtaacaaaatatctggtaatcatagaaacaaaatattgatgtatttaattacatcacccaaattaggactatgtattcctaattttattggcaaaacggtgagtctattacatgtatgtaaataaaaagtaatggagatacccttctccccagttcctgccacagtctgagcccaggtagttaccttagctatgtactcactatggtagtcagggttctccagagaaacagaacgaataggacaaatgcgtatatagatgtagatgtgtgtgtgtgtgtgtgtgtgtgtgtgtgtgtgtatgtgtacagggctacctcagagatattgcaagttccattccagaccattgcaataaaatgaatatcacaataaaatgagtcacgggaatgttttggctttccagtgcacataaaaatttatgcttatactatactgtagtcggttaagtgtgcaatagcattacgtctgaaaaacaatgaaaacaatgtacatgccttaatttaaaaatactttgggattttttgttttttgttttttttgagacggagttttgctcttgttgcccgggctggagtgcaatggtgcgatctcggctcaccgcaacctccgcctcccaggttcaagcaattctcccgcctcagcctcccgagtagctgggattacaggcatgcgccaccatgctaggctaattttttttgtatttttagtagagatggggtttcaccatgttggtcaggctggtctcgaactcctgacctcaggtgatgcgcccacctcggcctcccaaagtgctgggattgcaggcgtaagccaccgcgcctggcaaaaatactttgttgctaaatatatatatatatattaacaggagccttcagggagtcatcatatttttgctggtggagggtcttgccttgaccttgatggctgctaactaatcagggtggtggttgtttaaaggccaaggtggctatggcaatttctttcctcctgccttcattccttccttccttgcttgcttccttttctttgagacagggtcttgctctgtcacccaggctggagtgcagtggcacaatcatggttcaccataacctcatattctggggctcaagcaatcctcccatcttgggagtagctgagactacaggcatgggcccccatacctgactagctttttttttttgagatgaagtcccgctcttatcccccaggctggagtgcaatggcaggatctctgctcactgcaaactccgcctcctgggttcaagtgattctcctgcctcaccctcctgagtacctgggattacaggcacatgccaccaggcccagctaatttttgtatttttagtagagatgggatttcagcgtgttggccaggctggtctcaaactcctgacctcaggtgatctgcctgcctcagcctcccaaagtgctgggattacaggcataagccactgtgcccagccactaacttctaaacaattttttgtagagacagggtcttgttgggttgcccaggctggtatcaagcccctggcctcaagcaatccttccacttcagcctccaaaagtactaggattacaggcatgagtcaccagacccagctatcgtgacagtttctcttttttttctttctcttttcttttttttttttttttttttttgagacagagttttgctcttgttgcccaggctggagtgcaatggcgcaatctcagctcaccataacctctgcctcccgggttcaagcgattctcctgcctcagccttctgagtagctgggattacaggcatgcaccaccatgcccggctaattttgtatttttagtagagacggggtttctccatgttggtcaggctggtttccaactcccgacctcaggtgatctgcccgcctcagcctcctaatgtgctgggattacaggagtgagccactgcgccaggccaacagttttctttttctttcttttttcttttttttttttttttttgagatggagtctctctctgttgcccaggctggagtgaagtggtgtcatctcggctcactgcaacctccgctgcctgggttcaagcaattctcgtgcttcagcctcccgagttgctgggattacaggtgcccaccaccacgcctggctaattgtttgtattttttagtagagatggggttttgccaagttggccaggctggtcttgaactcctgacctcaggtgatccacccacctctgcctcccaaagtgctgggattacaggcttgagccactgcgcccggctgacagtttcttaaaataagacaacagtgaagttttctgcattgattctctttcacacacaaaaattctctataacatgcagtgctgtttgatagcattttacccacaatatagaacttcaaaattggagtcagtcttctcacatcctgctgctgctttatcaactaagtttatgtagtattctaaacctttcttgtcatttcaacaatgtccacaccatattcaccaggaatatatttcatcttaagaaaccactttctttactcattcataagaagcaactcatacgttcaagtttgatcataagattgcagcaattcagtcacatcttcaggctccacttctaatcctagttatcttgctattttcatctcatatgcaattcttcgtctactctagtcttgaatccctccaagtcatccatgaggattggaaccaacttcttccaaactcctgttttgttgttgttgttaccggtttttgtttgtttttgttctttgtgagatagggtctcactctgttgcctaggccggagtgcagtggtgagatctcagctcactgcagcctcagcatcccaggctcaagatcctcccacctcagcctttcaggtgcacaccaccatgcccggctaatttttaaattattttttgtagagatgggttttcgccatgttgcccaggctggtcaagaactcctgagctgaagtgatctgcctgccttggcctcccaaagtactgggattacaggcatgtgccaccaccacacctggcacctattttgctgttttgaccttctcctccatgaatcacaaatattcttttttttttttttttttttttttgagacggagttttactcttgttgcccaggctggagtgcaatggcgcgatcttggctcaccacaacctctgccccctgggttcaagtgattctcctgcctcagcctcccaagtagctgggattacaggcatgtgccaccacgcctggctaattttgtatttttagtagagacagcgtttcttcatgttggtcaggctggtctcaaactcccgacctcaggtgatccgcctgcctcggcctcccaaagtgctggggttacgggcgtgagccactgctcccggcccacaaatattcttaaaggcatctagaatggtgaattctttccagaaaattttaagttgactttgcccaaaggcatctagaatggtggattctttccagattttaagttgactttgcccagatccatcagaagaataactgtctacagcagctatcaacttaagaaatgtatttcttaaataataagacttagcctggtgcggtggctcacgcctgtaaccccagcactttgaggggccaaggcaggcagatcacctgaggtcaggagttcgagatcagcctgaccaacatggagaaaccccgtctctactaaaaatacaaaattagccaggcgtggtggtgcatgcctgtaattccagctactcggtaggctgaggcaggagaatcgcttgaacccaggagacggaggttgcggtgagccgagatcacaccattgcactccagcctgggcaacaagagcgaaacttggtctcaaaaaaacaataatgataataataataataagactttaaatgtgaaattattccttgatccatggggtacagaatcagaatggatgttgtattagaagacatgaaaacattaatctcctcttacatcttttttttggcggggggatgtggtgcttgaatggatcctggagtcggccattgctcaagcacaccaccaaacagtgcccttgcaaagcaggcctcatccctgtccaccgggcccagcacctcccgggtctacctcatctcagacaaccctgctactctgaatcctgatttgaaatcttggtgaaggtatgttttgttgtttttctaagtcttttaaaaagaattatcttggtttctttgctcctgatgactttttgcctaatagctggagcatgaataatgctccatgactaatcagatttagcctgctgcagaaactgttttagtttatcaacttagggggcattctgtgggaacaaagttaagatttcaagaggttccaatggttcgcaaccctgcccgacttcgcttaggcttaatactgcactgagagcagtcaaaccaccttatgacagctctccccagctgcatgaaagtctcctgttgtcactcactcatatctcctctcctactctaagcattttggttaccattttattcctaacaactacaccttgtcagacacagaagggcactcaggaaatatttgttgatgaaatgaataaaatttctgataagaataaagagttcattgtaaaaaaaaaatcaaactgcaaacaaaatagatgaaattatacatgaatttctctcaactctctatgtataatgttaaatcaagtttagcctaaagctgccctattacatattttaaatttggcctaaaggtttctctgtacatcatgaagtataacctaaatggaagggtaaacagactatagtctactcttgtgccagtcactgagttttggccaatcaaatgtggccaactgttcaaaccatgctaaaagaaggcaaacagctgagctgtaaccaatccagagctgtttctgtacctcacttccgttttctgtacttcgttttcgtttttctgtccagaaatcttcttccaccacgtggctgcgctggagtctctgagcctactctggctcaggatgctgcccaattcacagatcattcatcactcaattaaactcttttgaatttaattcagctgaagtttttctcctaatggtaaaaactctcctaagtttaagagccatagtggaaatcacatggaaaaagctgtagatttgattacataaaactgctaaactctgtaaatcaaaaaaaatcacagactaaattaaaagagatcgaactgggaaaatatttgctacatgtatgatagatttacatggaaataagtgggggcacctaagatattccaggaaaaaataagaaaagaacatgaaacagacaattcacaaaagagaaagtatgaatggctaacagctagaaaataactaaaaactattattaacaaaaatttaaaaatcaattatagtactcatttctgactggggcacagtgagctgggcacactacttctttctagatcttcagagccaagtttttaaaactcaaagctagacattgactcagtttctttgtctgcattttaggtgtttagaccccacctgaggagctgtacataacaaaagccctcaatgccactaaaccaatgggagaggggtaagagtacaaagaatttaaaaccacaatagactcatattattctattaccagtagatagaaatcaaatacgttttatcaatttgaagaacgttttccacgtcatccagtcacccaggccacaagatcctcagtgacgacagataattatgaaattagttgtattattgatactgctttttcctgggtattggcttcccagagttactgagagaatgatggaataaagcatcgactttgtcatatagagccatgtattacaagtaaaacttgctgtttcaaaatcttttccttctctttcaaaaaaactatcattttcttctctctgagcagtttttgatagagttcatcattagcaggggcctcaaaacagaacattgcaaatcatgtcagtttcagaatgattttttttttttggcttgctgatggcaaactgcaatgtgaatttctgcaagagcacagtgccatgtcataaatcattagtctggcttcagagtctcttgctattttccctacatggaggacagatgcttttttgttgaatcaggaccataatttgcatctggtaggacaatggatcatattctcttctgtccacacacagagccgcattgacaacagcaagagttgctcagagatagaggcaaagtttggctcagccagtgctaaattcagcttgatttttaaaagtaaatgacccagttaaaatccagtgaagagcaaagcacatagtggatttggaagtttcctttgaaatttccagctcagtgtatgaagtaactccagactctaatgagcctctccgactgcaagcaactaagacccaaaatgattgtctgtatcagatccagggctttctgtgacagcagacaatttattgttatgctttacaccctggttttccatctgtgattgatgtgtgctcttccgctttcaaaagacttttctaatagtcacgtttcttccaactgaccctgcaagatgagtcaaaatttccatacttaggaatcccagctacttaggaagctgaggcagaagaatctctgtaacctgaaaggcggaggttgcagtgagctgcgatcacaccactgcacaccagcctgggcgacagagcgagactccgtctcaaaaataaataaataaataaataaggagatggttatacaattgcattcttctcaacttaaaagcctctctctgagctggatgcggccattcacgcctgtaatcccagcactttgggaggctgaggcgggtggattgcctgaggtcaggagttcgagaccagcctgcccaacatagtgaaaccccatctctactagaaatacaaaaaattatctgggcatggtggcacgcaactgtaatcccagctactagggaggctgaggcaggagaatcgcttgaacccgggagatggaggttgcagtgtgccaagatcgtgccattgcactccagcctgggcaacaagagtgaaactccatctcaaaaaaaaaaaaaaagcctctctctttggcttgtagatggccatcttcgtgttcatatgatgctctctctgtctgcatgtctctgtggccaagtttccccttcttataaagacagcagtcatattggattagggcccaccccagtcacctcattttaacttgattacatctataaagacctatctccagataaggtcacattctgaggcactggatattggactttaatatatgaattttggggagacacagttcagccacaacaccaggcaacctctctggctttggtttcttcatctttagaggggaatgttggccttattgctccttcagggctctttcaatcccagtgttccaagatttgctcagcccttttgaagctgccaagcctgtccctgctatccccagggttataaatataagaattttccctccccgggcctgccaaccagtcctggagggtgggaaatgaacagagaaatgctgcgagggtggagttttcctttaaccttttgtcacttgcatgagtgctgtaatcggacaaacattcagggcgtggtgaactggggttcctgacatcctaaagcaaataagcaaatgacatttgttcttttccaagtcccgaggttttatgtgctccaactatagatgacaaaatagttccaggagagctgcagtgttttgttctccctgccaattcattagcaacagaaccgttgccgggctctaatccagcccggctgacagcagttccccagtaaaggaaggacagaactggagctgtctgtgcagccaacagggatcaggagtgctcagatgtactgacacgttggcaaaaaaaaaaaaaaaaaaaaaagaattaaagaaagaaaagaaacttacaaaagtttattgaactgagaagttcacccggtttcttcaaggaactcagacaggaaggtaggaaggaggggcccccggcatggtgataacacaaattaggggctggccagcatcatctttggtgaaaatttagaaaaattgggattttcttacctataaataaaaactgttggttttagaaacctaaactaagagtatgtgtgcaaaaggaaatctatataaggaagcagggctggactgtagttacaggaggcccaggaacagcccacttcctttctttgtgcctttttaaatcatctctaaatgtggagatggtaatacaattgcactcttctcgacttaaaaatacttttcttctaaatcacctgacacatctttttttgcccctgcatggtgctcatagccagtaagagatctttcagagcctctttatcagtctagtagatcttgctggaagccgccagcactccagatgctgaatgcagtcagactacagctcaagcactgaccctgaccatcctcctggtcttaagaatgtgccaaacctttatgttcgagctgctttattaggaacttcttgagctttctttccatgcaatttctccattcctactttaaacttttccacccagcttttatgataataatgagcgaggcttggatgctgctttatggcttttgaaaagcctggatagtatatgagtgtgtccatatcttactttttgtttctaccatgtgcagcagtgcgggggaagtaaaaaagccattcttgtggccccctcccggcttcctggaagctgcagtgtgcctgatgggacaggcatgttcctggctacactgtagctgagcaaaaggtctctgcatacagaagaccaggagaccataagttcaccatcaaagaaaagtctgcagctggtaggttgagcctgaataataatacatgccacaactcactgctgttcaactcattcctcagctgggttcactgacttgtgtacctcaaaatgctatgttttgctgtctcttcccgtctatactctgagatactaactcttgaatcctcccagttaaataggagtcttggatactaaacctggccatttagaaatcacatccatttatttgttcctgtagtcattaattcattcagaagcaaggattggatgtctcccatctaccaagcacaggactcagccatagggatgcacagaataacaggaaaggcttttcctgcctcagaggaactcctggccaatggtctcctctgacgcatgaaggcttctggacttggattttcattttgagtttttgaacttgtagtacccatgcgtccttttcaaggaagaacttgacttccttgctaacgcagagcatagatgtctgccaaatccctgtactcaaccagacttccagttctgatttctcctagtccttcctgttcctattcctgaagcccagcacaatagcctgaagtgtccacttgagtttggaagctctgtccccatgggaagggtcatacactagagcctttggggctgaggagcctctaagacatggcttctttggagtctctgtcttgtttgttttctcttggatccaccctaagcatgaccaccactggactacgatagaatttgaagagcccagtatatgtgagaggtcatttgcaacaaatgaaaatgggggccaaagggcaaggtttagttgtcagagtggtatctggtggcagcaaccctgccaggtcccctgggagcccaggtctgcccagcacaagttcctcagccatccttgctgctttgccttctgccaggctgggaagaggaaggggatggttactgtgccgtgaagagaaaggcaagtgggcattggccatagcctgtgcttaagaggcagtcgcacctatcgagtattcctgcccaaaatgcttaacctgaatcaaattgtgacgagataatcagatgtccaaaaaacccccaattggcctgaactcttcaaaaatgttgatgtcaagaaagaattttttttttttttttttttttttttttttgagacggagtctcactctgtcgtccaggctggagtgcagtggcacaatctcagctcactgcaacctctgcctcctggactcaagcaattctcctgcctcagcctcccaagtagctggaatgatgggcaagtgccaccacgcctggctaatttttgtgtttttagtaaagacggggttttgccatgttggctaggctggtcttgaactcctgagctcaggtgatccgcccactttggcctcccaaagttctgggattacaggcataagccaccatgcctggccaggaaatattttttttacaggcaagggaactgggccgggtgcagtggctcacacctgtaattccaacacttttaagagttcaaggcaggtggatcacttgaggccagcagttcgagaccagcctcaccaacacggtgaaaccctgtctctactaaaaatacaaaaaattagccagatgtggtggcacacacctgtaatcccagctactcgggaggctgaggcaggagaatcacttgaacccaggaggcagaggttgcaggtagtggagatcacgccattgcactccagcctgggcaacagagggagactgtctcaaaaacaaaacaaaaatagcaagagaattgttctacattaaagaaaactaaaaagacatgactaaatgtaatgcatgatgccaatttagatctgggattggaaaaaatatagccataacagacattatggggacagttatgagtgtgtgtgtttgcagaaggagaaagaaaaatgtggcaaaatgctaaaaattagtaaatctaaatgaaagtatgtggctattcattgtactgttttctcaactttgctgcaggcttggaatttttcaaaataataagtttaaaactcaagcatcatccagtggcaggtaaatgggcagtaagatggaaaaaatggagtgagcagacagcaggatccaggtggcagcatggcagccccagacaacttctgggctggggtctagtcccagtaaaaagtcaggacccaggctaaaaaccaggcaggcagacaggcatgaatacagggaagctgcagcttagtgtgcacctggaagccttgggccagccccaccatctggggaccaggtgtgggtagagcaggtaaattccagatccacaaacaagcaaataactcccaataatgccaccggtagcctttggaggctcaggactttcccaagtcctgagtgctgagtgatcaagaggccagacaggactggagccagcaggaactaacatgtctgcctgttgcccaaggatgacaaaagctcaaggcggagatggggactcctcaggaggtaggaactttactgggttctgtttcctcttaactggctacgttctgcattgccagattaagttactgattaaacccacagatgtcactctaatttccaactttttccatcttttctgcctcctagtctctatttgcaattcttcctagctgtccttgttcttctcctagttttatgccattatgatgtgtggaaaatattagacaacctctctacagtgtcttaaaatgcctgaggacaaagattccaaaacaaaatttatcaaagctggttttggactcaatagtgtgacacgtagtttccaaaggtcataaagctgagtgctaaagtgatcaagctcccaagctccctggctttgtcatcctttggcattttcccaagttttctggtccttaaaggaattgctgatttctccttcctgactctttttaatctcagctgtgctgagcagagcttcccaaattctgggcaggccagcagcttagccctctcctctccaggactcctgagcattccccctgtacatagggatggacagtgccggaggtcagccaggggttggtgggatggatccagtcaaactcagctctgctcggtttccaccatgtggctcagcaacaaagcagccatgacacgtgttgccaagaccatgtgttgggagccaggagtagatgaattcctggtgtacataaggaaaacagcaactgagtttgctacaactgtgattaacatgcaagattcatcctggagatagctcctcttgagaaaacataagatttgcagaaggggatttaaagaaagccccagtggtttttcatctcaatctttctctctcaattttttaaagcaccaaatccctatgttcaaatataaattttaggcaagaaccaatatacaggccaggcgtggtggctcacaactgtaatcccagcactttgggaggctgaggcaggcggatcacctgaggtcagaagttcgagaccagcctggccaacgtggtaagaccacccccgcccatctctactaaaaatacaaaaaattagctgggcatggtggcatgcacctgtaatcccagctactcgggaggctgaggcacaagaatcgctcgaatccaggaggcagaggttgcagtgagctgagatgatgccactgcactccagcctgggcaacagagtgagacttcatctcaaaaaaaaaaaaaaaaaaaaaaaaaggaaagaaagaaaagaaaaaagaaccgatatacaaaagagataacctggcttgtctgatttttgtgtgtgtgggagggggaccacagacctatgtggtctttcccagtagcccaggatactttcaaagtattattacggctctcacgggatccagggtttgagaaccattgctcccatctttcctccccacatgcagaggaactatggcatcttcgctgatgccttctttaatgtttgttgctcgagctatttttttttttttttgagatggagtctccctctgttgctcaaacagcagtacggtggcatgatctcagctcactgcaaccttcacctcccaggttcaagtgattctcctgcctctgcctcccaagtagctgagattataggcgtgtaccaccatgcctggctaatttttctatttttagtagagacagggtttcgccattttggccaggctggtcttgaactcctgacctcaggtgatctgcccacctcagcctcccaaagtactgggattataggtatgagccactgcgcccggctttttttttttttctttttttgacggagtctaactctgtcacccaggctggtgtgatctcagctcactgcaacctctgcctcccaagtttaagcgattcttctgcctcagcctcctgagtagctgggactataggtgtgtgccaccatgcttggctaatttttgtatttttagtagagacgaggtttcatcgtgttggccaggctggtcttgaactcctgacctcaggtgatccacccgcctcatcctcccaaagtgctgggattacaggtatgagccaccgctcccacttgagctatttttatgcttcaatgcataccaggacctctatcatatgagatgttttatttctttcttaaatgtctagaaaggtcctttgatggaaaatgaataactcatgatatcttcaaaaaccagcattggcctgaagttaatatatttcatcctaataaaaaaataaggccgggtgcagtggctcacgcctgtaatcccagcacttttagaggccgaggcgggcgaatcacgaggtcaggagttcaagaccagcctgaccaacatggtgaaaccctatctctactaaaaatacaaaaatttgccaggcgtggtggcacacacctgtaatcccagctactcagcaggctgaggcaggagaatctcttgaacccgggaggcggaggttgcagtgagctgagattgtgccactgcactccagcctgcatgacagagcaagactccatctcaataaaataaaataaaataaaataaaataaaataaaataaaataaaataaaataaaagtgtgatcacaaagtctcactttcatgatgctgaaaaggcagagctcatgaatccttccctctcctcccttacgtgatagacgaaccccagggtgtggctcttctcacaggttctgttgcactggctttctgtgaactcaacatcttggattcagttgaacttgcttcatttttttattgttacacactacatcattcattacttttcctgccattgactgctagttacattttcatctataaccgcaaacatcatgggatagaaaaccgtgggaaagttaatctctaaagcaatggaaagttcccaaatgtgagaataacagggcaacccatggtgggaaatgctactcaacagctttatttcatcacaataacaatgactcttgagatggaaaaaatttttatttgataaggctaccattcatcccaaaatggacaatgtgtatttagtcattcaattcaaatttgtgtggctcattcctcagctacttagttatttttcattagatttcattagtggttagactgtatttccctagtccacagcagccagagtgctgtacactattaacatacaaatggggatgtctcctgcccttatcatcacttggagtccccatcagtgttccacctgggagtccctagagagcctctcgcctgaactcaccaaaaactttaggaccaccataggcttctaccactgtcttcttctgctcggtccctcttcagtgatgtcagcttcccaggcctcaccacccacacagctaatgaaggtgtttcaaggctacctctggtgtcctcaaacgaccccctttacaggcccattgtcactgccaccaccccgatacatgggtacatgtggtgtaccaatatggagatgaatactctgaaggtcatggcatttgttgcccaagtgagaaaaagcctctctctatttcatgtaatgtacattttgtgtaatgtacatgagcaattactgaggcagtcttcccttgcatccaagatcttagagtttttaatgaaaataggggctgtgcacagtggctcacacctgtaatcccagcactttgggaggccgaggcgggcagatcatgaagtcaggagatcgagaccagcctggccaacatggttaaaccctgtctctactaaaaatacaaaaattagctggtcatggtggctcgtgactgtaatcccagctactcaggaggctgaggcaggagaattgcttaaaccaggaagttggaggttgcggtaagccaagatcacgccattgcactctagcctggcgagagggtgagactccacaaaaaaaaaaaaaaaaaaaaaaaaagagagagagaaagagaaagaaagaaaatagggccaggtgtggtggctcacgcctgtaatcccagcactttgggaggccaaggcaggcggatcacctgaggtaaggagtttgagaccagcccggccaatatgacgaaaccctgtctctactaaaaaaaatacaaaaattagctaggcatggtggctcacgcccataatcccagctgctcaggaggctgagataggagaatcacttgaacccaggcggtagaggttgcagtgagccgagatcaagacactgagtcactgagtgagcaacagagtgagactctgtctcaaaacaaaaaaaagaaaagaaaagaaaaaagagtttttaatgaaaataaggctttcagattttaacataggcctttctcttctaggattcagtcctgagttcatggaggcaggactagggttgggggggcacagtcgagtatattcagaactggccccccccaccttaacaagcttttctggttcagtctctcttcctttaaatgagttctgtctccccagccatcagttcctcttaaaaattggcttttggcagctcagtctaccaaacaggtctagacacgtctgaatcccagtgggagatggcttaggcttaaactaaggctgctgacacatgactttccacttaaaatttactcaggctcttttacccatcaatatgcttaaaaaaagaaagataacttcgcttacatcaagcattcattctgaagttactaattttcttttgccttgtccttatgagctcttggatttcaaatggtagattggtgaggttattactgatcatttgactcatacgcattaaccacatgaatattaagtatatgatttctatttctccgtgtcagcattctgtttccctaaaataaatttactcaaatgaatcttcaataggatgaggagaaattggaaccatcgtacaatgttggtgggaatgtaaaatggtacagtcattttggaaatcagtttggcagttcctcaaaatattaaacatagagttaccatgtgacccagcaaccccattcctaggtatacccagagaattgaaaacataatcacacaacaacttgtacacaaatgttcagtatgattccctttagatgaagagttcagaataggcaaatctgcagagacagaaaacagattagtgattgccagggactgggagaagaagggaatggagagtgactgctaatggacatggggtttctttttgggatgatgaagatctgaaatcagatagtgatgatggttgcacaaccttgtgactactctaaaaataactggattatatatttaaagaaggtgaattttatgtgaattatgtgtcaattttttaaaatggatctttacgatatattaaacaatcagcagcctgcgttttataggaaaacttaaatggttgctttactgacgtttataacaaattacagccttcttgtaaaaagcaagatcctttgaaagcccaaatagaaagaataaatgctttggctgcgtgcggtggttcatgcctgtaatcccagcactttgggaggccaaggcaggcagatcacctgaggtcaggagttccagagcagcctggccaacacggcaaaaccccatttctattaaaaatacaaaaaattaggcgggcatggtggtgcacgcctgtaatcccagctactcgggaggctgaggcaggagaatcgcttgaacctgggaggcagaggtagcagtgagatgagatcttgccactgcactccagcctgggagacagagggagactctgtctcaaaaaataaataaataaacacttttaaaatttattcatttggcaaccattgagcatgtagtatggcaatgtgccagcattgcagagataatggtgaccaaaacagacacagagatatgggcagtctccagacagtctgcaaaatagctatgcccagaaaagcacaaggcttggtgggagcatgtgaaaggaacattcaactcacacgcgagggctcggggagatcttttcatagcccctgactcctatcagagccctggagttgagcccgagtcaaggatgcaaagagcagagggaggagtgttccaggaggaaggaatggggtgtgcaaagaccctcaggtgagagagaacgtggactatcctgggaaccccaaaccgtttggaatggctcttgagaaaagatccagtctaagtatttggtctgaactgagtcttgttcaaactttactctgtatgtcaattagaatgtttcagctgcaagtaacaaaaaatctgacttccacagacttaaagattaaggacatttattttattattccacctaacaggaagactagaggttggcagacttcagagttggtagattcaggggcttaaccatgaggaactgtctttagggacccagcttctttctttctttttttttttttctccctctgtccctctctccctctccccaccccgacacacacacacacacacacacacacacacacacacacacacacacgctgccaccaccttctaactgtctctctgctatcctcctgttcagcttctttctaagacaagttccccttgaggccacatgacctgggacaacatgctttcctattctctttcagcaagaaagacacttctcttttctgaaagtccctagcaagcctcccctgatatctcattggcacaaatttctgaactgacccctggcgagaaagggggagttatcctaagtgtcttggattcattatccagcagtggaatgaatgctggggggtcagcctcaatgtggccacagtggaccataaacatagttggctgccttgggctggcactgccttcaccagcccctgccttggggcctgtctcccacttttgcatcaaagacatgaccaagatgaactttaaagcatgacgtataatgtggttttcactgcaagtttgtgagaatcaattatcatactgataaacttctcaaaaattatctttaaacctcttcctttcctcaaatttccactccttaccacatccaccacatctctttctctccaccccatcttcctccctaggcctgctacagccatactggctgttacctattttccactccttttctttaaaccactcagcttgcattttccatccagcagaagccagtcccctcagcccccatgccgaggaacagagtttcaggtcaccttctacatgctccccagggtctcagttctcgccctgcctggaatgcaacaggagatctgcaagctgacttcagtgtttctaccaaaaaacccctgtattctgtttacttcaaactctttcaacccaacagtttaattaaccatcaatcattattaaaagctatgaagacatcacacagaaattgttctatgtggaaaaaaatgaactttaatatggcttaaaaataccacaaacccccaacagaaatacaaactaccatcacagaatactacaaacacctctacgcaaataaactagaaaatctagaagaaatggataaattcctcgacacacccaccctcccaagactaaaccaggaagaagttgaatctctgaatagacgaataacgggctctgaaattgtggcaataatcaatagcttaccaaccaaaaagagtccaggaccagatggattcacagccgaattctaccagaggtacaaggaggaactggtaccactccttctgaaactattccaatcaatagaaaaagagggaatcctccctaactcattttatgaggccagcatcatcctgataccaaagcctggcagagacacaaccaaaaaagagaattttagaccaatatccttgatgaacattgatgcaaaaatcctcaataaaatactggcaaaccaaatccagcagcacatcaaaaagcttatccaccatgatcaagtggacttcatccctgggatgcaagactggttcaatataagcaaatcaataaatgtaatccagcatataaacagaaccaaatacaaaaaccacatgatcatctcaatagatgcagaaaaggcctttgacaaaattcaacaacccttcatgctaaaaactctcaataaattaggtattgataggacgtatctcaaaataataagagctatctatgacaaacccacagccaatatcatactgcatgggcaaaaactggaagcattccctttgaaaactggcacaagacagggatgccctctctcaccactcctattcaacataatgttggaagttctggccaaggcaattaggcaggagaaggaaataaagggtattcaattaggaaaagaggaagtcaaattgtccgtttgcagatgacatgattgtatatcaagaaaaccccattgtctcagccccatatctccttaagctgataagcaacttcagcagtctcaggatacaaaatcaatgtacaaaaatcacaagcattcttatacaccaacaacagacaaacagagagccaaatcatgagtgaactcccattcacaattgcttcaaagagaataaaatacctaggaatccaacttataagggatgtgaaggacctcttcaaggagaactacaaaccactgctcaatgaaatgaaagaggatacaaacaaatggaagaacattccatgctcatgggtaggaagaatcaatatcgtgaaaatggtcatactgcccaaggtaatttatagattcaatgccatccccatcaagctaccaatgactttcttcacagaattggaaaaaactactttaaagttcatgtggaaccaaaaaagagcccacatcgccaagtcaatcctaagccaaaagaacaaagctggaggcatcacactacctgatttcaaactatattacaaggctacagtaaccaaaacagcatggtactggtaccaaaacagacatatagatcaatggaacagaacagagccctcagaaataacaccgcatatctacaactatctgatctttgacaaacctgacaaaaacaagcaatggggaaaggattccctatttaataaagggaattaaatggtgctggaaaaactggctagccatatgtagaaagctgaaactggatcccttccttacaccttatacaaaaattaattcaagatggattaaagacttaaacgttagacataaaaaccataaaaaccctagaggaaaacctaggcattaccattcaggacataggcatgggcaaggacttcatgtctaaaacaccaaaagcaatggcaacaaaagcaaaaattgacaaatgggatctaattaaactaaagagcttctgcacagcaaaagaaactaccatcagagtgaacaggcaacctacagaatgggagaaaattttcgcaacctactcatctgataaagggctaatatccagaatctacaatgaactcaaacaaatttacaagaaaaaaacaaccccatcaaaaagtgggcgaaggacatgaacagacagttctcaaaagaagacatttatgcagtcaaaaaacacatgaaaaaatgctcaccatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggtgattcctcagggatctagaactagaaataccatttgacccagccatcccattactgggtatatacccaaaggactataaatcatgctgctataaagacacatgcacacgtatgtttattgaggcactattcacaatagcaaagacttggaaccaacccaaatgtccaacaatgatagactggattaagaaaatgtggcacatatacaccatggaatactatgcagccataaaaaaggatgagttcatgtcctttgtagggacatggatgaaattggaaatcattctcagtaaactatcacaaggacaaaaaaccaaacaccgcatgttctcactcataggtgggaattgaacaatgagaacacatggacacaggaaggggaacatcacactctggggactgttgtggggtggggggaggggggagggatagcattgggagatatacctaatgctagatgacgagttagtgggtgcagcgcaccagcatggcacatgtatacatatgtaactaacctgcacattgtgcacatgtaccctaaaacttaaagtgtaataataataaaataaaataaaataaaaaataccacaaaccaaatccaaagacaaaaattgagaagcagttgtaaaatacacaatagttttttatataatcactcagaaataaaagaacagccagggcaaaggatatgagctgtcagtttatgagagagagagagaacatttatttcaattgtttgcctatcagattgataaagatttaaaatcttactaatatccaatgttggagggaataaggagcaataggcacttttttttttttttttttgagacagtgtcactctgtcacccaggctggagggcagtggcatgatctcggctcattgcaacctctgcctcccaggttcaagtgatcctcctgacttagcctcccaagtagctaggactacaggagcatgccaccacacccagctaatttttgtactttttttttagtagagatggggtttcaccatgttggccaggctggcctcgaactcctgacctcaagtcatccacccacctcagcctcccaaagtgctgggattacaggcgtgagccgccatgcctgaacaataggcacttttgatgggaacattaattggaacaacttttctgaaagacgatctgcatttatatcaacatttaaaatatatttacttttgatcaaataattaacacttctaggaatttattcaaaggctatattcaggcaagaacacaaaaatataagtacacatattcgccatagatcttttcatagtagtcaaaattatagggagttaattagtgaattatggtagatttgtgtttgcaagacttgcttacctatgactacctccccagaatctagctcagtgtgtggtctatatatgaatatttactgagaaaatgaacaaataaatatagtaggaaattctatagctattaagaatgatgatgtataggccaggcacagtagctcatgcctgtaatcccagcacttagggaggccaaggcaggcagatcacaaggtcaggagttcgagaccagcctggccaacatggcaaaaccccgtctctactaaaaatacaaaagatggcacatgtccatactcccagctacttgggaggctgaggtaggagaatcacttgaacccgggaggcagaggttgcagtgagccaagatcgcgccattgcactccagcctgggtaacaggagtgaaactctgtctcaaaaaaaaaaaaaaaagaatgatgatgtatagatgtatttctatatgatgtatatgtatttgtgtatgacgatgtatagatgtatttctatacatcgtatatttccataaattttccatttattacaatggaaaattatccatcatatcttactaaaaggaaaagcagatgacaaaactgcatagacagaatcatctcatttttgtataaaaagcaaatgtgtgtgtgtgtgtgtatctatggaaaaaagtttagaagtatataccaaaatataaattgtggttctttctaaatggtgagattatagatgttgtttgcattcttatttatacctttaagtaatgtctggattttttacaatgagcatagattaacagatgtgacttcgataatcacaaaaatttcattttgaataacaaaaatactgctctctatgaatatatgtgctacagaaacacacatatatgaaagtaagtataaactactttgtagttttgtatgtctttccaggatcgcctgaagatgacaatgtccttgtagcaagttaccaccaggaaaaatcaacaagttgtccaaaacttgttcaaaagaggccaggcatagtggctcatgcctgtaatcccagtactttgggaggacaaggaaggaggatcagttgaggccaggagttcaagaccagcctgggcaacatagcaagaccctaggaggctgaggcaggaggatcacttgagcccaggatttcaaggttagagtgagctatgattgtgccactgtactccagcctggacaacagagagagacactgtctcttaaaaatattcaaagaaaatgcaaacaaaaagtctcagggagttcttcagcagctcattgtgtactaatgcactaggtggacaggaggtggactggatcaagacagacctttcccaggccagacactatagagggcccagctgtgattatcctccagccatggtcctcccccgagggccaggaatccaaggagccaagctcactcccttctagattgtgttccaagaatcttggcactaaaacagcacccctgcacctgcttcttgcacagaccttttgctgaagtctgaacaccagtgggtcaactgtgcctctagtatacactttccaagccaaagagttggccacgggggatttatgtatgggggtatgaataactagggtatccacacatgtgtgcaagagtccctggaagagagatgcagggtgttcaggggagggagaagaatggagaacaggccagaggctgttttttccccatgttgccacattccagagtgaaactctgataatgccaaatttgaagccagccttcctgctcattatgaaggtatatttgtaaatgtaggaggattaaatatgccatttacagctatattggcttgatttataacttttaaatatttagacacatggtatgtgggccttcatttgtattcttgccctgcgttccacaaatgttagggatagagcctggagacagagagcaaaaccagtagatcagtttgccctgtgagaagttccagctgtcaactgagagggtctgcagaagagcatagatgttgctctctaacctcatggacaacttagacctagaccaatcttggatgacatccatggcttcccagtaggttcactggtatcatctggactctagtgaatatgtaaagcagaaaaccaatgatgaaagaggcctaggatgcatccagtccatcagtggaagcaatgcttattaaaggttaactctgataggctaagcatttgctaagaatagacaataggattcccaagcactcaagagcctgaagctgtatagatagcttggatttatttggtaaagaaaaactgcttcccatacagctttctggaaaagcactgcttcctgggagccctgacgtgggactctgcctgagtttgaagcatagtcaaaaataataacaaaggacaactcaatagaaaaggaaaggcaaatacattttgaatatataaaaatattttcaacctcacaatgtgaagaaacaaatttaaagtatgcttttcacatgcacattatcaaagattgaatgatttgattatatgaagcattaggttagatgtaagacaataggcaatcctgtgcattttgggtggaagtataaaatgttacatcctctttgaagttatgttttggcagaatccatcaaaatgcaaaatattcaggcgagcagatcacttgaggccaagagctcaagaccagcctggccaacatggcaaaatcctacctctactaaaaatagaaaaattagctgggcatggtggcacacatctgtaatcccagctactcgggaggctgaggcaggagaattgcttgaatccaggagggcagaggttgcagcgagccgagattgcaccactgctactccagcctgggagacagagggagactgtctcaaaaaagaaagaaagaaagaaaaaagcaatacatttatactctgacacaaccacctcactgcaggaaatttatcagacagatacatagctctttgcatatgtacacaaagaaatttgcatattgcatattgtatgtagtagggaaagattgggaacaatttgaaagttcattgtggccgggcgctgtggctcacaccggtaatcccagcactttgggaggtcgaggtgggtggatcacaaggtcgggagttcgagaccagcctggccaatatgatgaaaccctgtctccactaaaaatacaaaaaaattagccgggcgtggtgtcacatgcctataatcccagctactctggaggctgaggcaggagaattgcttgaatccgggaggcggaggttgcagtgagccgagatcgtgccactgcactccagcctgagcctgggggacagagtgagactctgcctcaaaaaaaaaaaaaaaaaaaagaaaagaaagttcatcaatatgatactggttaggtaaattatgcctcatccatttagtggaatgctatgtgactgttaaaaaacaaataggatgatttatgaactgcttgaaatgctcttcaagatagattattgaataaaagattagggtgcatgaaaaacaactggcctgtactctttgacaaacatcatgaaagacaggtgaagtaaagaatgtatcaccgtgaaattgactaaagtctcatgacagtcaaatgcagtgggtgatactggattggagcttggtgtgaagaaaaaaacaattgccacaaaggatagtattgagacaactgaaaaaatttgtatttcaaactgtatattagataacagtattgtatcaatgccaaatttcctgaatctgatcattgtgtcatggttatgtaggagaatgtccttgttgttagacaatatactaacaagtacttagagataaagatgtctgtaactcactctggaatggttcagtaataatagtaataatcaaaatatatgtatgaatataaaaaatacaattgtggcaaaacgttaaaagttaatgaatctacataaaggcatatgagagttcattttactatttttgtaacttttctgaaggtttaaatgttttttaataaaaagttttttaaaaagaaaaagaggtgtagaagaacctctagtgtattactttttaggagaaattcatagactggaagggaacagaagaaactgatatcagtggttgcttctgggatatcagaaattggcctgagagagcaggtagaagggagatttactatattgtgtacctaactgtaatgttgggactaaaaatttttttttaaatcttatgtacgcatttcctattcaaaatgagagaggaagcagcaggagtgggtgggggagggaaccaagacattattttaaaagtaaccacagctactaaccagcaaacacaacttcactttcattgtgtgcatttagagtaacaattagttttcctaattcattttaggcattcctgtgtacactgatcaaaagtaatcagtatcgttttttaaaatgaaaagcagaactaaaaatgacactgctcagagacaagcactcttcagattttcctatggctccctgtagtctttttcccaaacacttttttttttgttaacatagttgagatcatacttaatatataatgttatgatctacctcctttttggcttaatatatcaaatatatatctatagatatctatatctatagatggatagatagatagatagatagatagatacgtagatacacagatagatacatagacagattttttttttaagacagggtctttctgtcacccaggctggagtgcagtagtgcaatctaggctcactgcagcctctgcctcctgggatcaagcgatcctcccacctcaccctcccaagtagctgagactacaggcctgcgccagcatgcccagctaatttttgtattttttgtagaagtggggtcttgccatgttgcccagactgatcctgggctcctgagcttaagcaatctgcccgcctcagccttccaaagtgcaggaattacaggcatgagccaccttgcctggccttcaaatattttctcaagtccttaacaatttgttttaaacagaaaccttaatagctgcataatgtactatcctatggatgtcttacaatttattgaaccattccctgttgttggacattcaggttgtttgcagttttctaagtaaatctgcagtgaacataataacttataattctccatctgcatttcagtttcttttcttcttttcttttcttttttctttttttttttttttaagacggaatcttgctctgtcacccaggctggagtgcaatggcgcgatctcagctcactgcaacctctgcctcccgggttcaagcaatcttcctgcctcagcctcccaagtaactgggactacaggcatgtgccaccatgccctgttcatttttgtatttttagtagagttggggtttcgccatgttagccagactgatcttgaactcctgacctcagttgatccccccacctcagcttcccaaagtgctgggattacaggtgtgagccactgtgccggcctgttttcttcagatagattcctagggccattcgcagtggttcacgcctgtaatcccaacactttgggaggctgaggcaggaggatcacgaggtcaggagttcaagaccattctggccaacatggtgaaaccccgtctctaccaagaatacaaaaaattagccaggtgtggtggtgtatgcctgttgtcccaggtattcaggaggctgaggcaggagaatcgcttgaacctgggaggcggcggctgcagtgagccgagatcgcgccaccgcactccagcctgggcgacagagtgagactccatctcaggttaaaaaaaataaaataaaaagatagattcctagtagggaaattactgggtcataggatattaacacatttaaagactcgtgggacatattgtcaaatacctttatcaaaagattgttccagctccttcttgcagtgtcaaggaccttctgagtctgcagtgatgggaatctcacatgttgtagactggactagaaggcagagagctgtgtggtggtctctgctgtgccacaaatcactacctggccctgagaaaagcagtttttacaaaacaccaataataatgatttttaaatatatgtaaacctgaaataatttttaaatcattttctttgttttcttttttttttttttgagatggagtctctctctgtcacccaggctggagtgcagtggcgccatctcagctcactgacacagccgcctcctgggttcaagtgattctcctgcctgagcctcccaagtaagtgggattacaggcacacgccactaaaaaatcagcacacccagctgatttttttgtatttttagtatagatgggtttcaccaagttggtcaggctggtgtcgaactcctgacctcaggttatctgcccactcggcctcccaaaatgctgggattacaggcatgactaacgcgcctggcctttaaatcattttcatatgtttgtttgtttgcttgcttatctgttttgaaccttgcaactagcccatgaaacaacagggaggtatcattcccatttgaaagatcagaaagactccgggcaacattgcaaaaccctgtctctacagaaaaattaaaaattagccaggcatggtggcacacacctgtagtcccagctactaaggaggctgaggtggagaggatctcttgagcccaggaagtcgagctgtggtcatgccactgcactccagcctgggtgacagagcaggatcctatctcaaaataataataatgataatgataaagctgggtgcagtggcttacacctggaatcccagcactttaggaaggcggggcgggcagatctcttgagctcatgagtttgagaccaacctgggcaacatggcaaaaccctgtctctataaaaaatacacaaaattagctgggtgtggtggcctgcacctgtaatcccagctactcgggaggctgaggcaggaaatggcttgagcctgggaggcagaggttacagtgagccgagatcgtgccactgcactccagcctgggtgaccgagtaagaccctgtctcaaagaagaaagaaaacaaagttcagaatggttaagtgatttttttccagaatcaccagctggtaattgacatgaaacacaccacttctggtgcatacttcagaataatttccatttaagtcacaccgcctcctttttaccatgtcatgcaatccctctagatcttggtggggattgtcttagtgcttctcagactttcccgtgcacacaaattatccaggtatcttgttataatacagagtctgatcagcaggccaggggtgggcccaagatgtgacatttctaacaaactcccaggtgatacaacactgccagtctgtgaacccaactttgaattgccaggtgggagacagtcacttaaattcctgtcagcaatactactctatatttcagtattttcacctaggacaaattattttagtgtgtagatgccatttatcatatagaacccaccaggttccagaatgcatagacaagtggatgacaatcagtaactcaccatagcctggattccataattttataccaaaaattcaaataatacagctttaaaaaaaacatatatatctaagaagttatttgaagctaaaaacacagattgcagaaccagccagtacagagtaggatatttagctggggaggcaagagctatatacagagaagtgacctaagaacaccagggtgcatgactaagtactggcaaaggagagcatcccaggcaggggccacagccttggaaaggcaaaggagagtaggaattagtcaaatattttagggtcagtagacagactaatttgggaagatagagatcttccctatcttcccagggagataagatgggaagtgcaactccaggctggattttcatagcttgtggatgcttggctgaatttagacctttatctgatagcatacaggaacatgccactgaaagcttttttttttttttttttttttgacagagtcttgctctgtcacccaggctggagtgcgttggcatgatctctgctcactgcaacctccgcctcctgggttcaagcgattttcctgcctcagcctaccaaatagctgggattacaggcgtgtgccactacacctggctaatttttgtatttttagcagagacggggtttcaccattttggccaggctggtctcgaactcctgacctcaagggatccacccacctcggcctcccaaagtgctgggattacagacgtgagccaccacatccagccctgctgaaagcttttgagcaaaggaatgacatgatgaatggagttaggcagatgaattttcggagggaaataactggagtgctaaaaggccattgctgtattagccgtgagagaattgcagtagaaatgaaaatggacaggtacaggtacaagagatattgtgagggaaaaaagtaataagttgactgtactggctaattatatgtggtggatgatagaagagtttagggtgagtctctgaggtttcaaggctggataacaggaaagtggtggtaccattagcaaaaatgggaacataggaaacatgctgatttagaaaacgatttcctcctgataagcaaccacaacaatagccccaaccaactttatatcctggcatggcccaggatactatgatcacaatggcagaagaaagacaatttgagacaaaattgccttaattttctgatcactagttaatattctgccttctgtctataaaaacatctgtcaggcttatgactggttttccaagagtgatgggtatacacagatttctgcctactttccacccatcctaacaactgtcgctggtcacacagctgactagaagtgcagagagaaatgtgcatgctgggatcagggccaaactaacctgcctgtatggggttcagaccagagactggcatcgtgaattctggctttctgtgcactctcagtacatgcacctttagaaaagcattgatctaattctgatttcattctgacttagcatgatccactagaaacctccttgtaggaatctgaagttctgagttcaactcacaaatacactggcttcattgccttatagtggcctcgtcctcagaatagcatagttatttgcagccaagggcagacctttatacactattggcagcctcttctcggcggagctcgtgggagcctgaaaggaagaagtccagacatgcaggcaattttctcctctgttcatcaatccactccattgtctttttcagtggtttgacctcatgccacagttgtaaggtattttggaaagccctgagatatattcatagctgtggctgtacaaacaaaagatttttaattaaaataaaagcaataatagaaacattttcaaaaagagggttggttttttaaaaagccaaatgtctttgtcaaattctaactgggatagttccatgtgtagattgttttcttttcctgtgacttcttatcacagataattaataagaatttgtggaacacccactctgttcagagcacaataatagtactgccactgtttagggtttaaagcaagttgccaattcaataaacccagtaaagggtttcttttttttacccctttgtaacaaccatcttttatctgagagattgaatatatttcaatggtagaatcatgtggcatcatatatcatgatttatcataaatttgcagttgacctatcaagtgagattgaactatgatatgaagccaccatagaaaaagtttttctctatttcttccctcttcagtcttctaatggaagtatagtttgagtggtgagagaaatgttccaagaacaggcagatgcaacatcagcatctgccacaatagaaatgagtaatgaagtctcaggataattttctgtttttgttttggcaataaaaacccgacttgtgtttttattactcttctcaatcacttcttaagccagtaaacctgatataggcaaatcaattagttcagaaatgtcttcaataatgggatactcttagagaatgggcaagtgacttcgggaggcccaagtgggaggatcacttgagctcaggagttcaagatcagcctgagcaacatagtgggaccccatctctttaaaaaaaaaaaaaaatgagagagaaaataggcaagtgattcaagcaactcattatttcaaccacagtcacacagcaggaagatattcaaaaccaaataaatgccccagaacttgcataagaacaaacacacagaaagaaaagataagactctgtggaaaccagttggatttcatctgttacttcagccgttgggcaagatctgtttgacatgtacttctgtaaaagtttcttatctatggaaccagctaagttctttgaaatatcacttcatcttgatattcctaatgatgatgaaagatttgtttgctgagctgtgtccaaacacaagctgaagtggagattctaggtacatatcaagatgatttggaccaaaaggagctcttttgataatttggagcccatttcactatgtttcactttcgttgaggtttccatagtggaatggttatcatgtttactgcacacttatgtttcactttcagtaactgggattaaatggacagacactaaacaatttgtgttgtgtctgggcatggtggctcacgcctgtaaccccagcactttgggaggttgaggccagcctgggcaacatagtgagaccctatctctacaaaaattacaaaaattagccggacatggtggcatgtgcctgtagtcccatctactcaggaagctgaggtggaccaatcacttgagcccagcaggtaaaggctgcagagagctgtgagacgtgaccacgccgctgccctccagtctgggtgacagagtgagaccccattaaaaaaaatttacgttgcttcaagctttgcttttgggatagttttgggatgttttgggatagtttcccaaatctttcaaaatattggattcattaagttttttgttgttcaggagggtttttttgtttgtagaaatgttaccattttctataactatggtataatatcacaatcagcctgttgatacaatcagcaatttcatccagatttcccagttttacttgtactgggcgggggggggggggtggggtgggggggcggtggtgtatttacacaatattatcacttgtgtagttttgtctatccaccctacagtcaaaatgcagaacggtttcatcaccacaaggattccttgtgttgcctttctggaacaatacacacacccctcccaccccacaaactgtatttttttttttttttttgaaacggagtctcgctctgttacccaggctggagtgcagtggcgtgatcttggctcactgcaacttctgcctcccgggttcaagcaattctgttgtctcagcctcccgagtagctgggactacaggttcgcaccaccatgccaggctaattctttgtattttttaagtagaaatgggttttcagcatgttggccaggctggtctcaaactcctgacctcaagcaatccaccagacttggcctcccaaaatgctgggattacaggcgtgagccactgtgcccagcccctgtattgtattttgacctatcagttagttctccatgtaggctggaaagtcagatgatagcaatgaaaagcatgggctctgaagcatcactgcctgggtttggatccaggatctaccaccatgctaggtaatttatataacttatctaatttaatgctcacaaaagccctgtgaaatagatattcttatccctattttcttttctttcttttttttttttttttaagacagagtcttgctctgttacccaagctggagtgaagtggcatgatctccgctcactgcaacctccacctctaagattcaagcgattctcctgcctcagcatcctgagtagctgggattacaggtctgcaccaccacacccgtctgatttttgtatttgtagtagagacaaggttacatcatgttggccaggctggtttcaaattcctggcctcaaggatccacctgcctcggcctcccaaagtgctgggattacaggcgtgagccaccgcacctggcctatccctatattcatatgaggaaactgacccttagagaaatgaaatacaatgcaatatttgctcagagtaacacaaaaacagacattccaactaagatacaaaaccaggattgtctgaccccaaagcccatgcttttccccaacagcaaacattaactttataagaataaataaatgcacctttgtgcatttatttattttggtgcatttatctattatttcataaaggtgcaccaaagatgcaactttgtacatgaaaattatttttctagagtagagttgtaaattatatctgttggatagaaaagggaattccaggccaggcacagtggctcatgcctgtagtcccagcactttaggaggtggaggtgggtggatcatttgatcccaggagttcaagaccagcctgggtaacatggtgaaatcctgtctctatttaaaaaaaaaaaacaaaaaaacaaaaaaaaaactagccaggcctagtactgtgcgcctgtagtcccagctactcggtaggccaaggtgggaggatcacttgagcccgggagattgaggctacagtgatccactgtgatcttgccactgcactctgtcctgtaacagagtgagaccctgtatttaaaaaaataaaagaaaagagaattccagagtgtatagttttattaccctacaggacattaaacaagttttttaaaaaaaataatagacctttcctttttacaagtttttgatttgctgataaattaggcagattgtacagacagttcccatatatcctctcttcctccactcttacccccacagtttctcctattactgtattaacatcttgcattagtgtggtacatttgttataattgatgaaccagtaccgacaaattatcattaactaaattccacagtttacattagggttcattatttgtgttgtacagttttacaggtcttaacaaacacaaaatgtcatgcatccaccattacaatgctatacagaatatttcactatcctaaaaatctaatgtgcttcacctattcatccctcccctgaactcctggcaatccctgacctttttattgtcactacagttttgcctttttcaggatgtcatatagttaaattaataatatgtagccttcgtggattggcttcttttacttagcaatatgcattcaagattccttcatgtctctctgtggcttgatagctcatttctttttaatgctatataatacttcattaaatggccaatatcacagtttgttcacctattcaactattgagggatgtttttgttgctgccagcttttggcacctataaataaagccgctataaactttggcatgcaggtttttgtgtgaacataagttctgaactcatttgggtaaatacctaggagtatgactgctggattatatggtaggagtatgtttatctctataagaaaccatcggctgggtgcagtggctcacgcctataatcccagcactttgggaggctgaggcaggtggatcacctgaggtcaggagttcgagatcagcctggccaacatggtgaaaccccatctctactaaaaatacacaaattagctaggcgtggtggcgcacacctgtggccccagctactcaggaggctgaggcaggagaatcccttgaactcaggaggtggaggttgcactgaactgatatcgcaccactacattacatcctgggtgacagagcaagactccatctcaaaaaaaaaaaaagaaagaaagaaactgccaaactatcttctaaaatgactgtaccattttgcatatctaccaagttttttaaaaatctaatttaggtgcagtggctcctaaattaggtggctcctaaagtgactgtaccattgtgcatatctatcaagttttttaaaaatctaatttaggcacaggtgaggtggctcacgcccgtaatcctagcactttgggatgccaaggtgggcgaattgcctgagctcaggagttcaagaccagcctgggcaacatggtgaaaccccatctctactaaaatacaaaaaattagccagatgtggtggcaggtacctgtagtcccagctactcgggaagctgaggcaggataattgcttgagcctgggaagcggaggttgcagtgagctaaggttacgccactgcactccagcgtgggtgacagagcgaaaaaaaaaaatctaatgtagtaatcttatttctagattatttctttcataaattgcagatattcagtctcttgaattctcctgtgaaccagtttcaccatcttgatggctccccaattaacaaggtaagtaaatatttgacatgtgcttacttaaatatttgtgttaagggccatgctttttactttctacaaattatactttgaaaatgataacctaccatatttcccacatgaaagacataacctaacacacactacaggaagaaaatcttttgtcatttttctagccatggtaatgaacttcacagtcacactgagatttcctaagggtagactcacatgtaaactggctcaataacccttttcaaagctattattttaccagtgcaaaagagtacctgtaggggtgggttgcccctccacacctgtgggtgtttctcgtaaggtgggacgagagatttggaaaagagaaagacacagagacaaagtatagagaaagaaataaggggacccggggaaccagcgttcagcatatggaggatcccgccagcctctgagttcccttagtatttattcatcatttgtgggtgtttctcaaagagggggatgtgtcagggtcacaagacaattgtggggagagggtcagcagacaaacacgtgaacaaaggtctttgcatcatagacaatgtaaaggattaagtgctgtgcttttagatatgcatacacataaacatctcaatgctttacaaagcagtattgctgcccgcaggtcccacctccagccctaaggcggtttttccctatctcagtagatggagcatacaatcgggttttataccgagacattccattgcccagggacaggcaggagacagatgccttcctcttgtctcaactgcaagaggcattccttcctcttttactaatcctcctcagcacagaccctttacgggtgttgggctgggggacggtcaggtctttcccttcccacgaggccatatttcagactatcacatggggagaaaccttggacaatacctggctttcctaggcagaggtccctgcggtcttccgcagtttttgtgtccctgggtacttgagattagggagtggtgatgactcttaaggagcatgctgccttcaagcatctgtttaacaaagcacatcttgcactgcccttaatccattcaactctgagttgacacagcacatgtttcagagagcacggggttgggggtaaggtcacagaatctcaaggcagaagaatttttcttagtacagaacaaaatggagtctcctatgtctacttctttccacacagacacggtaacaatctgatctctcttgcttttccccacaagtacccgttgaacattccagggaactgatccataaatttatttccaaaatgttttaacttgggaaccaattactggataaatgctaagttaccctggtataaatctgataaaagtgaatttttcaagccacacggtctcctttgttcagtatatttttaatttagtggtctctcttaagggaggaattgaaatcaaccctctgcaactgggtcttaggcttatctccaagaaataaaatctcacaaggttttgaggcctacagtctgaattctgacactgcacagaacttatacagacagggtagagacaggagacttacaggtctggtagtgagggaggctagggtgcgtggtttgaatgtcaagggcgttcttgggcttgctgcaaacctcattctgattcttccattttttaactgttgaactgaagtctatttctctgcagggttaagttattccagaccaaggagagaatgattcgctcttgccaccctcctcagatgtggagccaccgggcagatggttggcactgtgcacatggcacttgcatacacacacacacacatgcacacacgcacacacactcacacacacctcaactaatgtaaaggtcccaacataaacattagttctcacaagtgctccaaggattttaaaggctttggtgctgcaaaagatattgagtcagcttgtgacagctacaatcctgctcctgtttcaggtttaagaaaaaaagaaagaaagaaaaaaggaaaccatactcatttcttccttccacagctcagtgaaattccaaaaaattagtaagaatcccttagcttgcctcattggtagaaatgtctggttgggacattcctttggccactttcgctgaaaactgcatacctctgggactaaagcatccccactccagtctcctgtctcaaaactgactgagaattgtctacaaagataggaggactctgtgcaaaaaccccccggagaaaacaacacaaaaccacacctgaccctgcatagagcttgtatttccagagagaaaacacagtctctgagatagtattaggttggtgcaaaagtaattgcgttttttataattacttttaatggcaagttaatattttttagcatccctcagggcctctttttattttccctgctgagcaggtaaccacctaaggagtgtttgtccctgtttccatcatagtcaaggaaatgtgggacattcttttgcctgtgaaatgggaaagttgtcactgcgatacagtgttaagtttctccgagagcccatctttgcaagtgaagaggccttccttataggaaatagaaatgctgaccaggccttttctatctaggacacttgtgctcctggtcattttactacagcagtttgtgtttaatttgttgttttatttggcaataagcaagcaaggaaaacaagggtattaataatgataatcgtcatttgaacttcctgggtacaacatgtacttgtacccaagtgctgaatacaatttttaaaaaggattatttgtatgtgtgcacaaatgagactaaaaattgccatgaacttaaatcattcattctcctttgtcccagaaaaacacatttttgtctccgtggcatttgaatcaacttttctttcctttcctaattttagcatttgaaaagattttatgtcatgaaacgactttatttatgtattctgcaacccttgccacaaagccttagggtgtaccaattaaaaacatgagttttacccagcaaagaactgaagcaatttgatgatttttcatcgatgaaacagtttccattagcaagctccttgcaaaatgatagttctatttggcgactcaaatgccataaatctggttgtctttctggttttgcggcgaatcccgcctgcctgccgtggtctctgttgttgatttaggattttggcttggcgaccctttgttcttccctctcatccctcctttgttagaaaggtggaaaatcagcaagggctgtaagcgctgagaaaacagggagtctcctagcaggagtctcttgagtgtagttaccatttatggattatgatctaataattcaaattccagggcaacagaagaccattgcagaagttttcttggcatattaaaatctgcccgcaagagagtttaccagaaaaggaatctctgaggtgaggacctgacgtccacatctttgcgttggatggccaaaatttctgagaaacactaagctgtgaggtcttctgagaaataagctgatgtcacagggttggacggacctgttgccacaagatgctaatgctctggaaacctgccaaatgtattgcctgtttaaaatgtactccatagaactaccatttgatccagcaatcccactactgggtatctacccagaggaaaagaagtcattatacgaaaaagatacttgcagctgggagtggtggctcacacctgtaatcccagaactttgggaggctgaggtgggcagatcacctgaggtcaggagtttgagaccagcctagccaatatggtgaaaccctgtctctactaaaaatacaaaaattagctgggtgtggtggcgggcatctgtaatcccagctactcaggaggctgaggcaggagaattgcttgaacccaggaagcagaagttgcagcgagccgagattgcaccattgcactccagctctgggcaacagaacaagactccatctcagaaaaaaataaaaaaagaaaaagaaaaagatatttgcacacacatatttatagcagcacaatttgcaattgcaaaattgtggaatcaacccaaatgcccatcaatcaatgagtggataaagaaactgtgagatatgtgtgtatttttatatatatatcatatatatgttatatatatgatatatatattatatatatatcatatatataacatatatatgatatatattatatatatctatatatataatggaatactactcagccataaaaaagaattaattaagggcatttgcagtgacctggatgagactggagactattattctaagagaagtaactcaggaatggaaaaccaaatatcgtatgctctcattgatatgtaagagctaagctatgaggatgcaaaggcataagaatgatacaatggactttggggacttagggggaagggtgggaaaggggcgagggataaaagactacaaactgggtgcggtgtatactgctcaggtgatgagtgcaccaaaatctcacaaatcaccactaaggaacttatgtaaccaaacagcatctgtaccccattaacctatggaaaaattaaagtaaaaaatacataaataaaatggactccagagagaagttggttaaggggtataaaaatacaagtggatagaaggaataagttctaggccgggcacagtggctcatgcctgtaatccgaggactttgggaggccgaggcgagcgaatcacaaggtcagaagttcgagaccagcctggccagcatggtgaaaccccatctctactaaaaacacaaaaaattagctaggcgtagtggtgggcgcctgtaattccagttactcgggaggctgaggcaggagaatcacttgagcccaggaagcagaggttgcagtgagccaagattgtgccactgcactccagcctgggtgacagagcagggcttcatctcaaaaaaaaaagtattgttttataatgtgttataaattgacttgcttactataaacaatttacatacagaagtgaataaaggagaaactagcatttcaaataatcccaatcctacagctaactattgtgaaaaacttgatatatatgtgtacatatatgacatatagtatctaatatatatctattacattttatctattatttattatatatactgatttggctttttttttttaaccaaatggcttacactctacattctactctgtaatttgccttttttcccacataacaaaacggccagacatctttcaaagtccagatacgtatatctactctatttggttttgggtttttgttttgttttgttttgttttttgagacaacagggtctccctctgtcacccaggctggggtgcagtggcgcaatcttggctcactacaacctctgcctcctgagttcaagcaattcttccatcccagcctccaaagtagctgtgactgcaggtgtgtgccaccatgcctgaattttttggtagagatggaatctcaccatgttggccaggctggtctcgacctcctaacctcaagtgattcacccgcctcggcctcccaaagtgctgggattacaggcgtgagccaccatgcctgacctatctactccatttgtaaaatgactacatagtattccattgcatgggtataccatacttttccatctaattcctactggtgaagatttgtggtttctaattttttgcccttataaataatgcaatgggcatccttgcatatgtatctttgcacacctgtttgggaagtagaactgttggatcaaaggatattgtgtatacatgtttaaatataatcatactagtgcctgtaatcccagcacttttgggaggccaaggtgggagaatcacttgaggctaataatttgagatcagccaggcaacatcatagaaagacgctgtctctacagaaagttagtcgagcatggtggagcatgcctgtggtcccagctactcgagagactgaggcaggaggatcatttgagcccaggggttcaaggttacagtgagctgggatcgtgccactgtactccagcctgtgtgacagagcaaaaccctgtctcttaaaaatgaaaaataagccaggtgcggtggctgaagcctgtaatcccagcactttgggagaccgaggtgggaggatcacgaggtcaggagatcgaggccatcctggctaacacggtgaaaccccgtctttattaaaaatacagaaaacatcagccgggcgtggtggcaggcacctgtagtctcagctactcaggaagctgaggcaggagaatggtgtgaaccagagaggcagaggttgcagtgagccgagatcacgccactgcactccagcctgggcaacagagccagattcagtctcaaaaaataaaaaaataaaagattataagtatatcatatgcaattgtgccctccacttcagctaaatatatcatttcgtgatattacatgaactttgtaagtatcattttaatggctgcataatatcccattcagtgaattaatgcttctaagtcacatgaatatgactaatcaagtcattagaactttttttttttgagacggagtctcgctctgtcacccaggctgaagtgcagtgacacaatctcagctcactgcaacctctgcctcccaggttcaagcggttctcctgcctgcctcctgagtagctgggactacaggcgcctgccaccaagcctggctaattttttgtatttttagtagaggcgggatttcaccatgttaggcaggatggtctcgatctcctgacattgtgatccgcccgcctcagcctcccaaagtgctgggattacaggcgtgagccaccacacccagccaagtcattagaactttactaatcctgcaaacagtatacatgagacgcttatccctcactgtttttaactggtaaaactagtggctgtgttaaagccacaaaacactagtggccttaaacacatcctgagtgggactcaatgtggctaaaaaatgtgtcttgctggagacaaatatctaagtgattttaaatattgcaaaatatttgtaaagatagaataaagatcaaaaaggtaaaagtagatgaaagggtcacattccataattttaccaagaaaataaaccaatatttcaaagatgaaaaattatttcttgatagcaaattcaaatcacttaagctgtatatttcagtggaaaatattttttaaaaaacagccatgtcagaccaacaggaggtttctgactaaaatagttcattagcagatcaggaaaccacagtgttttctgatcacaatgtttgctgatctagtttctcatccctttgtttatgcatacattgttcctggagacatgtctgatgacagctgtaagaccatcatcataaaaaaaaaacctgtagttaaaatgcagactaatgagcctgtttcaacatgtctccaagctgcattaaatcacagcttgatcaagaatccacttctgggctaggcgtggtggctcatcctataatcctagcactttgggaggcccaggggggcggatcagttgaagtcagaagttcaagaccagcctggccaatatggagaaaccccgtctcaactaaaaaatacaaaaattaggccaggcacagtggcccacacctgtaatcccagcactttgagagaccgaggtgggcggatcacttgaggtcaggagttccagaccagcctggccaacacggtgaaaccccgtctctactaaaaatacaaaaaattggctgggaatggtggctaatgcttgtaatcccagctactcagaaggctgaggcaggataatcacttgaacccaggaggtggaggttgcagtgagctgagatcgtgccattgcactccagcctgggcaacaagagcgaaattccatctcaaaaacaaacaaacgaaaaaaacaaaaaaacagctgggtgtggtggcatgcacctgtaatcccagctactcaggaggctgaggcttgagaatcactgaagcctgagagacggaggttgcagtgagttgaaatcgcgccactgcacctcagcctgggcagagcgagactatgtcgaaaagaaaagaaaaaaagaagaatctgcttctatctaggtgcaatggctcagcctgtaatcctagcactttagaaggctgagatgggaggatcacttgagtccaggagttcaaaacaagcctgggtaacatagcaaaaccctgtcctactaaaaataatttttaaaaaatgagcctggcctggtggcacatgcctgtagtcccagctatttgggaggctgaggcaggaggattgcttaagcccaggaggttgaggctgcagtgagccatgattgtgccattgcactccagcctggatgacagagtgagaccctgtctcaaaaacaacaacaaaaacaacaacaacaaaatctccttcctagaaacatcaaacatattagaccctacaatttggaaggttgttttttgcttgtttgtttttttttgttgttgtttttggttttgtttttgagacggagtttcgctttgttgcccaggctggagtgcaatgcttgagtcactgcaacctccgcctttccggttcaagtgattctcctgcctcagcctcccaagtagctgggattacaggcatgtgccaccatgcccagctaattttgtatttgtaatagagatggggtttcaccatgttggtcaggctggtcttgaactcctgacctcaggtgatgcgcccacctcggcctctcaaagtgctgggattacaggcgtgagccaccatgcccagcccatggaagtttttattaatttgctctacgtaaggcattgcccagaatatgggattgtaaaaaatgaaaaagtggaaccctttattcaaataaagttgtatatagaaacctaatatgtaaaacactaaagaaaaatctgctttgcttcaagccagatcagggctcagagccccattacttcagccctatcttttcctctgtacagatgctccttgatttatgatgagtttatgttccaataaatcataaattgaaaatatcatatgtcaaaaatgtatttaatacatctaacccactgaacatcatagcttagcctgggctgccttaaatgtgctcagaacacttacattaacctgtaggcaaacccatctaacacaaagcctactttttaataaagtgttaaatatttcatgtaatttattgaatactgagctcaaaaaacagaatggttgtacatgggcactcaccattaacgtacacagccgaaagcatacggagcctgaagaatgtttaaagcattgaactaacatgaattgctgcgtgatgaagatgctgcagtggcagggtcatcaatttatctctcttctgataaggctggaaaataggcacttgggtatccacacagtacactgtagagtttgggttgtttatcctcctggtcgcatggctgactgggagctacatcttgctgcagctgcccatagtctttttttgttgtttttattttatttttatttatttatttattttgagacggagttttgctcttgttgaccaggctggagtgcaatggcacattctcagccacagtaacctccgcctgcccggttcaagtgattatctcgcctcagcctactgagtagctgggattacaggcgcccgccaccacgcccacctaatttttgtatttttagtagatacatggtttcaccatgtgggccagtctggtctcaaactcctgacctctggtgatccgccagtctcggactcccaaagtgctgggattacaggtgtgagccaccatgactggctgtttttgtttttaaatgagacagatcacccaggctgttacccaggctgcagtgcagtggcgcgatcacagctcactgcagccttgacctcccgggttcaagcgatcctcccaccttagccccccaagtggctgtgactacaggcacatgccaccacaccaagctaatttttgtatttttagtaaaggtggggttttgccatgtttcccaggctggtcttgaactcctggactcaagccatccacctgccttggccttcgaaagtgctaggattaccaggaatgagccaccacacccggccacagtaagtgttttttttaattttaatttttttttttatagagatggggttatgttgcccaagctggacttgaactcctggcctcaagtaatcctcccacttcagcctcccaaagtgctggcattacaggtgtgagctactgcacctaggtgagagtcttttttaatgccaagcttaactaaatttaaaccagaacaattgtacagtatattcacaaatatcattagacattatgcagttagtaaaaatgatattgaaattaatccatcaggtggattttagcaataatgtaaatataaagttccatctattttcatatattaaatattgtgtgtttatgtggagaccacccttattctacaatccagtcagggatagtaggtttcattctggtaggatgaaagaagacttgggagattcagaaatttggaaatagagtagctccatgtttaagaattgccttaaaaaatgagtccaaagactacctacaaaagaatcaccttgagatgttaaaaatataggtttctctacttcctctccaaagactcccattcagtgtctggagagaagcctgggaatcagtgctttttcaaatggtctccaggtgattccagtgtgcactcaggcaagaaggtggcaataaggagtttcagcaagagataatagggaattttggtaggctcctatgaaaagctcagctgcaagaaagccagaaaacaggtcagcatgtggcatccgagaagtgtcataccagtgctataccagtcctgggttacttgttgttagatttattctccagttctttccctgtccagctcagtgtatcaggggtgtcctgactcctgcaggctgtttcctaggtccctttatagactgacttccagctgggattggctagtgagaggtactgatctgagtttggaaagcagaagggagaagccagggtatttctcccttttctctatcttattctctatcttagacaccttctttggctgcaattgtgtcttcttcatggttccagctttcatcagataggcccactatggttcttggtcccactagctgaccacagctcctgggctctaattacatctttttccatccctccagcctagatgtggaaatgccttcctattggtgccaatatctgggatactttaacatcccctattggcttctcagctactctatcacccatgtcaccaattcccctcattaaattttctctattctaaatactcagaacagtgtctgttttcctccttgcatgttggctgatgcaggccccagccacagggttagctagggttcagaaccaggtctccagtcagtcctgggataggtggaactggcaggagcaaggcagggagggtgccagtcatggggtggggtccttgggtgtataattcaggactctccagctgtgtgatgaagcttggtgcctcaccataggctatatctgtggttttcaaaaaaggtcacaggcatataacgtcttctggaagccttactactggagtgtgtagcacatagtagctgcctaataaatatttatttattagatgcttgtagctggcaagggaaaccatttgatcagatttagggaaagaatttgaaagagattcttttcacatattctgcaaatgcttctggcatgaaaaagacataaaagattatttttctaaagctatttatttttatttttcagctcccagaaatgtttttttgagctgaacaatatcttcttggaatcaagtgacagttttttaaaactagaaaatgaggcctatgaactaaggatttattgttatctacctggcaatgaatattagtccatagcttatttttgcaacaaatatatgttaaatgagataagtaatatcagataatggttacattcgatttctaccacagttttgcagtaaaatgttatcatttctagggaagtaaaagcttagttgaccgtgagaacaattaaggctcaggaaacagcaaaatgcattgatattaacaagttaattttgttttaattttatttatttatctattttttttttgagacaggatctttttttttttttttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggccgagacaggatcttgctctgtcacccgtgctggagttcagcggcacaatcacgagtcactgcatcctctacctcctgggctcaggcaatcctcccacctcagcctccggcgtagctgggcctacaggtgcataccaccatgtccagctaatttttgtattttttgtagagactgggttttgccatgttgcccagggtggtcttgaactcctaggctcaagtgatcctcccaccttggcctcccaaagtgttgtggttacaggcataagcccctgggtctggctaccatcgccattttaatgcccatgtttacccaatgtttagttcccacttaaaagtgagaacatgtggtatttggttttctgttcctgcgttaattcacttagaataatggctttcagcttcatccacgttcctgcaaaggacatgatttccttctttttatggttgcatagtattccatggtgtatatgtgccacattttctttatccaatccactgttgaaggcaactaggttgactccatgtctttgctatcatgaatagtgctgtgatgagcatatgagagtatacatcttttttgtttgtttttggtttttgttttttttgattttttttttttcagatggagtttcactctttttgcccaggctggagtgcaatggtgcaatcttggttcactgcaacctccacctcccaagttcaagtgattctcctacctcagcctcccgagtagctgggattacaggcacctgccaccatgtccagctaattttgtatttttagtagagacggggtttcaccatattggccaggctggtctcgaactcctgacctcaggtgatccattcacctcagcctcccaaagtgccgggattacagttgtgagccaatgtgcctggccgagtgtatatgtctttctggtagaacaatttgttttcttttggatacatacccagtaacgagattgctggatctaatggtagttccattttaagttctttaagaaatctccaaactgctttccacggtggctaaactaatttacacttccatcaacagtatgtaagtgttcccttttctctacagcctcaccagcatctgtggttttctgactttctaataatggccattctgactggtgtgagatggtatctcactgtggttttgatttgcatttctctaataattactgatgttgagcattcttttcatatgttcattggccacttgtatgtcttcttttgagaaatgtcttttgaccactttttaatgggattgttttttctttccacttctataaattttataattagaaaacttagaaaggccagaaaaatgaaaatttaatatacattaactagagaaaatcagtagcatacgtgtgtgctagcaacaactcattggaaaatagaagtttttttttaatatatagttccaaaccctatatataaataggatataaataggatttggaacttctccgagtactcttttttttttttttttttttctgagacagagtctagctctgttgccaggctgcagtgcagtggcgcgatctcggctcactgcaacctccacctcccgggttcaagcgggcctcagaaataataccacaaagtatatatacttttgaggcctctgttctgttccattggtgtatatatctgttttggtaccagtaccatgctgttttggttactgtagccttgtagtatagtttgaagtcaggtagggtgatgcctccagctttgtttttttttttttttttttgcttaggattgtcttggtcgagctctttcttggttctatataaatttaaagtagttttttctaattctgtaaggaaagtcaatgttagcttgatagggatagcattgaatctataaattactttgggcagtatggccattttcaccatattgattcttcctattcatgagcatggaatgttttttcttttgtttgtgtcctctcttatttccttgagcaatggtttgtagttctccttgaagaggtccttcacatcccttgtaagttgtattcctaggcattttattctaaaaaagaaaaatcctctaagaaaaagacaaacaactaaatagaaaaatgcacagaacagttgaacagatatggcataaaagaggttatccaagtggctaatacagtaaaagatgctcagcttcattagttattagggaaatgcaaaccagagccataattaaatacctctaaatatccaccagaatgtctatagagaaaaagtactggtgacgatgtggagtaactgcaatcctcatacattgctggtaggagtggtacaaacaaaattgtttggtaatatccagtaaaggtgaacatatccacactttatgacccagaaataccacttccaaatgtaatccaatagaaatgtgttcatacgttcaccaaaagacatggacaacaatgtgtatagcagcacaatgcataattgcctcaaacttggagactatccaagtgtccataaaaaacagaatggggctgggcacagtggctcacacctgtaatcctagcaccttcggaggccacggtgggaggattgcttgagcccaggagtttgagaccagcctgggaaacatggagaaatctcatctgtacaaaaaatacaaaaattagctaattgcagtaatgtgcacctgtagtcacggctgcttgggaggctgaggtggaaggatcgtgaggcagaggttgtagtgagctgacattgtcccactgtactgcagcctgggtgacagagcaagaccctgtctcaaaaaacaaatcaaaccaaaaaaaaaaaaaaaaaaacaaaaatagatgaataaattgtggtattttcataagatatagaaaactctacaacaatgagaataaataatttacagctacttgcaataaatcaatggatctcacaaaagtgatgttgagtgaaagaagtatgtactgtataattccattgatatttagacatttcagctgagcctagtggctcacactttaaacctagcaatttgggaggctgagacaggaggatcacttgagcccaggagttcgaggttatggtgagctatgattgcgccactgcactccagcctgggtgacagagcaagaccctgtctcttaaagaaaaaaaaaattaaagacaatccatcgatattgagtacatagtgtataattccattagtaatttgagatgtatataaaattgatttatatgttgtgctttacagtgttctaatgggctttctaaacaactgtatgtttaaatttagatggcttatatgtctataacaccagcagctaagtaagcatcaaatttgtcattgtatttccctccttaaacaaacctgcggtaagcagaataatggtcccccaaagacatctatgtcctaattactagaacctgtgaatatgttactctgtagggaaagggacttttcagatgtgattaaattaagggccttgagaaggggaaattatgctgggatatcggggtgagtcctatccaaaatcatatgcatccttaaaattggagaacctctcctaatgtggtaggagggagatgtgactatggaagaatagttagagaaatgccacattgctggctttgaagatggaagagagaataatgagccatggaatgagggcagcctttgaagttagagaaggcaaagaaacagattctcccctagatcctcctaaaaggaacgcaatcctgccaacgccttgatttaagcccagtggaaaacatatgggatgtctgatttacagaactgtaagataatgaatttgtatttttttgggcagtggggagggcagggtctcactctgtcacccaggctgaagtacagtggcaagatcatggcagcctcaaccttctgtgcttaggcaatcctcctgcctcagtatcccaagtagctggaaccacaggtacgtgccacaatgcttggctaatttttttaattattatttgtacagatggggtctccctatgttgcccaggctggtcttgaactcctaggctcaagtgatcctcccaccttggcctcctagagtgttgggatttcaggtgtcagctagcacacccagacaatttgtattgtttttgaaataccaagttggtggtaattcgttgtagcagcaatagaacactgatataactttcttctcctgatttttagttggaaaggcaacattttaaaaaaatctcatgctttcatctctcatgagttcccactgtcagtagcagcagcaatgatcctataatgcaggaagtttggcaagattgagagttatgaactgtatagaataaatcagatacgcaaggagaaaaggacacaaagggcttgtcttcagttcaaccccagttcaactgtcactgggggttctgttatgaaaacaagcgctgtttctgcaaggtgcagacagggcaatactcctatataaatctgctcttgatttaacaacaaaaataccttcataaataaggaaatcgttccagtaagtatttggcatgccaatgatactaaaaatccattaatgcatctgagaagtgattatacctccctgaattggggccaacaagatgattctttgaggtctccaacaagagaataatataaccaagcagagaacttggctgtttaattagcaagcctgaaaaataatgacttgtgagtgtgccaaccaatgctgacctactctctccacccacattctctgatagagactttgatgtttttcctccaagagttttttaaagtgttatgaaaacacagcttcaatacaagtttcctaacctacacctacaccctatacaggaattctggaaccatcacttgaactatcatttcacacagagcattgacgcgtcattaattgtgaatacttgccaattttcattgtaaattgtttggcattattttgtaaaggagaacatatgcatatccatattcctatggctgctgtaacaaaacaccatggatttgaaacaagagatatttattctctcacagttctggagtccagaaatcctaagtcagtttcactgggctgaaattaatgtgctggcagggcactttgttttctgctcttctgtttggagtcaaatctccctctgcctcccacttataaggacacttgtgattgtaattagggaccacccagataatccaggataatcttcctatcccaggacccttcacttgatcacatcttcaaagactcttttcccatataacagtcataggtttgagaattggaatgtggacaaggctaatatgcatgtgcttctttttttttttttcgagtcggagtctcgcttcgtcgccaggctggagtgcagtggcgcaatcttggctcactgcaacctctgccttccgggttcaagcaattctcctgcctcagcctcccgaggagctgggattacaggcatctgccaccacacttggctaatttttttttgtatttttagtagagatgtgtttcaccatattggccaggctggtctcgaactcctgacctcaggtgatccacctgcctgggcctcccaaagtggtgggattacaggaatgagccaccacacctggccataccttcaaacttctaaataaagaccaaaatacttctaatattaaacaatgaaataaatgtgagctatgcatacatttaagaaagattcataaaaatgagattaatgatttacccaatttttgttgtttttcagacggggtctcactctgtccctcaggctggagtgcagtggtgcaagcatagctcactgcagccttgacctctctgggctcaggtgatcctctcacctcagactccccagtagctgggactacaggtgcacaccaccacacccagctaattttttgtatttttttgtagagacaatgttttgccatgttgcccaggctggtctaaaactcctgggctgaagcgatctgcctgccttggcctcccaaagtctctggattacaggtataagccactgcacccagcctacccaatttttggggaatcaatgagtgaaggttgttgtagtagtgttgggttaaattaaggaagaaatgtttgcaaaatgaaaaacgtaagcaacagctcttaccaccatgcagttaaaacacacacacacacacacacacaccacacacaaatacaatgggtcggctgagcgctttcagatcatctactgttgtgtatttgtatgattatcatagactcatcagtttttagtttataataatttgtatttatttatttcgattttccagcccatttattccagttcagggttagtgcctatcttgtcagttcagggtgcaaggcaggaagcagccctagacaggatgccatcccatcacagggcacattcatacgcacacccaaactcactcagaccaggaccacgtagagacatgctccttcacctcatgcggacatttttgggatatgggaggaaactggagccccagagaaaacccaggcatatatggggagaacgtgcaaactccacacaggcagtggccccagctgggtgtcaatttttttttttctcatcaacattataatggaatgaggttcttcaaggatctgctgtatgagactaacccagagtcatttttcaaattactagatttaatgaatcagaatttctaagaaatatgctggataatctacatacttaacaagcatcccaggtgatttttctcattagggagatttgggaaatttctagatgagtgcttctctagagttaatgtgcataggaattacctgggatcttgtttaaaatgcagttttagggctgggcgcggtggctcacacctgtaatcccagcactttgggaggccgaggcgggcggatcacctgaggtcaggatttcgagaccagcctggccaacatggtgaaacccagtctctactaaaaatacaaaaattagctgggcatggtggcgcatgcctgtaatcccagctactagggaggctgaagcaggaaaatcgcttgaacccaggaggcagaggttgcagtgagccgagatcgcgctattgcactccagcctggacaacagaagcaaaactctgtctcaaacaaacaaacaaacgaacaaacaaaaaacagcaaaagcggagggtgctagaagtagggggcctagaaacaaaattcccggggctccctccggggccgcggtctgggctgcgcatttggctgccgcgctcctcgcgaaggcagtggcttccaaactcctgcgcgcggtcatcctcagacccccctgctcgggcaagggcaccgagtgccagagcatcgcccagaactttggcttccaggatttctccagtgggcacttcttgtgggagaacatcaaggccaaaaccgaagttggtgagatggcaaaacagtatatagagaaaagtcttttgcttccagaccatgtgatcacacgcctaatgatgtctgagttggagaatagccgtggccagcactggctcctcgatggttttcctaggacattacgacaagccgaagccctggacaaaaatctgtgaactggatttagtaattagtttgaagattccatttgaaacacttaaagatcgtctcggctgctgttggattcaccctcctagcggaagggtatataacatggacttcaatccacctcatgtacatgggattgatgacgtcactggtgaaccattagtccagcaggaggatgataaacctgaagcagttgctgccaggctgagacagtacaaggatatggcaaagccagtcactgaattatactagagccgaggagttctccaattttctgggacagagacgaacaaaatctggccctatgtttacacacttttctcgaacatgatcacatctattcagtccaaagaagcatattaaccctgcccaatggaagaaccaggaagatgtggtcattcagtcaattgtgtgtgtagtattggtgctgtgtccaaattagaagctagctgaggtagcacttgcagcctcttttctagttgaaatggtgaactgataggaaaacagatgagtagaaagagttcccgaagaggccctcctctgcctttcaaaagaaggtcacctacacatgtttaacgtgtctctgcacgtctcaagcccttcacaggagaacaagtacagtgtggatttcaaacggggcgtaacctcagttccagctgatttttgacaactatgttgttgctgtggtatcctttttttacacgtgatgatggtggtttctggttccccccatccccacaaaggctgttgtaccacagcacctggaagcctgagtccgttaagggctctagcccagatttgtcccaggctttctgctgtgtgcctccctggtgacaatgaaattaaggctacttactctcagtggttgtttctctgctcttgagtgactgtgtccacagttcatttttttttccagtaggaataactccttttctgcatccatgctccatagagtccctccctttcagacatctgggatgaaagaatttggcttctatttctttttagactgcatttttttttgacatctattttcactcttaggccattaaacaaaacaggtagttatcgcttttatccctctgaaattcttctaagaactgagtgaggggactgtattgaatctctgtatgcactgggaactgagctatgaagaggatcttctttctgaagaggatcttactaaactgctggtctgacactcatggattgacactgttcctttcttttattgtgaaaaaaattaaacccctaaaaatcgtttgggaactccctaaagtattttgggaatcctcaaaaaacatgggaggtataagtatttagctacataaatgttgtaagatcacatcttatgtgtagaagtgataagatcatttggaattactggactagttgaatagttaaggtttctattcaggacaataaaatgtattttgaaagtgctgctaactattgatgctgacagtgtttcactcctatcagtgactcaaatatattatagataggtggtaaagggaacggagcctgtggggttaagtagaatgttgtgctagctgtgcctggactgagtataacagctttacgattatgggaaaacaaaatctttattattttttttccattccaaagattcatcctacagggtggccataaagtctagaattagatacaaatattttgtcattcattataacataatatcaataaaccatttgttaaaagatttgcctggtttccagagttggtggccaccttgaataattcttgctgtggtctgggaaggacaatgaaatttattcctgctgccttaaaaatatgtatcccttcttcatgcatcataactgtccccagtgagtgtcctttactattcctgagagtgactcctgtctaacttttcatactggtgagaagaaaaggagcctattttaacacttcagtggtgttgaaacacattacttactttctgaagatgtctcagtgaatcctcagtatgataatgaatgcgtcttccttctaagtactgcccaagcacttgccagctcctctcgcattgtcccttcatgtgaatattttttggttactttagtggaaatatagacaagtgtcctccccatcctctcaaacataatgagattgtttagtttgtaggtttatataatgaaaatgcccagtcagatctatgaatcgtcggtacattatattgcctctgagcactttagaatgtagagttgcaattgaatggccatttgtggagatggggtgcatatcatatgtagataaagctcaggtctcctggggaaccagttatagagaaaaataagtctgatacgaggaaaattgcacgatttagagtatttctgccatagagaaaatttccacaaactaggaaacgtagagagttaaagttattctaaagaatacccaaaagaggaaagtctgtgcttttttggaaaaaggaaaatctccaaacttctttcttcacttccctctgtgtttaactgaccctccaatgtgatcattgcctttggagttttggagaagtacaggaagtggcctgatccctgcttccatacttcactcctctatctatccttccctccctctttccttccagctaaatagacaattctagccaacattgagtcactcagtaagtctccagtgtgtgtgtttgctgagattgtctagcagttgagggtctgtgctggtttaggtgagaccaaatagagataaatatctttccatggtctttgaaacataatgtttattttgtggtcaatggccttaaaaaaatctatttctggttttcttcaacaaactcactagtttttcccttaaatgattttgtaaaaattaaaattatcttgaaaatgttttgacaaaagtaaaattaaagggacatcttttcttggttttccttctactgccacacaactgttctttcacctttaaccaaagagggtggtttagatggtttccaagattctaacccgacctcgcattctgtcattctacccagctcttaattcagtttgcttccattatcctaacaggcttcttacttacttagaccttggaaatgctgctgtgtttaataccctccaatactaacacagacttaagataggtactgtttattgaaagcctactgagtgaaatgtgcagttttaggacctttataaacatctcaatctttctagcatcctatgaaataggcatgatttcatgctgataaaaaagaagacaggggtcccagggatgtgaagcatcttgctcaggcttcggctgctggtgaccagtgtagctgggactgcagcccaggttttcctaactcagaagactgagcttgttcctggatgttattaatatctacttgtgtccaagcaaccaagggtcttgagtctgcttgattctgcttgtggtctcacatcaagagtaacagagctagtctaggcatggtggagctagtccatgcctgtagtcccagtgctttgggaggccatgatgggaagattgccagaggccagaagttcaagaccagcctgggcaacatcacaagactccatctctacagaaaaataaaaaattagccaagcatgctggtgtacacttgtggtcctagttgctcaggagactgaggcaggaggattgcttgatcctaggagttcgaggctgcagtgagctatgattgcacctctgtaccccagcctgggtgacacagcgagaccctgtctcttaaaagaaaagaaaagaaaatagcagactcactaaagtgatgttcacctttttatgacgttccttttttttttttttcgtttgcttaagcaaaggaagctgctagaggagagtcttgtcttggtcttcctgcctaagaactcctttatgaaaggaataaaagactgtcaaagtaggctgggcttgcgtccaggctaatctgtgaaggaggctagctcatgttccttacctaccctttgggtgtccactgggtcgtgcccctggagcggcctttacccttgagccatggtgctcacacataggcttttgagctccttggagctatccagaccctgctcacttttctttccagagatcagaacaaatcactccctcactcctactccaaacaaggtcttgttgataaactagtccttttcaaagtgctggtaggtaaaccagcgatgatggagcatcaaacacaagttaactcctgacttttgtaccattgtctctctattccattacatattaacatgactctgaataccttcgcccaccatctgcttgttgtgcaacagttgaggcagtaaccaggggagattcacttcctgtcttgtccatctccagggatcactcccctgctgctctccagcagccaagctcaggtgagctccatttttacccaagatgtgaccctctctttggttgggaaggagaaaggtaagaatagccatgaatgagtaaggattcttaaagggaggtgctgctatggtttttttctgctatttaagatgttgagacaggataactttagaaagatgcatgcacaaacccataaatagtgcttttataaaatttagttcactggaaactgagttcagtatttgacattagcttttctttcaaagtgtttaagactgctggaggtctttgctcaaataataaatactgcgtatttccaaatgtgttacggtataggcagtagttactatttgtctactccatgttaggcacattacatgtattggctaatcaaatcttcatcaattacctgtgtaataatctcaattaacttgcctccttgtattataaatggaaataatcctgtttatttaaacgtatttttatgtatcaatagggattaatcaggaaattcaaagggccttttttttgtatctttccctaatttgagctccctattctcattaacagataaaacaacacatttgcttcagcctggaatatttgcttttggtgcttagaggcagagacaagaaatgggcactcagggagtcacactggtagttgcacactgtatctacagagggcgtgtctcatctgtactctgctgggttacaggatgtcaggaggtatttgtgtccacctgagaattccgtttattaccttccatttaacagacaatgtctttcctttctgcagttgattttgctagagaggcaattcataaggtgaagtcctgttcatagtatgacttgttttctcactatccccttccatttttagtaactccttggtctatttggtgtctttaaaaaaaagaagttggtaatgaagacttctttaaatatggaaatgtgtgctcttttatggcatagatatgaaatcccttcctgtggtaataattaggttattcccagaagcacagggtcattctttttttttttttttgagatggagtctcgctgtgtcgcccaggctggagtgcagtggtgtgatctcagcccactgcaagctccacctcccgggttcacgccattctcctgccttagcctcccaagtagccgggactacaggagcccgccaccatgcctagctaattttttgtatttttttttttcagtagagacggggttttactgtgttagccaggatgatctcgatctcttgacctcgtgatccgcccacctcggcctcccaaagtactgggattacaagcatgagccaccgcgcccagccgcacagggtcattctttaaataaaagctttcctgtttaaagcttttcaaaggagcagaccaccttgaagattccccctagggttgataggtgtctaattccttttataaaattattattgttttcattttaaagctttggctataaagtcagaaatgtcctaaataacaaaatatttcatatttaatttaaagaaaagtaaagagaagaaaaatgaaaacccagtctttatgtaagctccaaggatattagggcttagagggcttttctagttttatgacaatttatactactgatttttatattatatattattggggttttgttgttgttgttttgttttgtttttttgagatggagtctcactctgtcacccaggctggagtgcagtgacgcgatctcagctcactgcaacctctgcctcctgggttcaagcgattctcctgcctcaacctgctgagtagctgggactacagatgcgtgccaccacacctggctaacttttgtatttttagtagagacaggatttcaccatgttgtccaggatggtcttgatctcctaacctcatgatccacctaccttggcctcccaaagtgctgggattacaggcatgagccactgcgcccagccctgtattcttgtttttgagatgagcagatctccgggaaaattgttgagttacaatggcattttactgtgatccttctcaagctcagatcatttctgtaacccaatgacgacctgtctctttggtgtactgtcctgtgaaatgttagctcaattttcccagaagttgtgtgtttgccatgagtcagagtgcttttcctcagtgggacagttgctggccctcttaattttggtgtatgtgcttcaaagtatgtaaacctctagtctgatctgtatatgatatcctgttaattgtattattattttgattatcttgctggaaggttcataattttcaatttgatagaaataaagtttttttctgcttataaaaaaataaaataaaatgcagttttagattcagtagatttggagtggaatctgagagtctgcatttctcttaataatagcctccgttaatgcacacactgctagtccagggcacattttcggaagcaaagctctagagcacactatggtgtcagagaccctgtttgagaatctgggaagggctacagagccagttcatagcaaaatatataaacatgtaatttatatgcaattgcaaaggatttgcagggtctctgaacgctatccttaggctcaaggttaataagacacagacatcaacctggttctcatgcgaaagtgacaggaatctttgaataataatgtccaacatctattgagcacctactatatgccttggcattgtgctgagtgatcttgacatattagctcatttaatcttcacaacaaacctatgaggtaggtactattattgtcattctcattttaccaataatgggcggatcacttgaggccaggagtttgagaccaacctggctaacatggtgaaaccctatctctaccaaaaatacaaaaattagctgggtgtggtggcacacacctgtagtcccagctactggggagactgaggcaggagaatcgcttgaacccaggaagtagaggttgcagtgagccgagatcttgccaattgcactccagcctgggcaacagagtgagactctgtctcagaaataaaataaataaataaataaataaataaggaaactggtgcacagaaagttctaagcaatttgtccaagggtattcagtggagtattcaagagctggattcctgaacccagatgtttcattactatgttttgctgcacctaatgtgtagtaattactttgaagaaagtgattactttcttcaaagagagtgaaaatgtgggctgatgatacctgagtttctctaattctgatggacatcagaatctcctgagggaatttgttaaacatcattaccaaataatgcttggattccagcctagcttctgaatcagaatctctgggggcggggctgggggattgtctttaactaatgcccaagatgattctgatgtgcaaaatttgagcatcattgtcacagacttttcaaaggcagagttttaagagtccaaaggaaagctaaacgaagtttgttgtgtgagaaactctgaaagggaaagtgtgactctgagggttaggaggctcccagaaatgtatttctgactctgatcttgataaagaagaaaagtgtggtggccctagaaaattcctttgttgtcccatcaggattattccttaacacagtcacttaaaaggagaaaggcccacttttaaaagaagttcaccttgttgaggacacaaaaaagtacttataaaggggcgtcattgatctgtaagaataatgcagcagaattaaccccactccccacttctttttcttgcttttttttttcttttttagatggagttttgctcttgtcgcccaggctggagtgcagtggcgcgatctcggctcactgcaacctctgcctcctggttcaagcgattctcctgcctcaacctcctgagtagctgggattacaggtgcccaccaccatgcctggctaatttttttgtatttttagtagagacgtggttttgccacattgggcaggctggtctcgaactcctgacctcaggtgatccgcctgcctcggccttccaaagtgctgggattacaggcatgagccaccgtgcccggccaccccattccccacttctaactccagacaagcttaagtgcatgtgaggggaaaagagctaataacaacaacaaaaaggaggtgggaggggggcacagcttgcctctttcctgaactcttgctttacttttctttttctcattcattcatttattccagtacttttttttttttaactgcatgtgccttcattttgccaagtacactctcagaactaggaaggcctgctcccctcacttaagaagatccattaacttgccgggtgcggtggctcacccctgtaatcccagcactttgggaggcccaggcaggtggatcacctgaggtcaggagtttgagaccagcctggccaacatggcgaaaccccctctctactaaaaatacaaaaattagccgggtgtggtggtgggcacctgtaatcccagctacttgggaggctgaggcaggagaatcgcttgaacctgggaggcagaggttgcagtgagccgagatcgtgccattgcactccagcctgggcaacaagagcgagactccatctcaaaaaaaaaaaaaaaaaaaaaaaaaaaaagaagatccattaaccacaaagatcaacccaagaatgagtgctaggagaagggcaagtgcaatgtcagaagagcacaaatggggttgtaagcagaagaggaattgcaagatggaagaagggcaaattttattatgatttctaaaacaggtggagcaggtgtattctgactggaggccaataactacatggcaatcctacctaagatttgtaattttaatttttatttgagatggagtctcgctctgtggcccaggctggagggcagtggtgctatcatgggtcactacagccttatttcctgggcttaagtgatcctcccacctcagcctcctgagtagctgggactacaggcatatgccactgtgcccagctaatttttttgaaaattttttagagaaggggtcttgcagtgttgccagggctagtgttgaacacctgggctcaagaaatccacctgcctcgacatccaaaagtgctgggattacaggcatgagccactatgcctagcctatttttattttttaagagacagggtctcactatttgtgtaggctggacttgaactcctaggctcaagtgatcctcccacctcagcctcctgagtagctggggctagaggtatatgccactgtacccagcctgtccaagattttaaaaaaaaatatgtgatgtctttaagattatagatactttataggtaattaatttacatatttctggtgatagatttttaaagagattgttaaaagagatatttgtgggccaggcgtggtggcccacacctgtaatcccagcactttgggaggccaaggtggcagatcacaaggtcaggagttcgagaccagcctggccaatttggtgaaaccccacctctactaaaaatacaaaaattagccagccatggtggcaggcacctgtagtcccagctactcgggaggctgaggcaagagaatcgcttgaacccgggaggcagaggttgcagtgagcagagatcacgccactgcactccagcctgggtgacatagtgagactccgtcaaaaaaaaaaaaaaaaaaagataaagaaaaagaaaaaaagaaatacttgtgagcatcctacagaaaggaactggtgatcaccagggccaggtgtgtgtggagttattaagaacaagtcatgacaaatcatcactgtttctttggtagattaaggaaccatggtaggtagtgggttgagtgggtggtagggaagcagaaacaacggatatggatccgcagaaatctttgtttttgaaaaaacatgcattgtgtgtcagcatatgtcagacatttgctaggcaattgcacctattttttttatttgctcattactagaaccttttttagaaaacactgacttcctaaaaaacaacaacatagaatccaggccctccaaccttgacacggaaggagagattggtggaaggacagtatctttctggagctgggttgcccatccacagggccccaaatcagatcctagatacacactcatctccttttcatgggttttcactaaagattgtaactaaacacctcacacttgggaattggctcaagtgttaacagaagactttcctcttaatactctgtagcaaagctgaaaaagcactggaagccataaatacctttaggaaagataggaaataaaatggatatatacatgaaaaaagaccagaatctagataatctgatttgcaagataaagtttactcacctttatttagagtcctctgcagagactatgacttcttttcactaccagagtacttattttaaatgactgttgttagtatgtctctacctactttgagtgatttttctttaccccagctgtactttttagttacaaattgttataacctaccttctagaaccaatcttatcttccgctaatccccaatgtgagtttcacagcctttcctactcaaagacttcaaaaaagccacttgttttgcctcctttatgctttaaccattgctcaatcttcaaagtttattcttcctcagcacccttttctattgactcaaattgttttattcagggctttgaagtttcaaggaccagaaattcaattaaattagttcaagtaaaaggttttcttagaataatgacatgaaatttctcagaaataccaatcaaagttctcttgagccttgtatttgttgtgaatattttaggcttaaacatattattattatttttttctcacataagaagaaatctggaggcaaccagttgctggttatttttagtagagctcaacattataaagaccagtgacactgcatttcttggtctgtccctcataatcaaaagatggctgctgtagctctagatatcaggtccatgttcaaagaaggtagaaaggaagggaagggaattcagccttttcctttggtcaggaaagcaaaaacgttaaagaaacctgccagtagatatctgcttacattacatttacaagaactctatcacacagctgctaataaaggaagtgaaatgacaagccacatactcggagaaaaaatttaccacacaaagaattactatgaagagcatatgaataacttccacaattaaataagaataagatatacaatagaaaacaatagaaaaatgaaaaaaaaaaatagaaaacacaacagaaaaatggcaaaagacatgaacaggcagttaatagaagaggaaacatttttggtgaatacatttagggaaagacatccaaccacattagtgaccagggaaatgcaaattaaggctacattgagatacacatttatacctactaaattagcaaaagttaagaagtctcagaatattgcattgatgagaatgtggagtttcatccaccactagtgggggtgtggatgaaatggtataaccatttagtaaaacaatctgagattatctcatgaagttgaatgtggacatactacaaaatgcagctagtaattccacacaagagacatgtacacaaatgcctgcagcaagcattatttgcataaatgaaaaccccgatgactattgtcagaagaatgaacaaaatgatgtattcatatgacagacctactattgcagcagcatgaatgaatgtaagaaatataattgagtgaaaaaatatcaagggcagaagattaaatctatggcataatatttttaaaagctaaaaaacaagcaagtgaaacaatatatatttttagagatacatatgcacgtggttaaacgatatggaaaaaacaaagctagggaaaggtaaatatagaattcaggtgctttcaaagattctgcaatgatccaggtgttcagttgaatagaattgtagattcatagttgcccattttattatgcctcataacttattattatttatttgtttttttgagacggagtctcgctctgtcacccagtctggagtgcagtggcaggatcttggctcattgcaacctctgcctcctcggttcaagcgattctcctgcctcagcctccccagtaactgggactacaggtatgtgccaccatgcccaggtaatttttttgtatttttagtagagacggggtttcaccaggttgctcaggctgctctcgaactcctgacctcaaatgatctgcctgcctcggcctcccacagtgctgggattacaggcgtgagccaccacgcctggcctttcataacttatttatatgttatatatttatgtatcaaacattacatgattaaaatttttattttatttttatttttatttatttattttttgagatggagtctcgctttgtcgcccaggctggagtgcagtggcaccacctcggctcactgcaacctccgtctcccgagttcaagtgattctcctgcctcagcttcccaagtagctgggattacaggcgcgtgccaccacatccgctaatttttgtatttttggtagagatggggtttcaccatcttggcccgcctcggcctcccaaagtatcgggattacaggcgttgagccaccgtggtcggccgattaaaaactttaataaggtatgaagcaaatggctttgacaaaaagtgtaaaaaggattaaaatacaccatcctgtgaaattttctttttggagcacatgtactggggaaccagacatcgacatttttagttattttagtttcacagtgctatttgagtataatagaaactgtatttgcttcagtcaatttggggagaaagaacataaacacatggaaacacaaatatcctaagggaattgagtcttattactttgcagacaatttttgaaataaataagttgctgagacagtaagtgctgttagaatggagagagggagacttaccaataatattatgttaaagagcagtgcaagtagaggagtggggacagaattgagcatgcagaggtatcgaaagagaaagtggaaatgcagcatgtaaattgcagattccttttcaagaagtttagtaatgacagaagagaggaaattagcttctttcttcttcagggagcttcaggactgttcttcggaagcccaccctactttgcttttgtttgatgcctgtattacagggagaaaagtttggcccaaggacaaactttgttaagcatttatgcaagcctctgaggtttctttctttatttttttaaagtatttttttctgggatgcacaaactccagagaaatggagtcagtgctctcgcttctgaggtttcatgttcagtccagggacacactcatagctgcccccctcccccgggggtattaatggtgttaccatttaattcgtgtttcctttttaaattattttcatcaccatttcaaagttatttaactcattctcaattccaatgatcacaccagaattcaattatgacaacaaaccaaaacagtcaaacaaaaaaattcccccaaaaaggaatgaaagctccccattccaaaacaaaatgatgtgtcatagtcattctttccacaaataagggcttattaattgtttttttttttttttttgagacagagtctccctctgtcacccaggctggaatgcagtggtgcgatcttggctcactgcaacctccgcctcctgggttccagcgattctcctgcctcagcctcccgagtagctgggattacaggtgcctgccaccatgcctggctaacttttttgtatttttcttttttttttttgagatggagtttcactcttgttgcccaggctggagtgcaatggcgcaatcttggcttaccgcaacctctgcctcccgggttcaagtgattttcctgcctcagcctctcaaatagctgggattacagtcatgtgccaccaggcctggctaatctttgcatttttattagagacagggtttctcttgttggtcaggctggtctcgaactcccacctcaggtgatctgcctgcctcggcctcccaaaatgctgggattacaggcgcgagccacagcgcccagcctactttttggtatttttcatagagacagggtttcatcatgttggccaggctggtttcaaactcctgacctcaagtgatccgaccgcctcagcctcccaaatattgctaggattacaggagtgagccaccgtgcctggccttattaattgcttataatctgcacatggcacaagtcccatttaaaataacaggaaatgacaatgcattttaatgggctttggtttattaatctattttatttatttatttatttatttatttatttatttatttatttgagacagagtctagctctgttgccaggctggctagagtgcagtggcatgatcccggctcactgcaacctccgcttcctggattccagcgattctcttgcctcagcctccatgtagctgggactacaggcacgtgccaccatgcccagctaagttttgtatttttagtagagacggagtttcaccatgttggccaggatggtctcgatctcttgacctcgtaatccacccgcctcggcctccaaaagtgctgggattacaggcgtgagccaccgtgcccagccctaatcacatgctttctaagtgggcctcaggattccccttgtgggcagagaacttctcttgtttattttagcttcttcacagatgtgtaccaggtatccattaggggctcaataaatgttgaattaatgaatgtgtgaataaacaaaaaatcactaatcagtaaggtttttttgaatgcttatttttgaaaacgcactttaagagtaaattttttttttaaatagaaagaataagatctagtacttgatagtacaacagggtcactatagttaataattaaattgtacattttaaaataactaaaagagtataattgaattgtttgtaatacaaaggataaatgcttgagaggatggatacctcattttccatgatgtaattattacacattgcatacgtgtatcaaaacatctcattaccccaaaatatatacacctattatgtacccacaaaaagtaaaaataaaaaatttttaaaaagtaaatgtttttaaaaattacttttaaaaagtaaatatttcaaaagctgtttaagacactgagactagactgtaacacaataggtgctcaacaaatgttttttgaataaatacctaatactcagacatcacaagtactttgaatttattgtgaccttgcaatctgaggcccttgtaactctggaagtaaagaaagctacatgataaacaatggcacatctttctcaggtgtaaattgcttaaagcttttacggctatttaaacaagaggcaaaataaaacattagcattcgttttaaagaaaaacatctttcttcaaatgtatattttgtttttgagagcttacttggggctgtatctccagactctgtttaatgttatctttccattggctttatgagtgctttgcaggataagtcgaagaagtagtaggcacattttgtgatttgtgttttacatatttaaagagaaaatataccaatcattaacatctgtagacggtttaactctagataaagccactatcatataatcttttctgggtttcacttcttcctccagactggaacactgggcagcttaaagctgtaaaagctttaagcaatttacacctgagaaagatgggccattgtttatcatgtggctttctttacttccagagttacaagggcctcagattgcaaggtcacaataaattcaaagtacttgtgatgtctgagtattaggtatttatttaaaaaatccccattttacatattaggaaactgagattactaaatgtgggctagggtcctcctgggtatggggcagggggagtgcttgctgctgttaaagaaaattatcctgacacttgtcaaacacatgaataatttattcaagattattacaataagggtcatgactattggaacaggagagagaaattgagctcaactcagaatacagcaaagacagcaggggatttatagccaaggaacaggcaccgtgtctgtgagggaggtgacggtggatggaaaattactaagaggagacatcaagggtagagggattctggctaaaggcaggtcaagggcttctacaacaaaggtgtaatataaggaatctaatccgatattaaatatcaagaattcaacggtgatcaggtatcgaggatggatgatttagcatgcttcttgctaacatttgggctcagccaggacacagggaggtcaacgttgaggcctaagtgagaaagggctcagaggtaccaaactaaaggagagcgtctctgttcctgcctactctgacctcttttccccccttaaactcagtggtaacaatctgacctgtttattacctcatccccatggaaggggtggggagtggcaggcagccggtgctctaggatcgttgggtagggagcctagctctctgaaagcagcaatgcctagtgggggtaccgaggccgagttcggagaccacctgagcaattgcggtccagagcaaagccccctggatcggaacgggagccgcccccacgccccgcccggctgccgagagccgcacttctgggcggatgccgcaggtcgggagggatgaggccgacggcgctgattggctgaccgccgcggcctggggtttccctggccccgcccctgctgcactccccccgcccgcgaacccgcgcgctgcccggtcctgcgctgctcagcgggaggggctggaccccgcgttcctcctccctgccggtccccatccttaaagcgagagtctggacgccccgcctgtgggagagagcgccgggatccggacggggagcaaccggggcaggccgtgccggctgaggaggtcctgaggctacagagctgccgcggctggcacacgagcgcctcggcactaaccgagtgttcgcgggggctgtgaggggagggccccgggcgccattgctggcggtgggagcgccgcccggtctcagcccgccctcggctgctctcctcctccggctgggaggggccgtagctcggggccgtcgccagccccggcccgggctcgagaatcaagggcctcggccgccgtcccgcagctcagtccatcgcccttgccgggcagcccgggcagagaccatgtttgacaagacgcggctgccgtacgtggccctcgatgtgctctgcgtgttgctgggtacgtacgcgccgccgggtccgaggggcgtgtgcggctgtcccgggagggctttagcgcagagccgcgacgggcagcgggggtgtgttgcctgacgcgtgcgcagctgtggggcgacacacgggggcggcttctgcagccgagggaccccgctttgcagcctgcaccccggctcccgcgtgcccgccgctgtctgtcgcccgccggtgcgatgagcccagccctgcttggacgctgttcacgcctctgcgctccataccttgctcctgtcctctgtttgcagttccactctagcagagcagggtgggctcctcccctctgtacggtagaggagcctggtcactggcccatctcagtagtgaaactggaggtttgatgcacaggggattctcagtagcaggcgccagtgcctgatttatcgtgagaagcagtttaatatttcggctataaaaggctagaactagttcctaattagaaggtgtgccaggttgtaaattgtcaggttgcaagtagggatgagcacgccaagtttttgcgtataggtctaaagaagttttgggggtgggggaggatgcggtaccccagacctgtttccttgtctgcccagaccttgccatggtgtagctttccatctcttgtgacagtgtctcaaggagcagtagacattctttggctgcagcagatttcgcattgtcttcctgattggaagagttcagttatgaggcttctggttgccagttactcctttcttttgaagagaaagaactggaatcatttggataagggatgggcgttggaaggagtagttttcactttttatgtattgtataaggcagttatgctgtgaactatttatatatgatggaataaacaaaaacaaagcaagagctgctggaggtttggatagtcctactcatgttgaagtaatcagaatagtagtagtattggcaagttctcagggtgggagatctgtggctttagccacctggatggaagtctgcgtaatggtttctcagtgacaggagattccctcggttttaatccagtagttcctagttattccactctccagtttccaaccgggtcatttaggcccttgcaatcttgtggaattcttataaattctgttaccaggttttgttgttgttgtaaggaaaaattccattttgttatcttttttttttttttttggatacagtctctctctgtcacccaggctggagtgcagtggcgggatctcggctcactgcagcctctgccgcctgggtccaagtgattatcctgtcttggcctctctagtagctgggattacaggcaccgccaccatgcctggctaatttttctgtttttagtagagacagggtttctccatgttggccaggctggtctcgaactcctgacctcaggtgatccgcctgtctcagcctcccaaagtgttgggattacaggtgtgagccacagcgctgggccctaaaactgcattttgttacctgttaatatgaagcatctttgttgtttcccaagacacttcctgtttaggtccacagtgagttttaggaattaagtttaggaaagtggaacacaattttggcacattgtctttttttttttttttttggagacggtcttgctctgtcgcccaggctggagtgcagtggcgcgatcttggctcactgcaacctccgcttcccgggttcaagcagttctctgcctcagcctcctgagtagctgggattacaagcacataccaccatgcccggctaactttcgtatttttagtagagacggggtttcaccgtcttggccaggctggccttgaactcttgaccttgtgatccacccgccttggcctcccaaagtgctgggattacaggcgtcaaccaccgcgcccaactgaacactgtctttataaaaacacagtcctttcagatgtcgggacttattaataattaaatatattcaaatttatttgcaacaaaaaattacctttcatagaaatgttacattaaaaaatatattttaacttatacttgatgtcattggaactttgttaaactttgtttatattttagtgaaaggagaggaaaatgttcgatcagaaaaaaatatatttctaatatattgaatattatcctatcattgccacatattgtgcactatcagaattacatatcatctttgtcttttcctactgtgggagttcgatcaatttgtaaaacaacataaatttttttctatgggccaaacagtgattagaatggctgaaacataatactgctctgaggtagctgaagctaatggtattaaacacaaagccatatggtagatctgcaattaaaaaaaaaatcacatataatggaggaactgacatgcagtacaattttataaattatgggttgttgtagcctgtagttttaacatgatacaaacatcacataattatcctataaaggttaatttcattgctacattgacctgacagttgcaggagtacaatagctgtcaataagataaaattgtgtttttggtggttttggagaaagctttgaggacttgttttaggaaaaggcatttaatctatttacaacattatgttttggtattactggcatttcttttaaagtaattcagcatattatcactataagctcagaattcccttttcctaaatagaaagtgacctattttactgacttttaaaaatgtaagattacattacatttaacaacatcaactgtccattgcaaacagcagtgaaggagaccagtggtgcaggagatacaaaacttttcacgcttacttttggaagacacgtgttatatagcaaatgcgcctttctggtggagtctgttatattaaatttgatttgtattcattttactgacagcaggagattggtagcctaaaatcatggtagcttcaagagagttttcaacctggcataaatttcctttttctgtgaggaatccacaggtaagaattgactgttagaacaaaaagatgattaagcacttcataagtgcagggttttgtgaaagtggttcataattataatgtggatacattccagattctgttaatgaccacctcaacatcatacagtatagccattttaatatgatgatgttacgtcaacctgttgtacaactactttataattttactgtgggtgatgtgtgttgaagtgatcattaaacatgcctgtgtgcatgtgtgtgtatatgtttctgtccgtatgtcatctttatcatcagtgtgaaacacgacttcctctatatacacgtttgaattattagttccttaagtggatctgataaatccttggaaaaagaaggagaattttgagaagtcctgtgtgttagttcctcaagtggatatggtaaattcttggaaaaagaatgagaattttgagagataatgtatatttgattcctttctgaaatggaacatagtcttgccatctgtctttggctctttttatgactggttctgtgactatagaacaggccatatacattatctgagcgcatgagaaaagctctacagagaatggtggtaggctggtatgaaaggcgcgatgttgttgtagggcatcgagccccgggccgtcaccgtcacctcggccgctgccgctgtcaccatgtcaccatcggggccgctgccgctgtcaccatcgccttgttcccccatcccccgccatggctgaggacctctccgcggccacatcctactgccccgtctgtcaggaggtgctcaaaacgcccgtgcggaccgcgccctgtcagcacgttttctgtagaaaatgtttcctgactgcaatgagggaaagcggagcacattgtcccctgtgtcgtggaaatgtgactagaagagagagcatgccctgaacgggccttagaccttgaaaatataatgaggaagttttctggtagctgcagatgctgtgcaaaacagattaaattctatcgcatgagacttcattgcaaatcttgtaagaagtatcaggatgaatatgatgtttcttctatcattccaaactttcagatctctgaagattcagtagggaacagcaataggagtgaaacatccacatctgataacacagaaacttaccaagagaatacaagttcttctggtcatcctacttataagtgtcccctgtgtcaagaatcaaattttaccagagagcgtttactggatcactctaacagtaatcacttatttcagatagttcctgtgacatgtcctatttgtgtatctcttccttggggagatcctagccagattaccagaaatttcgttagtcatctaaatcagagacatcagtttgattatggagaatttgtgaatcttcagctagatgaagaaactcaatgtcaaactgctgttgaagaatcatttcaagtaaacatctgaaggctgtagacatctctgcatctttgtacctgcaagtgccatctttaagggggaaactacatgaagtcaccgtttcagtaacttgatgtgtatattaataaaagtaattcagtcattttagtttttgattgaaaataaaggtagggcttctaaaaacttcatcctcttggtaagttaaaaaatgaaagttatgacattagctttaaaagcgtaaaagatgtttcactaatgtaatggtgaaagagaatccctgttgtactttatctttttgtaatattaaatattcttgaatttttcattatgttgcttttgaaatttggtacattcctcccatttactttattattgtacacattaaacacacagtagcaaattttgaacgatgtgatataatctaacaaatctgagccagttattagagttgcagaatagaaacttgaagtgctaaatggaaaaatccaaaggaaattttttaaatgcagattctagctgaaaaattcaactataagaaaatcgtatttatataacatttactatttttgaagactagtaataattttaattctttaaaaagtgaaagcttgttgtaaagatattttctttttgttattagaaggaaatacagagagaaaaatttatttctttcatgggcatttggtaatttcagtctttgactgatttgtaagcctagaatatactaagctgaatagcagctctttggcctcagaattttcagtagccagtatttctgattaactaagttgaaactcttattagaaactttcagttggtattactgtattctagaagatataaatgagaggtttggcttcatctcagtttagaaatttattcaaagctaaagatgtatatgtatatatatatacttttgtgtgtatatatacacgtatgtgtgtatgcagtttttcaggttatatatagagtttctataaggattttttaaatggacaagcaatagggggttgaagtgtttatctgatttgttaaaattttgtgtataaccagatttttaaaaagtgatagtcacagtgctaagtgatctagttggctgctattacaccttagaaattgagtttacacacacacacaattacctgtttgtatggtgctcatttcttattctcagatataatgtgtgaccgtgatacagtgagaaagattctaccaaccactgtttcactactttttagtcaaaattgggtatgttcttagtattcattagtgagaatcataaagtattttgtagaaggcccaaatcacagaataaaggactaagagtggattcactgacattccatactaatatacattgtttatgctttctttaaaataactaaaagaacataaaagagaatctcagtagtttgctgctaatatatacatatattgtataaaaaggtatattttggttttgttctacactgaacattttttaaacttggtttaataaaaatgttaattttggaaaaggcgcgatgttttagcccagtgtattaaaccatatcctgaatacaacttattagtgtttaattgctaagggtcatttcagattttagccactatggcattaggctgccgattaatggacactgagtccattaatttattcaatgcatattgatggaaggctagcttcgtggccagtaccatgttaggtactagggatacaaagatgaataagataatccctgccctgaagggctcagagtctaatgatgaagaaataaacaagtggttataatacatcatgataagtacgataatggaggtttggaatatgttccctttgagcaaagacgagagccttgtcttagatctgctccattgtagataaatgatttgtctgtttactcttagagacgcagaaaggtcagaagttacctggaattactcgtagctgctgctgcttttttttttcttttccaacttgatatagggcagtaggaacccaagtaagtaccaatgtttatgacttatttgcgggcagtcccacaatatctagaagatttagctggaactgacaaaactttgattccttatacctgtgttttgctgtttttgacaatcatttagaatatctttctgtgctgtgtgtgttccatttgcccttccagatcttttctccactctgctctgtgcttctgggaaatgaattacatggggtacatcaactgagcccttcctttttggtttcagattagctttgcccagtgggagggacatcagaaaggatctccctaaaagctagttccctcttgctggatttagtgttgccaaagctgttctgtgagtagttcacaacttgtattcaataatggccctctctgccagccatctatagttacacatctttctgggttctaataacccttccctagcccctttagacctggagatgataatggcttcctgacgttgctaacctggagttataccaccatcttttgctgttttccctaaaccctgcctgtaccttttgaaatggttccttcattaagttttcttgaatacttcatttgagtatgctgcttttcttggcaggaccctactgataatacccatctatgtctaaaacagatttgaggtagcttccgtttctgcattaaacaccaattacagtgtccttaatggcaaatgcaaacaggagcccatgggctgccatcttggctttcttgggagggagggggttatggttccctcagcatgctccaaatgtggtatcatcattatgccaaatcaaagtcaatgggtatagagtaaaatctggctgcaaaaacatttgcaaccaatgctagatggttgtggggtccctgttgcttgttttaacccagtaattatctcaaatactgatgccatttcttattaccataatgctgacatcattttaccccttaaggatactcctaaggagcggtccctttgttaagcctcaatctgggtcccttcctcaaagggggaaaaaacaagtattttgggaagattctcacttgctaaatagtttccagcattttgtgccttcccttttctcgtaacatttatttgttcattcactcatattcagtacacatttgttaactgtatcataggtgctgggcagtgtgttagacactgaagataaaaataagtaaacaaataggacacggtgcctatcctgaccacttgctgtttcttctatttaactttttttttttttttttttttttgagatggaatctcgctctgtcgcccaggctggagtacagtggcccgatcttggctcactgcaagctccgcctcccaggttcacgccattctcctgcctcagcctcccaagtagctgggactacatatgtgcgccaccacgcccagctaattttttgtatttttagtagagacagggtttcaccgtgttagccaggatggtctcgatctcctgacctcgtgatccgcccacctcggcctcccaaagtgctgggattacaggcgtgagccaccgtgcctggcctcttctatttaacttctattaggaaacttattttgcttctgatgaaagtttacttgtttttctgtttgttgtcgttgttgttgtttttctctattctagtcacagagagagggaaggaatctcaaaaaacgaacaaaaatttgtcaaactggcatattcttgggtcagtctagaatcctattgcaaggctttttctttctttaaatgggtagtttggaacaaaagcagaggcttggaggaaattgctgctatttggctctagttggttttattcagctgagttttagcttaaatttaccttacttggaataaaatatagaaatgttcagaaaacgttccccttatagattttatgaaatgtaaattcttcctttatattctctttgaattacatcctttggaaactcaagaatgtgctatggatctttgttaatctctttctcatttagtcatttttggctgagctctaccaaactttccaatgtgttactcagtttggggaattattctgattcttttggttaagaaatttaaggttaaaattgtcaatgtttgcctatttttttttttaaaaaaagaagttggcagcaaaagtcactaaactcccagattttgagtgaactgattaacatgtaatttcagtttttatggaaagaaatttggaatgttgtctacttcctcctaatttaggtgccttaattcaacatttgaaatggaaacatacagtctgtacaatcagctaattaaggattatagagatactgtcttgtctcttcttttcaaaaaaaaaagcatttgccatccagagattatgaatagtggttacaggtagcattctcatctttctatccttctttctccttttaccttctttttcattgtcattccttcctccccactgtacttcccttccttctgctcatcttcccttcagtcttcttgctgtttaggtttaatgtgcaaatggtttaggtaggttgcctttttactcaactgaaactagtctaaaattgggggccaggcatggtggctcatgcctgtaatcccagcactttgggggactgaggtgggaggatctcttgagccccagagttcaagaccagcctgggcaacatcgtgagaccccatttctatttttttaaacaaacaaaaattataaaattgggaatgacttgttccttataagctatgaaaaactagtctatgtattttctttaaaatgttaggcagcatagtctagtgatggactgtggattcaaattttagctcctccattgaactctgtgaccttgggaaagttttctctttgtgcctgtattctttagctatataatgaaagtacctatggttatcttaaatgagacttaagtgaatcaatatgtaaagtgccttgcacttaatatgcatgatgtatgtttgtcaagtaaaataattctctaatcctactacctgtaacataataattatattagtagaaataacatcaactagttttgtattagggacaaaaacacaaactttaaaatgtttctcatgagtactcatggaatgcttttgaaacttagtgttttattagtcatgtgtgaaagccacatacatgatttctaagtagtggtaattccagccatggtgaaaattgatctgtgtaggtctgtggtggagagtaattaaacgaatggaaaaactgttattttatacagtgataagtcctgaatttcagcttactccagaaagtggagttagctacactctagtcacctttttattgctgaggtcttgggaatgattactccacttataaaaaagtagagttaatattcctaaaacttttttttggggggggacgtagtttcactcttgtcgcccaggctggaatgcaacggcatgatcttggctcactgcaacctctgccttctaggtacaagcgattctcctgcctcaacctcctgagtagctgggattacaggtgcccaccaccacgtcgggctaatttttgtatttttagtagagatggggtttcaccatgttggccaggctagtctgaaactcctgacctcaggtgatccacccgtcttggctcccaaagtgctgggattacaggtgtgagccactgcacctggcccaatattcccaaaacttttgaatgaccttaattatacatcctcatttgtataaattctgttatttgaattgctcttggcgattaaacaggcagcaaggaaaaaccgttgtgtaatacttctctatatcctccctctccctaaaccaagcttgtccgacccatggcccacaggctgcatgcaacccaggatggctttgaatatggtccaacacaaatttgtaaactttcttaaaacattataagatttttttgcaatttttttttaagctcattggctattgttagtgttagtgtgttttatgtgtgccccaagacaattcttctagtgtactccagggaagccaaaagattggacactgctgcatctaaactctttttcaaacattgtgacatatgttaaactcaaattgtttttaaaattgtgtgagcacaatgttgttttaaagtatttgacattgcatcattttttatttatttattaagcagacattatttgctgtaatacaatgctaggagctgcaaataccagtgcaaaaaagatcagctctccataccagtgtatataagacaattacagatgtttgtaaaagctatgacagaattaaagcaagattataagaaagttagacttttggggatagcagtctcaatgaaggctctctaaagggggaatatttgaattgagaggtattggacttgagatttaaggaacaaaatgagttggccgtggaggagctgggggaaaattccaagcatagggaggagcaggtgttgagggcaaaagaagaaaagggcattttgtcacagaaaagaggccagtgtggctggaatatggtatgtatcaatggtatttttaatagtgaattttgtaacttttatttctaaatgccagaatggataaaaataataattgacatttatttagtgctctctaggcttggtacagccagtgcagtctctcgacaactctcttaggagcttggtcatctgcattctgtagatgacggaagtgagggctgggaaagttgggaaactcacccaaggcaacctggctaacaatggtatagtcaggaattgggaagtgcatttttgaggattataacttttgaatgcagattaactagtgtgtatttgggaaaggttgtaataaatggagagggtgaagtggggatggttgatgagtacaaaaaataggtagaatgaataagatctagtatttgatagtacagcagtgattatagtcaataataatttaattgtacatttaaaaataacgaaaacagtataattggattgttcgtaacacaaagaataaatggttgaggtgacagataccccatttaccctgatgtaatgattataaattatatacctctatcaagatatcccatgtgccccatatgtatgtatatttactatgtacccacaaaaattaaaagtaaaaaaaatatggagagggtgagaaaggcaagaatgtgggaattcattgtctataaaaacaatcattattgggcctggcgtggtgggtcatgcctataatcccagcactttgggaggccaacgtgggtggatcacgaggtcaggagatcaagaccatcctggttaacacgctgaaaccccgtctgtactaaaaatacaaaaaattagctgggcgtggtggcgggcgcctgtagtcccagctactcaggaggctgaggcaggagaatggcgtgaacccaggaggtggagcttgcagtgagccgagattgcgccactccaaactggatgacagagtgaggctccgtctcaaaaacaaaacaaaacaaaacaaaacaaaacaaaacaaaacaaaacaaaatgattattttagatggcttaaatattttgtaactattttagttttatgtttaactagttatgatgtagtttcagagtcagtttctgcttaccattttgagtatatctgctgtctaaaagaggcactttaaagttgggagcagtggcttatacctgtaatcccagcacattgggaggctgaggcaggaggattgcttgaggtcagaagttgcaggttgcagtgagctgtgattgtgccactgcacttccagcctgggcaacagagcgagactctgtatctataaaaacaaacaaaaagaagaggcactttaatatttcatatctcagactcccaataactattaagcattagcaatgaggttatatcatactggaggatgtaactaatttcccctattcagtaacatgctcacagactttttcttcaaatagcgttgttataggcattcctttcaggttttcacaggaaaggaagatctttgtctctccctgtgttttagatgaatcgtgtatggagttcagagtgacctttggtaatgcattctagcagatatagttagaatctcgtgatttagtcctcagttgtcactgcttggaaatgtttcctgagtctttttcagggtggggtgtccaggaaaatgacatataggaaacgtgtagcagatgagcccttcagttaattggcagcttgtcacggcagattctgccttgccttttggttcatttgcatcagtagtaggagagatgggtttgctgcttggtgctggagaggtaaatgagtagagaagaaagctattatctattgaatgcctagtatatgcgtttggtaaatgtttcacatgaactcatgtaatcatcacaaaactctgaggtacatagtattagcctcattttatgccctacctaccactggagataccaaaaataggtatgcatttttcgatcaagggaaaaatataacccatggatttttactagcttattacttatggtagaagacagactcataggaaaaatgataaaactgtataatgttattgagtgcctgttagcactgagattactaagaatgagtgagacaaggtctccatcctcaaaaggtacacagagctttggaaggtgagataggcaggtattttaatcaagttttttgttttttgttttttgtttttttttgagacagagtctcgctctgttgcccaggctgagtgcagtagcatgatcacagctcactgcagccttgacctcccagactcaagtgattttcccacctcagcctccacgagtggcaaggactgcaggtgtgcaccaccatgcctggccaattttttttttttttttgagacagagtcttgctctgtcacccaggctggtgtgcagtggcgcaatctcggctcactgcagctctgccacctggattccagcgatcttcctgcctcagcctcccgagtagctgggattacaggtatgtgccaccacgcctggctaatttttgtatttttagtagagacagagtttcaccatgttggccagactggtctcgaactcctgacctcaagtgatttgcccacctcagcctcccagaatgctgagattacaggcatgagccaccgcccccagctccggctaatttttgatttttcggtagagatgaggtctcactctgttgcccaggttggtctggaactcctggactcaagtgatcctactgcgtcagcctcctaaagtgctgggattacaggtgtgagccattgtactgggccagaagtctgtctttatttcagaacaatttcccctgaaaccattgctgttgctgtacagcagagataatgtaaacttttgggcacattacttttggctactgctgaattctgaaataattcctgtagatagttcagaaggatatgagtctatccacattaataggtgaaaacactctaatattggtgcttaggaagtgtatcgccattcaaatacttgttatatgaatgactgggcaataaacttgagtcagccattcttccagggtttaaagtctagctccatctattactattgtgtgacattgggcaggtcacctcaactctttgagttcgtcatctaatgaggaaagagatgatgctaatagtgcctttctcatagtgctgtgaaattagatgagataatgcatgagacaatgtatgtgaagtggttaacatagtcctggcctgcagtaggcactcaaatatttttgctgtttttgttattattaagctaataagccaatttggtaccactgacacagtctgctatttaaatgtgatttcatgtgttggtgactttttgtttgtttgtttaatttgtcctagctgcagtttaaacagcattgaagtcagaacctggtttgtatttcagttcctggtgcccagatcatgatgggaaatgttttgattacttctaacctatttctttctggaatcagatacctcagatcttttgattgtacttctaggtgaacagtattcccacagctcatagacaaggtacctaaatgaagttcttggttggagagagaacagcaaactagaaatatgaataaataaagatgtgtgtgaggtgagaatggcatggtttggatagtaataacttctcttagtcctcagctcctaaaacatgaagattttatttcttgaatataaacttgtcaagagctaacttaaagtacaggttgaatgagttaaacattgccacttctcatcataacttcttttgatgaataatttattctttattttttctgtagagtttaagaaatagatgtatgtaatgattacagtcatttatagtattctgaggttgtcctaattttaggtaactgtcttcagaaaggtaacttgttaaatagatgactaaatgtaattaaaattcatacttttatacttttttctttttctttttttttttttgagacagaattttgcttttgtccaggctggagtgcaatggcgcgatcttggctcactgcaaccgccagctccctggttcaagtgattctcttgcctcggcctcctgagtagctgggattacaggtgctcaccaccatgcccagctaattttttggatttttagtagggatggggtttcaccatgtgggccagggtggtcttgaactcctgacctcaggtgatccacccaccttggcctcccaaagtgctgggattacaggtgtgagccaccatgcctggccacttttttcttaaaatttttaaaaaacacacttttgagagaatatttgatctagaaagtatcactagcatagttatgcagtgtagcagaggcaagtgacattttttgtattttactatttttcaaagggcatggataagagaaaggagttttaaatgtgctccttttcaactgttgtctctgcctagcccagtagccacttggagaaaaggtttcttaaattgtgatgttatcaaaacttgttaggcaggttatggataatgttcaactttatggctagtgtggatatctatattaaaatttactttatgtcccacagtatgaatgcagttctcagtgttgccattgaatataattattaaccaaatctgaaaaccagtaattaccctctgaagtttttttatggatttcccccctttcctcaggatttgacattgtaaatgattttttagtgagtggcaattagtttgaaccctttatttaaagagttcaaagtgtaatctagtagtaaaaacagttggtttggaagtcagattctggtcttgcctctgctattctctgtgatctcatggacaagatcccatggctgcttcatttactgattgtaaattataatgagaatgatgtattccttgtttatctctcaggatcatagtggtaaatgaacctcagttattaaggagagtcatcttgcagcagttgacaccaatggattcaggtagtaagacaaggagcacatggtatataaggggctattttgagcaactgcagtggacttgtgggagatcaattataaacttagcctggctaagaatggggtgagtgttactgtcagcataaaataggaaaaagttgaagactgaagtatttagaaagtagtaatataggaaaatgatccctgacacaaagtagtgtaggcctcctgcctggctttggttacatatgtttcttctggtaaaagaggaggcaaagatgagagtaggaaaaggaaaattaaaaaatgaaaaaaggccgggcgcggtctctcatgcctgtaaccccagcactttgggaggctgaggccccagctgggtgtcaattttttttttcttatcaacattataatgaaatgaggttttttcaaggacctgctgtatgagactaacccagagtaatttttcaaattacctgatttaatgaatcagaatttctaagaaatagctggataatctacatacttaagcatctcaggtgattcttctcattagggagatttgggaaatttctagatgagtgcttctctagagttaatgtgcataggaatcacctgggatcttgtttataatgcagtcttagggctgggtgcggtggcccatgactgtaatcccagcactctgggaggccgaggcaggcggatcacgagatcagtagtctgaccaacatggtgaaaccctatctctactaaaactacaaaattagctgggtgtggtggctcacgcctataatcccagctgctcaggaggctgaggcaggagaatgacttgtactgggaggcagaggttgcggtgagctgagattgcgccactgcactccagcctgggcagctagagtgaaacaatgtctcaacaacaaaaaagaaaaaagtagatattgctggtagctctgtttttgcctttcaggagcacttctgaagagaatgaggcttttttgagaggaaggaggattaatcatgaggacatgctttggaaggccagagtttgctgtcccgtaaagagattgtggtagagattttattttcagttggattaagtctagaatcacattgatagtgatttacattgcctgaagtagggaatttgctctttaggttggtcaattaattaggtccgtattctagatttgctagaaaaaggagcaactcacttgaagagctttgtggtggttgctcttatttcatatcctcacatgtttcatgattaaggatgaaaattgggcctggtgttgtagctcacacctgtattcccagcactttgggaggcaggggtgggcaggtcgcttgagcccaggagttcaagaccagcctgggcaacatggcaaaaccttgtttctacccaaaaaaacaaaacaaaacaaaattaactgggcttggtggtgcaggcctgtagtccccagctaacttgggggttgaggtggatcacctgagcctgggaaggtcaaggctgcaatgagctgtgattgcaccactatactctagcctgggcgacagagtgagatagggtcttgaaaaaagtaaaaaaagaaatatttgatttgaaagatagcataatttggttgaatattttgtaaattaaagttgtagtaaaagcagaggagtttgaaattttggactgtcaaatagaattgtagcagaagtgttatagttgctatgaggctagccatagacatattttagtgaattatctgacttatagtgaattataggagactttagtgaattatatgagataaagacatattaatactttctgcaataaagaatgtaaatggatactatttgaatgggctaccattatgtttatgtaagctataattacccaaaataacagggaaacagtgttgtaccttttaaaagagcttagaatgctaggatgattcttaccttgcaatttcaactgcagattttgtattttattaagacacgaaacaaatttccattcatttttactaatatgtagatattttgcagaattcttttgtgttcatgggatacataaagtttgagtatggacattggaagcatacaggtctgagtttgaatctcagttctgtcacctgttgcttgggtaactcacctgagttcacagctttagtttatctgaaaaggactgtgtcttaatctgtatgttctccttggcatgtggcccagtcaccgttacatagtgggcatttgtttattccacaaatgtctgttgctcatatactgtgtgccaagcactgtcttaggtaatagagatacaagtaatcatacaaataaatatgaaaaatgaaccaataagtattgtgaaggagaagtatgggtgctatgatagtttataataaggggtctaaaaaaaaggaggatgaggtagcttttaaaaatgattactttggctgcagggtagaatgatagattagagctaagaaataatggatttagggagatcagttaggaagctgctgtaacagtccaagtgaggcaggcagtgagactaaagaggtggtggtgatggtggtagaaatggagaaaagtagatacatttcagaggtatttgggaagtaaaggatacctgtcttggtgacatgttgaaggtgtagggtaggagagagagaaatgtcaagaatagttctgaagcttctggcttgtataattgaacagatgttggttcctgccagttactgaggtggagtgtgctagatgagaacctggtttgataggaagggggatggggaggagatcgtttggtttggggcatgtaagtttaagatgtttttgaaatatttaagtggaagtaccaagttcttgtttggataatggttctagagctcagaggaatggtcagacttttgagaatcgttggcatattcgtggtaattgaagccatgagaattgatgaaatttcaggaagaagttataaaatgaaaaggaagaagactttatactgagctttgagaaacactgacttttcagattggttggagggaattaagaccaccaagactgagaagcaattccttaaaagctaggagagtgtttctgggaagccaagtggagagagtggtaacgatctactttgttctgaagggtcaaacaagataaagactggagagtgtccattgggtttagttacacaaagatcatttataaccttatgtaaagccatttcagtggtgagttggaagctgaaagagatggatattgctgggtatagattattctttgaaaaagttggattgaggaagaagggagaatgtggtagcttaagggagaagacactcaaatattggctgagtgaatacatgtgcaacatgaacctcctttagaaaataacaagcacaggctagcaggatcatctctgaggaggataggaggaggacctgttagggatatcagctgaaacatgaatagtctgggatcatagttttttgtgtttcctatgatgtgccagatgaaggaagaagaatcttgccagaaggagaaatgtcatttttagaacaatggtataggaatcgttgaccacccttacagaaccctcattgctgagaatttgatatattgttttctaactatcaccaagtatagcggaaagagtctgggattggagcctggtaatactgctttgctattttcttgtgttaggtcgcacagttgattatttagtcctaaagagcttcaatttcttcatttgtataatggagcgaatactgtctacgtcacggatttgttaggattaaatgacaatctgtgtatataaagtagcaggtatttagtaggcactcaataagctgatgtctacctgttttcttgcttctcatggtaacagttgtttattgtgtagtttcagcattataagtttgctcttagcctcaaaggaatcatttgtgggaatccttccttcttcatcttatcttttgtgtaaaataacttgagtgatacaagcatacatttctggggaaatggaaatattatttgctactgcaataataaccaataaataagtattttgccagtcgtttttggcatgtatgccttatatttgtgtgcctttaaaaaaaaagcgtgtgtgttttaaacaaagcttactaatttagatatgccaatttggtaacttcctgccagagtaagagtttttatgttttccttctgagacacaccttagtataactttattttagtttctgggccattgccatttggcataacttcaaactagatgtgatggacccacataaatacttttaagatttaaaattttttttatggtggggggatatgaactttcaaaaccagctgaggtgtcaggtctggattttatttggttgtttaatttttttttttttttgagaccaggtcttcctcactctgttgttcagggtggagtgcagtggtgtgatcacagctaactgcagccttgacctccagggctcaatttgatcctcccacctcagcctcctgagtagctgggattacaggtgcatgccaccacagctgactaatttttatacttgtttcttttgtagagatggggttttgttatgttgtctaggcaggtcttgcactcctgggctcaagcaatctgcctgccttggcctaccaaagtgctgggattataggcatgagccatgtgcctggccatttaaaattttttgtttgtatttttgattttcgaattttttttctacacatattttgaacactgagataactaattgtataccaaaatgactgaaatgaagtcagtctgatttccgtaagtttgattgctaaagcagtctccttaaaggtgttaaaatgtgctctcaatccccaccctacacaacatctgtctcccaggctgaagtgcagtggcacaaacatggctcactgtagccttgacctcctatgtttaagcattcctcacacttcagcctcctgagtagctggaaccacagatgtgcactgccatgcttggctaatttttaaaatttttgtcgagtcctggtctcactgtgttgtccaggctgggctcaggagatcctctcacctctgcctcccaaagtgctaggattacaggcattagccaccactcctagcctatgtatgaacctttacggaagttgattaccctagaatttttataagagcattagaatttgccagctttcttcaagagttaatataggccgggcgcagtggctcatgcctgtaatcccagcactttgggaggccaaggcgggcggatcacctggggttaggagttcgagaccagcctggacaacatggtgaaaccctgtctctactaaaaaaagaaaaaaaatacaaaaattagccaggtgtggtggtacctgcctgtagtcccagataccctggaagctgaggcaggagaatcgcttgaaccctggaggcagaggttgcagttagctgagatcatgccactgtacctccagcatgggtgacaaagcaagactctgtcttaaaaaaaaaggagtcattatagtagtaatactatagtaaacacatacttgatattctttggaatatgggccttactatgaaataggagaaattatttctttcccagttactaataagggagacttcattggttaagggaattttgtgggtagaattgctaagactagaaatctcattgttggttcaaagagagaaataagttaaccacgtgttctcacctgaatataggatgctttgctttacaagcttaaataatacccggacaaaactctacaggtcacaagttctttaaagacttaataaactctgtagaaactatacttcaaaggggaaccttctccttgattcactatcctgccttgtcttctgaaatttattggtttttgacaagcgtttgaagaaagaccactaaaatacagtgttgttaatatttggtgaaatgttcttgtacatacatctgttatagattttccaagttaaaaattacttttccattagaggagctccccataccttgtttctttccccaaaggggtgtgtgtgtgtgtgtgtgtagtttataatgtattttactcttttgactttggaaatacatagtatttcattgtataggtttggcacaatctactttttaactctaatttttagacatttgaaccttggatgatatggaatactgtcattagtaagttttatgttacctttctttctttctttctttctttctttctttctttctttctttctttctttctttctttcttttcttttcttttcttttctttctttctttctttttttttttttttgagacagtcttgctctgttgcccaggctggagtgcagtggtgtaatctcagctcactacaacctccacttcccgggttcaagtgatttccctgcctcagcctcccaaatagctgggattacaggcacctgccaccacgcctggctaatttttgtatttttagtagagacgggatttcaccatgttggtcaggctggtcttgaactcctgaccccaggtgatccacccacctcagcctcccaaattgctgggattataggcttgagctgcatcgcctgaccagcttgctttcttaaaaaatattctgattcctgaagtttctttttttcctttttattttttcgaggagttttgctcttgttgcctaggctggagtgcaatggcgctatcttggctcactgcaaccttcgcctcccagattcaaacgattctcctgcctcaacctcctgagtagcttggattacaggctgccacctgccaccacgcccagctaatttttgtatttttagtagagtggctcagcctgtaatcccagcactttgggaggccgaggtggacggatcacgaggtcaggagattgagaccatcctggctaacacggtgaaaccccgtctctactaaaaataaaaaaaaaaaaaattagctgggcgtggtagccggcgcctgcagtcccagctactctggaggctgaggcaggagaatggcgtcaaccctggaggcggagcttgcagtgagcagagatcgcgccactgcactccagcctgggcgacacagctagactccatctcaaaaaaaaaaaaaaaaaaaaaaaaaaaaaaactcaacacgtgttaaatcgctaaagtctgaagagcccagaaaagaaaataaatatcattagtaatattctcaccatcatccaaagattaccccttttaacattttggttgcttatctttccagtgctttttaatgtccatatacccacatttttttaaacccatgctttaaaagaaaaaaaaacttgtgatattactgcatgtatacatatattttgtaattttcaatataattgtctgaaattttaatggttatatggtatttcactgtatgtatttggtagaagtcactttgcccccatttttggatatttaggttatttgcaattgtgctattatgctgtgtacaacgtccttgtggaaactttggcaaaccttgggttgtccatctcaaactctctcattgtactctgtccttttcagcctgcttctctctcttttccagtaactcctttaacaacaagatcagatcaggtggacagattattcttcaaacaatttactattaggcaatgaatatgctggtttctgtgaattctgggattaaagagatacatagacacattttatttgcagagataaagaattacaataataaactaagtgttgtgataggtttatatatgtataaggtccatgggggctcggaaagagagcaggggttgtgagggcagtaggcagggaagaaagatcagggagtaagcatttattaatcctcttaatgtgccaggcactaagttaggcacattactaggctcttagtttgcagcagttctgggaggtatgtacacagtattattcttacttaccagatgaggaaactgagctcagacaggtaagtaatttgcccaagctcccacaagtagtaactgggagaaagccagaagtaaacccagccagatatacttgactacccaactctgtccagtactccaccctggcacaccaaaggattggttccaccagtagctgaatggaagctagaatggcaagtaggcattagctaggtggagggggtggggtcattgtgtagagcatgtcaagaggtttgaaataggtatgaggagtaggtgagatgaggcttaagctaaaatttaattgttgtgttttaaaaatgtatagtaagattgactcatttagtgtacagttctgtgaattcagataatatggaatttagtcctgtaaccagatacaatcaagatactgaattggtgtgttacctccctgagtgccctcattcttcttctttgtagtcagctcctcccaccagccttgacttttggcaaacagtgatgtgttctctatcctatatgtcatataaatggaatgtcatataatgtcatataaatggaatcataaaggctatatagtatgtagccatttgagtctagtctctttcacatagcataatgcgtttttgattatgccaagtactgtgatgtaaatgttactgtacagttttgctgtaggtttttgtccctttctaaatgtgcttatatcacttctaaccctagttccatgtaaacagaatgttttttggcaaagaagttattaagttatagcttcaaataccatggaagccctaaatagtttcccgataagtggccaggagaaagtacaattgaaaaaaatcagctgtctctcccagtaccctttacctcagttatctccttgcttttgacatataaaaatcacgtggccggtttactactgattgtgacctttgccatcttaaaagggaagagaaagaaagcgaacagctgtaccatgagggagtggaaggaattaatgttgttcttggccagttggcactgttttcttgtgcctttctgggaagggaacaacaggtgagaaggtttgctttttgtttttgttagtgtataaataaataggttaacttgttttttatttgtgtggaaatgtgagagtccatagtgaagtaacttgccctaatagctcgtgattttttaaaagctcattaaatatatacacaaatttattttaagtgtcttaatgaactaagctactccaaggttgaggatattgtaggcaattactgacgtaaaactacaaatgtaaaaaccatctttggtaagtgtcacttatatcctatatcccaactgctttttctcccttttatcctaattttaaaataaaaaagaaaagataacgaagaactttttataataaaaccatgtcagccacagagagatggtgactgtaagctaagtgaccagaatgtaggtgcctctaaaagttgagggtgcactgttctttgaattcttgcctgttaacacttttcataacatctctgtgaatcacactcaaatatactgtacagtgctatcactgatacctctcacctgccaccaggctctgccccttccctaccaataccttgcacaaattcattgtcctgaagcacagctttcttgctcaagaaccagtgttgatttttcatttcttattgaaacatacacaaattgtttacctgaaattgaaaaccttcatgctgtagttttgctttgcccattcacatttatttctctttgttactcattcccctctacgttactttagtgaaatcatcctgttttttagttgtctaacagcagattgagttcagttaccaatttttaaattcagttctaattccatttcacattgtagttgttttgactagtttttttctactctattaaaagctctagttgttctctgctctcctcacttatctgactctgaaatcttctaaatggtacccactttatttagaacgttttagggtcaaataagtacaggttggaatcctgagtgcaccacttaactattgaggctgacagccagtgtacacctgggtcttcacttcccctgccccatgactcttcattgtcttagtcccttctatggacctccctatgatacctcagctaaaagtttgaagcagaacccagctcctctagcaccagctagtgtctgttctgagtggccgatgctggtacaagtatgagttattaaatatttttaatttcaccctgtttattatatgtatgattttaattaagttacttgtcctttctgagccactcccagatctttaaaatggggataataatacctgttttgcaggatgactgttcattcatcaaatatttgttgaaggcctgccttgttctaggcaatgacttaagtacttgggatatattggtgaacaaaacagaaatgtctgtgccttcttggatcatgtgttttagaattatgagaattaaatgaaaataaatattcaatatggtgccagacacatagaggtgcccacagtgtcttatctcactttcttcctgcttgccatatcttttccatcagggccaaagagaatgggaagtgggaagaaataaacttcatatttcatttgtatagctgtggagagtagcaggccctgggtccctttggggaggtcatgcgaactgggcatggccttctgtcaagaattattagaccaggcatggtggctcatgcctgtaatcctagcactttgggaggctgaggcaggaggattgcttgaggccaggagtttgagaccagcatagccaacatggtgaaaccctgtctctaataaaaatataaaaattagccaggcatggtggcacatgcctgaaatctcaggtctccaggaggctgaggcatgagaattgcttgaacctgggaggtggaggttgcagtgagttgagattgtgccattgcactcccacctgggcaacagagtgagactcttgtctcaaaaaaaaaaaaaaaagttttcagtgatcagtgtgcagatataggtggactaaaaaaatcatcagtgaccttttatctgtactttgttcttttactactcaatgagactgagagcctgctggattcactaagaccaggtgaacccagagggctctcggtctcattgactcaattgggtttgaatctcaattctgcaacctacgtggctttgggcaggtttcctcattttcaaaattatacaataatatttaccttttaaacttattgaaggattggaaagctgtaacacctagcatgctgtcgtggcataaggtgggggttaagtaaaaagtagctactattaacatttttgaaaagtgctccttcattttccctgctccctttcatactcttcatcctactttcctggtagttcatttcttcttagttggctgttgactttctcttttctttccaagattatggctcatgccactttttccgagcaatcttaaagtctcatggcttcagctatttcctttataactgataattccagatattcatcttcagtctgtattcttttctgagtgccagatatgaatgtctaggtgtgtgctagacatgaaacatgtgccaaatgatcaggaatgataatcaggatggagtctgtatacttgacctacagaggaaacaagctgtcttatctggcaaactttttagttttgcttattaagttggtaaaattttgaatgactttctttactcttggacatctaatgatcttttgtaaagaaggggaagagaaccctttctgttcagaaataacacacaacttgattagtaggagaatttttcatgtgattctggaaagaatttgcaacacctgtttccaaagaaagcaagaaatatattgcatatttttctccccaaaatgtattttgtccaaactgaattggacacagagaacattccttaagtttggaataaataaactttctgaaaactgctcaggtaacaaagtagtaaagagccaaaaaaaattttatttacttctaacctttgactactaaaaggagaaaatgaaagggttcatggaagcaaacttcacaaaagtaactgtagacttaacttgtcagatccaaatatacatgtagaaaaatgtacaaacatggttaaatttacatatgccggaattttggggggaatggaatgtgtttcttacatattagttttatttattacctttttggtaaaaaatcagctcctagaagcaactcccacactgtttatttttcttatacattttgctgaggtttcaacatttctcttccatagtttgcagcaggatggctacttaaccaaatttaatagggttaagatttattgtgtgtatcacatagagaccctggaagttaggctcctttcctaagagagaggctgtgtaatgtggtgaaaagaagagaaactttttgttaaagttttggtttccctgcttaccaactgtgtaatactggattatctgccttagtgttcactcaagtgctgtgcacttgggtgagttacttagtgtctctgagtttgatgaaatttagcccagagatacaattagtgccttttttttttttttttagtaatttgctgtatttgtgtcttcttttatattcttaagctaaagtaggactgaccatttcatcagcctgtttaaaaaaaggcatttggttttgttgatagtcttttcctttatttttcatttccttaatttctgttctatattgcttttagtttcttgagcttttaaaaataaggtttttgttttgttttgttttgttttgttttgagacagagtcttgctctgttgcctacgctggagtgcagtggcgtgatctcagctccctgcaacctctgcctcccaggttcaagcgattctcctgcctcagcttccagagtagctgggagcacaggcatgcgccatcatgcctggctaatttttgtgattttagtagagatggagttttgccatgttggccaggctggtcttgaacacctgacctcaagtgatccggccacctcagcctcccaaagtgttaggattacaggcgtgagccactgcaccagccagttttattaatttctaatgcaggaatttaagggtttacaattttcatgtggtattttagctgtatcctttaagtttcgacttgtggtattttccttgttcacttttaactattttgtcattgaccttttgacttttcttgacctgtgactcattgactcttaagttttcaaacatagatattttggggagacctttttttttctccgttacagaattgttaagattagagataatatgtgggcaaatatcaggcaaatagtagatactcaataaatgttttcatttttccttaaagaaataaacctctgctatttgtttttttttttgcgtgtgtatagatgtgtagagatgggagtctccctatgttgttcaggctggtcttgaactcctggcctcaagtgatcctcctgccttggccttccaaagtgttgggattacaggtgtgagccactgcaactggcctaacgtctacttttgaaatgagaatgggaaatacacaattgccaataagtgtaaataatactaaaagtgactttagttctgcatgatagccaattgagtagatgaagtatagaaaatatagggggatgataagaagagggtaaaattgggaggaggtaagggagagaaggaaatttagcccttccaaattctttctctagaatttagagaggatggctcacacctgtaattctagcactttgggaggccaaggcggacgcatcacttgcgaccaggagtttgagaccagcctgggcaacatggcaaaatcctgtctctacataaaatacaaaaattagccgggtgtggtgatgtgcacctatagttcaagctactcagaaggctatggtgggaggattacctgagcttcagaggttgaggctgtggtgagccatgttggtgtcactgcactcaagcctgggtgacagagtgaaacactctcaaaaaaaaaaaaaaaaggaaagttaggggaaaaagtggaaatatcaaaagtggaaatatcaagtgttaattccagtcttctgtgaagtcatattctgctgaacagtttagtctatgggcttctatatactaattattttagattatatttcttacactttagtaatagaagtgtccttagatgacctttagtgtgtatgtgtatgtatatgtaggtgcatgttgccctgcatggcaacaaaaattttgtttttggggaaagggtccctagtttcattagtctttttttttttttttttttttttttgagatggagtcttgctctgtctcccagactggagtggagtggcacaatctcggctcactgcaacctccatctcctgggttcaagcgcttctcctcctgcctcagcctcccaagtagctgggacaacaggcgtgcaccaccatccctggctttttttttttttttgatacagagtctctgtcgcccaggctggagtgcagtaggacactgtctgctcactgcaacctccgcctcctgggttcaagcaattctctgcctcagcctaagttgctgggattacaggcacctggtaccacacccggctaatttttgtattattagtagagacggggtttcaccatcttggccagcctggtcttaaactcctgacctcctgatccacccacctcagcctcccaaagtgctgggattataggcgtgagccaccacacccggcctaatttttgtgtttttaaacaaaattgcctgatctcaggcaatccacccacctctcaaagtgctgagatgacaggtgtgagccaccgcacccgttccattagtcttaaggaggtccataatccccaagaaattaagaaccacccctccctccctcctctcccattcctccccccccttcctcccccctctacttcctcccccctctacttcttcccctgccccctctcctcccctcctctctcccctccccttcatcccctcttccctcccctccccttcctccccttcctccccttcctctccttcgttttgagacagcctctctctgttgcccaggctggagtgcagtggcacgacctctgctcactgcaacctccacctcctgggttcaagcaattctgcttcagcctcctgagtagctgggattacaggtgcacatgctaccatgccagactaatttttgtatttttttttagcagagatggggttttaccatgttggccagtttggtcttgagctcctgacctcaggtgatctgcctgcctcggcctcccaaagtgctgagattacaggcatgaactaccgcacccagccaagaaacaacattttagacttcattagttgagataaattgagaagcttaaaaggaagtaatttattttttcctgctctgatagtaatgactacttcccacttgagtgagatttggtgttccttttaattcctcacattacagccagatgaccaggcaatatactaagatcaggatttgacttttaatgtagtgcaacttaaaactactgaacatgatatgttataagcataaatattgtaatacctggtatgaattacaaaactgtaaatgcctttgattagtaaagttttgatacagctaagccaagcattttgggcctcacctgagggtaggaacagttctgggagtaagaggaagcagttggtagctgcagtggagatgcgatactgtaaaaggcagctttggacagccagaagacaagaagacactgttgggttagagatgaaaggttttaccccaggacaaaagaatagggaagacctgaggctggtgagagaggtaggagggtacccagtcatacttgactggctctcttgcttccctttacatgaaggcgtcattgcctgaaaagagaagctagctcaggattctaaaatttgaaggatgaagcagtgataggttcttcagaggaagcactaaatgtatgcacgtgggggagtttttttttctgagcactggctcacaataaaacctatgtttactcaagtactttataattattccctcttatgtttctggaatcaaaattagtgccttgtgttaatatgttttggaaatttaatgctcaacctgtcagtttatttttaaccccctagatctgcattatccagcatgagatccattagctgcatatagcaatttaaaattaaattaattaaaatttaatacaattgaaagttcagtccttcagtcacactagccatatatcaagagctctgtagcctcatgtgactagtagctactgcactggacaacacattgtattggacattttttttttttttttgagacggagtctcactcttgtcactaggctggagtgcagtggcacgatctcggctcactgcaacctccacctcctgggttcaggtgattctcctgcctcagccttccgagtagctgggactacaggtgtgcgccaccatgcctggctaatttttgtctttttcgtagagacggggtttcaccatgttggccaggatggccttgatctcttgacctcgtgatctgcctgcttcggcctccctaagtgctgggattacaggcatgagccaccacgcccagcctggacatttcttttatcacagaaaattttattggctagcactgccctagataaaattatgtattttctttcctttttctcccatcagactaaagctggtttatattaatgcgtaattaactttgatatttgaaagtaaaaaacttgaaaggcttactagagtaatattcttttgctttttacataattaaaaagacagtgccactcttttataatgatctgcctgagtgccattattttataagatttttcaagaagtggtgactaaatcaaagcactgttatggcttgtatttatccccttctactgaactcttgagtctcaaggttatttctactctctctgtaagcatgtctggaagggcccaaaatgttacaacaaaatttccaatttaaaaagttagtggcggggcacagtggctcacgcctgtaatcccagcactttgggaggctgaggggggtggatcacctgaggtcaggagttccagaccagcctggccaacatggagaaactctgtctctgctaaaaatacaaaattagccaggtttggtagtgcattcttgtaatcccagctcctcaggaggctgaggcaggagaattgcttgaacccaggagttggagttggcagtgagccaagatcacgccattgcactccagcctgggcaacaaaagcgaaactctgtctcaaaaaataaataaataaattagctttgtttcatacatttttaaggaaatcatcatagatctctaaagttgcaagagagggaaaatcgccaaaagtaattattttgctgtagggctacttctctgagaacctatcaattaggcataaaggctatacgttagtttttactgctttgtgtttttttgtttatttgtttgtttgttttttttgagacggagtcttgcttttgttgtccaggctggagtgcaatggcatgatctcagctcactgcaacctctgcctcctgggttcaagtgattgttctgtcaaagcctcctgagtagctgggattacaggcatccgcctctgtgcccagctaatttttgtatttttagtagagatggggttttgccatgttggccaggctggtctcaaactcctgacgttgtgatccgcccgcctcggcctcccaacgtgctggggttacaggggtgagccaccatgcctggcctgctttgtgttttaacagagtaagaaaatagacttttcctttgctctagtttcaatcttcttaatataggtaggactttttcagataaatttatgattaattacaaggaaaaggatagtatggatgatttcaggtaagttataggcataatttcaagaaacaaaaaatgtttttattgtgatagagcatctcaaacacctttagaatctacctctttttcctgttccccccgttatttctttgtttcaggcccttaacatctctcatatacactggtatttcttgcctctggccttgccgtctattctgtcttcacactgcttttttctttacacagctcttttcacagccccctcagttagagtacagattggattgtgtgtctccctgctacccacagaataaaacttcaaatgtgatgattttggtcttttgttttattataaaatattcaaacatggaagtatatacagtagaaaataagttttctccctgatttgatttgtattagtaccatctctgctatttagcccccactgttaaatttgactggcttaaaaaaaataccatctctgaagataactacttagaagttggtcatatgtttttccagacttcccaatgtttatttatatataaacataaataattttaggccaggcgtggtggctcacgcctgtaatcccaagactttgggaggctgaggcagggggttcatgaggtcaggagatcaagaccatcctggctaacacggtgaaaccccgtctctactaaaaatacaaaaaattagctgggcgtggtggcgggcgcctgtagtcccagctactcgggaggctgaggtaggagaatggtgtgaacccgggaagtggagcttgtagtgagccgagattgcgccactgcactccagcctgggtgacagagcgagactctgtctcaaaaaaaaaaaaaaaaaaaatttttagagaaatcaaattataccatatatgatgtttttacttattttgcttggttttatgctgtatactcattgattatatttttttgttttaatttttaatttttccatattttatggtaggatgtcaaatataaatatatctcttatatctgagatataaatatatatgtgaaatataaatatattctaccggattttatggtaggatatttgaaatatatattcttttatggtattcctataagaatatatttatatttcaggtatatatgcaagtaccttagcattgcggtgacttataataggtgctcagtcaatgtttgtttccattcttcttggacatatatgagaagggccatataagattattaactatttatttattttttttttgagtagtgaaactctaaagactcacagtctgaggactcatggagttgttcacatccatgaacaacaatgttatgaatcttttagttataaagcaaacctttctctggagcatgtttgtgttttctcatttaggtttataaattgctctgagactagcaggattgctgtttaagagtcttgtgaggtaggctgcctgattattttaggtgcttccagtaagagcagatatttttttactggtgaataagagaccacattataatttgtcctttttactgagagtgcatagtatattgtatactgtaaacttgtatagtatgtgaaaactttttacatgggaatcttggaacaaagtcttagatgtctaactcgtttgctaactctgaggatgtggaggatggatatggacataggaagttcaacatgtgtatcatggagtgggatatgtaggtgtgtaatctatgatacagtttcagatctgagagtttctagtggttctagagaagagaacaggatggatctggagctgttgttaattatttgtaaagtcctattttgaagtgtgattgctttttactcttcagcatctcctttggaaatcttatccctctactttcctgcagggagtttgttttgggtggatcagtaaagaggatgcaattggggcctcaacttcttttctcattgaggaaagagtgaggggtgctgctgagagctcagtgcttctacagtagccatatttgaaggtttgcttagaggtaatgctggagcgtacacaaattgccttcaagattccagtagtttgtgatttaaaaatttgtttgagcagttaacatgggtatattcagtttgtttatttttgttagcagtttgtgttcccaatggaaaacagcgtgagaaagagttgctagagtatagaattgtaagtgcttccctagcgtgttcttggacttcagattgttcacctttttttttttttgtcccttcttggtttgtttgtttgaacttgagccctttggtgtgacaagtcacatacagcttttcaggatctaagtttatggttacataagattattgtttatatgtttcagaagctttgctcacttgtttattcattcatttcataaatattccttgaaatgcttactgtaagcaagattatgcagggcatgttattaggtggtaattagggaaagggaaaaatggaaattatattttgcagatacaacaaaggctgaagaggtgtgtgtgtgtgtgtgtgttttagatacacacacatctatatgtacacagagacacgatccacagttgtgtaggaataacttcctaaacatctttaggatctacctctttttcctgttcccactgttatttctttgtttcaggcccttaacatctctaatatacactagtatttctgtcttcacactgttttttttctttacacagctcttttcatagcccctccattagcacacagattggaattgtgtctccttgttacccacagaataaaacccaatgttcttaatatgtagtcttaatatagactctataaatagcccctttgttaatctatcttgaattactcacttttaggtttcagctccctactgagaccccaactggctttaccttctgttccctcctggttctgcttatcttccattgcccctgtggacctgctttctgtcattgccttccctgccctcagtctcaggagcctgagactggcttctagatgggtttggacaatggatagcactggcaggaggagagtagagttgctgtgtttattttcctggtttcctcctgcaagatcatgtcatgttggctctcccagagggcatggctcatatcatggggccctctttgtctttccaagtctgtagatgatagcagcttcaggaggttgcactatcttttgactgtgcccacacccttcacaccttgtaaatagtccctttcttaaactctccttaaattacccagtttgggggtgctatctgtttcctgctgggatcctgatggctgtgttgcccaaacctaaatgtcagtcatgcttgcagttacagctgtgttattttcctgtagtactgatttccctcttttattaaaagttctgtggtggctgggcatggtggtttatatgtgtaatcccagcactttgggaggccgaggcaggaggattgcttgagtccaggagtttgagaccagcctaggaaacatagtgagactctgtccctaccaaaaaaaaaaaaagaaaaaattagccaggaatggtagcacaggcctgtagtcacagctacttgggaggctgaggtgagaggattgcctgagcccaagagttcaaggttacaatgaactatgatcctaccactggactccaccctaggtgacagagtaagacccagtctcttaaaaaaaaaatttctttgaggtctttttcattcttcacctcttttagtcttttttcctttcttctttcttggcgttgcagctgccatattatggcagtggaaatgtttgaatgaataaggaggggatggacatctgagtttccctgttgtgtagcataatattcatttaaatgtctgaaatgagatctttagagaaaattgagggagtgggtacatgaatcagtgtagtcactttaataacttgatttttatttcattgttttcaaaataaatttagtactttttctttaccttctacatattagggattaacattgatttactttagtctttctctttgtaaaatgcattttagatttattccattggaatattttgtaatagcacatatttgaggaagtatgtatgacatatatttaataaaatggaagaggtttcaattatcactgaattgaggagaatatgggaacatctgtttacatctatccaggtattcatgtgtctgttttcctcaacatatcataggagtagtgcactaagagcagacatacatgcctaacagttgtgtttagcaagatcaaaatatgtatgtggtactgtcacccatggccctgataggaaacagatggcatattcaagctggataatttgaagaggattaaatgaaacaagtattcacaaataggtgggcagagtttagaaaatcaacaagagatattgtagtatcctgggctagcaacagagaggatgggaatattgccccatagacctgaagtgcaaagagaaggagtgctacctcaaaaagagagctttgtggagaaggctgcctgatagcagctgtagtcccaggtagagggtgagccaccacgcccggcggttattacatagttttaaaagtgactcctcttaaggaaattttaattaagagaaaaatatcctagaactatgattagggtcaaaacagtatctatgttctttaggtattaaggaaaaagtgtatctgtcctaagaaagtgtttataaggagaagagtcttcctagaacactaactttaacacagaactctcatcactactctaaaaaattaacattaaaaataatcttggccaggtgtggtggctcatgtctgtaatcccagcactttgggaggccgaggcaggtggatcacttgagggcaggagttcaagatgagcctggccaacatggtgaaaacccgtctttactgaaactacaaaaattagcggggcttggtggcgcgtgcctgtggtcccagctaatcaggaggctgaagtcggagaatcacttgaaactgggaggcagaggttgcagtgagccaagatcgcacctctgcactactccagcctgggcgacagagcaagactctgtctcaaaacaaaaacaaaaacaaaacaaaacaaaacaaaaatgatctcagtagcagataaagactattccattgctttttggaatagtgatacctgtttactctggagggatggacattcctctgtgtgtgtgtgtgtgtaatacatatgaacaataggggacataattttgacatatttaacttgaagaaaggcatgcttagacaatgacaacccgatattgaacaatgctcaatactaagtttctttatgaagataccattgttgtattagtggagacggtataatatattctcagtaaagacctcagtctttactcagttctcatgctccttgatgtcttagcatttgatatattagatttgccatgtactagatactctgagctttggtttttgtatcacaacattgtcctacttctctattgttcattcattcttttgtttaaagaatggccagactatgctgctgaacaagacagacacagcccttgccccttggagcctgtgagcatcctttcttcctctcctatagcctcttttcatgttttctctgtggatattagtccttagctaattgctttgtttcttttagtcttgatttgccttctgtaagaactgttttattctcctagcttaagttgcaaattctaatgccaacaacttacacatctttctctacttctgatctttaccctgaattttattcacttagccatttaatacattttttttttttttttttggagacagagttttgctcttgttgcccaggctggagtgcaatggcgccatctcagctcaccacaacctctgcctcccgggttcaagcgattctactgcctcagcctcctgagtagctgggattttgggtgcccgccaccatgcccggctatttttttttttttttgtattttttttagtagagacagggtttcgccatgttggccaggctggtctcgaactcctgacctcgtgatctgccagcctttgcctcccaaagtgctaggattgcaggcgtgagccactgcgcctggccaataaatttttgttcagatctgtgtgcctggtacaaaggatacaaaaatggtaaaggtagcctttgccctcagagttgctgacacacacataaaaagttaaagtacagcgtgatagacatatgtacatggtgccatgggacagataagaagggagtacctggcttggacttgaaggagaaatgagagagcaactatccgcagtagaaggctgagcatttcaaatccctgtgaaacctagggttttgaaaacagtatgtttcggcaacagcaagtggttcagtgtgattggagccttaaggggacagtggaagatgaggctgagcatttagggaggtgccagattgccccaaaggcagtgttctcaatactaaactaatgttcttccaccataaatgagctccccctggcaacttctcatttctatcaatggaactttcgttcttcatatgtccaaaccctgaagtgccatcttcaggtctgcctcagcatttgtgatcagtgctcaagttttgtatcatttctatattcaaaacattcttctctgcatcctattctgtttccactatctacacactacttatcacctaattagtagataatttcaaaactgtaaatatttgtgtttcttcttgctctctctctcccttttttttttttcctggaagttaatttctaaaattcctcattttaccatgttgctgaccctgagcaaaagaggacagtgatattttatttcctacaaacttacatcctttccaagtgttttaaacccataatcctttttctttctttggagttgggagtcttgctctgcacccatgttggaatgcagtggcataatcatggctcaccgtagcctcgaattcttgggctcaagtgatccttctgcctgagcttcccaaatgtctggactataggtgtgtgccactatgaccagctattttttttttttttttttgagatggagtctcgctctgtcgcccaggctggagtacagtggcgcgatctcagctcactgcaatctctgcctcccaggttcaagtgattctcctgcctcagccttccaagtagttgggactacagccactacgcccagctaattttttgtatttttagtatagatggggtttcactgtgttagccaggatggtcttgatctcctgaccttgtgatccacccgcctcggcttcccaaagtgctgggattagaaacatgagccacctcacccagccacccagctaatttttaaaaatattttttagagacagggtcttgctgtgttgcccagaatggtcttgaacttctggcctcaagtgatcctcccgcctcagcctcctgagttactgggattacaggtgttagtcaccatgcctgagtcctataatcttttaataaacacagaaatctcaagcactgttattcccatgaaaaaccatagaattgcagaattcagagataatctatagcaaataatacactgttccattaactttcagttttttcttcttcttttttttttttttgagacagggtcttgtcctgttgcccaggctggggtgcagtagtgtgaacatggcttactgaagcctttacctcttgggctcaagggatcctcctgcctcaccctcctgagtagctgggactacaggcacatgccaccatgcccagccaattaaaaaatttcttttgtagagacgaggtctcaatatgttgcccaggctagtcttgaactcctgaacttaaggggtccttctgcctcagcctttcaacgtgttgggtttataggtgtgacccaccgtactcagcctactttgagttcttatcgtgaacacaacatgtattatactgagtgaggtttttaaaggacaggttccccttctcccaatcatattctaacctgttaacctagccagatcacttgtctccatgggaggccgtatattccctaactctggaagagatagcttgtgttggaatcctggttccaccacttcctagtttcagcaatgttcctcatttctctaagcttcaacaacgttatatgaaaaaagcaggtagtgataatacctacttcacagaggtgaggtaaggattgagttaatctatgtggcctaattcccagcatgtgcaagcatgcaatacatgttggctacaaaatgcgtgtaccttgaaaacttcttgctcattccctttgtgctcttgttgatgcaattctcatgcttccctgcctccctctaccactaaatggtctccctgtgctcctccctattgcttgtgttttacctgtcatttcaccttcaactcagttgcctcttctttaatagtcttttctaactcctccagtctgtattgacctctgaattcctataggtccttctatgccattttagtaattatattcctatttttatggcatatttctgccttttatggtatttcttcttaactttacatgcaataaaagagttgtggaattaccatctcaatcaagatacagaacagtttcatcattttccccaaaaaatctaccttgggatttgtttttaaacaatttactgggtatacattatttttctacatatacaatttaggttcttgaatttagtattggttttatacaaatttgtcttccctaagtatggcttagtattgcgcatatagtgagtgagtttgtataaaacaaagcctaaaagcatggtaaatttgaatatcttaagaagccactaatttaaattatttaactttggtctttcagggtcattttatttaggtgcaaaatttcaactgaaattattttggtataacttgttaaaagtggttttggagccttgccagggctaataaaaccgggtgtttgtttgtctttggaaaacaaaaggctttttctttctatttttattactgaatatatacttgtggttttatcattttctttctctctctttttctttcttttctttcttttttttttttttttcctgagattgagtcttgctctgttggccaggctggagtgcagtggcacaatcttgactcactgcaacctctgtcccctgggttcaagcgattctcctgcttcagtctgcccagtagctgggactacaggtgtataccaccatgcctggctaatttttgtgttgttagtagagacggggtttcatcatattggccaggctcgtcttgaactcttcatgtcaagtgatctgcccaccttggcctcccaaagtgctgggattacaggcatgagccacctaaatttttacatgtttcttctcctggatgacatttggttgttatgatattaattactaaatttatttatggaattttgccttttttcttaaacacagtttaatgtaaagcaattcaattaaaaatgaattaactacagaatgcaaaatggaaaaccttcctgttttctcagctttatttttccatgggccaattttgctctcctccttgtggaagtctcttttattgtttatttctaaaatcggaggtcaatgcaagtaatagtatttatacttggaaaaaggtggggctgatatggacaagcaaatgatgctgcatgatttccttaatctttgcccttgggtataatggagatccatctccagagagggcaaaatatggctaggatttgcatcccattcagtagactttacttcctaatgaagtgaattgaatttaatcatgtgtgtctttttttcccttccccaacagcttccatgcctatggctgttctaaaattgggccaaatatatccatttcagagaggctttttctgtaaagacaacagcatcaactatccgtaccatgacagtaccgtcacatccactgtcctcatcctagtgggggttggcttgcccatttcctctgtaagtaaattaataagtaggtagtgatgggtttgttgtgctggaggttggatgaagcatggagttggggcgggggtaaatccacagtactgtcttcaccagtgttgatatggtgaatgattgcttgaggaatatacccactgttttagtccagaggcagtgtttctccagttaaaggtggatgttacccagaacaacttgatgtcattctgaagaatgatagaatgattatttttgaataggagagtctttttgagtcatttggatcaactcctctcagtaaacaaatgaagaaacttaggtccagacacttgttaaagcccagtaagctatcgtacggcagagctgaaactaagattatgcttgctttatcatactgttaagtggaaattgaggccatgaaaaaggaaaacgtttgcatattaaatttgagaaaacaaactcagcagaaagaccacaaatatatgtgcaaaataaaattatcagaatacattaagatatgtcactattggccaggtgtggtggctcacacctgtaatcccagcactttgggaggccgagatgggctgatcacctgaggtcaggagttcgagaccagcctgaccaacatggagaaacctagtctctactaaaaataaagaattagccgggcgtggtggcgcatgcctgtaatcccagctactcgggaggccgaggcaggagaatcgcttgaacccaggagatggagatttcagtgagccaagatcatgccattgcactccagcctgggcaacaagagcaaaactccatctcaaaaaaaaaaaaaaaaaaaaaaagaaaagaaaagtcactatttcttactttgtactgtccttcagatagttcatcaatttgtaggacaatattgggcttcactgttaaataattaaaattttcattctagtttaagattcacaaactaggttaagattgccacttgggatattatgcctactttctttacccttggctctcattcctaaatcttgccattgtcattttatgtgacttggaaatagaagggaaggagcaaggtgaagatttacctccttgagtgtcttggcagtgcagcatatcacaccttatttctcctctggccacctgtcttgttacttgcctttcctagatatatgacttacaaaactttagtgtctcagtaaactcagtagccttgttctgctgtaggactggctggcttttctctctctattttgcctccaaattggctaagaataataacctagttgtttgttttttcagcttatgtatctgagttcattttgcctttttgtctggtagatttttttctaatgggctgcagctcagtattttgaaggtgaaggggtccaggattttattatgttctaagaggtataagtattaatatattcatataattctaatttgattatagctacttttatgggagtaaaatgagaaaaatctagcatttagtttaaggggatacttctttttctaagaaatacatcccaccataactggttacttaaattttagttattcagcttaggagaaactgtgtgcagggaagtactgccacttggatgacaatagacggtgtttctgtactatatgaagtactaagtagttgtggtagccatgattctgagcaactgttgccagataaagtttcttttttaagaaaaacttgcccctgtatttgaggagataattgcttgagagtgaataaattaattgtaataataacacatatatatttttgagatggagttttgctcttgtcgcccatgctggagtgcaattgtgtaatcttggctcactgcaatctctgcctcccaggttcaggtgattttcctgccttagcctcctgagtagctgggactataggcgtgcgctgccatgcccagttaatttttgtatttttttttagtagagatggggtttcttcatgttggccaggcaggtcttgaactcctgacctcaagcaatctactctgcctcagctcgggttcaagcgattctcctgcctcagcctctcaagtagctggaattacaggtgcctgtcaccacttccagctaatttttgtatttttagtagaaatggggtttcgctgtgttggccacctggcaacatgccccctggcccatgatcttttattaattaaaaaaattattataaagtagaaagagaaaataaatagcccttagttctactacctgaagacaactactggtagcattttgatgtttcctttagtttgacacatttttttgttgttgttgttgtttgtttgttttttatttttatttttttgagatggagtctcactctgttgcctgggctggagtgcagtggcacagtctcgacttagtgcaacctccgcctcccaggtacaagcaattctcctgccttgacctcccgagtagctgggactacaggcacacacaaccacacctggctaatttttgtatttttagtagagacggggttttaccatgttggccaggctggtcttgaattcctgacctcaggtgatccacctgcctcggcctcccaaagtgctgagattacaggcatgagccaccacacccaatctagtttgacagtttttatatcattatgagcacaccacagatttagttttgtgctttgtttttttacttatctttataacaatttttttttttttagttatagtattataatatcaagcagcttaaatagcaatagggctaaatttttttttttttaaggagtggaaaaagacttagtatcaatctttttatcaatcttagtatcaaactttgattaattcctgtgagtttgctgttaggattgacctggaaaaatattttaatgccaattatttatttatttgtttgttatgagacggagtcttgtcctgttgcccaggctggagtgcagtggcatgatcttggctcactacaactgccgtgcaataccaccacactcggctaattttttgtatttttaatagagacagggtttcaccatgttggtcaggctgttctggaaccctgacctcaggtgatccaccagcctcggcctcccaaagtgctgggattacaggcgtgagccaccacgcccgacctaatgccaatttatttttaattaaagaagtagtatttggccagtttctgggccttaaatgtgcttgaatgtgcaggaaggaattcttgcaaattcttagggtagatttgtttgttttaatagtttgtgtataacatctgttatatatagaaaataatttattttctataaaatgaattatttatgcttaacataactttcatataatgtgccttataatttgatcagaattaagatttggggtgatagaaaatctatattttaaagcagtgatttatttttacaatgcgaggttcataatctttttaagaaatatattatttactgtttcttctttagctatccaaaaaggtgccatattcagaaaactatagatttctgcattatttggcttttacattttttttttgtttttgggttttaatgatccatattagatttgacaccagacttttttttttccatcatttttggctttgtgtagttctaccttctcccttggtaattcattatacatttacttttataaattcttatatttctagaaaaaggcaagactttttatgtacaaactttcagagtaatgatagtaacaataaagttagtattaaatctcaaatccatatgttgcaatgaataatatactttgtctaaatttaaaaatttgtagtttcaggatagaaaacttacctatgtttaataggctattttaaatcgacttgagtactgactgtaagtagttgcttttcttaagtgatgattactgtatggcataaccttttagcaaaaatacttagcctaaaataacagtatagccaatgtttgtgaccaacttattaaactttttctaaagagtgattgtattacttatggtgacctaaactggaaatgtacatggatgtttgtgaaaagggcttaatcacttttttttttttgaggtggagtctcgctctgtcgcccaagctggagtgcaatggtgcgattttggctcactgcaacctccacctcccgggttcaagcgattctcctgcctcagcctcctaagtagctgggattacaggggtgtgccatcacgccttgctaatttttgtatttttagtagagatggggtttcaccatgttggttaggctggttttaaactcctgacctcgtgatctgcccgcctcggcctcccaaagtgttgggattacaggcgtgagccacggcgcccgaccaaggcttaatcactttatatattttatgttattttattgtattttttgagatggagtctggctctgttgcccaggctggagtatagtggtgtgatctcagctcactgcaacctccgcctcctgggttcaagtgattctcctgcctcagccttccaagtagctgggactacaggcgtgtgccaccacaactggctaattttttgtatttttagtagagatggggtttcaccatgttggccaggctggtcttgaactcctgacctcaagcaatccacccacctcggcctcccaaagtgctgagattacaggtgtgaaccaccacatccagccactttatatattttataacttagtgaaaaacagatgactacctcaaagaaaaatggggaaagggcatgactagaaagctgtcagtggaagaaaattgccaagaaatataaagaaatgctttaacatttaacatttcttaagactaagtcttaagaaatcaaagtttatattaaagcaacactgagaacacagtttggcctgtcacagtagcaaaggtaagaactttcccagcttatcaagcatagaaaacaggtgttctcatacacaaatctggcaggggtataaattggcattaaaaagagtatattgttgaacctataaattatactggaaggaatttatcctggaaataaaagtttcatatagagaattagttggaagacagctgattacagtactttttatagaagaaaattggaaataagtaagttcagctgtaggggactgttttatgatttattctagtgatgaaatattatgatatttcataagttttgataatattgacatagaaagatttttgtaatatattgagagggagaagaatagtaatcgttctttctgaatagtgggattattagtatatgagatattttcatttggtctcttatattttctgtttttcccctcccttgaacattgttttttcaaataaggaagcctatttttattttttaaaaacccattagaaatttttctgttttcatttttcatatacctgaagtttaaatgccttaactatatacccatttttacatagcattgtggaagcttaactgttatgtgtgtggattttgtctgtttctaagaaagtgccaaaagaaaaaaaaagatcaaaataactatgttttgagatttcacagtaaatcaaacttcactccttgtcctgtggctcagcagtctacgtagctgactaggctttttagaagtgattggttgtccgttaacctgagtggatctacacatacccatgtaactccttgaatgtggaaagtttgtcttttgtgttgcagcatgctgtaattcaattctgacactaaccacctggagttagcatgagactccacggatttaaggtcattgtccccaataagactgctttcactgtagttttcaggtgcaaatttgaagttccccaggctgcaactctgggggttcctgtgactctgtcaggttcagtaataggctaaaacaactcatagagctcaggaaatcattttacttatgattatagttttattataaagaatcagaatgagccaaattaagatacacagtcaaagtctcagggtggggggcagcctgaatgtagaacttttctgtcctctcccaatgtcatcaagatgtgtcacttttctggcacattgatatgttcaccaaccaggcagctcctccaaccttcagtgtccattgtttttattagagttttattatgtagtcatgattgattgaatcattggccaagcaattgaacttgatctctagttcccctcacctacctggaggttgagctggtttaaagccctgtccccctaatcacatggttagtgtgaccagcccccatcctgagtcattcattagcataaacccaggtgtgaaccaaggggctcaagaataacaaagaccctcctattactcaggaaattgtaaggttttcgagtctctctcccagggacaaaggccacattctttgttatagaccccagtctctgtattttttactctatagccttggtaccttgaaagtgtttaaagcactcagttgttggtttgatacaatttaatattttttaaaaaagttttcgttgtttcctttgaatctgccaacccaagtttacttaggagttggaaactttccatctaatatgggtttctattgttgaaaaaaattattctgatacttgttaaaatggtaaggaaaactttactcaagactattgcacctagtgcaatagcggagggctcaactctaactacaacaaggagaagggggtggatttatgggtgaggggaatcagtggatggaaaatcacgaagaggagacatcaaaggtaggagattcttgttaaggcaggccaaagatttatgtatcaaaggtgggagatgaggaatttaatcatatatcaaggatgaggggcttcttgcttagctgacttagcaggacttttgctaagactgggcatgtcctgtccttgcacaccatgcaaggacaggctgacatgaaaggccaaggttgaggcctagttgagaagagggttcacagctggttaactaatgtttagtcaactaaagagcctttgtcactgtctattaatgatgaactttatcttaagcgtgcattgcatagtgagttagtagctcatcgtagaagaacatctatgtaaacatatcttaatatgcaaaaaacctttgttctaggttaattcagaaatatgcattatttaaaatcccattatatctccatttaatagaccaagtattggtctattaaaattcctttactctgggatgtggattgttatagtttttggttggagatttttgtaaagtcattctaagtgtaaaaaatacagaaatggaaatagcctctcaacccaaaatttctaataatgtagttttttttttttttttttgagacagtctccctttgtcacccaggctagagtgcagtggtatgatattggctcactgcaacctctgcctcctgggtttaagcaattcttgtgcctcagcttcccgagtagctgggattacaggcatgtgccaccatgcctggctaatttttgtatttttaatagagacggagtttcactacattggccaggctggtcttgaactcctgacctcatgtgatctgcccacctcagcctccccaaagttctgggattacaggcatgagccgctgcacctagcctcgaataatgtactttgaattatccttttcaactgatgttgtttgtgtgttagcataatgaaaaatgtctagcttttgtataccattaagcacttgtatttttctggcattgattaatcagattttcactataaatattactagtgtaataatatattaagtagacaatattcacaattttaaaggataaaatacgactttttaagaaatattaagaaatattttttattaattttggtagtctaagtgctcctaagttaattttaaaaaatcacttttactccctttgttaacacctgggggaagtaacacaggatacattttttgggttgaattgttgtggaataccacatttgaaaagtttgggatttgataatgttttggaagatgagggagattatttactatatatatgtggattttctgaagttctttgtttttggtacattgtttgaaaaaataatatttttttagagaagctgcccacaaagcaggtaactgaggtataatttttattattttgaatagcttacttaaatggtaataagaaattgctagtcttgaggaagaaagaatgagtgggttaataagtttatttttataaagtgtaaagtactatataagtaaagtgttcttatggcgaagtggctttagaattttaccctgcatagcagaggagattggagttggttaggttttatggcaaggcacatctctcttgctgtccttttcctgtactggttcaggaagctggtatccaaacagtctattgctcacatttgtttgtcatttctcccttgttttcatggggacataggcgctgtgctgccatttcttattttcacctctataggcagtaagacaataatcttcactagagtaggaatggtctgtattgctcaccattgtaaccttagtggcatgtaataggtgtttaataacttgaggtagaaaattttatgaaaaactacaaaatgttaaatagaataagattgttgtttatgtttgataatgactactaccatgaaaattcagcttaactctgtggaaactgaccatatttccaagtcatctcttgctatcagatacctcattaaaacagtttttcgggggtgaggggggacaaaggagacttacattgaatgcgtatcctgactggagatgtgtgtgtgtgtgtgtgtgtgtctgtgtgtgtatatactatatactatatatatatgtatgagatatgtatatctccaaagggggaaatataaatatataaaatttaaatataatacttaaatataatatttaaatataaatatataattatatttatatttccccctttggatgtatcttatataaataaatatatatttatagatcttataaaaataaaaataaaaatatatatatgtatttccctctttggagatatcttaaaatatggaggaaacgtctattagaattgtagaaatatagtactgtggagattggtttcttaggttggaaaaaagttttattttcttgtttacttattctcatgtgtagctgcatttcctatccacagcattgtggaaagtactgattctcaattcttatgagcaattttattaacaaaatagtaatagctccattatttgacagtctgacctatatgtctgggttcttcaggcttctagcctacatccacattcttctctacttgttcaggcattaagagaagaatgtatttcctgaaatatttcacaagtggacacagttctttctattccgtgggtcttttggtctgcctatggggtctttttttcttccaaactattgaggtagtacttgatctcacagtaaatcccaaggcacctgccatctgtgtgtcaggatttctcagactgttgccagctgctgtcatccccaaggcagtgtatcccttagtgatttgctactgtggtctctaaagttgcatgccactctctcttgggcatctggtatgttttagattcgtacaatggaatactgttcagcaacaaaaaggaacaatatatccatggtgctatataggtgatccttaaaacattattttgtgaaggcagttttgtaattttcgctaatattagaagagttcccttcacatgtaaaagagtttttaaccagtttcccagatttgctggataccccagcaccaatatttctaaataaaactgttagtatttgtattatggttccaagatcctgagcatttgtgcaagaggaagttaaagaagatgtggtgtgaccatgttcttatgttgtcctttcctgtctctaataaaggacggcgaagtgttcttgtggtatttggtttgtggaagcagtaagttaccatatcacatactctgtcttgaaccattataaatattcactggtaaaatatagaaagttgtgtttatttatagctgagtatgagtttactatgcagagaacctgagtcatgggctgactagtgaatgtatcaaaaagcggaatgtgggaatgtaaaagggtgcaacaactttggaaaacagtttggcaatttcttaaaaagttaagcatcaacttaccatatgacctagcaatcccacttgtaggtatctacccattagaaatgaaaacatatctacaaaaatacttgtatatgaatgttcataggattaatcataatagcacaaaactggaagcaatctaaatgtccattaactggtgagtgggtaaaccaaatgtggtatatacatacaactgaatactattcattaataaaaaggaacaaaatgcatgctgtaacacagatgaacctcgaaaacattatgctgagtgataaaagccacatataaaatactacatattgtataattccatttatatgaaatgtctagaaaaggcaaatttgtgtagagacagatagcagatgagtggttgcctgggtttcttggtggaagcagggattaaatgcaaatgggctcaagggaatttggggggtaatgaaaatattctaaaactagattgtggtgatgttgcatagctatataaatttaccaaaaccattgaattatatgtatacttagaatggatgaatgttatggtatgtaaattatacctcaatttaaaaaaagggagcatgaaaatgaattttgccagctcaagtaataagaaacagtgtttgacaagggtagtcatttgagaaatgatgaaagagatttagagatataatctttcaggtgaaaggaaaagggttttgacttgatttgataaacgaagaaagggaactctttcacttttgccttaatcttcagtaaatgtcaaagttaacatcaagtatctatttaaatgtttgcatttctccacacttttgtacactgtgtctggtgaagtaagttgatggtgtgcactaacccttttggaatagtttatcaaggatttaatgtttgtatcttttaattccacatacatatatatcttaaggaaataactagaaatgcaaacaagaatttgtattcagaaatgttcactatagcatcacatagggtaatcaaaaaattaaaaataacctacatgctctcaaagtaggaggaatggttaaattatagttgattttgctttgtctctcttggtttcaaggagtagaaattctaactagattaagtaaaattgggctttgttgaaaagggtaaaaggtgctctaataaccccaaacagcaagatcactgaggccttttggcagtggggagccagagctactttcccatttcacccggttcagggaccaggctagtcactgcttcttcctctgtagacctgctttgttctcagcttcttcttcagccagtcttccttgtacatggctcagtgttgtttgccaccttggacttactcagtttttgttaaaattcacatatttccagaacaggaatctgaaagagctgttctttttgagccttaggtgggtcagtgaacaacctgtggtttggtctttttcttcatccccttccaggggtctgtatttaggtttagatagttagtgaaaatgaaatggcactgggtaatgacattgattcaatacatcttggctaggcacactggctcacgcctataatcccagcactttgggagactaaggcaggtggatcacctgaggtcaggggtttgagactagcctggccaacatggtgaaaccccatctctactaataatacaaaaaaactagctgggcatggtagtgcacacctgtaatctcagctactctggaggctgaggcaggagaatcgcttgaacccggaaggtggaggttgcagtgagccgagattgcaccattgcactccagcctgggcagcaacagtgaaactctgtctcaaaaaaaaaaaaaaaaaatctcataggcttatacgaggaatggcaaatattggccattatttattatcaatttaaaaatatttctaaggcctttggtggtggcagcctcttttcttgattctctcaacagaatagtgtacatttgtggtagattcatgcttattttcttatatttccttaccaaaacttgaagtcaggatattaccccttcttattaaaacctcttttactaagactggcaattgaaatcccattggatgccatattgggcactgtggaccaatctccacctcctgtatgccccctctttctgatgtggccacggtgaggtcactgtctcctgacctgcccttaccccactcatgtctgccttagtggatcttcttcctctcctcatcttcctctgctgttgctctgtgcctcatcctccacttcttttctctctgtatacatcctgtacagtgttttgtacctctgtgactttagagaccctttctatccccaaatctctgtctctgtcctagaccccttctgctgagatggagtctctcataactactggcttatcgaatatcacactcagagatatcaccaactctccttttctttcgaacattcagaattttttgtacctcagtttattctctgctataattatgtactgtgccttattcaatttgtattcctggtagcacctagcggaattccttgcacagtgggtttacttagtatttgcccacatgaatatttttattttttaaaatgggctattatcctttgtatggggttttattttgttcccctactatcctgaaaaatacccacaaactttttttctaaatctaagaatagtttctaacatggtttttgtggtcaggggggaacaaaaccccttaatattaatggacatacatgttaatagcatttctaaatacatttgggcatgtgtattagggcctatatgttttctctgagaataaggacacacagcctagtgagttttggactcgaatcctattatatgtgaattttctttctttctttctttctttttttttttttaagacagagtgtcactctgtcacccaggctggagtgccatggcacaatctcggctcactgcaacctctacctcctgggttcaagtgattctcctgcctcagcctcctaagtagccgggactacaggtgcatgccaccacacctgtgaatttaatttctatactaaatatactattccaaaagaaagaaatgtttattggaaaatgcaaccaattcagaaatatgctttgtagacagtgaaagtttcaattattttgtatagactaaattagattatagaggttctttggctgggcactatggctcatgcctgtaatctcaacactttgggaggctgagctgggtggattacttgaggtcaggagtttgagaccagcctggccaacatggcagaacccttctctattaaaaatacaaaaattagctgggcgtggtggtgggtgcctgtagtcctggctacttgggaggttaaggcaggataattgcttgagtcctggaagtggagtgtgcagtgagccgagactgtgtcactgcaccccagcatgggcaacagagcaagacaccatctcaaaaaaaaaaaaaaagaaaagaaaaaagaagtagtggttctttttatgtacaaaataaatttgctcattgggttagagtatggttattgattagggggctaagcatttagttactgcatggggcagccaataataaaatcacagccctgtgtatttacctccacagtgtgtgctgataagtgcaaaaggtttgtgcaaattcttttgaagttatattgtaaccatggtatatgtattgaaaacttggccattttaccccattcctatgaatgaaaactatttggtgaatcagaggatagtctgaattgggatatgaaggccagtataagtgtcagttagcaaagtcagctctagtttattatttttttttttttcttttaaggcgtagcattactagaagtatagctttgggaaccttgtagcatcttaaagacttttaaagggttgacagctattggcaaattgactaatacagagaactaaactttggttcatgtattcaatgtctaaatgaaaaatgggaagataaaagagctaagaatgaaatgtgatttcatgtgcttctcctttttagctcttataatagattgaacagatttgatatttgtggtaaatacactcaggcagagtgacagaggcttggttgtcatttagcctttagggccttagtggagttaatgagaactgcaaatggtcatcaagtcttggtgcttcatggagaagcaacacttttacagtgagtgtgttagcttagtggttatggtattactgcagggacatggatcacttagggagagagcgtttcaggcttgggtcagtcttaaagcagatctcatgtggagggtttctgctaacctgcatctcttacaacacagtactagtcagtatgctgtagtattaatcagtaggtcaagttcagtgaagtaaaggagaattgaattcttgaagttcacatttaggcaaaaatttggcgttttaggaggtgagtataagacatgatctttatagaaaacgctgatgataaaaacagcgctctctgttaggtgcttttatgcttgactccattgtcatcttttcttaagaaactaagctcaggactgggtgcaatggctcatgtctgtaatcccagcactttgggaggctgaggctataggatcagttgagctcaggagttcaagatcagcctgggcaacatagctagacctcgtctctactaaaaaacaaacaaacaaaaaacaaaaaaaaacccccaaaaaaaccaacaaaccagcttggcatggtggtgcgtgcctgtggtcccagctgctcaagaagctgaagcgggaggatagcttgagcccaggagatcaaggctgcacttagctatgatcgcaccatcgcactctagcctgggtaacagaatgagaccctgtctcaaaaaaaaaaaaaaaagaaactttaagttcagattcctttttatagcagctttcagcctgctatagacaatacagaaatgagtggataaagttttatttagatactctgatagcttagccagtgacaatgacctatccaaatatggaatgctaaaatgttttctttttggaagcaaagcccatgaaaaattggtttggaagtagcgttaaaaacctggtgattaaatgacaacaagaacgtgagaagagatttttccaaaatccatttagtgtgtttggacagaaacaaaggaaagataactctttgttaaattggttaatagaggatttgaacactttgtttgctgtagacaaaacatctttatcttaaaactgtaatctttctaacttccgttgcatgcattgctgcatttccttttttacatgtgctctcatttattttcatggcaaatgcatttttagacagagtctgtgggataattattgccattaattagttttgatatttcttttttaatgatattttcatttattcccttttgctagctggattgccttttgcaattcttacttcaaggcatacccccttccaacgaggagtattctgtaatgatgagtccatcaagtacccttacaaagaagacaccataccttatgcgttattaggtggaataatcattccattcagtattatcgttgtaagttaaatccacttttccaagtttataacttttgggcacttggcttaattttctgttactcttttaatgcttaaatgtgtaatcctccaaaaacaatgtatgctttttaaacctttaattgatgctttatttgatcaagagaatctcagctattttaagtggagtcaaaaaataacaatgtgtaattgtaagagccaggcatggtgacatgcctgtagtcccagctactcgagaggctgaggctagaggatcgcttgagtctcggagttggatactataatatgtgatgatcacatctgtgaatagccattatactccagcccagacaacactgcaacatcccatcttaaaaaaaaacagaaaaaaaacacgaaaagaaccttgctggctatgtatagattttatgctaatcttttccatgtcactgtgattgttagagctctaattttattgttttaataatcttgtgatcaatagttgaatgttatagcaatatgattctagcatactttatacataggatatcattttataatttattgtatctgtatgtatgtacctaccgtttttgattctccctctgtactgagttctagaaaagaaaaattttgctaagtgatgttaaaacttcaatgcacgcttactttaaataatttttagatcatatcatacacaggagagaaaagctatagttctatatatgattagtagtgaatatgaaagaatttttactggtactgaatgcaagagtgagtcttaaactaaaatagtaactgttgttttccggtatttcaggtggaaatgcttaaagaatgtgtctagggataagactattgactggactacatgatttttataatctctactaaaattctgtaacttaacagttttgtgctccatagcttgtaatattatggttccagcatgcttccactgcatggctctgctgaccataacttgtgactttataaacaagatttatgttagttaaaagtagaaggctgggtgcaatgactcatgcctgtaatcccagcactttgggaggccgaggcaggcagatcacctgagatcaggagttcgagaccagcctggccaacctggtgaaaccccgtctctactaaaaatacaaaaattagctgggtgtggtggcacacacctgtaatcccagctactcaggatgctgaggcaggagaatcgcttgaacctaggaggcagaggttgcagtgagccgagattgcaccactgtactccagcctggttgacacaatgagactccgtctggaaaaaaaaaaaaaaaacaacaaacaaacaaaaaaaccagaaaatatggtggatgtggtggctcacgcctgtaatcccagcatttgggaggccaagtcaggaggatcacttgagccctgaagtattgagaccaacctgggtagcatagcaagacccctgcctatatccatccccctcctcgcaaaaaaaaaggccaggtatggtgggcaggagcctctggtcccagctactcagaaggctgaagcaggaggatcctttcagctcaggaagttgagcctgcagtgagccatgattgcaccacggcattccagcttgggcaacagagtgagaccctctttcaaacacacagacacacacacacagatttttttttttaattaaaaaatatatatagttgtatccaggagataggccaaagatgacagcatgtatatcatgtctgtttttggagtttattttaaaaaaagaaaagcttcttaatttagaaatgtcttaagaatgatcgtaataccttattagcattgaaagttaacttgtaatttgtggtgcataattaataaaagaaaacctttgtatatagatatttgttttataagactgtgagctccttgaaggcagagatgatatcttgttcatccttgtgtccactgcctggcatggagcccagcatgtcctaggtgcctgaatgaaactgtatgaaggaaactatagagtaattacgcagtaatgttggtgactctcccaaagtacggggaagttttaggaaatcaggtattcttttaatctaaacaaatctttacactgaattttttctgctagaagaaagccaagtctataattcttccattaaggagggagtagggtctttttttaaaaagtatgtatgtttctgagtgattgctaagcaattaaatataacatttttagtaggacttttagttgcaaatagccaatttcagacaggattcaaatattcaaataaacagtgctagaaatagacctgtctttcaattctgccttgttttttggtgtcagtaaaaaggatgccatgctagcagaactacaggaatttgctctagcctggagggctgcagtagagcaggacactgattgctgggcactgtgttgatgtgcacggcctacacagggcctgacaaaatgcttagttagcaaaaactcatgaattatatttcattaacttgaaattcttttctatttcttttcttcttcttcttcttcctcttcctcttcttcttcctcttcctcttcttcctcttcctcctcttcctcttctctctctctttctctttttctctctctttctgtctttatctctctctttctgtctctctctctctttctttctttctctctctctgtctctttctttcctttgtttcttttctttctttcttctttcacagtctccctgtgttgcccaggctggagtgcactggcgcgatctcagctcactgcaaactccgactcctgggttcaagcgattctcttgcctcagcctcccacatagctgggattacaggtgcctgtcaccacatcagctaatttttgtatttttagtaaagatggggtttcactatgttggccaggatggtcttgagctccttacctcgtgatccacctgcctcagcctcccaaagtgctgggattataggtgtgagccactgcgcccggcctatactctactgtctcaacataacctgtgagaaagttatctttacatttaataaaatggcaagcaaattaatagatgaatgcagactgctttaaaaagaacagattgtttaaaggtattgttttcatctctacagtatcactgaaaacaaacactgcttagggcagtggttttatgtatgtatgttttgattaattgattgacagagtctttctctgtcacccaggcttggagtgcagtggtgtgatcagagctcactgcagcctcaacctcctgggtttaagtgattctcctgcttcagccacctgaggagctgggaccacaggtgtgcaccaccacatctggctaattacatttttttttaaagagataactatctctctgtgttgtgcaggcttgtgtctcaaactcctgggctcaagcagccctcctgcctcaacatcccaaagtgctgggattataggtgtaagccaccatgctcagccttatgtgctcatttaaaataattcaattttattcattaactcagcctctttcaggcaatgctcggttagacttgtatacatttaactttatttactagaaagtaaatcatttatttaaaaaaatccctgtgattaagactgcataccagggccttgacatgagttgcaaatgattgattaataaatgagtgattgagggagctggcaggtagagaaccagcattattatagtttctgagaagacatgagataatttcaatgaggaggaaatggtcagtgaagtcaaatacactgagaagttaaagtaagtgagagttgataaaaatctgtttgatctggctgagtgcagtggctcacacctgtaatcccagcactttgggaggccaaggcgggtggatcacaaagtcaggagttcgagaccaccctggtcaagacggtgaaactccttctctactaaaaatacaaaatttagctgggtgcggtggtgggtgcctgtaatcctggctacacaggaggctgaagcaggagaatcacttgaacctgggaggcggaggttgcagtgagccgagatcacgccgctgcactctagcctgggcgacagagcaagactccgtctcaaaaaaaaaaaaaaaaatctgatctgatgaaacaattttgacttttgagaaaaaaatcagtagaataaaggaaatggaagtggttagagatatttaggagggagaagaagatgcggagatgtgtcattgattttagacaattcttttgggaaggtgggccctgaatgaaagacacaaaatcatagggacagtgtagaaacatataaaatgatcttggttgatggagatttaaaggggatgataagagaatactgtgggagataggcttaaaaaggttgaatcactctgatttagataattattagctttgaacttcataagtattgttttacttctccaaacatttttatttctttgataatttatcatatcccagaatctaagtaaataatgcattataaatagtctcagtttaaggattaggccacacttggcttaggtgtaaacttcatgaaaggttaagaattggcataaatggctcaaaggttagggtaaggaattaaaatgaaacaaaagaatatggttatcttgtgtggatcaaatgggcagacacatctctgcatttaattcagaagaattgatttagaacttctttattgtctgcttctctcagcgatgtgagttgacctagcatttgctggctttagagactcccctgcattcccattattaatggttaagtttcagcttacactacttctgaagatcagcttttaatctgtgcccagtattctgaatattcctagcaaactcattttctgtcatcactggcaagagccaggatttgggtggccataaactatgatgattatgactgggaagactcacaaaacatactacctgtttctggaaaatagttcagtgcctaagaacagctcatacctgagatgtggaagtttcaactgctgaaactgtggttgattaatatacttgatatgttttcaagaatcaaagattaattccaaaatgaaatgttagataagttctttctggctgctgatctgtgaggaattactgggaccccttaatggcctaaggaggcaatgtgtactgaaatggaaagggttcctctgttggcagtcagggataaccctaagcaaaactgtaaaggaatgacattcttggaagtacatatagtttacctctcctgtgacctgttctcagaaaagaatctgactaattcattcatgttaaggactataattagaactgtatttttatggggcttaacatgtataaactaagggcatttgctgtttacccaaggcagcacctttcactaaaatttattgaccacctactttgtttaggtcactctggtgatatgaggttttctgttcaacaattaagaaatcctccttaccttgtagagttcatagtctcattgtcaaagttaaaacattctaattatggaactctaggagccattgagccaggtaaggaaaggattttaggtatcagattcttgaaatccctttcgggaagcaaccatttattttacttatggtaagacttactctgaagacagttgatcctcattaaatggaaatgtttgaatgctttataaaatagtttatataaatttaaggtgaagcagagaagctagtaatgtatctcaagtcaagctttgctacttaattctctccacacagattagcaaacccactgttcaggctgctctgtggttaagtggtttttttttttttttaatttttattattattttttgagatggggtctcgctgtgtcgcacccaggctggagtgcagtggcgccatctcggctcactgcaaccaccacttcctgggttcaattgattctcccgcctcagtttcccaagtagctggggattataggtgcctaccaccactcctggctaattttttgtatttttagtagagatggggtttcaccatattggccaggctggtctcgaactcctgacctcaagagattcacctgcctcggcctcccaaagtgctgggattacaggagtgagccacggtgcccggccttaactgtttattttggtttcaggtagctagagtcttactgtcttttttaatagcaaatgttactatttataatgttgccattcagtattctttgaattctcaggatatgggtttgttaacttataaagcattggaaacctttttatacttttaaattagtgactaaaaatcctgtcccaccccttgggaccccagcagaggtcacctggaaggctaaatccctgccctctgtatcctctagcaatcctccctgaaatgattttactctttttaatatgatggatgtctttgattcaaaggaatatttgagaaaaatgaagcctctgtcagataaaagtacttatacacaggagtttctgattggggaagtaggtatgtatgtatgtatttatttatttattgagacggagtcttgctcttgttgcccaggctggagtacaatggcatgatctcggctcactgcaacctctgcctcccaggttcaagtgattctcctgccttagcctccgaagtagctgggattacaggcacccaccttcatgcctgactgattttttgtatttttagtagagacagggttttaccatgttggccaggctggtctcgaactcctgaccttgggtgatccacctccctcgggctcccaaagtgctgggattacaggcatgagccaccacacccggctggaagtttgttttttggacaagccatagtttttgtcctccaggatatatcactgtctactttttaaagctctgtttatttgaatacaagaaaaaaaaaataagatcttgttattttaggtaagtgatgatataattttgtcccagccatggctttgtaagtaatgtccaccattgatatgacacctgttttgtggtttagaattggatatcctaagttgactctccattgtaaagaaaaaaggggctgggactgtttttgaaacaaagatatttttgcgatttaccatttccttttttccccctatgttttgttttgtttaaagtgcctgcttgctactttaacatgttatttttctgtttctttttcagattattcttggagaaaccctgtctgtttactgtaaccttttgcactcaaattcctttatcaggaataactacatagccactatttacaaagccattggaacctttttatttggtgcagctgctagtcagtccctgactgacattgccaagtattcaataggcagactgcggcctcacttcttggatgtttgtgatccagattggtcaaaaatcaactgcagcgatggttacattgaatactacatatgtcgagggaatgcagaaagagttaaggaaggcaggtgagtgttaaatcgctaatgcttgtttaatcttgtatattcttggaatagaaggtttcagtgactggaagataagccacgcacttaaaaagagaagttagtgttatcactgggaggtgaattttgatcttgtatgaattgttctctctcatcatgcctttttccttttttattgctgtcttccatttaaaagtgttttattgcagctctttttttcatcgccagcatgtaagaatgttaaatgaaccttatagatcatttaggctagagtcagcaaactttcttaagatgccagataacatatataatatatataattttttttacatttttatattattattttgtagagactaagtctcactatgttgcctaggctggtgtcaaactcctgggctcaagtgatccttccaccttggcctcccaaagtgctggggtaacaggcatgagccaccacacccagccaatagtaaatattttaggctctctgggccatatagtctctttcacaactatggaactgtgctgttaatagcaagaaagcagccatagacaatacttaaatgaataatgtggctatgttccaataaacttcacaaaaacagcgctgccacaggggtcaaagtttgccgaaccctgatctagtcccaccattatttatgaagctctgctagatcttagtattcttagtttattattattgtttagatttttttttataaggtaacttggttcaggttgtgacagctctaggtcatcaggttgctgtcttataacgcccttattgggctcctttctgcatgctgggacacctttagacatgaatgaaacagaatgtttagaactcagaagatccaactttttaaattgatagatgaggaaaaaatagaggaccaagaacactaagtaaagccactaattagtagcagagccaattcctcatttcaagtttcaaaattgtcagccttatctttttatatatcaagtttaatttcctttagttgttcaaagtacaaatactttcttgggtaaaacatcctttgtttgtttgatttttttagatatgatttctagatacttcattgtctttgttggtattcttgaaagcaacgtgggcctgctaatagcttcaattttttttttcttttcctttttttcttttttttgagatggagtcttgctctgttacccaggctggagtgcagtggcatgatcttggctcactgcagcctctgcctcccgggttcaagcgattctcctgcctcagcctcccgagtagctgggactacaggcacgtgccaccatgccctactaatttttgtatttttagtagagacggggttttaccatgttttccaggctggtctcaaactcctgacctcaggtgatccgcctgcctcaggttcccagagtgctgggattataggcatgagccatggcacccggccagtagcttcaattttttgtatttagtggggatgaaaaaaatcttatttaactagagtatatactatggtatttgcttggggtttagcagtgaacaagacatctctggtccccatcttcatggaccttagtctggcagggaagatttacattaaacaaaggatgagaatggaagagaacttgcttggtgataatgaggtcaaagaagagaaagatcaagctgttaaatggcaaactttgaggtggtgaggaggactgatatgggtgtaaagtcttaatgaaggagggaaaagtgactgaagaggtagacagttgagaaatagttggtaaaaggtgatagtgttgatttgagctcaggtgaacaagcatttttataaggggctagaggaagaatggtccagaaatggctttgaggaatgatgaaaacaccaacatcaatactggactcttaaggtgtatgggctgtgtagatctcattccctgcaagggcaagcagtatcctagggaaagcctctttaattggatggctaggaggtacagagagccttcagggaacagtttggagacacagggaaagatagaagactttaacagtagagccagaattccagagtgttcagtggaggagtaggaacagaggggatgaacaaatggcttgggtggaggagaggaagcctattgaaaatgagactgaaatttaaaacaaattataaagaagaacaaatagctgggtaaaaacataccatgtaaaacaaaatctgatacaagcttatccaacctgtggcccacatgtggcccaggatggctttgaatgcggcccaacacaaattcgtaaactttcttaaaacattatgatttttgtttgtttgtttattatcagatattgttagtgtattttatgtgtggccgaagacagttcttcttccagtgtggtgcggggaagccaaaagattggacgccccgatttaatagaataaaattatcatgatttcttcttccatctataacttaaccatataacctttaaaaaataccatacatatttatgaatgcaatgataaaaccagctataggagtacggctggcgtggtggctcatgcctgcaatctcagcactttgggaggcagaggcaggcagatcactcgaggtcaggagttcaagaccagcctggccaacatggtgaaaccctgtctctactaaaaatacaaaaagtagctgggcatggtggccgcacacctgtaatcccagctacttgggaggctgaggcaggagaatcgcttgaaccccggaggcagaggttgcagtgagcagagattgcgccactgcactccagcctgtgtaacaggatgagactctgtctcaaaaaaaaaaaaaaccacctccgccccacataaaaaaacacttataggatttaaatcacaaaggaaaaaaatagaatagatactagtcgaactactcttttaaatagcttttttgaggtataattcacatgacataaaattttgcccattttaagtgtacaattgaataaatttgtaaagttatttaccattacagtcaagttttcagatatttgaaaagcttgtccctgagtgtttacagtcaatttacactcccatctgcaaccggagggtcaagtttctgtgcctatagttttgtgttttctagagtattatataaaaggaatcctacagtgagtactttgttgtgtctgccttctttcacttaacatgttagttttgcaattcatccatgttgttcctttttctccccctgaggtatattcgattgtatggatataacacagtttacttatccattcatgcaaatattgatggacatttgagttgtctccaatttttggctattaaaaataaagctgttctggctgggtatggtggctcacacctgtaatgtccgaactttgggaggccaaggctgggtggatcacttgaggtcaggatttcgagaccagcctggccaacgtagtgaaaccccatctctactaaaaataacagaaattagcgaggtgtggtggtgcacacctgtaatcccagctacttgggaggctgagaaactgaggcacaagaatcactttgaacccgtgtggtggaggttgcagttagcccagatcatgccagcctgggtgacagaacaagactgcttcttaaaaaaaaaaaaaaaaaagatgttctgaacatttgtgtaccagtacagtaatatatacttttattttttcttgaacaaatatctaggagtagaagtgctggactatatatagcatgtgtgtatttattaatggccagtttttgttattttagccattctaagggtttttgttatggtatctcagtgtggttttaatttatatttccttaatgaccagtgttgctgaacatcttttcgtgtgtttcttgtccattcagctattgtcatttttgaaatgttaactcttttacccattaaaaaaaaattagttgcttgtctgagttgtaagagttctttatatattctgaataaaagtcctttgttagatatatgttttgaaaatattttctctcaatctgtggcttgctatgtattttcttatttatttatttatttatttatttatttatttatttatttatttatttatttatgggacagggtcttgctttgttgtccaggctgtttttgaactcctgtgttcaagcgatcctcttgcctcggccttccaaagtcaaagtgctgggattataaacatgagccaccatgcccaatcaactttttcttttctttttttttgagacagagcctcactctgtcgccgaagctagagtgctgtggcacaatctcggctcactgcaacctcatgcctcagcgtcttgagtagctgggattacaggtgtgtgccaccatgcccagctaatttttgtatttttagtagagatgagtttcaccatgttggccaggctggtcttgaattcctgacctcaagtgatctactcgcctcagcctcccaaagtgctagggttacacgcgtgagccaccgctcctggcccaactttttattttctttttcttttttatcttaatttaagttctaggatacatgtgcagaacatgcaggtttgttacataggtatatatgtgccatggtggtttgctgcacctatcaacccgtcatctagtttttaagccccacatgcattaggtgtttgtcctaatgctctccccacgccttaccccacaccccctgacaggccccggtgtgtgatgtttccctccctctgtccatgtgttctcattgttcaactcccacttaggaatgagaacatgtgcgtttggttttctgttcctgtgttagtttgctgagaatgatggtttccagcttcatgcgtgtccctgcaaaagacatgaactcattcttttttatggctgctttctttttctttttcttttttttttgagatggagtctcgctgtatcccccaggctggagtgcagtggcacgatcttggctctctgcaagcttcgcctcccgggttcacgccattctcctgcctgagcctcttgagtagctggatctacaggcacccaccaccatacccagctaattttttgtatttttagtagagatggggtttcaccgtcttagccaggatggtcttgctctccttacctcgtgatccgcccaccttggcctcccaaagtgctgggattataggtgtgagccactgcgcccagctggctgctttattttcttaatggtggtttttcaagcttaaaagttttaaatttgatagaatctaatttatcatttttttcttttatggtttttgctttctgtgtcctaagaaatctttacttgcctcaacgttccaaaatttttcttattttttaaaataagttttatgatttatttgtttagtattgtgatccatttgaattatttttttgtgtataatgtgacaaaaagggtcaatatctactttttctccattgaatatctggttgttccaacattatttattgaccgaaaaaaaacattttcacattgaattatgttggcacttttgttgaaaatgaattgaccacataaatgtgggtctatttctggacacttagtctagttcattgctctgtatgcctctcatgcgaataccatactgcagctttgtaatagttttaaaatgaggtgtaatgggaagcttttaactttgtccttctttttaaagcttgctttgtctattgtaagttctttatgttttctttgaaagggcagaaattttattgagattgcttcaaatatatagatcaatttttgaagaattgccatgttagtattgggtcttccaatccatgaatatgttgtatctctccattaacttaggttttctttagtttctcatgccagtgttttttagttttcagggtctgggtcttgcatacgttttgttaagtatattactaacttaatgccattgtgagttttttttttaatcaatttccaattgttttgagtgtgtagaagtagaatttgtttttatattaatcatgtatcctgcaatcttgctaatttaatttattagttggagtgattttatagattcctgaaggttttttgctttcccattcatgttgtgtgtgaataaagagagctgtacttcttttctcttttatattgccttagatttcttttcctttccttactacactggctaagacctgcaataccaggttgaatgaagtggtgagagcagattgcttgtcttcttcctgaccttaggaaagaagcactcagcctttcacaaatatgtcaactgtgcatggtttttttttttgtagatgctttttgttagatttttatcatgaatgggtattggattttgtgacatgctttttctgtgtttgttaagatggctatattgtttttcttctttattctctaatatagtatattatgttagttttttgaatatcaaagcaactttttatccctggggtatatacttagtcatggagtattatactttttatattaattggatttggtttgctaatattttattaaggatttttacatctgtgtttatgagttattggtctgtagttttcttgtaaagtttttgtctagctttagtgtcaaaagtttggtattaaatgttgaattcatcagtgaagtcatttgggcctagaagtttctttgtgggaaggttttaagtttaatttaattttttaaaactgagacagggtctcactttgttacctaggctggagtacagtggcgtgatcttggctcactgaaaccttgacctcccggctcaagtgatcttcccaccttagcttcccaagtagctgagactacaggtgtgcgccaccacgcctagctaatttttgttgttgttgtagtattttttgtagagacagggtttcacctgttgcacaggctggtcttgaactccttgtcgcaactgatctgcccaccttggtgcccaaagtgctgggactgcaggcatgagccaccactcctggcctattttttaatgttttaaaaaatatttatattcattcattcatttatttaattaattagagatggagtcttgttctgttgtccaggctggagtgcggtggcccagtcatagcttatggtagccttgaactcctgagctcaagtgatccttctgcctgaggctcctacttagctgggactacaggtgcatgccttcaggctcgaataatctttgtgggaaggttttaaatatgatttcaagtttttaaatagatatagaactattcagattatctgtgttttcttctatgagctttggttgtttgtcttttaagggatttgtccatttcatgtaagttgtcaagtttattggcatcaaattgttcatcatgtcattatactatctttgtattgtttgtaggaactgcagagatagcctctcttacattcttactattgataatttgtgtcttatgtctttttttcttgactgatctggctagaaacttatcaattttattaaccttttggttagtttcaagggtttcttttgatttcattgatttttatctattttttgtgttcagtttcatttatttttgcttttatttttatttactttctcctgcctgcttttagttttgtttgcttttcttttttctagtttcataaagtagatgcttagatcactagctgtgtcacaaattttgatatattggatctttatttaactgaaaatatagttgatccttaaacaatgcagggactggggcgctgaccccctgtgcagtcaaaacttcacatataataacttttgactcccccataacttaactacaaatagcctactgtcgactggaagccttaataacgtaaacagtccattaatgcatattttgtatgtcatatttattatatactatcttcttacaatgaagtgtggtagagaaaagaaaatgagaaaaccataatgaagacaaaaatatgtatctgctattcagtaagtggaaatggatcatcctaaaggtctttatcctcattttcttcactgagtaggctgaggaggaggaagaggagaggttggtcttgtctcaggggtgagggaggtagaagggaggcaggaaaggcaggcatgctcaatgtagctgttattgaagaaaatctgcatgtaaatggacctacacagttcaaacctgagttgttcaagggctaacaatactttctaatttcccttgcgtcttcctctttgatctgtggattatgtaggggattttgcatttatctttctgtcatcgatttctaatttaatttcattgtgtttagagaacatactttatatgattagaattctttcaaattagttgattcccatccccctgggcccccacatttttcacatacagtctattctggagaatgttccatgtgcacttgaagagcatgtgttttctgggtgaaatgttctatagaaatcagtttggtcaagttggttgatagtgttactcaaatcttatatatctttactgatttttttttaaccaacatgttttatgagttattttttggggagcttgaaatctctaactataattgttgaattgtctttttgtcctttcatttgcgtaaactttgtttttttatcttgtggccgtgctgttcaatatgtagcacttacaagtgtcgttttttttttctgctgtattgctcctttttggtatcaatgtatttctttgtgtttagaaatattctttgttttaaagtctattttgcctgatattaatatatagtcactctaattctcttatgcttattgtttgggttatatatttttctataagtaaaacttttagcttattcgaatctctgaatttaaagtgtatcttttagagacaatatatagtcatatcttgcttattctttttaatccagactgaaaaatctttgccctttgatcacaaatttaatgtaattaccaatatggctggatttttctgccattttgctatgtgtttttttttttttttttttttttttttttggagacagggtctcctctgttgcccagactggagtgcagtggcataatcttggcccactgcagcctctgcctcctgagttcaagcaattctcccacttcagcctcccgagtagctgggattacaggcatgcgccaccacgcccaattaatttttgcatttttagtagagatggggtttcaccatgttggacagtgtggtcccgaactcctgacttcaggtgatccacccaccttggcctccctaaatgctgggactacaggcgtgagccaccacgcccagccttgctatgtattttctatgtttcgtctctttgttactgttcttcctatactgctttcctttgtatgaaacaatttttttttagtgtagcaatttaagtatcctactgacatgttatctgtttttttggttgtttctctaggggttacaatatacatcttcatatatttaatttttttttttaaggttaatacatgactaagctacaggaaaaaaaagcatatatgtattagtttattatttacttataaccaaatgaagaaaggtgtttattttcagtgatcatagattaacctgggagttaactatcttcttattttctggcataaatatccaagcttttgcatgctgaccatttgttactcattttcatccttttggcattcttgtaacataggcatggacaataatattgtcccacttttatgaataaagaacttgaagcacagtaaggattagcatcttgtttttgattctagaaacttaataaaatggaagtgggacttcagtatcagggtgttgattctctgttttgtacttttccaccaaatgccatgcctatgtctctaatatctctcttggatcaaccaacatgttaataagttaggcaggaaaactctaatcttttctctcagccagcaaatttaagaaagtcattgtggtgatgagtgtacctaaagtctagaaaatgtcattgtaaatgatttttttttttttttgagacagagtctcgctgtgtcacccaggctggagtgcagtggcgtgatcttggctcactgcaacctctgcctcccgggttcaagcgattctcctgcctcagcctcctgagtagctgggactacaggcgcccgccaccacgtccagctaatttgtgtatttttagtagagatggggtttcaccatattggccaggctggtctcgaactgctgaccttgtgatctgcccaccttggcctcccagagtgctgggattacaggcgtgagcccccttgcaaattattcatacatatattatttctctggttcaggtacataaatcttattttgttttagctgagaattttcttgtgatatttcttattgatgatatttttgtttcttgcacaagccattttgacaaaatgtgaaatatatttatttaaaatggtataaaaataattattttgtgatatatacatgtcatactcattcactgtctcttcctggtgtatataaattggctgccatatactgttactttgattgcacttttaacctaagtatacttaggctttttacctatttaaaatttctacagccatccatatgcaagtgtccgcttacagtcctgtgtaagggttgggaaagcaccctctttaaaagcagaattaattttggataactgaaattgaagagctatatatgttgaaagtaattattatttatagctttttttttttttttggtctgagacggagtctcactctgtcgcccagcctggagtgcagtggtgtgatctctgctcactgcaacctctgcctcccaagctcaagcggttctcctgcctcagcctgcagagtagctaggattacaggcctgcaccaccctccccgggtaatttttgtatttgtagtagagacggggtttcaccatgttggccaggctggtctcaaactcctgacctcatgatctgcccaccttagcctcccaaagtgctgggattataggcgtgagccactgcaccaggcctgtttatagcttttaagataagctcccttagtaagctttggggttctgaagcaaggagcaaggaaaatcaaatatagaaaaagttttagaaagactttgtatcttcctagaaaaatgtaatttccatctgtctttccagaatgagtcagttgttgccaatttcagagctgtataatagtggtacataactgtgggtatgcattgctgttctattgtggagtgtagtttggctggatacatactttcctattatttttctcttgaattttgaaagtcagaaagctaaaaatgcaaaaaatccagtctaaatattgtctatagttttttaggattatagtgtaatctgctcttttaacttatgtatctctacagcctgccaccatataagcttttaattataaaattatgatgcttgacattggggagaaaggaacataagcacccataatgagtcatttttgttgactgtataaatgagtcagagttacatgtaaggatgagaatatcctcctacaattttggtttttgatcttgattttttcccattgactctcttttctccccgccattctctctcttgcacgtagcacacttttgcgctctgtctgctattactgctattataaaccttttactggacttcagttgtagtgaccattaggtcctaaacatagaactaagagcataagtggactttaatagaatacttattaattttaatatctagagttcataatttagaattaatatatgagaatttactgtaaattaaaaggggctatatacttgcaatattagaacatccagttatctaggactgccattattaatgccaatgagaataccattcctctaagattttctggggaaaaaaaaagctaatgagcccaggtagttcacatctgtagctcccttcccaggccaagattctctttagatccatggcccttaaattttaatggttcattagagttatctggagggtttattaaaacacagatttgctgggccacaacctcaagtgcctgattgagaagatttagcatggggcttgagaatttgtatttcttctaacaagtttcagatgctgctcttgatcttggcaccacagcttgagaactactactttagattacctggattatgaaaacatgaccttggatgacatctacttcaggatacaagggtttatatttaccgttaggatgaatttaagggcatacacagctagctagtctatttgttatttttaaaaaattaagacagggtcttgctctgtagcctggcctggagtgcagtggtacgatcacagcgcactacagccttgacctcccgggtgcaaccaatctcccatttcagcctcccgagcagctgggactataggtgcttgttggcacctataggtgctgttggtgtagccaccatgcttggctaatttttgtattttttttgtagagacagggtttcaccatgtttcccaggttggtcttaaacacctgggctcaagcgttctgcctgcctcggtgtcctacagtgccgggattacaggtgtgagccactgtgccgtgcccggcctagctggtctatttgtgatagtacagtatggaaactattggctgcttgaagagatttgctttttttttctttttttctggcttttatttaaattgtgtatgttttagcacaggcccagtgtttctgatccattctgagtaactgatctctggctgtatgaatcagatttaaatacaaaattatttttgtttggattatggaagccttgtattcttcagatgcttacttgcagtatatatgattgaatgtgagaaataaatttcctttcttaaatgcaacccacatgcagataaaataaagctgaagtttgaggaaatgccttctatcataggaaaactcattataactagactggctgggtgtggtacttacgtacctagtacaactggctttacattttgagaaaatggctgaagaagaatatggtctaattgtagacattactgggtaagcatttatgatgctaaaggattcatttgttaaggcttgtatttctcatgcatatgtatgtcagtaactagacagctttttaaatcatatacctgtgtaggaatagcaacatatgaaatgaagaaggggatgatttaaaaagatccttcactttgtgagaggatattattattgtatttaacaggaatgtgacttaaagatcagtacctctttccagcttccctgttcttaatgtcagtacctgacaatttaggcttgtaggcaaaaagcagtgctacttagtctccagggaatatgtgagtaagaaaaccaataatagcccctgaggagtacagaaatttgctgtaccaaaatggccccagcttcgcctggaccagctaatttactgaccagtaacctattgacctgtctggatcttgatttcctgtgatgtcattctctattgagcagacagacagaaaaagcttttgttgatacagaatttctaatgccactcttctgggagaatgaggtttgcagagacattagataatattatctaataacagtactgttcgtttatataataaacttgggagatataggagggagatataggattggctaacttttatgtttatattatgttaatcaattattttttcttacataatatattgcaactcagaagcaatgttttgcttctggggtaatgtttataaacttttgcatgtgaagatgggcaatttggaagacttttggtttctggaagaacagaaatactcctgtaaaaattgagaaaatcttcacataggcagtgggaaatagaattcagacagcccctaagtcctttcttcttatggtttgtggtttgttattgtgctgcttacgtttgttttgagcatgtttttaagacttgaattttctttttttttgagacagagtcttgctctgttggccagagtggagtgcagtggcatgatctcagctcactgcaacttccacctcctgggttcaagcgattctcctgcctcagcctcctgagaagctgggatcataggtgtgtgccactgcacccggctaatttttgtatttttagtagaaatggggtttcaccatgttggacaggttgttctcaaactcctgaactcaggtgatcctccagccttggcctcccaaattgctaggattacaggtgggagccaacggtatccggcctaagacttgaattttaaaaaatttataacaggatacatctgtatttaatcattatgaatattatttactcagttaatctgactgcctttgaccataatggaaaaagaaatttgaggcattttgcacacattattccaatacttgccagatgtgttggggaagatgcattaagttctgcttgtttaagctaatgttctttgacactgcccaagatttctgacaaaagaatgacaagagagggaagttaaactggacttcctaatgctcctcggttttgatgaggaagtccaaatttctaatcactgaaaggggaaaatacatcaggcagtaaggtgtctaaattagataacttagtggcttgatgtaatttattagtatatagcatttaattacatgataaagtatattccttagttttattaatgtatttttataactgtcaaaacataagttgttaaagtatacttcttgtgaagccatttaaactgatactcgatgcatgtgggtgggagagaaggtgaaattgtttatgacatttaaatttgaaaagtgtaaggattatcttggataattaaataaaactttattactcaatagtttagattctactttagcaaaaaaggaaaaaaaccacattgaatacctactctatgttcgataatgctgcagggtgttaagagtatgacatgaattaagatgtgatctcaatcagggaggatgggagtttgccagtaatttttcttttgttttggtgtaccttctgatttttaaaaataattaacatatcttatgcaactaaaaatatactgtcaaacctatttaaaacatcttattctacccagcctgcccagcttttgatgtaattggggaagaaggttcagtaacagatgattttaacataacaggttgggctatgattgatatgttaattgagtgctcttcagagaaagggtgatccataaattcaatctagatttttaggaaaggtttcttggaggaaacaggggctgaattgactcttaagtaataattaccaaagagaggtgtggagctgatttcaggcaaaggtgttgaataaacaacatggaacagatatgttgggaactgtaagtagtgtattacactgttttgcattgctataaaggaatatctgagactgggtaattaataaatgaggtttattttggcttatggttctataggctgtgtaagcatggcaccaacatctgcttggcttctggtgagggcctcaggaagtttacagtcatggtggaaggtgaaggaggaaacaggcataccacatggcacatgagcgacagggaaagagaaggtcccagactcttttaaacaaccagatctcatgtgaactgagtgagaactcactcatcaccaaggggatggcactaaaccattcatgagggatccattccagtgatccaatacctcccgctaggccccacctccaacattggggatcacatttcaacatgagatttagaggggatgcccatccaaactatatcaagtagtttgttggcaagtgatggttctggagctgttggggcttaggaagagtgtgtttactctttgctcaacagtttgttctagtgaaggacttgaagcaggagagtaacaagctcatgttttttttcctatacttgtaaaaattattcagctttccactctttaaatatactaaaatgggcacctaaatgttgtacgataagaattggtttcttttctctaacagcagaagggcttgggatactgaaggaaatgtgacttttctgcctttgtctattgggtaagtggctcatgcctataatcccagcactttgggaggccaaggtgggcagatcacgaggtcaggagtttgagaccagcctgaccaacagggtgaaaccccgtctctactacaaatacagaaaattagccaggcatggtggtgcacacctgtaatcccagctactcaggaggctgaggcaggagaactgcctgaacccggaaggcagaggttgcagtgagccgagatcatgccactgcactccagcctgggcgacagagtgagactctgtctcaaaaaaagaaaaaaaaaaaaaaaggtttctctaagtgaattattgtggcactgtgttagtcctcctggtaacatgagctgtagtgacatcgtctggttttaatcttaaaggaataggaggtgacctgtctggcagcctcctactgggctctaataattttacatttgtgtgggcttttgccttctcttgccattggtggtgtctccttcaactcaaatctaaatttctgtattggcataatactaaaaacacttttattggtgtcttgagcgttatctttcttttttactatcacgcctgcctaattaaaacaaattttttttgtagagacagggtctcactgtgtagcccaggctgatctcaaactcctgggctcaagtgggcctcccaccttggcctccctaagcactgggattacaggcgtgagctactgcaccagctaaggcttatctttcttgaccctagtcaccaagagtgatgatttcattatctgcaggagggtcataagtggagcctactgccaggttgtagtagatgttcttggccttggtgttgtcttttggagtgagggcttagagtagaagtctcagggtctcgtttctagttagcagtcctgcctcttaaaacaataacaatgcgtactttagaaagtgatttaaaattgtctcttccttctgtattattctgaaagaatttaccttttagcaagggagtcttcttgttcagtgtttttacaaaggggatgggtggtgggcaaggtgttacagttgcctgcaaaggagtgacgcacagtgtatcgttcgtttcatccaccgcttgtcccttgtttcctttttgactgtagttttactgttaggtaaagtggctttggtgatttggagtatttttgtatgaggtcatgaattttccttaataaccaaggaaacttatgatctttccttcccctggttagtagttgtatgtgttttaccctttttgtcagcagccttcgtcacagcctcatctctcctcatctgttacagtagtcaccaagtttccctgctgagagtttggaagcatttctttcccagtcatgttattttcaagatataccgagttctgctttcctttatcttaagattctcagcaacctcctattttctagattcgtttttttgcaagattcttccagaaacagaagacacacatgataacaagttctaaataccctacacacatacctactgtgtcctacatttccccactcttttttcattgtccatgttcctgctagtttctctcctttaaggtttatgacctaatatctgtagatgtcagtcactcggcatgtgattcacagatgttagtggctgtggagtggtatttgaggaattaatgactaaaatagaatagtcacttctgtcttatttcagatgggtatgtgtctctctatgtaatgtggcttggttaaaattgacctatataatagagtagctttaaatggaaatgtattaaaataattgtaaaaataattcaaggagtatatgacaggattttttgctgcaaatgaaacaatttctcactttctaggtggttcaaggaaataagatgagtctatataattttttgttatattatattttagttaattttggtggggaccgttttatattcctttaccatttattaccttcatctctgtaccctttgggagaggtaccctgtgtttcttatagttctagacatttctagaaatgtgatttctttaaaaagcctccccttcctaaacattcagtatttaagtatatttattagctgcattagttataaaaatggcagagttaatttactgaatttcagggtatcaaacatttgaagaaacatttgaagaaaatgcctcatgttgtaatttgacttccttttaaattatatgtatattgtatatttttattggaaacaaaacatgcggtatttataaatacatatatatgttaaaacattttaactgcaagatgtgagaacagggcccgattcactgctgggttctgggcatgagtttgtaggtagggagctgtgtttatactcggagtagtggcacttttagccaagaaactcttggggaaactattaggaagagaaatgtagactgtgtgtgtgtatttggcggggaagagatttgtaagaaatctgtagcaggcatgtcagatattttgacaaccattactttaaaatattgtcacatatatattatcccttttacatcaagttgtgtttccagtattatcaccgtgttatgtgaaagtttagtttaacccccatttgatacctttccctggagctgctgttaatagtttgtatttcctttcagtcattttgctatgtatttttatattgaatgtgaaattgtatagtttgtgtggattaaataagtaacatttaaaatatgtcttggagacacagcttgtatcagttcacatagagctattcattttagttaatatgttgtacaatcagttctccatatctgtggattcaactaactgtggattgaaaatacttgtgaaaaaaattgcatctgtactgaacgtatacagacttttttcttgccattattccctaatcaatacagtaggacaactatttacatagcatttacgttgtattaggtattggaggtaatctagagatgatttaaagtatatgggataatgtgtgtaggttatatgcaaatactgtgtcattttatatcagggacttgagcatccatggattttggtatccttggaaggtccaggaaccagttccccacagataccatggggcgacagtattcagaataatgctagtagaatcggctgggtgcggaggctcatgcctgtaatcccaacactctgggaggctgaggtgggtggatcacctgaggtcaggagtttgagaccagcctggccagcatggtgaaactccatctctacaaaaaatacaaaaattagctgggtgtggtggcgcacgcctgtaatcctagctacttgggaggctgaggcaggagaatcgcttgaacccaggaggtggaggttgtggtgagccaagattgcaccacggcactccagcctgggcgacagagcaagactctgtcaaaaaaaaaaaaaaaaaaggtgctagaatcttccttgggtccttgagtttccggcagtgttgcagtaaacgtctgcatttctctaggagacatacctcaaagtggaattactgggtcacataatacatttttcctatgttgattgatatttccaaaccatcctccagaaagtgtgcaatatgagagtgctcattttctcattcatcacctacttgattccttaagtatcttagatgtgagattcttgtagataataatctgatatctcattgccaaatcatttagcacagttatcgattgtcaaaatctttctgaaataaactatgactaatatacttaggaaaagtttatgttcattaagaggtcattgctcatatatccatttgtagcatttgtacaggacattttaacttttttataggatcagtccatgtttacagattatcagagaggggaacttatgctatacttcaggttaatctgctgttatataaactttataatcaggaaataacatttgagaaaatgcctcgttatggtttgatttccttttttttgcatttagagtgtacaaaaaagacaaattggtattcacttaaaatgattatttactgaactctagcctgagtgacagagcgagaccctgtctctaaagaagacaatttttacattgacaacatctatttcttcatggattaagtctaatttcttcttcgtatatttactttacacattttgccacatgtaaactgtactttgtgatggaactcccctgcctggagatggcaggattaaagttcctctttgtctgtctaccattgacaagagtgaaatcatggcacagaaagagttgggaagactcagatttgagctgcagagacgtgacttttcgagcaagttactgaacctgtctgagaatcattatctctgtgtgagcacgagagtttttgtgaaagtagaaacgctgtgtattaagtacctgaacatactcagtaacttgtaacaattataagtctttaaacaacctttctgccttataatgctttgggaatcaatttcaggatgatttttaggggaaaaaggaaattctaatttgtagcagaaccaactttggcatacctgggggaaatggtggtatagtaataatttgaaacatttttgagcattggtcactgtataattaaaaacaaaccgctgttgctgaaactattttgtctgttagtaaagtgactgattttagatagcatttcattagttctaagtgttcttttaaaaaagcctgcttctatttctggtaacatggaggattagaagtgcctactgataatagttcagctaaacgtgctacatgatacgttacacacacacttgtgtatactgtatcttaaattatatatacacatcttgaaacacatttaagtgtttttagtaaatagtttagctggtgggagagtaaagggatttttctgaggcctgcgtcagttagtgctgtagatccagtgtggtccttgaaagtatctgccggttcctggtggcatagacactgagttttgataggcagtgaacatggggcacagatataaaggctgaggccggggaagaggacataaaagacatgtggataatgtgagaactcccgaagagtggcagcatcctccccgtgggagctattaaaaagaattcttaaacacaggaccacactcacactggtctggagcaagaattcatactatttggtttaggaaggaaaaggaaaaaaagcttgaagtttaaagtgtattggtagtgaacccagcataagtgaacacataccttctctggaggaactctccttaaaccaaggctcaaagattcccctcagatagagtcctaatgacttcattctaatataaatggacctatgtggaaacaagctaccctgagacagtcagcaaatacaacaaattacctaaactctcaaagagattacagatattagaattaccaggtgtagactaaaataagaggagatagaaaatatgatgtgggatgaagagaatcaaagttggccaagtaggtttggaaccaaagggatttgtaaatgatacatatatggtaatttaaaatttacagtgtaacatattgattaagcagattagatacagtgaaagggatgacaaaatgaaagatacacctaaagagacctagatgaaaaatagagaagaaagggtaagagatctggaggaatagaatgcaaaggtcttacgtgttgaatcagcatcccatagaaaggtacgaggatggaggatgcccagtatgcaaaggtggctgaggacttctacaaattggtgagtcctcagatagaagaagccaatgaatactaaactagagcaataaaaggaaatcctagtactagacacaatgcagtaaaactagaatattgattgatgggggcaggaggagaggaagcagttacagagaaaagacagattacccagaaagaactggctgacagatggcttatattttaacagcaaaagcagaagccagaagatagcgcaatgatagcctcaaagcgatgagaaaaaaagtcatcaatttagaattctgtactcaggaataccatcattcaagaatgaatgtaggctgggcacagtggctcatgtctgtaatcccagcactttgggaggccgaggcaggcaggtcactcgaggtcaggagtttgaggccagcctgggcaacacggtgaaaccctgtctctactaaaaatacaaaaattagccaggcatgatggcaggcgcctctaatccctgctacttgggaggctgaggcaggagaattgcttgaacccaggaggcggaggttgcagtgagctcagattgggccactgaactccagcctgggtgacagagtgagactctgtctcaaaaaaaaaaaaaaaaaaaaaaaaaaagagtgaatgcaaaataaagatatttcaaatgaaaacagctaaagatgtatctgttttgtgctttttaactttggagagtagggaggaggaaaggaagaaagtcaggtggtgggaagagatcagagatgatcagctgggttctttgtgatttaacctccttctgagccccaaaatactaaattaagatatgctttatatgagttgattgcttttgatgctgatgaaggatggatttgattgtgtctttgcgatttatgaggctgaacatggatgtggatgttggagcacagagatagaagaatgctcagtcgaggagggaactcacatgcatgggggcaggcggatgcaggcagatggctatgaatgctctcaatgccatgatattggggatcaggccaagtttaatcagctctgagaagggggtgccctggctggcaaatgtgaggaaaaaaacatcataaagttgccatttgaaatagaatcccaggctaggcgcggtggctcacgcctgtaatcccagtactttgggaggccgaggcgggcagatcacctgaggtcaggagttcaagaccagcctggccaacagggcgaaaccccatctctactaaaaatacaacaattagctgggcgtggtggtgcgcacctgtagtcccagctactcaggagggtgagacaggagaatcacttgaacccaggaggcagaggtggcagtgagccaaatcacgccactgcactccagcctgggtaacagagcgagactccatcacacacacacacacacacacacacacaaaatagaatcccattcatagtgatttatgtagtcaaaatcagtttacttaataattgaagctggcttattgttcagtagaccacccctcagagtcagtgaaaacagcagcatttcaaaatacatttttctctccgtaaattttcttcctgagaagattttcgtaagatttggttggaaagctggctcacattgttactgtactgtacttgccttcatcagagaggctataatgaagtgagatgatagtctaggattggttaaaatctagaattggttaaagtctaagggcagggttcttaggccagggccatagtcttaaacatttcagtgaagtcactatgatgaaaacaaactgcatttggggccgggcgcggtggctcacgcttgtaatcctagcactttgggaggccgagggcgacggatcacatgaggtcaggagttccagaccagcatggccaatgtggcgaaacctcgtctctactaaaaatacaaacattagctggcacagtggtgcaagcctgtaatccctgctattagggaggctgaggcaggagaatcgcttgaacccgggaggcggaggttgcagtgagccaagattgcaccactgcactccagtctgggcaatacagtgagactctgtctcaaaaaaaaaaaaaaagcatttgggctactccttgggatttattaaaccacccatacagatatttagtctatttgtgaattctggtcataataagatatccttaagagctgtatctactaaagactccgataaagagttagatttatatggaatatgaatgctttgaatttccattgttttgtgctttattctgtttgcttaatagaaataaaagaccatattatgatctgtttgttaaattactatggataaagacatagacactgagattgaatagaattacccctttgtttttaatccctgtctgtcaaagtcatagccagacttcttcacaaattctatactgaataaaatatctgtttttgtattcagtgtaaaaaatggaaaccaacaaatgaaatcattctatggctgattcagagctgtttaaaactattacctaaattagtttgcagttcatgattttatagcacagtgtaaaggatttagtgagacctcacttgcttggctttgagaatatttctgtgattatggatatgttggcttggtgggctttgacaatccttgaaattggcttttattaacttgtaggctcttcaataaaacattgaaactataaaatatgcagagctgtgctctaattatctgatttaaaattactattcgtattgatccattctgtgtggtcaaatagcaaggttaaaaagtgatttatttttcttcctttacgtagactaaacccagaataattattgggtttaattacataattcctggttggcacaggaatttacagaattctctttcttaggcatgtatctgattacaaaaagacaatcaaaattcttggtagaatcatatatatgtgtgtgtgtgtgtgtgtgtgtatatatatatatatatatattttttttttttttttaagtaatcctttctttcccacccactggcagctgccaaacatacacacgtgactttccagtatgtgtgtgaggaggtttctctcctgtctgaattcagggaaccaacgtctcccttaaattccttttgaacaaggcagagtgtaataagtaaattacttaagagccggtccctcttgtttttgttcttattcttacgtagggaaaagtggttgggagatgcattctagttatttgcatgagcatcttttcgtggcatactttcactgtgcctgatgtgcttgcctcttctgcatcagtggctcattctgtataagcaaatcttagatctttaatgttagctctatttttcttttctcagaagtgccacaaaattaagttttgtaagcattctgtcatttttaggtggggaagatgatacttagatgtttatagactctaatattgaaagaaacaaaagcactgaatttggtgggaaatgtaaggcaagatgtgtgcccatttaaaacaccaaatttttttttttttgagatggcgtctccctctgtcacccaggctggagtgcagtggtgcgatctcggcccactgcagcctctgcctcccaggttcaagcaattcttctgcctcagcctcccgagtagctgggactacaggcacacgccaccacgcccggctaatttttgtgtttttagtagagatggggtttcaccatgttggccaggatggtctcgatctcctgacctcgtgatccgcccgccttggcctcctgaagtgctgggattacaggactgagccactgcgctgggccaaaatactaaaatattaatatggatggaaaaaagcaatcaacttctgagtgttcccaaggaggtatgacattattcagggactaatcctgcaagtggaaaataaaacttaaatcatggtcacataagtgtgtatgtaataaagtcaaggcaatttgtgccagttatgacttgtcaagtatcattcttctgacatcttagaattgcttggcaagtttattttcatgacacattacccatcctgaaggtttcaataaaatgatactgtatagagatctgacctcagatccttcttgcactctttaatgttcatgtcctaattgtccccctgccgtacccttctaatttctcaaagtagagggaggcagttgtgtacactctgaaactaaggagcagatttatgaaatcaacaatacttttggctcctaagagagaaaagtaacatttgtcttctttttcttccaggttgtccttctattcaggccactcttcgttttccatgtactgcatgctgtttgtggcagtaagtactttgtgtctgttgacggttaggttatgtgctgcatggaattaatgtgctcagcatcagtgtcctcacctgtcctaataaattagccagtagcaaaaggtgaaacagatgatctgcaaatctgtaagtttcatactgagaagtagttgatgtgtgcccttactttgggacgtttcctgaagtggttttctggaacacagcttctgtgtaatcacagcaggtaactaatctgaaggactgggacaacaggctgctgttgcttgttaacctcctccctaactgggagccactctcctcatctgctcagtgtgggcgaacagcagcagagcttctttccttctgggctctgctgtggtgaggagttgggttttgatcattgttaagtgaaggcagctgtccttgttcctatttgagcagattttgttttcctcccattttctaaaacattcccagagtgctctgcaagggaccagaaaggtttcaactgctgggaaaggcagttgccacttctggagcctgtcatctatacaacttccaggtccagttctgatgccaacctgtagagcagcagcatagcaatttgcatttgcatcatacaaagctggcagtgaggccttacgaagatttgcacccacattttgcattatcaaactagagatgaatatgtagttttttgagagtaactaatgcaagaccaggcttcaggacacattcaagggatttttaaaggtcaattttacttgatttttatttttttataatgttctctttacatataaagtattaataaaacactatatatttgggtgtattaatatgtcctgcattatcattatttagggggaacagagaggagggttagaaaatctgtaccctaatagatcagctataatttttgtcttaattttctttataaggggatttttatacagttgtgttctgtgtaaatttgtcatttcctgtgtttttccctttgatcacattaagtgccgtatgataatttaatgcttagacttaaaatgcacaatatgtaacattaagggtaaactaatgggaattagtctcagagataatttaaaatgttttactagaatcttgcttttatttgaaaaaacaaattccaaacattaaaagaatatgtaaattgtagatgtgttatataaaattcaaagtcagaacctcaagccattacaacagctaattttcaaagctttcatcttacattaattaaattttgtgaagaagcacagagtatgattcagcagaatttagggcttcctttttaagacacacactcaaatgtttctgcagatgcagcatggaaaatgtgacttatctgaaggtagttagcagaaaatactattctgacatcttctgttcatttatcatattagaaaaaaatcagcattctttcttaagtgagacaacatatttttttctttttaattagagcacgaggaccagggcagacccggaaggctgagcaatagctagagccgttactatcctgagagctcttcccagagcatgggcctgtgactggactgaagggcgtttgaatgtgtgggcgtgctttgtatgccctgggctagacctcactaggtctagcttttgtctcactagctattgtggtttgtttttcgctcacctgtctgtgttagtgtccaagtccctctttatgagaaatctagaaatctgagttttgattgatcttgatgatgatttgcattttacactacttttatttttgactaaatttccatgaaaagatgagggatgactgccactgttttacaagtgagggaataggcaccttgggagggggctgctgagttctgtgagctctgtggggtttcttgataatcaggatcccatgctgtattgattgattgattacttggtctgaaccctagtccatttattttgaaggtcagctcatgcagatctctggaagtaaaatggcattctggaagtgactgacacataactttgacccactgtttgtaattttaaagaaaattctcagctataacatattccatacttcatcattttctgctcttcttccttgacccttctcaaaacacccattaacgtctgtgtaattggtcaaatagtaacttgtactgagggctgttttgtgaaagattaaaattactatagagaggatgacattgatataatagagggcctcagtggcaggcctgctcagtggacatgcagccacatatgaaggatatcaactcgggaaaatgatgtcaaccatagtgtggtaattgggtcagtttgaaccaactgtgttaaaagaacaactttagataaatttaagggtgtcactgggcaaggaagaaacgactttcaaattgggcagccctcagagtcactgcagattcagaatgactccactgcttctaagtggtcagggagaatttatggacagaaaaaggaaagtgagtacagaaaatggaagcgaggtgcagaaactgccggattggttacagctcggccttggagctttatttgagcgtggtttgaatggctgtgagtggttgaaatatggctgcagggactggctgagactcagctgctgttacagaagcacattcctgagtcaggctcccagtttgcttacttaccaaattaggttgttctttgtacagaagaactcaagtatgtgagcagggggttttcaggacagattttagtttgatttaacagatgtaaagttataatggcaaaaaaagaagcctagataaatagatttgttgtagaccaagacctttctggagaagaaagcaggccagagcaaccatgcactgcattttactgactctaggtagtggaaatatttgcttgatgtggatgtaggccccagcttttatttcagccctgaatacacagatccttgctttttacatttatgtacaacttttttttttttttttagacggagtcttgctctctcacccaggctggagtgcagtggcgcgatctcggctcactgcaagctccacctcccgggttcacgccattctcctgcctcagcctccagagtagctgggactacaggcgcccgccaccacgcccggctaattttttgtatctttagtagagacagggttttaccgtgttagccaggatggtcccaatctcctgacctcgtgatccgcctgcctcgggctcccagtgtgttgggattacaggcgtgagccaccgcgcctggcctatgtacaacatttaacctctaagccccacccccgaattccttgagcaatgactcatcttgtttctctgggcaccttggcttcatgagtcagtctcagatttgggtagagacgtagtcatttaaatcctctcctaggacagtctttgatagccaaaacttctctgtcaattcctgacacccagaaattaacttctagttaaaaatggctcttaaaacaccctgaccattgttcttctctggcagccagtgcagccctgcacacttaactgtgccaagagagtgtcagcatcagtgaaaacctcccaggcctgcgggagctcagggcagggctgctttgcacatagccagtttatatgcttagtgactccccgtgaacttggctgaatgccagagattccaaatttatttgattattcaggagaacagccatggtatgagtctgtattttctttcaatacagtgaggagtgttaaaatacttttcctgagacccttctattgaggctgtaaccccagattgtttatatcaccgcctgttatgaaattcctgtatctatgcttcagccagactctcctcctgccacaaaatgcctcttatctgggccttgcccctgccctgtgtttagacagtgctgcccacctatctaaatccactcagactctttcatactatccactttccttaagattcatataatccctcatttagcattcactgtatacctcctagcattgttgatacttcgtgatgttttccaaacttgattattgctgaacattgggcaaatgatgaacaactcatggcccatagcctacgaaccttgtctgattttgaggtgggatttaagatctaaatttagtgcctcagtgaatcctaaaaatggtgaaattaaaacccaaagaagactaaactgaggcctgctttccagtgttcttctggacagatctgtcatcaaatgtaggtggagcaatcaatttggcttgcctggctagtcataaaagcactatttcaaaataagtagaccaaggtatatttctttgcattgagcctgctgttgttagtctagttctggggttggtatttttttttttttcagtgaaaggtcagataataaatatttaggctttgtaggtcacatattcttttttgaaaaaacaaacaaaaaaaactccttaaaaatgttcttagcttgcaagccaaccccttgactctagtttaaaatggaaaaaaaaaagttcttactttattaacaatagaatattcagaggctatgagacaataacaacattttacagttaagaagtgttaacaagattagtcaaggaaaggcaaaatcaaaacagcttcaaaaaatatctcgttcaacgattatttattttaaaggtgagatattctaattagatcctttaatggaagttaaatgtttcagaaatttcaaccaaaaatggttatatatccttcctgtcttagtttgggctgctataaccaattgcagcagactgggtggtttataaaaaacaaatttctcagtctggaagctggaagtctaagattagggtgccagcatggttgggtaatggtggggccttcttccaggttgtagaatgtcctcacacagtggaaggggcaagggagctcccctggatctcttattaggtcattaatccctttcatgagggttaaccccttatgacctaatcacccacaaaagtcctattttcctaatcccattgccttgtgggggttaggcattcagtatacaaattttggggtaacacaaatatccaggcaatagcaccacccttcagtgataatgaaagaatgcctaagtagtatcacagatgttgaattttctagtttcttttaatattaatttttaaacaaaagaaaaaatgggcataccttgtaatttgttcctgatgtggctctgtgtaatgaagagtcttccgtttgttttgaccaggtcttctttgtgcactttataaaactatcatgaggctcttcacaagcggagccacacgttttggagtgttggtttattagtctgttttcatgctgccgataaagacatacccaaggctgggcagtttacacaagaaagaggtttaattggactcccagttccccgtggcttaggaggccttacaagcatggcggaaggcaagaaggagcaagttacatcttacgtggatggcggcaggcagagagagcttgtgcagggaaactccaccttataaagccatcagatctcgtgagacttactatcacaagaacagcatgggaaagacctgcccccatgattcagttacctcccactgggtccctcccacaacatgtgggaattcaagatgagatttgggtggggacacagccaagccatatcatttgggactgggaggaaggcctctgtgcttctcagtgaagcatttgctgcctgcaggtggaatggccagctttctgcaaccctcctttctgggcttgaacacctggttattttgagcaatgtgatgcttggtgtccttattgctctaagaaataggaaattgcttgtatgaatctctagtaatatcccggctaagaagtttttttttttttttttttctctgagacagagtctcactctgtcgcccaggctggagggcagtggtgtgatcacggctcactgcaacctccgccttctgggttcaagcagttctcctgtctcagcctcccaagtagctgggactacaggcgcacactgtagtacaaagagacagggaggaatagaaatagcctaactgtggtttccttctgaggcgtcggggttgccatatgttgtgttcctgtggtatttgtatatccagcccattttaatagatgaaaatgggggagggaggagtgtgaaggtcaggcgaagaatatgatgtatctttgtttttcctattaatcttcatttaaaatttgtgtgtcctggaaacccatgtctcttcctttccagttctagagttgtgttcctgtacgttacagcagggatcacactagtggcacactcaagtgttcttttgataaatgacatttactcttgatgtatatcaggatagcctccaaatttgggagcagagactataaatactagaaatagtcatcctttttaatcaaggaaggaaagcattttttggtatgggcagctgactggagattcttccgcatccattctccctgttaccaggtgatctcttgtattaataccttttaaaaagcccagttaccactgcacatctccctcagcatacttccccggattaggcccccttttctgcatttctctggtggctggactaatttatattccgagcagcagtgtagaagagttccttttctctgcatcctcaacagcatctcttaatgtttttttggtctttttaataatggccattctaactgaggtaagattgtggttttgacttgcattttcctggttagtgatattgagaattttttcatatacctattggccatttgtacgtcttcttttgagaattgtctattcatgccccatgcccacttttcaatgggagtatttggttttctaccgttgagttgagttccttatatgtcctggatattggctccttgctggataaatacttggcaaatattttctcccattcaacagactgtctctttattctcctgattgtttcctttgctgtgcaggtttttagtttaatataatcccatttgtctatttttattgcctctgtgttcaaggtcttagccataaaatctttgcccagaccaatatcctgaagcgtttcccctatgttttctttgattagttttatcgtttcaggtcttacatttaagtctgtaatccaacttacttgagagataggggtccaatttcattcttctgcatatggatatccaattttcccagcaccatttagtgacgagactgtctctattgtatgttcttggtacctctgtcaaaagtcagttggctgtaaatacgtggacttatttctggtatctattctgtttcattggttgctgacgagtctgtttttataccaatactgtgctgttttggttattatagccttgtaatatgaagtcaggtagtgtgatgcctccaagctttttttcattttgctcaggattactttggctttctggctcttttttaattctgtatgaattttaggattttttttttctatttctgtgcagaatgtcattggtgttttgacaggggttgcattaaatttgtagattgctttgggtagtctggtcattttaaccatattaattcttctgatccttatgcgtgggatatctttccacctgtttctgtcttctgcattttcattcaccagtgttttgcagtctcctttgtagagttcttttacctccttggttaaatagatccctaggtgtctttttttcttcttcttctttttttgtagctattgttaatgggattgctctttttttttttttttttgagacagagtctcactcagtcgctcgcccaggctggagtgcagtggtgcgatctcggctcactgcaacctccacctcctaagttcaagcgattctccctcctcagccttcccagtagctaggattacaggcatgcacccggctaattcttgtatttttagtaaagacagggtttcaccatgttggccaggctggttttgaactcctgacctcaagtgatccacctgcctcggcctcccaaagtgctgggattacaggcgtaagccacaatgccaggcctgacctcttgatttctttctctgctaattcactattgttgtatagaaatgctagagatttgggggcatggtgcctcacgcctgtaatcccagcactttgggaggatgaggcaggagaatcatgaggtcaggagatcgagaccatcctggctaacacagtgaaaccgtctctgttggaaatggaaaaaattagccaggtgtggtggcacgcgcctgtactcccagctacttgggaggctgaggcaggagaattgcttgaacctgggaggcggaagttgcagtgagccaagatcgtgtcactgcactccagcctgggtgacacagtgagactcggtcaaaaaaaaaaaatgctagagatttttgtatgttgattttatatcctttaactttactgaatttatcagatctaagagttttttggtagagtctttaggtttttctacatataagatcatattgtctgcgaagacggacagtttgatttcctgttatacaacttggatgcctttatttcttttctttttttcttttcgagactgggtctccctgtcacccaggctggagtgcagtgacacgatctcagctcactgcaacctcattgtcctgtgcttaagcagtgatgctcccacctcagcttcccaaatagctgggaccacaggcacatgccaccaatcctggataattttttgtattttttttttttttttttttgtagagatggggtgtcgccatgttgcccaggctgttgtgaactcctgacctcaggcgatctgcccgccttgaccttccgaagtgctgggattacaggtgtgagccaccacacctggtccgtttatttctttctcttgcctcattgctcagggttaggtcttcactgctatgctgaataggaggggtcaaagtaggcatccttgtcttattccagttcttagaggaaaggctttcagcttttccctgtttaggatggcgttagttgtgtgttcatgcaacatttatcatgttgagttatgtccccttcatgcgtagttcctgtggacaggtttttttttttttttaaatcatgaagggatgttgaatgttattaaaagactttcatcacatttgaatgtgatgtgtcacatttattgatttgcctatgttgaaacctccttgcatccctgggataaatcacacttgatcgtggcatatctttttgatgtgttgttgaattaggctggctagcattttgttgaggatttttgcatctgtgttcatcagagatattggcttatgggtttcttatgttgcatccttgtctgtttttcgtatcagggtaatgctcacctcatgaaatgagttagggagaattcccttcaattttttggaatagttagaggagaatgggtgttcttctttgtaagtatggtagaattcaataataaagccatttggtcctggattgggaccaaatgggagacattttattactgattgaatctcattactcattattggtctgttcaggttttctatttcttcctgattgaatcttggaagattgtatgtatccaggaattgatccatttattctgggctttccagttcatgcacagcagttagcagtagtctctgatagctaggcatggtagcttatgccggtagtcccaggactttgagaggccgaggtgggagatcctttgaagccatgagttcaagaccagcctgggcaacatagcaagaccctgtctctaccaaaaaaaaaaaaaaaaaaaaaaaaagaagaaaaagaaaaattattcatgctggcatgctctgtagtcccagctactcaggagactgagacgggaggatcacttgaacccaggaggctgaggttacagtgagtgatgatcacgccactgtgccccagactgggtgacagtgagaccctatctccaaatagatgattggagatagatgttcttttgtatttctgtgttatcagttgtaatgtctttttcatttctgaatttatttgggttttctttttctcttgtcgatttcgtttatcctttcataaaagcaactttttttgttgatcctttgtacttttaagagttcattttgttaagttctgctctgctctttagtatttttcttccaccaattttaggtttgttcttgtttttctactatcttgagttgcattgttagattatttacttgaaatctttctagatttttgatgtgggcgtttattggtattaatttacctcctagcattgttgttgggtttcggtatgtcctgcctctattttcatttgtttcaagaaatttttttattcctttaatttattccctgacccagtggtcattcaggagcatgttgtttaattttcatgcatttgtacaatttcccaagttcctcattattcatttccagttttattccatcacgatctgagaatagtttggctggtggggtttatttttctttcagcacattcaatacatcatcccattttctcctagcctgtaaggtggctgctgagaaattcactgttagtctgataggtgttccccttctaagtgacttgatacttttctcttgctgttttattctctgacttttgacagtttgactgtaatatgccatggatttttgaattgcatctatttggggttttctaagcttcctgtgcctgggtgtctaaatctcttgctagacttgggaagttttcgggtattacttaatcaaataggttttctatcccttttatttttgttttctgagacaccaaaaatttgaatatttgatgactttatggtgtcacatatgtcacagagctgttgctcattctttcttatttttgtctgggttcaaaagacctaatttttgaagttctgaagttctgcttgatgcagtctattgttgaaactgttggatctattttatatttcattcaatgaattcatcaatttcagaatttttttttatatctatgtctttgggaattttctcattcatatcctaaatggtttctctgatttctttgtattatttttctgattgctgttttcttgtatctcactgagctttttcaattttttttgaatcattattttgaattctttttctgagatttcacacatttcttcattggaatctgttgctacaaaattactgtgttcctttggaagtgtcatatttccttcttcatgtttcttgaatccgtatttcggtatctgtacatctggtttaacagtcacttcttccaattttttgaatttgccttcataggggaggatattttccttaagatatatctgtggtgttggtcgggtagatcactttggctttgattccagatgcatgcaatagtgtagtctcagtatgatttctttggctgtaaagttatcagttgtgtgtgatttcctcagtggcttaagttgcagtttttaattgctgcaatgaagcatttgctggagatgggaacattaggtgggcccatcctcgagccccaggagtggcagcagcaggctgagcatgcctgtccttgggccctggggcagtgtatgctggcactgatgttagagggtccaggtgggctgattcttgggtctccaggaagcttgcttggatgccagcagtagcacggtgggaaggtcctcgggcttgctgcccatagacagcaggtgtggtgcgggcagtggcaggacaaccctctgattcccaagtggtttgcgctggtggtggtggtgaccgtgatgggctgggtggctagtccccaggcccataggtggtgcatgtgggtggtggtagcagcaggttggatggtcccttcctgaggcccctgggaggagtgctcaggtgttaatgataggtgcaccctccaacgcccgatggtgtgcttgggcataggggtaggtggagccgggctggataggtccctcagtggtgtgtatagggcttggctgtggtaggtaggggtgtttttgtgtggcagcagtcataaacaggtgggttgggagcatgcactttggccccagatggtatctgcaggacagggtagcctgtaatcaggcttgacaatgcacagtggctctgctggctcactgccagtagcttgtatactttggccctgcggcagcacccagctgtgggtgggggactttaatggggcttcagagatgtggatatgcaggggctgttgggcctcagggaatgatgcagtctgctgggggtggggctctcaaaatggtgccctgctgtagctgcttaggactcggggggatgagctccctctctggagcagtgccatcatgcagtccccaagttccctgtttgtgtgggttgagggtttcttccatggctgggattgcaggacttcacaatgggaatgcggatgctgactgttgggggtcacttacccttctccagcatgggggagcctccccaaccaatccctgccaggtaccctgccttgcttccctctccttacttgcctcaggtgtttcctgtcattttggtggtaaattccagcattctctcttaggtgatctattcaaagtgtgatttatctactactgttttggtggttcttcaagcagaaagcaagtaccaggggcactttagtcagccatcttgaaaccactccattgttttctactaaatggcttgctgtcctcgaccatagcttttgcttcctcctaactttagtttgcaaataacctattatgtacccattaggcatccttcctactacttttgaaattagagaacgccttcatacttctggtataaattccagagacaaaatacagcccagcaggtctctgggtgatgcctggtgtaagtcatctagtcagtgcagggagatgtgggtatgcaaggagaaggcagggctatgtggtccaaataggactgactgtgaatgggcaattccacctagaaggggaattaaaagtaataatgttgctgccgagcctgtctggtaccacacactgtattggacatacagctctgttaagttcctactcttaaaagagaagtaactaactgaatgccttacctagaatgggtttaatagataaggttggcaaatggcatgtatggggaggagagaagagtggaatctgcaaaggaaggaacctatacagcctttttactattagccttggcgctgaagcatgagctgtgtcccctgtatctagttctaatagaacagtattgagaagcttcagacattcaacttttcagtggcatttagggaaagctaaagtaatagactttcttttaaaggaagtcatgtcaagtgtttgctttgcccagaatcaaagtagagccaccagaaagacactactttttagctttgttgaacttacgcatataggaaacttttgctggcaaggtgggaggggaaaagccagtccggatttctgggcatgtcagctgtggaattcaagtttacccaaggtctgagaaattcagggtgtccactttcttgagctctacagaaatggaagtcttcacagagctacaccgagtaccctgacccagggaaacgcagtatgggcacataggaagcacactcaggccatgcctgtttgtcactagagaagccaaagcctagagcacaaggttaggtacagaaccacaactggggcatcccagaattctcacggtgaaataatttctgggtccatggtcagagtttcactgatgggggaaacctctattcttgggtagatgtgtaaggagaaaaacagctatttatagggggaaagacttcacttagaagtgttggagcgagctgggtgtggtggctcatgcctgtaatcccagcactttgggaggctgaggtgggtggatcacctgaggtcaggagtttgagaccagcctggccaacacagtgaaacatcgtccctactaaaaatacagacaattacctgggagtggtggtgagtgcctgtaatcccagctactcgggaggctgaggcaggaggattgcttgaacccgggaggcggaggttgcagtgagccgagatcgcaccactgcactccagcctgggcaacaagaggaaaactgttccctgcttccccctcccacatccccccccccaaaaaagtgttggagcttagttgattattgataatgttaagtaaatgttaattcttttcactggcatgttggggaagaaatctggagaaaataatattcaatatgagtttgcaggctatctacagtgaaagtcagggttgtttagaatggaaatattgctacagggattttagaatcttaaaagaggaaagaccttggagtcctagctctgagtttccttcaggttggaagtagcatgggactagcttaagtccattctagagttgctatttttgatttgactacttacttttttcacagcttgaacaacaaacaaaaataaggattctgcagaaagccagtggttcttaaacttgctgatgagtcagactcagttaaacagctggtgtgctcttttagaactagatggtttatactaagtacttgataaaattagataagccctgggtctttgccagcttttggtgactgaacacccatggcagtgcccagagagctgggaatggatttgtgtcatctattttaaataggcagtgtccatggggagagctatgtatattgttttctaaggactgcatttaatttagtctacgagtcatatattattgaacagaattttaaagggaatgttataaattatattgttattggatagaaattaggtagttttctttttttttttttttttaatgagagcagactccctaaaaagaatcatttctacataaaaccttcagagatgcacccaaagtcaaaggcagactgacatgagaaaggggaatttcttaggtccgattagtgtacagaaaactcatagaacttaacttaaaggggatacaagtactgttgaaagaatacacttcttggctggatcataactaaactacaacctatattacttgcaaatacagattatttagtctcagttgccttgttaaacaatttgagggtagaagagctctctttggttaattaatgaaatagtccctagataggcccagagcaatggcaacctgtgcccagaatgctagcactttatcccaagactcagaactaaccacgatactgggtcaggcatggtggcgcatgtctgtaatcccagcactttgggaggccaatgcaggcgggttacttgagacgaggagtttgagaccagcctgggcaacacagtgagacccccatctctataaaaaaaaaaaaaaaccaattagctgggctcagtgacatgtacctatagtcccagctacttgggaaactgacatggaaagattgcttgagcccaggagtttgaggctgcagtgagtatgactacaccaccactgcactccagtctgggcaacagagcaacgccccatttctttaaggaaaacaataaaaaaaccaatggcagcactggtcttgactatgagaattataacccaaattgcaaggggaggaactgtccctgaaatcctgtttagaaagccataaacaaggaaacacctgtttgtatacagtttgaagggtggtatagctagactggcaatagattcttgtgaacaagttagtagggcaatagttttgtttctttaaaggattaacatttaggtaataatgcgtacgtgaatgtttgcctagaagtcctgttccctatataataatactttgataatcatttcaaatgccaacccttccttaatataaaagttttgcgttatgttaaataaactatttttttctttattcttttcttttagctttatcttcaagccaggatgaagggagactgggcaagactcttacgccccacactgcaatttggtcttgttgccgtatccatttatgtgggcctttctcgagtttctgattataaacaccactggagcgatgtgttgactggactcattcagggagctctggttgcaatattagttgtaagtatacaggtcaacagcctacatcttgatattgctaaacatttatataagtaaatagaaaaaaaaaatccaaaaaatccccagctgaggagaagactatgcagtgggcaagaatctcaatgttattaaaagtcacttcaggatacacaccaggttaaaaactaggttgctctttctaaaacttagtagttttgtaaaatcttagtatttttattgtgaaaggctctggctagaaatagtttttttaggggattatgacttgaaaaaactaattcacatgtagaaataactcttttattcagtattggcaaaatgaagctatttgctgaaggcataacaaagcaactcttaatttggaataatctttaaaaaatcccagttagtctctaattttttatatgcttaatctgtacacctcaaagtatatccttttgtttatatttatcttaggatgctgttgatcacaactttgtatgtagtttttaacttgatctaaattataccattaaatattttgcactgtaggctgtatatgtatcggatttcttcaaagaaagaacttcttttaaagaaagaaaagaggaggactctcatacaactctgcatgaaacaccaacaactgggaatcactatccgagcaatcaccagccttgaaaggcagcagggtgcccaggtgaagctggcctgttttctaaaggaaaatgattgccacaaggcaagaggatgcatctttcttcctggtgtacaagcctttaaagacttctgctgctgctatgcctcttggatgcacactttgtgtgtacatagttacctttaactcagtggttatctaatagctctaaactcattaaaaaaactccaagccttccaccaaaacagtgccccacctgtatacatttttattaaaaaaatgtaatgcttatgtataaacatgtatgtaatatgctttctatgaatgatgtttgatttaaatataatacatattaaaatgtatgggagaaccaaatccacacttgcaggcatttgtagtcaactgtaatcaaacaggtggtcaataatttaaaatctcacattcctttagctgactctacaagtagaggctggcagcaaacacaatatctctcttgattttggtgattcctaagagaaaagaaagtaaggtttaaactttcaagaccacaaaac

SEQ ID NO: 37155 - DNA, 6447 bp, Homo sapiens
ggaggacccccgcctcgccgaagacgggcggggcaagccgagcctcacggggtccccggagctgggccgggcctccagatggagaaggcgcaacggggagttcttgagtaagccagagcggtgtccagcgcggtgtagccgcagccgccgctgtcaggcgcagcaacgggcaaccccgtagaagtcggtcggcaggtcctctccaacccgccgctaccgcgccgctgtgggagagaccccagcaggagcccaaaggcagctacgggggcgcgaaggccgctggcgccgcctcggccagcccttcccgcgcggtgaggaccccggggctgtggcgggaagggacccgaggtgcgagaccgagcggcgttgccatggaaacgggccagggcgcgtagtagaggccccgggccagacgggctgcgggtggggtgaaccccaggttgggaggatgagagagcagaggtggagcggggtctttgggatagagagacgtggggtagggtgaggcggggagggggccaatgggagcaagtggagccaggggacctcagttcgaggcacctgacctggggtttctgtaacctccctggtttctataacctcaggattcccccaaacaggttccactgccttaaggatgacagtcgtagggaaccctcgaagttggagctgccagtggttgccaatcctgatactgttgctgggcacaggccatgggccaggggtggaaggcgtgacacactacaaggccggcgaccctgttattctgtatgtcaacaaagtgggaccctaccataaccctcaggaaacttaccactactatcagcttccagtctgctgccctgagaagatacgtcacaaaagccttagcctgggtgaagtgctggatggggaccgaatggctgagtctttgtatgagatccgctttcgggaaaacgtggagaagagaattctgtgccacatgcagctcagttctgcacaggtcagcctctccacattggctatcacgtagccctccttcccagagactaacagtgccttacatttatggttcagggtacctttatggaaattgtctgatttgattctaactacaatacaacccagtgtggcaggcaggttaggtgatgctattctaattcagttgactaagatacatacttgctcagaagttacttttttcaagattacatggacagtgatttgcagaactgatatcagagcccagggtttcttactgcaagcttctctgttggtcatgaggtcccaactatcagtcccacatagttctgtttccttccatgcctacctcttggctgtttcttagctgtttcctgtagtctctacctaaacttccctgtcatgctttttctttagtgaatcctggtacttctccttagtccactccagacctccttatacctcaccgctctcctttttctaggccttaaccctgtcaagccatacttgctcttttttggagaatctcaacatactagagtctaacccagtgattgtcaacagggaacagttttgtcccccaagggacatttagcaatgtctggagacattttttgttgttacagctgggggggtactaccagcatagaatgggaagaggccaggaaagctacatcctacagtgcacgggataaccccactatgacaaagaattatccaacccaggctgggtgtggtggctcactcctgtaatcccagcactttttttttttttttgagacagagtcttgctctgtcgcccaggctggagtgccgtggcgcaatctcggctcactgcaagctccacctcccgggttcacgccattctcctgcctcagcctcccgagtagctgggactacaggcgcccgccaccacgcccagctaattttttgtatttttagtagagacggggtttcaccgtgttagccaggatggtctcgatctcctgacctcgtgatctgcccgcctcggcctcccaaagtgttgggattacaggcatgagcctccgcacccgaccaatcccagcactttgggaggccgaggcaggcagatcatgaggtcaggaatttgagactagcctggccaacatggtgaaaccctgtctctactaaaaatacaaaaattagctgggtgtggtggtgggcgcctgtaatcccagctactcgggaggctgaggcaggagaattgcttgaacccaggaggcagaagttgcagtaagccgagatcgcaccactgcactccagcctgggtgacagagcaagactccatctcgaaaaaaaagaattatccaccccaaaatatcagtagtgctgaaggtgagaaactttgctgtaactctgcgcctggggagatcttgtgtgaccaactcctgacttgctctttataggtggagcagctgcgccaggccattgaagaactgtactactttgaatttgtggtagatgacttgccaatccggggctttgtgggctacatggaggagagtggtttcctgccacacagccacaagataggactctggacccatttggacttccacctagaattccatggagaccgaattatatttgccaatgtttcagtgcgggacgtcaagccccacagcttggatgggttacgacctgacgagttcctaggccttacccacacttatagcgtgcgctggtctgagacttcagtggagcgtcggagtgacaggcgccgtggtgacgatggtggtttctttcctcgaacactggaaatccattggttgtccatcatcaactccatggtgcttgtgtttttactggtgggttttgtggctgtcattctaatgcgtgtgcttcggaatgacctggctcggtacaacttagatgaggagaccacctctgcaggttctggtgatgactttgaccagggtgacaatggctggaaaattatccatacagatgtcttccgcttccccccataccgtggtctgctctgtgctgtgcttggcgtgggtgcccagttcctggcccttggcactggtgaggtgataaaaatgaattggggatttatctcatgggatagaactaggtagggagtttgttcagaaaaggtctgtggatcttctcttctatccagaggggcagacctaagggatagggtggctctagcaagaatgcacgtattctattgtagattttctggatagcaaaactgggggagattgttttgctggaggccctgggtctgggagaaggggggctgattcctctgaaattgctagaagagacacaggtgaggcctaacttgggctttccgctaccgtcctgcaggcattattgtcatggcactgctgggcatgttcaatgtgcaccgtcatggggccattaactcagcagccatcttgttgtatgccctgacctgctgcatctctggctacgtgtccagccacttctaccggcagattggaggcgagcgttgggtgtggaacatcattctcaccaccagtctcttctctggtgaggactttcctttccctggtgggcctttctggacttaggaatgaagaacacattgtggctggtcacagtggctcacacctgtaatcctagcactttgggagaccgaggccggaggatcacttgagcccaaaagtttgagacaagcctagacaacatagtgagaccctctctctataacaaaaaattagccgggcatggtggttcacatctgtaatcccagctacttgggaggctgacccaggaggattgcttgagcctggggagccagggaggttgaggctacagtgagccatgattgcaccactgcactctagctgggctgacagagtgagactgtctcaaaaaaaaaaaaagaacacatcatagaacttgggatagagtcaggatgaggcttgaagggaaggaatattgtaaaagaaagaagaaaaccaaaaaaaaacaagaatgcatttcttttgaatagtttaaaattactaagccctcaaaatgtcctaggcagtgtggaaagcactcagcaataactgtgtgaagtaggtaatatttccattccacagatgaggaaactgaactaaaggctgcttaagtaacttgtctgagattacactcctaaaaagtagtgaactaggtttcagcagtctgacttgtattctcacccattacactaaaataacacccttgaatttttattttgaaggtgggcccactctaggctttcaaaccagattgccctttcaaaggcagtagtagtctctgttctgaacccttcttgttcccaattctgtgtgtctgatttttatcccatcacatttatatttgaaccaaggctttctgaaaacagggccttaatccaaaggaatgtctcatgctaggaattaccaactccaaggcaagacaggcccctggaggcagatggatttgtgctactctcagattatgtagtagctacctggatccttaatgacaccgggttgggggatggtgttggtaagataaagagcaaagagtccgggtgtggtggctcatgcctgtaatcccagcactttgggaggctgaggcaggcagatcaccaggtcaggagatcgagaccatcctggctaacacagtgaaaccccatctctactaaaaatacaaaaaattagccgggcgtggtggcgggcgcctgtagtcctagctactcactcgggaggctgaggcaggagaatggcatgaacctgggaggcggagcttgcagtgagcagagatcgcgccactgcactccagcctgggcgacagagcgagactctgtctcaaaaaaaaaaaaaaaaaaaaaaaaaaaacacagaacaaagaataatgggacctgaaagggtggaggtgaaggcagtcgactctgcagggacatccaggagcatgagtctgccgttagagtggcaggctgcttcagccccctccccttttggtcctggatgtaagtgggtgcccttagagatgtagctcctagtgttgaccctccctccgggggcccatccctgcagtgcctttcttcctgacgtggagtgtggtgaactcagtgcattgggccaatggttcgacacaggctctgccagccacaaccatcctgctgcttctgacggtttggctgctggtgggctttcccctcactgtcattggaggcatctttgggaagaacaacgccagcccctttgatgcaccctgtcgcaccaagaacatcgcccgggagattccaccccagccctggtacaagtctactgtcatccacatgactgttggaggcttcctgcctttcaggtatcctccctttattccatggctattactgtcaggttcctgacctcaatttttcctgtccctactcatccagtaccctaacccaacccgttgatccctggttcagtggtaccattcagagatcattaaatggttcctcctatccccaagcaggactgagcttgaatgatatgagagtgtctcacttataaagctctccggagacatttcccccttcaccttcctggtttctgactttaatgcctatggacatcatgtggggtttaaagcccatttgatgacccatttactttgttgaatacctctttgtgccaggcaaagaataaagtggaataaaatggacaagatccctgccctcaatctattagggaagatattcttgaagtgagagcggctaatcataggcaaaaaatccccatgaagccaggagatctggggcagagagtggagtgaactcacttttcacaatgacccagcaacatgggagagggtgggggctggatttcagcccagccactgtgctgatggtgcacagccctttaatgctgtgtatcatctcttttcttcacagtgccatctctgtggagctgtactacatctttgccacagtatggggtcgggagcagtacactttgtacggcatcctcttctttgtcttcgccatcctgctgagtgtgggggcttgcatctccattgcactcacctacttccagttgtctggggaggattaccgctggtggtggcgatctgtgctgagtgttggctccaccggcctcttcatcttcctctactcagttttctattatgcccggcgctccaacatgtctggggcagtacagacagtagagttcttcggctactccttactcactggttatgtcttcttcctcatgctgggcaccatctcctttttttcttccctaaagttcatccggtatatctatgttaacctcaagatggactgagttctgtatggcagaactattgctgttctctccctttcttcatgccctgttgaactctcctaccagcttctcttctgattgactgaattgtgtgatggcattgttgccttcccttttgccctttgggcattccttccccagagagggcctggaaattataaatctctatcacataaggattatatatttgaactttttaagttgc

SEQ ID NO: 37156 - DNA, 5787 bp, Homo sapiens
agtggcgctccggccagtgattggctggaggtttgttaactattcatgagggggcgggccgagcggggcggcctttgttaagcagcgagggcgcgaccgcgggtactctgctgccggcttctcggagcggcgctgggcgaccagagcagggtcgagatgtcctacatcccgggccagccggtcaccgccgtggtggtgagtgcgcttgcgcgggctcctcctcgtcttggcctgaccccacctcgcagagcgggaaacggacaccccaagcaggttgacagagcatcgaacccggggctcctgcgaaccggcggcaagggctcgggtccccgctttgccggagcgggccgcagttcccccagccacgaaacagggatggccgggacccgagagcctcccgagaccctggacagagcccagactgcgtgcgcagggcggggagggccacggggaaaggcctggctgcaggagcctggaaaagcgcccccttcccgggcctccgtgtccccagacggggagctgctgggggcgggcgccgatcccgacgtccatgagtcgcagcctctggaatgaggaaatgcttcctccgctgcagcctgcgccgccgcccggagggagatctgggggtggggctctcccgagcctgccgtggcagcccctgcccccttcctgtccagccttgctcctccaacccactcgccgcctggtccagggtggacgctcgtatagctgcgatgagcgtttcctcttcgaacttttcctgggtctccagcccttaaggcaaaaaagtccaggcctccctcctggcacttgagtcctgagtagaccctccgggggctagcctaggcccctggccgccctctggcttgttttaggtgctgggtgctattagactaggcagagggaggaaggaaggctgggacgttagactcagacgccggtgtcacagagggacacaaccctatgacagaggtggggagtcccagagagaagtgctcagccagaaaagaccacctcaggaaagactcaggtctcctgcctacctcccgacagcgttcagagaatgagaagaaatgcctgcccggtgggcagtaggtcaagcgaaagtccccgccctggagccatagggactgggtgtgttatctcagttgggtgtgctggagaagctccagcaatcaggtgggtggaggcagagaagccactgataaaggcgacaagtgaggctgagcttagagcactggctcaggcctgggccaggaggaaacattgctggaccagctgacagctgtcctaagcttcaccctccctgcaccagcttgactttttttttttttttttttttgagacagtcttgctctgtcgcccaggctggagtacagtggcgcgatctcggttcattgcaacctccgcctcctgggttcaagcgattctcctgcctcagcctcccgagtagctgggattacaggcatgcaccagcatgcccagctaatttttgtatttttagtagaacggggtttcaccatgttggccaggcttgtcttgaactcctgacctctggtgatccacctgcctcagcctcccaaagtgctgggattacaggcgtgaggcaccacacccggcccagcctggcttttttagatccctacctgccccagagagaaggcaccaggtttgctctttaggtagaaggggggcagggacaggtgaggagctacagcaagccaccttctgcgtgacctcacccagcaaatcagtgacagccctgtctcccaacccaagggcctgtaatcttctgaccgtgccggcagagcaggcctggaggagctcagtttggggcatgaggacccaggcacagtaggcctcatgcttcctgcccccctccctcacgccataactggtcccagggccttccccaaaactgcaggcccatgccccctaattctggtaacaccaggaacgtgcctggacatggtgtgtatggtctggcctctccctcgagtcttggattggggatgggtttgggcaggctcactccccagtccccaccctctcccatgtagaatcctgagaatattaaagacatttaggccattcttctgaaccctggctccatagatccatctgccttctggacacctgccccgcagctcctggcactccaacctaacctgctcctcctcctcctgggtccccatctgaataatgtgtgttcagccaggcacggtggctgggtgctcctcttgactcctctcctccatgagtggtccctaagtctgtagatctccattttcaggtagctccatgtcccccggcctctgcaccttgcttttgtgagatgtccgttcctctactgattacctgagtggtcattctagcagcaaacctgaccatgccctaccctactccgttcctgagaactccagtgggttcaggatcaaggtcaggctacccatcaccccctcaaagcctggtgcaaataatcctccctttgggaaacttctttaggtctagtctagattgtggtcttctgcttttttcttttctccttcctgttaaaacttgactttgggagtgatctggtctggctcccagcatctgctgactggacggcgcttgccaagggctttgaaaagaacctggcacagttggggaccatagccccagagcatggtgggaacaccccagagcatggtgggaatgccccagaacactcgtttctgcacaagagcagggtctggggcttagggagacacccctgctccccttccaggacgggatctggccccagccttacactttcagcctcatctcgcctcccagttctgtgtcctgcactggacactccagtctcacgaacacgtatccacggcaccctgtgcgctggtccccgtggccggcaagcccttcctctcctttctttttttttttttttttttttttggagcccagagatcctttatttttttttgtttaacacctattatgccatgaattcatagggaataggttccagcagctcaggcgccttcccgttggttctcacaaagtgtgcttccctgggtggagcaggctggtgctttagttgaacccaggtacctttctctttggcttctttctttttctgatcattttccttcacgcgttccaggaagctatctcggctcttagagtgctttatgtgctcaatacgcacattaattctcttggcaagaatcttgcccttaacttgtttgtttacaacaatgccaacagcatgctggggaacattgtagactcttccagttttgccatggtaacccttgtggggcattcctttttgaacagtacccattcccttgatgtctacagtatcacctttcttatagattcgcatatatgtggccaaaggaacatctccatgttttctaaaaggcctagagaacatatatccggtgcctctcctctttccctttgtgttcgtcattttggcgaattactggaagatggcggttccggccgaaaggaaaccccttcctctcctttctatgcaagtttgatctctgcttttccagagcacctcctgtgagacgggcttcccacctacagaagccacagcacctggactcttgggccagcaggggcttccaccacatgttgaccaagactagtgcctaagactaacaggggaagtggggacaggttgaggacacagggctgtgtgggtggatcaatgtggccaagttctgagtgccagctcctcagcctcccaggctggtgagcagctggattcctgcaggggcctgggacccagccccttgtcatggctctgaggctgctgctgggaacacccaccagcctaattctccaaccacccacttctctcaactggcttttttctttgccagcaaagagttgaaattcacaagctgcgtcaaggtgagaacttaatcctgggtttcagcattggaggtggaatcgaccaggatccttcccagaatcccttctctgaagacaagacggacaaggtgagggggtctggggtcctgggaccgctccatggggcacaggggcctgagatggtgggtctctgcttcctgggcctgcatggaaggaacagacttcatctctcaaaccatgctctctaagaaggcatcggaagtgacctagtgagaataaggacgggtggggtgaggaagggctgctcagacagagcccaggaggagcaggaggcggccatcagcagggccggtgcatggtggtgcagcaactctgccccggctctctcagaacagtcctcactgaccatatgtgctgggagaggctgggtgcagggacagagggacggctgagaatgtgccatgctggcttccgctgtgtgataaggggccagtccagtgaccacagggcttgacttgggctgcccctttccagggtatttatgtcacacgggtgtctgaaggaggccctgctgaaatcgctgggctgcagattggagacaagatcatgcaggtaacaggtgtcccaaaggaggagaaacaaggtttgggcaagcaggtctgaagcacttgggggtggggagctgccccagcctcccagctgggagagactcactgcagccaattgggaacccatactggcattgccccagaggacgctggctttctctcctgtgtgtctcagccacagtgcttggtgtctcccagccctgggatgttaggctgggggcctacttgaatgacctgggcccccaaagccctctgcttccagatcccagagggcggggagctgaggtgagcctgtgttctctcctggggccaggtgaacggctgggacatgaccatggtcacacacgaccaggcccgcaagcggctcaccaagcgctcggaggaggtggtgcgtctgctggtgacgcggcagtcgctgcagaaggccgtgcagcagtccatgctgtcctagcagccaccaccatctgcgactcctgcctgccgcctctctgtacagtaacgccacttccacactctgtccccatctggcttctgctgaccgctgggccccagctcagaagggctatagctggtcccagaggcctggcctggccttccttcccttctcccatccctggcctggggcctctgggaccggctttctctcctggacaccgaggattggaaataagggcctggagctgagtagtagccagtctgctgtgaccacaggctcaggtccgaccctgctgcttggccacagcagtggctgggcaagtgggaaccactatctcttgggagcccccaaaagctgggaaatgctggaggaaccaggcctttcccgcttttgcctggctgcagggttcggctctgcccctgccccccagccctcgtgtgtccacaccgcagtgcctctgcccctcgggggactggacacacatcctgccagaggcgctacgaagctttgcccagatgaagccaggtgggctccgcgttcactcccactctcccgaggggtgctggcctccccagggtttgccttcttacggatttagacgaggttcgaggctcacctatcagggcagctctcaggattgtcattttcctctttgcctgtgggtttaacttttgtatttttttaatcacaagtttgatacaaaatgtttttatcgtactctttggagatgcccattctacttttgaatttagcttttactaattcgcatctggaagctcagcaagtgcacaagccttactttggttaccgtggaaaccactgccgcccctccccgatgtggtgcgctcaataaaaatgctggaattc

SEQ ID NO: 37157 - DNA, 34720 bp, Homo sapiens
gcgcccgcgcctcgggccgtcgggagcggagcctcctcgggaccaggtgagcgcctcccggaccccgcaccctggaagccgctcggcccgcggggggtgaccccgagtcctgggaaggcggcggcggcggctccgtccctcgggtccccgggaagggggactccagccccagggacggcggggggctcggcgggttcggggctcctcctcgcggggctggggccgcgcctgcccctgtggctccgcgtctctgggtccgaccctcgggcgcgcgacttggggccacctccccgcggcctcctctggggcggagccggcctgggcggggtgggggggtccctgtctgcgcccgagctcggtgctgggacccccgctcccgagacgaccccggcaccgcacgccccgccaggccccgcgtctgcgagcggttcgggtccggctccggcccgcggggaagacgccccggctggctgggacctccgggggcgcagggcctctccccgggccggacggaaggggcggcggggcggggggaggaggggctttcggtgcccgagggcgggactgggcggggaggggacgcgggtggccccgacgccccatcgctgcgcccctcccggcctggagcccaccagggccccgccaggcccaggagaagctgcagacggaggcggctccccagggcggcgggacccgggctgacagcgacccgcagcccctgccgggccgcccacacccgccctgggactccgccggggcgctggtggaaccgctgggcctgggtctccactgctggcaaccgaacggatcggccctctgtggagccgcaggtgtgcgggcgagcggcgcccatccgggctgtgccagcagaaccccggtgcccgcgcctaggacgcccctggagaagggaccttccctttggggtcggaacccagaaaggaggggcctgcgatccgcggagctccttgttcttgggataacacagctctggcttggaggcccccttgcacttcgactctggtgattatttcaagaaaggccagaccgggcacggtggctcacgcctgtaatcccaacacttggggaggccgaggcgggcagatcacctgaggtcaggagttcgagaccagcctggccaacagggtgaaaccccgtctctactaaaaatacaaaaaaaaattagccgggcgtggtggcaggcacctgtaatcccagctaatcgggaggctgaggcaggagaaaatcacttgaacctgggaggcggaggctgcagtgagctgagatcgcgccactgcactccagcctgggtgagggagcgagactgtctcaaaaaaaaaaaaaaaaaaaaaaaaaaaggaaagaaaggcccggtgagatgctttctcttaaacacggccctgcacgttgagttgctgcctcctgtggcctatttcacgtttatgcaaagtcgggcgcctgatgcggggctcacccgccacaagcaggggtcctggtgctgctcatggaaggggccctacccagcccgcggggcactggctgggacggggctgcccaggtccgcccaggatccaaacacccagccccgcccagcggcccttcctggcctgcagtggaggctgtaatgggcaggggtggtgggaatcccagctcacagggcgcctgctcttagaagggcggcatctgggtccagaggtcagaaacgtcagatgcccatcccagaagtggcggggaacctgtctccacaatggatagcagcactgtctttttttttttttttttttttttctcatttcatagataaggaatgatgccttgttggggggtttgttctgcatgtctttggtttttgtgcagtacaaggctatttgggctgtttgatcactgaccgtgtgtagtgatgtgcattgcctggttgtgatgtccccatgttcctaatggatgttcgctttttgggtttttttggttttttgtttgtttgtttgttttttgagacagggtcttgctctgtcacccaggctggagtgtggtggtgctatcactgctcactgcaatctgcacatccctggctcaagcgagcctccacctcagcctccgagtagcggggactacaggcatgcaccactgtgcccagctaattttcttttaagagacggggtctcactatgttgcccaggccatggatgtgtttgtttgtttgtttgtttggggtgtttggggggttttttctttttttattgatttgaaaaagctttattttcccgaattttttattgtggtatacaatataaaatgtactgtcttaaccatttttaagtgtgcagctagttcagcgacagtaagtacattcatagtgttgtgtagccatcaccaaggtccatctccggaactcttttcctcttgtcaaactgaagcccatggagcaccaactcgcatcaccccttccctcccctggcagccaccatcctactttatgtttccaggaatttggccatttaggtgactcatatgagtgaaatcgtatgaaatgtctccttttgtgactggcttatttcacgtggcttaatgtcctccagattgatccacactgtaacgtatgtcagcattcccttcctttgtaaggctgagcagtattccactgcatgcatgccctgcattttgtttacccattcgtctgttgctggacacttgtgttgcttccacgtttgagctactgtgaatgatgtggccatgaacacaccacacagatacctcttggagatcccactttcacttcttttgagtatgttcccagaagtggaaatgtggatcatttgattttttcatttttttgagaattaattgcctcactgtttcccacggtggctgcaccattttgctttcctgccaacagtgcacaagggtccagtttctccacatctgcaccaacaggtgtcattttccgggttcgcttggttttttttaaatgttaaccatcctaatgggtgtgaggtggtatctcactgtggttttgacttgcatttccctcatgattagtgacgttgagcatcttttcatgtgcttgttggccatttatatatctcttgggagaaatatctgtttaagtccttgacctatttttgaatcaagttgattgttttttgttgttgaattttaggagttctctgtatattctggatattaatcccttattagatacacagtttacagatattttctctcattctctgggttctttttactctgttaatgatgtcctttcactagatagatgcaaaaaatgtttttaaattttggtgtaatctgatttatctattttttcttattgtcatacccaagaaatcattgctcagtcccatgtcacgaaggtgttaccttatgttttcttctaagggttttaaagttttaggtcttaaaacgtaaagatccattttgagttaatttttgtatatggtattaggtaagggtctaacttcattcttttgcatgtggatatctagttgtctctgcaccgtttgttgaaaagactgtctttatcgaatggtcttgacggcttgattgaaagtcatatatgcaagggtttctttctggactctctgttttattctgttggtctgtatgtctgtctttatgccagtgccacactgttgatgactgcagctttgtagtaagttttgaaattaggacatgtgagtcccccagctttgttcttatctttcacgattttttttttttttttttttttttttttggctattcgaggtcccttgagattccatctaaattttaggatttattcactatttctgaaaaaaaaaacaatcactgggatttttatagggattacattaaacctctagatcaatttgggtggtattgacatcttaatatagtaagtcttccaatctatgaacatgaatgtctttttttaaatgtcctcttcaatttctttcagaaatgttttgtagttctcattgtacaggtctttcacctcctaagtcaatttttaagtattttattatttttgatactatagtaaatagaattgttttcttaatttcctttggattgttcattgttagtgaatagaaatacaagtgatttttatgtgtttactatgtattctgctattttgctgaatttgtttattagttgtaacagtttttgtggaatttttagggttttctacatacaagatcatatcatcagtgatcagagataatttacttatttctttccaatttgaatgcctttaatttctttttcttgcccaattgctctggccagaacttccagtacagtgttaaatagaagtagtgaaagcaggcatccttcctttatttctgaccttagaggaaaagctttcagtctttcaccactgagtatgatgttcactgtggctttttcgtataatatggcttttattatgttaaggttgtttccttctattcctaatttgttgagtgtttttatcatgaaagggtattgaattttgtcatatggtttctctgcatcaactgcaatgatcatgtgtgagttttttttcctccttcattctgttaatgtgtattacattgattgatttttttttttttgtatgttgaactatccttgcactccagaaataaatcctacttggtcaattcattaaattccatttaattgcatcaaattataccaaatttagtttactattaatagtattttgtttaggatttttgcatcaatgttcataaggaagactggattgtagttttcttttcttgcaatatctttgtctggtattggtatcagagtaatgctggcctcataagaatgagttaaatagtgttcccttctcttcaagttttttgaaaattttgggagggtttggtgttagttctttatgtgtttggtagaattcaccagtgcagccatcaggtccagaggttgtttgtcaggagatttttgagtattgattcaatctccttactagttatgtctattcagattttctatttcttcatgatttgattttgtcttgataggttttgtctgtctggaaatttttccattccatctgtgttattcaaattgttgacatatagttgcttatagtacactcttataatcttttttatttctgtagaattagtagcaatgttgccactttcacttataattttagtaatttgagtttcttctttttttcttagtctagaatctagcttaaggctggtcaattctgttatcttttcaaagaaccaacttttgttgtcattgattttctctattatctgtctgttctccattttgtttatctttgctctgatctttattttttccttctttctgctagcttgttctttttctagttccttacattgtaaggttaagctcctatttgagacctgtcttttttaatataagcatgtatagccatcagtttcccccttagcactgctttcactgtcgaacaagtttttaaatttgtgttttcattttcactcatctctaagtattttataatttcccttgtgatttcttctctgatccttggttatttaacagggtgttgtttaatttcgtgattttttaaatgtccttgttgctgatttttaactttactcctttgtggtctgaaaagatatcttgtatgatgtagatctttcaaaatctattgacacagactttgttgttgcaactaaccccgtcattgcaagcccttctccgtctggttgaagtgacttccaggagatttaaagggctggcacccttttctcccttcatttttctctttttcctcttttgagacgtagacattgaagactagcacattcaaaagcaaccatatatgtggagaaaataaaaaagtcattgcacatgctcaggggaagtcacgggcttagaaaagacctaagaagaccttaagtttatactttatgctgatccttagcacagagacagcaacaatcaaaattataaaaacaagaaaaaccagcaaactctggggaagaaagagattttgatttcacaaggcatacaaagaaactttcctatttcaaaggaaaaaaaaacaacagaaactgtcactgaaaaagacttggtggtagatctactagacaaaggctttgaaagaactatcttaaagatactcaaataactaagggaaaatgtggagaaagtgaaagaaaatgtaggaacaaatgaaaatatcaataaaaagctagaaattttaaaaagaaaccaaagggaaattctggagctgaaaagtacaataactgaaatttaaaattcactagagaaatgcaaaggcagatttcagcaggcagaataaagaatcagggaacttgaagatacaaaaatggaaattattgagtctgaggagcagaaataaaaagattgaataaaggtgatcagagcctaaggggtctgtgggataccatcaagcaaaccaacataaacattgtaggagccccagaagaagagagagcaaagggagcagagagactatttgaagaaataatggctgaaaacttctaaaatatgatgaatgacatgaatataaccatccaagaagcccaaaaagctccaagcaggatgaactcaaagagacccacactgaaacattctaatcaaattgtcaaaacccaaagacaaagattttgaaaacagcaagaaagaatgattcatcacatgtaaggaatcctcaataaaactattagcagatttctgatcagaaactttgaaggccacaaggcagtgggccaatatatccaaagtgctaaaagaataaaaactgtctaccaagaagcccacatccagcaaaactgtcctttaaaagtaagggagaaattaacacattcttagatcaacaaaagctgagaatgttccttaccactagacctgccctataggaaacgccaaagggagtcctgcgggttgaaataaagggtgatagacagtaattcaagtgaagaagtaaagatctcagccaggcatagtggctcatgcttgtaaccccatcactttgggaggccgaggcaggaggataacttgagcccaggagttcaagaccagcctgagcaatatagggagaccctatctctataaaataaaaatatttttaaaaatcgaccaagcatggtggtgcacacctgtggtcccaactactggggaggctgaggtgggagaatcatttgggcctgggaggttgaagctgcagtgagctgtcaccacaccactgcactccagcctgggcaacagagcaagaccttatctcaaaataaataaataaataaatatctcagtaaaggtaaatatatagacaattataaaagctaatattgctgtaacaatggtgtgtaatgctgctttttgttttctacataatttaagagactgatttaaaaataacattatgcttttggacacataatatataaaggtgtaattttgtgacatcaataactaaaagggttggggacagagccattcagggagcagagttttgtttatgccattgaagctaaactggtataaattcagtgtagactgttataattttaggatgttaaaatgcaatccccatggtaacaacaaagaaaataactaaagaataaatacaaaagggaatgaggaagggatttaaatgtttcaccatcaaaaaaattaattaaacacaagacagtgatactggaaattaaggacaaaaaaatccataaggtatacagaaaaaaaatgcaaaatgaaagaagtccctctttatcagtaattactttagatgtaaatggattaaactctccaaactctctctgttaaaagacagagattggcagaatggatttagaaagccaaatccaactatatgctctctacaagagatgcactttagatccagaaacataaatagattgacagtgaaaggatgggcaatgacatgccacacaaatagtaaccaaaagagagcaagagtggctatactaataccagacaagataggctttaaatcaaaaaaggttacaagagggaaagaaggacatcatatattaataaaaggctcaatacagcaagatataataattataaatatttatgcacctaataacagtccatcaaaatatttatatcttacactgggaagattgttgctggctctcagtctgcttccagtctgctcatattgcttttgttgtaatgatggtcatatgtgggagctcagtgtcaagagggcagacttgagcccacactgccaggcttcagacctcagctattagctgagtgccctgggcaagttacctcactgggccttggtttcctcatctgttggagtggggatggtaatagtacctatgtccaaggccataagtccaattgtgaatgttgaatgaagggatataggacagtatctggtacacaattattatagatttttcattgacattttatacattctgttttcttcaaagactttttggttcctgttttgcactcagatacttccttttcctggagtttatttgggagcaccatgtgaggtagtacctttatttctagtcacagggtgagccctcatcccagcctgcttccaccactctgaaaggccaccatgtcatagcctaagttctcgtgtgttgttatgcccatggttgtgtggagtgttggcctgttccagcaccaaaaccaaaactgtaattttatcgtttcatttgatagcacaagctttctcatcactctattttttattttgctcaactcttcttgctttttctaccaagtaaaacttggattcattttgcaaactcctatctacaaaaatgcaaaaaattttcttggaaactttaattaaaattgcattctattatagattcagttaggaataactgatatttttaaatcagtttaagatagtgggatgatttcttatccaaaaacaaggtttgtctttccaatatatttctcaaaaatttttttgagtttttttcataagtcctgcacatttttattcagttgattccttgggtttatgttgtttttcttactagtgtaaatagcatttttctgcaacattttctaactggttgttagaaaatgtttcttctaactgatagaagaaaatcaataactttttgtatgttgaggactaagctctgatttttttatcttgcctatattcttatctaaggggtctggggagtcatgccctacaaaccataaattctcatcagatggttttatctaaccctatatgctgtgacttactttccatctgactctggcatgacactacacgaccaagaagaaaataaaaatattttaccccaaaacatgtttctttgccacattttgaaatggccctgcaaagctgtcctttactggggaaaatttgcatctgtaaggaatctctgttaacatagctagctctttttcttccaggccctcccaattctgaagagattaaccgagagtctagcagcttttaaaggtctcagtaggaaacacttgtcattgattgtctctaagggcagccactatgagacttcagaagaaccttggtctccacagtcttttatcttaacctgagcatttcctttctatgatcccaggtctttagacaaactcaaccaattgtcaaccagaaaatgtttaaatttacctgtagcctggaagccatctctccccgctttgaattttcctgcctttctggattaaaccaatgtatttcttaaatgtatttgattgatgtctcatgcctccctaaaatgaataaaaccgagctgcaccccagccaccttgggtacatgttctcaggacctcctaagggctgtgtcatgggtcatggccactcatatttggctcagaataaatctcttaaaatattttacagagtttgactcttttcatcaatgatatatttttctaagtggctcactaaattttctctccctaatctcccctcctttctctttctttctctctttctctctgtctatatatatatatatttttttttctcttttttaaaaaaactttgttcagatgattttctgggtagacaatcctatctttaataaggacagttttgtctcttcttttccaacagttatacttttatttttactgtcttattgcattggcttccaacacaacactgaatggtagcgtaagatctgcactgtttgcccccaccccattttttttgtactgtagtaagcattcttctaatgcaggattttttaacccagggttagatctacgaatggaatccctgaattcctggacatgatttctgtatatgagcatctatgcatttgtgtaaggtgaaattgtgtagactcttaaaagggtccatgaccacaaagataagaaccactattttagctttttgtgtaaaatatgatgtgagctcttgatttgaaatgtatatcctttatagagttaattctactcctaaatttcttactaggttttaccttgtctggctgttgttgtttcttagttagaaattgatgtttcagggatctattgaagcaattgcatattttttcccattttatgttaatgtgacttacattaatgtattccctagtgtttgtggcaacactgtactttaacttcatattatagttctggtatagtggtccttaatatgctattggattttagtttttaatattggctagaatttttgtgataatgttatgggatttttagggtgtcacttttctggcctgaaacctctatggccagtggcgcctttgcccaagttcttgtcctgtgtccaggaagaatgaggtacacagacaagtggagggtgtgcaagacagagaagctttattgagtgttaggggagctcacaggagacccgcagggggcagcccctctctgtaggcgggttgtcttgtcggcgggttgtcttgtcaaatgttcagctctcagcagagagaaggccctggagtgggtggctcctctctgcaggcaggtcatcccattgtctctgcagctcttagcagagaggaggccctcgagagcgtgtctcctctctgcaaacagggcatctcaactagtgttcagctctcagcagagagaaagccctggagagggtagctcctctctgcagctggtcgtcctgacatcccttcaggtcctgaagctctcagcagagagagcacctcctctctgcagctggtcgtgccatgctctgccctgctctgactgagcctggggcttttaaaggcctcagagaggggaagtgcatgctgattggtccatgtgcagccatgtgcaggcccagaagaaagcaccttgagttcccctctggtccgtaggacgggcaacccggcccccaggcttcaggcctgccccagcctgaaggtggggcttcactggggacccatcctcttctgcccaggagcctatctgcctcctgcagccatccatggtgcccaggctgctggtaccaaggggcaccggtgcccagccaccctcagcacccccccaagcctcccctcctgcacttctcagtgcccacagtttggagggggccaagtcagcagggggctggcatgtcagcactgccacaagcatgcacccacccggccaggctgtgacagtgcccaggctcagccccaactctgctctgagattggagtgggtggtgggagcgggaagaagctgggcagcgggaacaggcacctccaggcctacaagggaaagaggggccttccctggctccccaagagtgcagcgatgcctgggtcagcagccccagttggggcagctgaaactgcaccaggagtgggggctggctcctgcctcctccatggagcagaaggcccagatccacagccacgacttgggcagttgtacctggggaactctcacctcgccaaactgcaaggggcagggatcccacttatccccggctcctgctggctccgtggagcatggtacctggccatgtcctctcgcagcctggggcagggtctccagacctgggccagcatcccagacaggggcaacaccgccgtgagctccccttcacccagcacaccacccggcccggccccatggcagcggcccccagggaggcagtctgcggggttgggggcctgtctgcctcttccatgggccctccctgagcagccagtgtgatggcagcggccacaccagatgggctgccgctgccatcagtaatatttatagtgatatttatctgtagagttacttttagggacttttttttttatcaagctttggtcacaggttatgcaacatttaaaaatgaattgggaaaaagtttatctttttatgttctaaaacaagttaaatagcatgaagtgcttgtccttgaagctgtgaaactcacccacaaactgcctgagctggcacctttgggaacggacttcattcctccctgggccccaggctgagcaggtctggcctgggtcacctcatccactccagacgccgcaaaatcacagcaacccttcagggccctctcctggcagcgcctcccctagtcccggtgcttggacactcctcccatctgcaccgaggagagggcggcactccaatccctgcattacccctggaactgcacgctctgaaccaggcccggtgccctttctgcccagctgcccggctgctgccagccccactctgcggagccagcagcacagtgaggcccgtcctgatggcctcctggagctggagcttaggccaagccacagggcatcagggaggatggacgttcaagggctggatctgtttgccccagggtcctggcacccaacagaaaggaaagccaggctaatgacggctgtgtccctacacttgacagagtcctccctccctccttatcaaagtcctgtttaaagggaatggagccaggctggagagagagtgcctagctctgcaggggagccggtctggggaagctgggatctctctcccgccctcccctctgcactgtttccagggcagccccaggcagtggggggcgccagacagtggtgctccattcccttccatgccgacgcgcccagctacccactccacccagccctggaggacatggaagggcctcaaccatccaaatcccacccaaaactgagcccagaggcacccactaaacatctgtgaccccacccagggtggggcaagagggcgcaagccccccagtccagatgctggtgacggtgtgtgctgggcgcagaccccgcttccttgaagactgagggcagtgcccccaatcccgctgacctgctgtgcgtgcgcctgccatgggggagggtgccaggggagaggcactgggggtgtctgagcgacccccacccctgttgcaggacttcagggccacaggtgctgccaagatgctccagggcacctgctccgtgctcctgctctggggaatcctgggggccatccaggcccagcagcaggaggtcatctcgccggacactaccgagagaaacaacaactgcccaggtgccaggggtcgggggccgggggctctgggcatttggggggcagttgggaccagtacccaggtgccaggggtcgggggccgggggctctgggcatttggggggcagttgggaccagtacccaggtgccaggggtcgggggccgggggctctgggcatttggggggcagttgggaccagtacccaggtgccaggggtcgggggccgggggctctgggcatttggggggcagttgggaccagtacccaggtgccaggggttgggggccgggggctctggcattcgggggcagtgaggtcaaacccacaaacaggcacggggccaggaaacggggctccaacagcagtccctcctgaggctggctcgtgacaggtcctgtgccccacagagaagaccgactgccccatccacgtgtacttcgtgctggacacctcggagagcgtcaccatgcagtcccccacggacatcctgctcttccacatgaagcagttcgtgccgcagttcatcagccagctgcagaacgagttctacctggaccaggtggcgctgagctggcgctacggcggcctgcacttctctgaccaggtggaggtgttcagcccaccgggcagcgaccgggcctccttcatcaagaacctgcagggcatcagctccttccgccgcggcaccttcaccgactgcgcgctggccaacatgacggagcagatccggcaggaccgcagcaagggcaccgtccacttcgccgtggtcatcaccgacggccacgtcaccggcagcccctgcgggggcatcaagctgcaggccgagcgggcccgcgaggagggcatccggctcttcgccgtggcccccaaccagaacctgaaggagcagggcctgcgggacatcgccagcacgccgcacgagctctaccgcaacgactacgccaccatgctgcccgactccaccgagatcgaccaggacaccatcaaccgcatcatcaaggtcatggtgagccgcgggcgggagcaccgtccacgcgccaggggtggccacggtgggccgtccacccactccgggcctcactttacccctctgtgagtgcggaggccgaaggaggaagctccgggcagggcctgggccactcaggtgtccctccatccccacccagactcgaggtgcagccgccccaggtctcgaggcacacggctaaccagcatgtctgtcttttctgcagaaacacgaagcctacggagaggtgagtggcgcttcccttcctgccagtgctggccggcagctgacccagcagagatgaccgcgccaggctgccgactcctggcgcctccaggctggaacagatgagaggagagggagtcacctgctccatgttggacctgaggccttggagtctggagaaagggctcccagccaaagctaggctgtttagatcccgtgagggtcagcgttagggtcacccacagagcacgtgttacaaggagaggtcgagggtctggcctccgggcaggtgggatccatccaccctggactcgaggcccgagcccagcccagcaggtcaggggagaaggaactgacatcatcggggtccatgacatccccacctccctgtgtgtcccagctccagctctcaggaaggggagcaggcatctgagatctcccccgtgaggcttcctgcaaaaacgtgccctgcctcagaatcgctgctcagtaacagtggtttcattgccgtgtacaaatggtgcctccctcaccagtgccccttgctcttccatccttttgtaaaatttattcttttatatttgtttttttagagacagggtctttctctgtcacctaggctggagtgcagtggtacgatcacggctcactgcagccttgaactctgaggctcaagccatcctcccacctcagcctcccaagtagctgggactacaggcacctgccaccatacctggtgtgcgcatgtagttccagctacttgggaggctgaggtgggaggatcgctttcgtattgtttttttgtagagatgggatctcactatgttgcccagcctggtctctaactcctggcctcaagcagtcctccctgcctcggcctaccaaaatgttgggattccaggcgtgagctgcacccggcctttcttcccttctattttctgtcatggcttaagccaggcttggttttttaaacttgcctagaacacctgaccgagagccaaactctttggcttgtccctgatgggggcagagcctcacagcaccccatgtctcacagctccctcacgcccgcccaggttctcagggcatttcagcatctccttggcccctgctgagagtcgtgggctacacgttctgagaccctgccctgccacctgaggaatgtcccacccatgcaaccttctgtctctgcttcctcgtttcagtgctacaaggtgagctgcctggaaatccctgggccctctggccccaagggctaccgtggacagaaggtaagatgcccagattacctgcagggtctgcgctaccaggaagcccctgatttgttttgaaatccacacttggccgggcgtggtggctcatacctgtaatcccagcactttgggaggccgaggcgggcggatcacaacgtcaggagatcgagaccatcctggctaacatggtgaaaccctgtctctactaaaaatacaaaaattagccgggcgtagtggcatgcgcctgtagtcccagctactcgggaggctgaggcaggagaatcgcttgaacctgggaagcggaggttgcagtgagcagagatcacgccactgcactccagcctgggcaacagagtaagactctgtctcaaaaaaaaaaaaaaaagaaaagaaagccacatttaaggccagctgtatctcaaattgtctcaacacttctgtccctggagaaactaaaactctatatgtctaattccttttaaatagtatattgagaaaagcagaagcttgtaaaaaatgagatatgccattaaaatactttggtaagcaagcatattcaagtaagtaaaatgtgagatgcactacacttaataatatgattgctcattaatatgaaggaacctcttttgtggcttactaaataagcagttttagggagcctggtttgaatgtcccctgcattttctggtttgaacatcccctgcattttcctaacagaggtgcatcaaataaagtccttccaaaactcactaacagagtatgtgaaactccaacaattcacatctgttaaaaattataaagaaaagcataggaggagaaagtagcttctaaggagatgaaataaggaattgaccatcatagaggatgttactgctacgtagcttcgtgtttttctaaatttggataacagctgtctagaccagtaggtatctggatgtactttctccaggatgagacatctcgaggctgcaggtcaaatcctgccatctccctccctggcttctccagtcctggtggcaatgccgaccctactacagctgggaatgaatttgccacttggggcagccttggctgcacacagcagtgcagtgacccgttctgttgggggggccactggaagctgccacagggatcactgtggttagagtttgaggggtggcaaggtgccaagcggagcccaggacagggcacagctgtgatgttccagaagcctctgcccacctcatcccctgccctgagtttcctcccttttcttccttttgacctcttaattcttcccctttcctctgctcctctttgcacttaaattgggagcatatcaataaatagatgaatttatttaataaagttctgtatcataggttaaaattttaattccaagagagtgtaacctttatgtggtgttctgaagtcctgatctgtctaaagttacttagataaaggaattaatctttgtagtgacggtgacccaggcatcgctggagaatcagagcccagtgttggccacagtcacagctactgggtgcagaagggacccccacgggccaggcacccccaccccaggggtctcttctggctccattttgcaggtggctttgtgggaagcttccctcagagctgggagaaatgggtcaaagcaaacccttgtctgacagaggctggccctttggggagcagctgacaccaagacttctccacttgggcaggggaatcagtaacctctgctgtgtcacctctcagaggagctgtggcagggtccccagctgcctaccgcccaccctaccctgcctcgatgtactcttttctctgcttttagggtgccaagggcaacatgggtgagccgggagagcctggccagaagggaagacaggtgagtgtccttgccccacgcccgccccgcctgcagcccagcgccccagggctgggctcacactgctgcgttgtccttcacagggagacccgggcatcgaaggccccattggattcccaggacccaaggtgagtgacctcggccaggggcttggctccaccctgaggccccagcactgccaggcaggctccccccagcccagcctcggcctcagcctctacgaccctccccccagttaccaaggaacagaagcacctcgataacttgatggccgtcccaaaacccagcctccagcccgacccagggctcagcctcctccgcagactgtttgtcgagaacactagatgccagcggcccaccgagcactcccctcagcctgcagggctggcccttccctgcctgtgtctctgcagagctcctcactaatgcccctctctcctcctgcccccagggcgttcctggcttcaaaggagagaaggtgaggctcttgccctgacagacctcagacctgcgccagcctcggcccagacccacctcttggcgtccgccgcagcctgtcactgctcctggggcaccggcctggtcttttctcagtggtggctttgggggctcctggggggtcctgtggccttgagtttggcccaagggctttgccccccagaggcagcagtgcccatgatgctttgaggcaccgagctcactgcgccggctttcctcctacacagggtgaatttggagccgacggtcgcaaggtaggctggctgggtaggcagagcccctccttcctgctgctcagggcagaaggaccggggctaatggagttccctcttccttctctcttcagggggcccctggcctggctggcaagaacgggaccgatggacagaaggtagagggagcctcgggctcacagctggactggtctcacagaggcatcccagcctctgcagggcccccagatccagcctgatctgtcagcttacacatgtgtacacacgcatacacacacacacacacacacacacacacacgaacttcagctcctgccacatcccactgccccacccagggcttcaccagcctgcatctaattcatggctgcacatcccggcttggggcagctccacagctgcacacagaggccagcaacaagcctacccactcccaggtcaaaccacaggacagccccacccactccttccatggctccccgtgggaacatcctctgtgcccagggagctctgccctcagggcctctgggaggcagccagggatggcctgttcctgcacaacggccactctgcctccccggagacagctccacagcagccgtggcctcatgtgggcacccgtgtgccaggaggagagcgctgcagccctgcggggcagaaccgggtgggctgtgtcttggtcgttggcacacatggaccccagaaccccgccctgagactcctcctgcccccttctccttcagggcaagctggggcgcatcggacctcctggctgcaagggagaccctggaaaccgggtaagggccgtttgcacccctccttcagcctcggcccagggggtgtgggtgcctgaccgggtgggagggtagttgctgctgcagtgggagcgtgggttctcccggcagcccagcagccccagcccagcagccccagcccagcattctgccgggtcggagtcatgtgaggaactccccctgggagctcctggcggatccccgtggcctggagacctgatgcatcccaaacttcggtgtcactggacagctccatttccctgagcagcagatccaggcctggcctcttggtcactgagcctgggcctcacagtgagggtgggaggtgcgtcccgggctgggacaatggagcacttgggccctggctcatggggagaaccccacccgccgtgtgccgagctccacctctcactcctctctcagggccccgacggttacccgggggaagcagggagtccaggggagcgaggagaccaaggcggcaaggtaagtggccttgtcagggtacggggcaggcggggtcaccagcttccaggggcctcctggaggcagccccagctgagaagctgagcagagagggcctttctggaaacactggtcagtgaggagccaatggccgtgggatgtggtggagggtgccctgcccgttgcttcatcagcttctaaccagggcttgggcggccccgccgctgctcaccgaggcctcggcaacaaacccacctcctcccaggtggagccccagggagccccacccacacctcctggagctccccatgggaacgttggtgccccaggggctctgccctcctgggccgcctgcagtgtcgccccgcccctggcggccccaggatccccaagggcttttttctgggagcttggacttagggcttcccactttctgtccaccttccctcagcccaagcccaagtctggctgagtcctctgagcagatgcacaggcgtcctgcccgtgacacacactctgccctcagctggcacggaggttccagcagcccccagccagcatctggcatcccaggtgccccgtggacatcagggaggtgcagtcccaagcccgaccgtgggtcctgcccccgcagcgggcatcctgcaccccccttcccctgccaaaagacgtgaggctgattctgcaaacccttccagggggaccctggccgcccaggacgcagagggcccccgggagaaatcggggccaagggaagcaaggtgagcccctctgcctcttcgcctgcagctgagctggccacactcacgcccatggcccagatgaacagtcacgctggccaccatctctgctgtcaccatggtgccgcattgggctctggggacacggggagggacaggaagaacaggccatgtgccctgagccaccagcccctctgacctgtgccctcctcacgaggctgaacaagttccaggggaccctgcagggcccccatgtgcctggcaagcagattccgctggaagataataggggctccacaccacacaccgcacaggcgtgaccatgcctcagggcccctgcctctgggtgactgtgctgtcctctccttcttcaggggtatcaaggcaacagtggagccccaggaagtcctggtgtgaaaggagccaagggcgggcctgggccccgcggacccaaaggcgagccggtgagtccctcctgcccctgcctcagggccccgctctgggcatcctccttgcagcttgaggaggaccatgggggaagggcacctgggctgtaggcaggatcccctgctggcaaggcacagccaggcccccatcctcccaagaagtggacccggaccaccccacgggaccccccagagctggacttagaggtaaagcccaggcaggtcctccatggtgttccctaaacccagcaccagctgcccagggcatcctgtgagggctgagcagggcccgtcccagtgctgaccactccaaggggactctgtctgagcatggggcctgcctgggagtgaccgcagtgactggacagcaccaggtccccaccaggccccagcccatcacctaaaacgccactcaccagacatccaactccacctggagcctccccagatcattcctaaatcctcggcatgggcgggaccgacgcagcagagggacgagggctggcagcagagccactggcgcaggctgaggctgttgggaaggagcctggggatcgaggtcccaggtcccaaagccagagccctcctgtagagaaggagcatcggccccggcacagcccccaccctccacaggctctgggcttggactcagccccctccctcacccacacgcctgttctctgcaggggcgcaggggagaccccggcaccaagggcagcccaggcagcgatggccccaagggggagaaggtgagtcctcgtgtggaggcagcccagggtctcactgtggtgcccatgggccctgctgacgagggccccaaccccattcctcccagagaacaacagaaccccagggcctcactctccagagttcactctctgcagagtctgggaatgcagccctgagatccccacaccccattctctgctgaggaagctccactacccacccaggcacaccccgcacagctgtgcaggcaccattcacccccggcccactgaggcaccactcacaccccccggcccccactgaggcacctcttacccccagcccactgaggcattgctcacccacgtgacctcaggggtgatgctgaagggctgtgtggtaaaaccccggccaccagctccccttgacatcaggtgaaggggcttcctcccaggaagtggacgaggtcctacccacgtgtgggtggcctcagggggaccgagagacaccgtgctcagagcggcagctacaggcaccgggaaggagctatgggtgaaacaggcgactgttgcaggtcccccgggacagacggggttcttcctcccaggcccccttccccaacccccggccacacccgcctctcacatgggacccaggccggaggcctcagctgagacccgtggggcctcccttcccttcccacagggggaccctggccctgaggggccccgcggcctggctggagaggttggcaacaaaggagccaaggtaggggagcagggtgggccgcaccccaaggtaggggatctgagggggtgcaggggggctgcaccccaaggtagggtggccgggactgcaccccaaggtaggggacccgggtgggtgctgcaccccaaggtaaggggggcccaggtgagggctatacctcaaggtaggggacccaggcgggtgctgcaccccaaggtaagggaccaaggcaagggctgcaccccaaagtaggggacccaggtgagggctgcaacccaagataggggtgcttaggcaggggctacacccagaacccagcctactccactcagtgtgctcagggctgaaggtcaagtggagccacagcctccggggagggtcataggggccggggccagacccgtcttacccccgaggccctgcagtgtccacaggattgatactggggactccagggtgctgctgtcagtcaagagaaccccaaattcctcccctttcttccagggagaccgaggcttgcctggacccagaggcccccagggagctcttggggagcccggaaagcaggtcagtgtcagtgcaggaggccggtgccctctgaccccacgggtgggtctcccctatccatgtggggacagcctggagctagccactgtccccatagcaaacccaggcagcagagcctggcctcagaagccaggacctgctcccctagaccccgagtacctcatacccaccctcagccccagccccccatcctgccctgaaggacccaggttgtggagtcaggggcaaggcagtgggcctgaggtcctggatgggccacagggaaaggaggagctgggaccctcaagacagaggtccacggcccccacaggcagcaggaggagctgcggccatgtggcctggtggtcagggctggacggggcatgtcaggtgacccctgggcatggccagtccctgcctgtgctgacttctgaatttctctcctgccctcagggatctcggggagaccccggtgatgcaggaccccgtggagactcaggacagccaggccccaaggtacgtgcccctcccccagcaggacgtattaggggttcggggcagctgcctgaggagcaggacagggggccggcctgggggaccctgttgccggcagacgtgcctcaggacgggcctgtgcctcctgttctcagctctggagtgaggggatgcctccggggtccaggaagcccccctggctctcctcttcagcagtgacccttgggtgtgcatggcacatccttcctgaggcagggcctgagggcagctacgtggcctgagtagggtcctccccgcgtgtgggcaggcttcgggtctctaggcacgtccagcccccactggaggtggacagggcgaggttggccctgccaggcctctgctcacagccagaactcgacggcacccctagcccacttccaccccagtgtgcaccttgcgccctgttgagcacagccccccagccccaccccgtcctatgaccatgctgaccgactcaacgtcctcctccagggagaccccggcaggcctggattcagctacccaggaccccgaggagcacccgtgagtcacagcctgggatggcagctcccaggagtgggtggacattgtcccaagggccctgaagattcctagtagttccctcaaggcctcctctgtgcagaagaaagtgtgaggtccctcctgcgggacagagtggtgagaaggcttcgggtgactcagtgaaggataggtccagcccagcatcaggaaaagagcacagctcagaacgcagcacagtggcctcacccagagtgtgaatgagcgagggagggaaacggggctgcagaaagctgcccagagggaggaaggagcactgggatctgaggctgagtcaccctggcttctgtttgcttcacagggagaaaaaggcgagcccggcccacgcggccccgaggtatgtgtgggtcctggccacctgtgcccacccagggtgggggtctgcacgcccaattgctgggaacacaatgcccaccgtcactgacaggaccacccctgtcttgagatggtcctggctccccaaggcccagccatgtcacctatgctgagctctgggggagctgtcagccactggctggtcccttttcaaccaaagttcaggctttgcaaaaaaaccacatagatgctcccgtttaaaggaccccaaaatgccagatcgatttttccacataaaaatctcactggtgtccctggtagagacagctcctctgtcccaggctaacatgtgttccctgtcacagggaggccgaggcgactttggcttgaaaggagaacctgggaggaaaggagagaaaggagagcctgtgagtgtcaccgtcccgaagcccacagcagctgggcagaggcagggaggggccctgaggctgagcgtgtgcatctatgagtacaggagaacgccaggcagcttggccccagccatgagcaccacccccaccttcctaaagggaacggctggctcaggggccccctccctcaacccagcctcccttccagcgtcccctccccagtgaccccccaacatcccccccacagcatcccccacaagggtcccctccctagtgacccctccacaacatccccccagagtcccctcccagcatccccactacagcatcccccaccagggtcccctccccagcgaccccaacatagcatcccctccagagtcccctcccccaaaagatgcctccacatagcatccccctcagagttcctacacacagcattccccaagggttccctccccaatgtcctccccacagttatcccccagaaggtgctctgtgcctccaaatccctagcctggccaagggtttaaccagggctgcaggttggtctggaactgagcacaaaacaagggatggataacgatggatggatgggcaagtggatgggggtgggcaaatggatggatgggaggatgggtgatggatggatgagtgaatagaagagtgggtggatagaagatggatgaatggatggattgctggatgagtgggtgggtggatggataagtggatacatgggtgaatgagtagatgtatgggtgagtaggtgggtaggtgggtagatggatgggtgggtgggcgagtgtgtggttagatgatggatggctgaatggatgagtggggggatggatgggtgagtgggtgtatgtatggatgggttagtgggtgggtggatgaatggatgggtgcataaaggatggatggatgaatgagttagtgggttggcagatggatggatgggtgagtcagtggatagatggatgggtgggtggatagaggatggatggttgggtaggtgatgggtggatgagtggatagatgggtatgtgagtgagtggggggatgggtaggtgggtggatggatggttaggtgaatgagtggatggacagacggacagtgggtggatggatgagtgaacggatggaccgatggatgaatgggtgggtgggtagaggatggacggacaggtgagtgggtgggtggatggatagatgggtaagtgagtggatagatagatgggtgggtggacagaggatgggtggatgaatggatgggttagtgggtggctgggtggatggatgatggatgggtgactgggtggatggatggatgggttagtgggtggctgggtggatagatggatgggtgattgggcgaatgggcgaatgggtggatgggtgggcgtggagttggtgggtacatgataatggggtggaatacccatggattggaatgagctgttttggctgctatttctgggacacccagctctgccaggcccctacccctctggtgggccaggctctgacggtggccactcatggcctttctagctctggtgccagcatagggaaggaggaggcacagccttgtcttactccttgcacctgttagcccccccccccgccaagggaggacccgtggttggggacagcacagggggccctgctgtgtgcagggactgtccctggggccactgaagcccacctgttcttgttccttctcaggcggatcctggtccccctggtgagccaggccctcgggggccaagaggagtcccaggacccgaggtaggttggtggccagtccccatgccctccccccaacctgccaggccaacacacacccaagcctcgtggttctgcccacggtggacccacgtatcagtgggcagtggcctgggagagactcagccacccagccttggccccagagtctcagcctcatccttccttccccagggtgagcccggcccccctggagaccccggtctcacggtaggtgtcacatggggcagaaccagtgtccttctcctgccaaaactagacaccaagagcagcaggggtgggggaaggtcagctggcacggtcagagagcaagatcagtggaggaggtcagagggcaaggtcagagagcaagcttggttggggaaggtcacagggcaaggttggtggggggaggagggtggcagcgaggttggtagggacaggacccgccagcctccccgcatggctgcctccacacgtgggctggaatgtcccgggacccccaggccaggaccttgctgtggaaactcttctggggccccggggggactaccctgcctgccgtgtgcattgcaggagtgtgacgtcatgacctacgtgagggagacctgcgggtgctgcggtgaggcactgcccacggcagggtcggggcccatgcaccgggtggagggcgggagtgcagcagggctgggtcatcgctgggtcctgcatgtgcacgtgaccctagggtctgaggtctccccggtaccccccgatgaccctgccacccccccagactgtgagaagcgctgtggcgccctggacgtggtcttcgtcatcgacagctccgagagcattgggtacaccaacttcacactggagaagaacttcgtcatcaacgtggtcaacaggctgggtgccatcgctaaggaccccaagtccgagacaggtcagcggggcaggggcgggtgcagcattgcggggggccgggcggggcgtgggaggcgatgagatgggagaagtccagacgcgtccctccaacgagggcctctgcatggctggggatgccccagaccccgaggcctctggcaacgacctcacgcgtgcggcttgcagggacgcgtgtgggcgtggtgcagtacagccacgagggcacctttgaggccatccagctggacgacgaacgtatcgactccctgtcgagcttcaaggaggctgtcaagaacctcgagtggattgcgggcggcacctggacaccctcagccctcaagtttgcctacgaccgcctcatcaaggagagccggcgccagaagacacgtgtgtttgcggtggtcatcacggacgggcgccacgaccctcgggacgatgacctcaacttgcgggcgctgtgcgaccgcgacgtcacagtgacggccatcggcatcggggacatgttccacgagaagcacgagagtgaaaacctctactccatcgcctgcgacaagccacagcaggtgcgcaacatgacgctgttctccgacctggtcgctgagaagttcatcgatgacatggaggacgtcctctgcccgggtgagcgtgtgggcgcggggcagtcggccgaggagcagcaggccccagccgctgtctagcgtgagccccagggacacccctcacctgagggatgaatgtgcagcccaggatcttgggctgtgggtgggaaggggtcgggccctctcggggctgcagggcagaggccagctgcaccctgagcctgtctaggcagatcagtgaacggccgctgagggttcgctagggactgaccctggcctggcccggcctctctcctctcttccagaccctcagatcgtgtgcccagaccttccctgccaaacaggtaatgcagggcaccctgagccaccaccccagactagcaaagcagccctggtgtccttcctcctcgagggccgggctgggggaggggccgtgcagggacccggggggcggcggagccactgcggaggctgctccttagggagatggccccaggatggcagcacaggggaggaggggcttggggaaggcaggctcccaggaacgcaggaacagcatcacgaggccatgaggtgggtgctgctagcctggcgctgtgctcggcatgtggccactggtcttgaaggcccaccatgggccttgcagtctccctcagctgccgcccagctcccatgggctggccgtgcatgtgccactcggaggaagccctggattcagtgagtgaaaccatcccggggtggaagcactgacaccccccagcaccagcaggtcttgctccaaccctggcctgcctcggagctgcagctgcggctctcacatctctgggagtgggggagcccatgtcccggatgtggcccacgtgggtgtgaagctggagctgggggtgccgtccaggctctgctggacgtggtgctgcccccatggtgcactgctgcaccgtacctgggcccacaggaggtccccgggggcgttaggagctgagtccccctcagtgagccgtcccctccaggagtgtgagggtagggatgccatggagacagggtgggagggtccgacctggaggaccacagggaggaaacctcagggtctgcggtacgaagtcagcgcttcctcagcacgcgggtcgcggtgtgcgttcgggcgttccatggggagctcccggtgggtgagctgggccactgagcacattcacaggccctgaggctgccccaggggaggagccgtggactcagagccgaggttccccatacgtgctgcgacagagaacctagggcttgcacctgggtctggctgcccttcagcaggcgggcagcctctggccccacaacagtgggctgtgcttctgccgccaaggtgcaggcgtcctcccccagggtccacatcagcagcaggggcacctggaccctgagggcaggaaccagaccttggctcctccacccaccccctcgttcctgatggggcagggaagtctcgggaccccatgatgggcgacatggcgatggtcactgtgggtgctttgctatcaggtggggggccttcctctccactctgggtccagtgtgagtggccgctatggcttcccctccactccaggttctatcgtgagtgggtgggtgctgcgtctgtggatgtcacgtgacctttcctctttagcctatcattgtagttgggagttagttagcccgttgagcgtcattgaatttccagtgttgagccagccctgcgtgcccgggataaacccacctggccgtggtgtgtggccctgtttatgcacgtgggccctgattcgctgatgcctgcctgagggtttgcgcttatcggcgacatcagcctgcacttttcttttctcgtgatctctctggttctggcctcagggtgacgtgggcctcgtagggtcctgtggtggctcctccccagacggtgacatggagtgagcccattctccctcctgggagtgggtcactcaggccaccagagcaccacagggaaagcagccagggaggacacggaggcccttgaagctctggcctcttctgaggcctccaggacctgacagtgagtgggagcagccctggcagaacccctcccctcctctcggccgccctgacacctcatccccgacactcagagctcatcctccttcccagctgtttccaatttcaaagtgaactcgaccttgtggctccaggagatgcagcagggacagtgttaaatcggctttcaccagcccacacggccaggcatcctcctcggccctcctgggcactgggtggacaccactggctgtggcctggccctggccttctccagacagccctgtccaccccaaagcccagccaccctgggcctgcagcaggcctgtggagttctcagttgcgtggggaccagagggtgctggagaaacaaaccagacgcagctgaaggcagtcagggcagggcgcaatcagcgataagagctgcataggggccacagcgtaacctgagctccagtcggtggaaagaaaaggcagagacgttgcagaggccaggtctgctcaggggaagacagttctgggtgtagaggactcacatcccagagaggctgaggaagggtttaccaccgcaagctttctcaggcgggctcttgaggggtggctggggtcttcctggcgacgggcctgcggcactggaagccctactggagtttggcctgtctccggcacaggtttggacggagctgttttgtgctgaaaggttttctcggggtccgtggtgtcccccaaaggtgccaccgtgcgggtctcctagctccctgccagcttcctgtccctgtgctcactgcccccacgcctcctgccaaggccgagccacacacccgctccacctgcatttcctctaccgactcgccagcccaaatgccgctcttcactctggcctcgctgagcggctgcccgaggaggagctctaggccgacgcccaccgcaggccttacagtcttctctggacgctcccttgcagatgcaccgtggcctggcggcgagcccccggtcaccttcctccgcacggaagaggggccggacgccaccttccccaggaccattcccctgatccaacagttgctaaacgccacggagctcacgcaggacccggccgcctactcccagctggtggccgtgctggtctacaccgccgagcgggccaagttcgccaccggggtagagcggcaggactggatggagctgttcattgacacctttaagctggtgcacagggacatcgtgggggaccccgagaccgcgctggccctctgctaaagcccgggcacccgcccagccgggctgggccctccctgccacactagcttcccagggctgcccccgacaggctggctctcagtggaggccagagatctggaatcggggtcagcggggctacagtccttccaggggctctggggcagctcccagcctcttcccatgctggtggccaccgtgtcccttgctgcggctgcatcttccagtctctcctccgtcttcctgtggccgctctctttataagaaccctggtcattgaatttaaggcccaccccaagtccagaatgacctcgcaagacccttaactcactcccgtctgcagagtccttctttgctgcatcaggtcaccctcacaggctccagggtttgggtgtggaagtctttggaggcccttacttagcggcccagctgggctgccgtgcgtctgggatggggctgagggagggtgctgcccaggtgctggaggatgttccagcaccaggttccagcggagcctcggaaacaggccccagaggctggtgagcctcgctgggtgtgggcactaatcccgtgcatggtgactcgtgggcgctcacggcccacctggtggcaggtgaaggcttccggttgggcagcagatagtcctgggggaagctggcagtcctggcaccatgacgtatctgggctggtgtcatgcacagtagggcgaatggccacagctgcctgccagcagccctgatcccggggtgtctgcacccttccagcccaacctctgggtctccaaaagcacagtcgggggagcatccaccaggcacaacctctgcggtcctcagaggactgagcagagaatcccagggtccacaatgttggggagcggcagggatcaccatccaaagggagcggcccccacggcgagctgaccccgacgttctgactgcaggagccctcatccaggctgggctcctgccgggcacggctgtgaccatttctcagggccaggttctcgtccccacacccactgcacagggcaggccaggctggtcttcccactgtggggatgaaggatcctccacaggaggaggagagcagagtccacagacatcccaacagcctcagcctccctgtgcctggccggcccccacagcttccccgtctcctccaggccccacagacactgatgaatggacagagacccccaaaaccagctgccccttgcatgtctgtctccatatgtttggtgacagcagtgaaaatgttattagttttgagggggtttgggaagcccagcggtacctgaggagtttctggacatttaagccggttcctaggtgtggccttaacagggaggctgcccttcctttcactgaatgagctgcgtcactcataagctcactgagggaaccccatctgccagctcgtgcgtgctcagacggcgtccatgtctcaagcgttctgtgaaggctgcggtgcagcgtgaggtcaccctgctgtgttcagagctttgctcactgcctgcggggctggaccgttgcacctccagggcccccagaaaccgagtttcgggtcagggtcctctgtgtgcattcctgggggtccatgtaccagctgtgacgacgtccaggggttgggctgagaagcagacacccttggggaaactggctctgtccctcccctcccccatcccaggagctgaggtcttggtgaggccacagggccaggtccacgcaaggactgtccgtgtcctgtcctgtggtctctggccccacgtgacacccacacgtgtggtaggcagcctggcctgggttgtggctatggccaggcccccaagctgtccccgatgcccagggctggtgaccacccaggcaggtgggggccccacttggtaacagagtcatagggcagaacccacctgggctgccacagaaggtctggctgcccctgtgcccactgctccccaccatggccaatcagaagagtcaggggctcctggtctttccgggagggacgtggcccagccagctctaggtgttctgagcagctctgggacccagcgattgaggggtcaggctgggggtgtcagagccagggtcctccttaagtacctcccacactacacagacagtggcccttttgtgggcagcaaattcttgagccatgaaaggatgctttgggccccttccctcccaggagggcagcctgtgcagggatggtgctcagcaggtggacagggcctggggcctgtgtcagggtctcaggcctgggagcaccagcagaggagatggcggctcccagcagtgccgcctgaaagtgtcttgggctaaggacccacacccagggctgccctgcagaaacgcccccgcagagcccagtggtctgtgaggttgcaggcagggtgcgaatggaagggcacaggtgcggggctggcacctgcccggtcctgcccacctcccctccgcccagcccgcacctgcgtctccccacagagctgtccgtggcacagtgcacgcagcggcccgtggacatcgtcttcctgctggacggctccgagcggctgggtgagcagaacttccacaaggcccggcgcttcgtggagcaggtggcgcggcggctgacgctggcccggagggacgacgaccctctcaacgcacgcgtggcgctgctgcagtttggtggccccggcgagcagcaggtggccttcccgctgagccacaacctcacggccatccacgaggcgctggagaccacacaatacctgaactccttctcgcacgtgggcgcaggcgtggtgcacgccatcaatgccatcgtgcgcagcccgcgtggcggggcccggaggcacgcagagctgtccttcgtgttcctcacggacggcgtcacgggcaacgacagtctgcacgagtcggcgcactccatgcgcaagcagaacgtggtacccaccgtgctggccttgggcagcgacgtggacatggacgtgctcaccacgctcagcctgggtgaccgcgccgccgtgttccacgagaaggactatgacagcctggcgcaacccggcttcttcgaccgcttcatccgctggatctgctagcgccgccgcccgggccccgcagtcgagggtcgtgagcccaccccgtccatggtgctaagcgggcccgggtcccacacggccagcaccgctgctcactcggacgacgccctgggcctgcacctctccagctcctcccacggggtccccgtagccccggcccccgcccagccccaggtctccccaggccctccgcaggctgcccggcctccctccccctgcagccatcccaaggctcctgacctacctggcccctgagctctggagcaagccctgacccaataaaggctttgaaccc

SEQ ID NO: 37158 - DNA, 17081 bp, Homo sapiens
gaaagggagtgttcgggtttcgctggggcctcgcggctccagagcccagcatggcttcctcgcgagcctcttccacggtacagagcccgggatcccagctcactctggcagggagcgctaagggggaaggggatctctgcgggaaggggccgttaaggagcgggagaaggcggtggagggctgaggaggaaggctgcgggactcagcggtgtcctacacagcggaccaccgttttcctgatccctaagcgctttcgtggactgtagcttatttgcacctctcccactacagccccaaagggcaagcatctcttccgactcatccagtaacggtgctctgaaatagggaagtgtcttggccaaggtttatgcctttggcagatctcagaattttaatgagacctactaactcctactacctcacgtctaggaacgtttgaaatgtatacacttgtaatgttgtaacttgttatcctttagcaccgcgttggttatttcatctatccttagtatttccccagtgataagcagtaatccgggaagcataaaacacgagattgaacacttccaacggaatgaagtaaacagatttcagagcaaacctttcataggaaaatacccgagagaacctcactagttttattaatcccatcaaccaaagtgagggactgaaacaccctcaccctaccttcacctcctcaaatcaatgaagagcgtcttaagtagtgtccaatttgtcctttcaattacagaggaaacaggactgtgaaactcagggtgagcttcatcctctggtgaagtccggtaaattgccaagattaaaccttagtttaatgcagatctttgatttagcaggcaaccaaaactaaagcacccgacgacttagttgctccggtcgtgaagaaaccacacatctattatggaagtttggaagagaaggagagggagcgtctggccaaaggagagtctgggattttggggaaagacggacttaaagcagggatcgaagctggaaatattaatataacctctggtaagatgcaaattgtgagcccatctttacctctttgtgtaatgaatacctttctaaacttaaataccacagttttataatgtcaaaaaattacaatttttttttttttaaacagagtctcgctctgtcgccaggctggagtgcagtggtgcgatcttggctcactgcaacctccgcctcccgggttcaagcagttctcctgcttcagcctcccgagtagctgggattacaggcgcacaccaccacgcccggctaatttttgtatatttagtagatatggggtttcaccatgttggtctggctggtctcaaactcctgaccttgtgatccgcccgcctcgtcctcctaaagtgctgggattacaggtgtgagccactgtgcccggcagaatttcaattcttaaacttgcagctataaggctgtattttgcctacccccttattatcatgcagagagcctttttcttacaatctgttatatagtttttcttctatgagtgagcagtcttatcaaaaattcagtgtacatttggattcagattgattccatttgtcttctggagatctaacatagttctggcattggtttgcagctagagtggttcatgatattctcccttttgaagttttgtaattattttttacccaaagtgaaatctttttgtgtgtgtgtgtgtgtgtgacagggtctcactctcttgcccaggctggaatgcagtggcgtaaccttggctcactgcaacctctgccttttgtgttcaagggattctcctgcctcagcctcccgattagctgagattacaggtgcccgccaccacacccagctaatttttgtatttttagtagagactgggtttcaccatgttgcccaggctggtctccaactcctgacctcaaatgatccgcccacctcggcctcccaaagtgctgggattacaggcgtgagccactgcacctgactgagctatctttttttattataaaagtaatagtggccaagcctggtggctcacacctgtaatcccagcactttgggaggctgagaagcgggagtctggcttgagcccaggaatccaagaccagcctgggcaaatagtgataccccatctctacaaaaagtagaaaattagctgggcatggtgacacgtgcctgtattcccagctaattggggttctgaggtgggggttcaaggctgcagtgagtcatgactgtgccactgcactccagcctgaacaacagagcgagaccctgtctcaaaaaaaaaagttattttcttttaaaagatcaatgtataaatgtgtgaagtagaaaatcctgtatttttaaaattaattgattgtatatctttctgagaattttaatacagctaaaaagtatgtaattttttccataaatgaaaacacaatacgtaaattgttgtataacccccatttttcatttatataccattgaggatatctttccatgtcagtaatgagaggtctactatattttaaaaataaaattatgcatatttgtcctaagaaattcagacaatgccaaagggcataaaatgaagactcctctgcagtagggacatctgtcaggtttcttattgatcctcccacacattttctaaacacatgcactgtagcctagtgactttttaaacttttaatactgtttttaaacataacgtcaccactgtacctctcattttttatcacacttgtattttggtgtgggtttcaaaactattgctagattatccagaaatccttatagttgtggaactctcattttcctggtaattatttgcagtttagtagttaatgatttgttaagtatccctatactgggtctcctttcgagaataaatagctttggctgttgttacaataatgtttctgttacatcttctggatagacagcctagttaactcatttgcaaaagatgttctgtactcttacttgctggtctcagccaaagtgtgtgtttatataggcacaaagttaataaatgaaacaagaggtggcttgaaccattttcttgccttttgaagctgtgtcatttaggtttatgtgtttggcataatttaataaactgaaaaacagtaaactataaaatgtgtaatagacagttacttttccctcagggcatacacagactgcaattactagaaattatttctctctatttgaagaagatctgctgatgttgcctgttttctttttaataggagaagtgtttgaaattgaagagcatatcagcgagcgacaggcagaagtattggctgagtttgagagaaggaagcgagcccggcagatcaatgtttccacagatgactcagaggtcaaagcttgccttagagccttgggggaacccatcacactttttggagagggtcctgctgaaagaagagaaaggttgcctttctaaatatttactttttttctttattataatcacagggttctactccaaattttggttgatcatttagttgaactttaatagaatgtctcaaatcatgttaacaatatcttactgtgtttatatgagttagcccataatctgtcttaggccaatttttaccgcactattaatgtttcttttttgtgtttgttcgtttttgttttgttttgttttgttttgttttgttttgttttgtgttttgagacagagtcttgctctgtcacccaggcttgagtgcagcgtcgtgatctcggctcactgcagcctccgcctcccgggttcaagcgattttcctgcctcagcctcccaagtggctgggattacaggcacctgccaccacatttttcttttttgtatttttagttattttttatatttttgtatttttagtagagacagggtttcaccatgttggccaggctggtcttgaactcctaacctcaaatgatttacccaccttggcctcccaaagtgctgggattacaagcgtgagccttcgtgcctggcccgtttttctttatagacttggaagagggtgctaacatgctcccttgcctcccctccccagtgcgagttttgaattggataaacatttgttgttgggctttgaaaattgagacatcaaatgcattccatatcaatgacatagaacaatgataaatgtttcttggattttattgaagaggggtaccatcctcagataatgccctcttgttatttgcaggttgcgaagtcttagttgtggtctagtcacacacaattatgaggagcccctctggtctctctgtccactgtctcatctacccttcatcatccagcttgttggaagggttttttctattactcccttgaggtccttacccttatttactcttcaacctgctgcaaactgaccaacccctaccacattaaaattgctctttgttaagatcaccaatccacctttactaagaatagccctagtatactgccagccactcctccttgaaatactccctccttgaactactccctttccttcactctcctaataacaaatcctcttgattttcctcttctctcactagctaattcttctcacttaccttctaaacctctttttctctgcctgccctttacaggctgcctttttctctacttgcccttggtgatcagctctactcccatggcatcattcactgtgtgttctgatgattcccaaatctctcactgcagcttaggtatcccacaggtacttcaaacttgagacatctgaattgaaatatttccccacctctctcctatactcatacaattcttagttgaaaatctgcctagcctcctttataatccattagcaaaatctggtctgttctacttgcgagatacaactccagctatcttctttgctctatctttactgctttcaaatctgcactgttgtgatagccccaaacatgttgtgttaattgcttgcttaaaatcctagattgtcttctcatacttggagtaaaaaactcttaccatggtctgtaaggtcttcagccttactcatgtctcccttccccaatttactagaatagccacattggtccttatggaatatgctagttctttttatgtctttccacataattggtctacttttattcttctgtcttgtcttttagaggctttttttcttcctttttttttctttgaaacggagtctcgctctgtcacccagggtggagtgcggtggtgcaatctcagctcactgcaacctccacctcccaggtacaagccattctcctgcctcagcctcccaagtagctgggactacaggcatgtgccaccatgcctggctaatttctgtatttttagtagagacggggtttcaacacgttggccaggtgttgaacacctcctcaagtgatcctctcaacacctcctcaagtgatccgcctgcctgggcctcccaaagtgctgggattacagatgtgagctaccgcgcccggcctttcttcttcattttttattaacctggatccctgtcaaacttcttattctttcgtttcagcatagatgccacctattcaaagaagcctttcgtcacacctaacccctctgttctctgtcatagtatgttattttattagccttttcaaagggtatacttttttattattgtttagtttgttttttccaccagcaaagtctatcttattcattattatgttccttaaatgaatcctttgagtcactactgctactatctgaatttcagtccacggttgtgactcagagcgtcactacaacagtactgtctgatttccctgccattattcttcccttttaatccattctttgtactgtttcagggatctttctcatctgtaaatcctcctgagcgtggcattagcaattctttgtgacctggctcctccttgcatttgcagccctattcttcaccagtcctcttctatgttctacgctccagccatattgaattatttgtgactgcaagctcaacatgtttttcttacctccaggccttatttgtttaaccctctgcctgacattttctcattcttgacccccttgacctgattaactgaggactcaatttacatattacctttttttaatgaagccttccctgatcctctaagcttagttagatgcccgttacaaagtcccctctagccctctgtgcttactgctatagtgataggtaatataatggattatagtttgccagtactctctgttgtttccccaggactaagctacttgaaatcaagaactgattcctagtcatcactgtatagttagcacctgagtcagtatccagtacattgtggcactgagtgaaagttggcagtcttcacagaccaagtggtagcagtgtaggggctcattgactctaaactgtatagagtaattgcttatagttgaattttggaaatttccaaatagagaagactgagtgggagaaaccacactgggagtttagccatccccacttgactcttaaagaaggttcctggagggccgggtatagtggctcatgcccgtaatcccagcactttgggaggctgaggcaggaggatcacttgagcccagaagttcaagacttgcctgggcaacatagcaagcccttctctctacagaaaaatttaaaaattagccagttgtagcagtgtacatgtagtcccagccactcgggaggctggagtgggaggatcgcttgagctcaggaggttgaggctgcagtgacccatgatcatgccactgcactccaccctgggcaacaacaagacctcatctcttaaaaagaaaaaaaaaaggttgctaggtggtttgaacagtgagagaatagtaaaggcttgctcccatcttaggggaactttaataacagtgtttaaaactgtgttaaagtgtactttaaaaacagtattatctcaaccatgtttaaattctgatctttttttttttttttaacaggttaagaaatatcctctcagttgtcggtactgatgccttgaaaaagaccaaaaaggatgatgagaagtctaaaaagtccaaagaagaggtagaacatgtctttaacttcacagtataaacatgaaggaaatgaggggataggtctctcgttttctgctttcaatggtttgttttgctgagatgttgggggaaatgtttttgaaggctctaccattcaagaagagttgctggcagtagttttggttcctttgtaagtatgaatggagctaagtgagttttccagtcaggaaagaatcatggcattcctggtataaccatgtagttacatatcatagaaaaaaattcagtagaaagtcctctgcctgatttcatcctattaccgaatgaattcaccttccttctgggcagttaaaatggagaaatgacagttataagaggagtagaatgcttcagatttgacctttctgctcttaatttgcctttcagtatcagcaaacctggtatcatgaaggaccaaatagcttgaaggtggcaagactatggattgctaattattcgttgcccaggtaaagagagcctccagtagaagaaagaagcatattttttgtgtgtgtttcctctcaggaactgagtgctggataatgactatggttgttaaatgaaattgaggggtagagtagggatacatgtgggtccttgtttacaaccctgttgctcctggtgatggtgtttctgtgtcgcagggcaatgaaacgcttggaagaggcccgactccataaggagattcctgagacaacaaggacctcccagatgcaagagctgcacaagtctctccgggtaagatgctcccagcaattgtcccacatcttaaaggttcttcatgtttatttgatttttctactttggctcacctctgggaaggtagaggcaactagagtgattcctccctgcttaagttgagctgctgtgacatggaaggagccatcagttaatgtggcaggagcttactgtgctttgtattcagcagaggcctatggttctattctttatttctccccgttaatatgtcagagtttctctggggttttctgtttatatttagctgactcagaagttgtgatcctaagactgtagaaaacatctgggcacagtggctcagtcctgtaatcccagcattttgggaggcagaggcaggcggatgacttgagcctcaggagtttgagaccagcctggtcaacatggtgaaaccctgtctctactaaaaatacaaaaatttgccaggtgtgatagcatgtgcctataatcccaggtacttgggaggctgagacgggaggattgcttgaacccgggaggcggaggttgcagtgagccaagatcacgccactacactccaccctgggcaacacagcaagactctgtctcaaaaaaaaaaaaaaaaaaagactatagaaaacagcatgctggagtttcatataacttcatttatcaatgtatgtgtcttctaacagcagcaacaaaaccatagaagaatcttgggatgggttaaaactgaaaagctgctttgttgttctttttatggtggaaaagcaaaggagctcttagattaacctattaatgatcaccgtgtgtgtattttttttctttttaagtctttgaataatttttgcagtcagattggggatgatcggcctatctcctactgtcactttagtcccaattccaagatgctggccacagcttgttggtaagttccattttacaatgacattttttcctaaatggggaacaggctcaggaagaaaattagcatttgcgttagacgtctatttctacgtcctctttctctgcttctcatgatcacaccaaactacagatgtcagtcagtgctctacctgttgtataatacaatgtagccttggtttagccgttctcgctcttcaccagtgaccccagagatccattacacaaagcactctgtcacattcttgacactagtattttggaacaggtcctgtagtgagtttatagaccaactagtatccataactcagtctggcttttctttttcagttatgtgacctcgctaagatacttaatttctgtaagcttcagtgttcttacctgtaaagtgggatgaggtagtgtttgcaaggcattttgccttgacagtgcctggtatgtagtaaggactcgttaaacgttaattattggtttatctttgttttattttcttatcaccacatatgcagaaaactcaggatgtggtaactttgttgttttgtttgagtttggttgtgtttttctgtgggacatggctatctaatgagaaaggaaacttagattgaatacacaggagctacttgactaggctgacctttagatgggttcaggagaaagccaaggttctgcacaaatgagtccacctctccaagcctcattaccttcactataaagtttgatcgttcctgccgtacctgcttcacaggtctgttagaaagatcatccgagataatagatataaaagtaatttgttgaaaaatttccaaaataagaagtctctaaaaagtttaaggccagccagccatggtggctcacacttgtaatcccagcactttggaaggccacggcaggaggatcacttgagcccaggagtttgagaccaggctgggcaacaatagtgagaccctgtctctacaaatttttttttttttttttttttttttttttttttttttttttttttttttttttgagacggagtgtcacactttcggccaggctggagtgcagtggcgcgatctcggctcactgcaagctccacctcctgggttcacgccattctcctacctcagcctcccaagtagctgggactacaggcacccgccaccgcacccagctaattttttgtatttttagtagagacagggtttcaccgtgttagccaggatgggctcgatctcctgaccttgtgatctgcccgccttggcctcccaaagtgctgggattacaggtgtgagccacagcgcctggcccaaaaaatttttaaaaatttatttaattttttaaaacgttagccaggtgtggtggcatgcgcctgttagtcccagctactcaggaggctgggtgatagaattgcttgagcctgggaggttgaggctgcagtgaactgtgatcacactactgcactccagcctaggtgacagagtgacactgtttctcaaaaaaaaaatttaaatactttgtaatcagcaaaatactattcatatttaaggacagtatcactattaatattcgtattattggatagtttaatttgccccaccttccctcacaagtggatccaaaagttaaggagaatggctactggtgtagtgttaattatagtccagtaaaagcctctggttgcgtgtgggctggaggtagctttttcttctataacccttctaactataaggcttttatttttctgtcagccattgtaaagtttattgggggtgagaagagattgtcctttagtaatattaccaaggtaccttttccttcccagaccaaccctggctgagatgctttcctttgtatttgataggagtgggctttgcaagctctggtctgttcctgattgcaacctccttcacactcttcgaggtaagttagagtcttatccaaatctcggtctttttcccagtgtgaactcagttaagccttaaactctgcttgacactcagaccccatacacacagcattaatccttgatttgatttgacttggttttctctggctgcaagactggactatcacaacttcctacacatccacttttctctcatgtgcagtcacactctggcattttataatctctaaaccaaaaaccaaaatgggtttttttgtgttttgcttttttaaaaatgtaatttaaatattagcttaaattaaaatagttcatgttttaatagttgaatagtcacttgaatactctgtatgtccacatgttccctagtatataacatgggttataaagaggcaggaaccttttaacttgcatctcttacactcctttagggcataacacaaatgtaggagcaattgtattccatcccaaatccactgtctccttggacccaaaagatgtcaacctggcctcttgtgcggctgatggctctgtgaagctttggagtctcgacaggtgaatatcactgttctgtggcccatactgccatcactaaagtagatgtttgattggttggtccccaggacctcagtaaaaatctggcatttaggccatgcgcagtggctcacaccttaaggctgaggcaggagaattgcttaaacccgggaaatggaggttgtggtgagccgagattgcacactgcactccagcttgggtgacagagcaagactccgtcttgaaagaacaaaaaaaaaaatctggcatttaacccccaagatggtttaagagtcaaggtaacctagtgtgaaaatgaagtaagtggaagatttcattcttaggccttttcttactaaaggagttatgtccgttttttcttacctgttaactttggatcttgatttttgtctatagcctagtgaccactatttcctagctccatttattccagaaagatccagcctacctcctacatgataaattaacaatgaactaaatataatattcttggcagttcgttggttcttagcaaacagccacaggggagaggaaagtgaggttctgtctagcagtattaccacggagatgtctcctcgcaatagcatcatcctttacctagaatgtattttccaactacaacagtttttaaaaatgtgtttatgtgattgttttccaaaaaaaaaaaaacttcggaagcaccctgttggccaaaaggcatctgaatttaattgtttagttttctttctttgggaaaacacatgaaggtttttacttgagaatttttatgagagctaattaatgtcttcactcctcaccagacagggtctcacttaggagcgcagtgagttttaattggctttggtaatacttagcaatgtttattccccttgggctttggcttgttctgtgtatgcacattgacaaagttccctttttaattgcgttccttagagttcatgtttatttccttttgctgatgttcagatcttttggtggttgctgggtagcagaatttaatggccaccaaaaggagactaagcctcatctctatttaggagttcctttttcatttggatcttggaacaggcctaaatttgaaaaaggtttatctgtaatccacttgtaccaaaactatgtgatttctgtgtccttatatctcttccaaagcatgttttctttctagaatccaggtactcctttggtgcagaatgactattttgcttattgggccaaagtagtttacaagtgtagttacaatttagcctctcgtgttgtacagaatgggtatgtctgcacagaaggtaagcagttttgtgactatttatatgtctataaaattgtttatatgtttggttcctttccagtgatgaaccagtggcagatattgaaggccatacagtgcgtgtggcgcgggtaatgtggcatccttcaggacgtttcctgggcaccacctggtgagccatcctgttattgttttatccatataggcctgtagcatcttcttaaccctttatggctatctgccaggtaaatttttagagcagagatcttcaggtaggattttcttgggctgcagggaattggaatcagaggagaatgtttaatatagtgagagctaagtatatttgccttttttttttttttgaggtggagtctcactctgtcacccaggctggagtgcagtggcgcgatctcggctcactgcaaccgccgtctcccgggttcaagcaattctcctgcctcgacctcccgagtagctgggactacaggcgcgtgccaccatgcccagctaatttttttatttttagtagagacagggtttcaccatgttggccaggctggtcttaaactcctgacctcaggtgatcttcccgcctcagcctcccaaagtgctgggattatagataacaggtaacgcgcccagccatatttgcctttaaattacaattaatctgaaatttcagagttacaaattaccagaaaacaaggattttcactcttgtccaatgctacaggtatataagtctcccttcctggttctgtaagttcagggaggctagaatctgttagagaacttttccattaagttataatttacatacaatggaatggatttattttaagtgtacaatgctgtcagtctttacaaacgcgtaccattcctgtgatcgacacctctgtcaatatagagaatagtccatcaccccagaaaggtccctcatgcccttttccagccaactcccccttctaaagcaactgctgatctgacttctatcaccacaaattaattatgtctattcatactgtgaattcatttgtggcaggcttctttcagcataacattgttaagagtcattcatgttgttgcatgtatcagtaattcctttttattgctgggggttattcatttttatgactgtgccatagtttatccattctcctgttgatggacacttgggctgtttccaggtctgggccagtcagaatgaagctgctataaatattcttgtaccaggctttttgtggacatgagtacaattgctgggtcatagggtagaggtatgagatgtatatttaactttttctaaactccccaccagttttccaaagcggttacaccattttacattcccggagttctggttacttcacatccctgttaacatttggtgttgtcagtcttaccattttgcccaatctagcaggtgtgtagtgatctcccgtgattttcattcttattaccctgatcattattgctcttgagtgctctgtcatatgctttgcctggttttttaaattgtgtttgtctcttttgtctttatttccatgtgcatagtcagttataccaccttgtattgaagagactttcctttctctgttggaattgtttcagtacccttgttgaaaatcatctgaccatatatgtgtggttatttctgtacttcctattctcttccattgatctatttgtgtatgagtgatttttgtatccccaacatccaatttagggcctagtaaatgtataaatgcttgatgaatgaaagaatataacagtggaggaagaaagaaggtaacagagtctttgctgggccattcttggggaatcctgttattacaatagccactaggttgggcatggtggctcacacctataatcccagcactttggaagaccacggtgggtggatcacctgagctcaggagttcgagaccagcctggccaacatagtgaagccccatctctatgaaaaatacaaaaattagctgggcatggtggcgcacacctgtagtcccagctactcagaaggctgaggcaggagaatggcttgaacccgggaggtggaggttgcagtgagccaagattgcgccactgtgctccaggctgggcaacagagtgagactctgtctcaaaagaagaaaaaaaaaaaagccctagaggtttacagcgattccatggttttcagctagcacctaaggcagataagcttagttgttgagtcattgtttatgtcagaaaggagcttcctgttaatatggttatatgaatagtttcagaagcattaataacttaagctataatggcttagaatactttatgtgttgtagaaactgaataaatatcagctggttgattgttagtgtgatttggttttagctatgaccgttcatggcgcttatgggatttggaggctcaagaggagatcctgcatcaggaaggccatagcatgggtgtgtatgacattgccttccatcaagatggctctttggctggcactgggtaaggcttctcccatgtagtcaggggcagttcagtactctcacctcttacctatacctgcttccacagagaactggattcaaagtgttcatttctaaattattttctcaggggactggatgcatttggtcgagtttgggacctacgcacaggacgttgtatcatgttcttagaaggccacctgaaagaaatctatggaataaatttctcccccaatgggtaaaataaacacactgaatgaggggcgaaaaagggttctgggtcagtaagtactctatttctaacttcaatactgcatccaatccacagctatcacattgcaaccggcagtggtgacaacacctgcaaagtgtgggacctccgacagcggcgttgcgtctacaccatccctgctcatcagaacttagtgactggtgtcaagtttgagcgtaagctttcctcctattttacgtctaaatgacacagacaaacagtattgtgttcccgtggaatgcaggccaggctttagcttaactgagcagtaaaacaggagagaaattgacctactggtaaaggagcaaattataatttccttccctctgccatacccttagatctgtgggaaagcacgcttctcgttgcaggaagtaaagcagactttcatgagtgctttgcttcattctttcctccatggatgctctgagcactgagtccttaatattattctgaatagattctcggtcagggaatgagccaaaagaccttactgttatttgttcccttaagtctgtagaaacaagtttttttaaaaatagtatgtttttgcagacttttgtgcttttgtcttctcttttgaatacttgaattcctcaagcaattccccttctcttctcctgtagctatccatgggaacttcttgcttactggtgcctatgataacacagccaagatctggacgcacccaggctggtccccgctgaagactctggctggccacgaaggcaaagtgatgggcctagatatttcttccgatgggcagctcatagccacttgctcatatgacaggaccttcaagctgtggatggctgaatagatgacaatgggaaaaggacttgaacctcaagctctctctaaggagctgttttcctcaaacgagaagaattgaagtgtttagttctatcatgttttctgccaattaccatgcatagaccctcagtagaattggatttccatgtcagcccccactccaggaaggcagcccaatccctaggtgatggggaacccctctcacggttgaaaatttattacctttttacgccctgccacgaactgtgtagacattgtttttattaatcttttgtttggccgggcgtggtggctcacgcctgtaatcctagcactttgggaggccgaggtgggtagatcgcttgagctcaggagttcaagacgagcctgggcaacatggcaaatgccgtctctgcaaaaaaatactaaaattagctggtcgcggtggcttctgcctgtgattccggctacttgggaggctgaggtgggagggattgcttaagcctgggaggcagaggttgcagtgagccgagattgcgccattgcactctagcctgtgtgacagagcaagaccctgtctcaaaaaaaaaaaaaatttgttcgaatgccttatagccttcctcacagcacccaggattgtgactgactctgcatttttaattcttgaaacttggctttccataacatggtacatgcttcaggactacatatgacccagagagcaaggtggctgaactatagtctggaagccctcaggtaaagaggcacatctcaccactcattggttaaacaatgcatcatagcgagcacttttcctttccctggagaatgggatgtgaagcagtagaccgcagccacgccgatggttatacagtgaagaagacttcacctcttcctattgagtttgcttggaatgctgacagcatcaggcaactctgaactgaacatttgctttgtcagaaaatatctttttttttactttgaagtttggcaaccttcatgttaccccaaagcaaaaccattgtgtcaggagtcaaacaaatgtttagaaagcaaacatgacgtctctattgtacaacctcctttctcttggctgtttaaaggatgtacttcgtgtattaaagggtactttatgttgaagt

SEQ ID NO: 37159 - DNA, 167776 bp, Homo sapiens
ggcccccagtgcaggcggagccgcgccgcgctcccaccccggccgggagctaggagccagcggccagccccgcgcagcgcagcgcagcccgcagaagcccggtcagcgcacgtgcccgcgagacctgcaaacttgtgccaccggctctgcccgtccccggggagcccgaacgccccgcagccctcacccctcccgccagtctccagccatgggtaagcgagcgcgctggctgcgcgccacggccacggtctcgcgcccccgccccgggagggcgcgcccttccgagggtcccgcccctcccccgctcaggtggcgcctcctcggccacctctgcgacgaagccgggacgctggaggtgggaggggcgcggcgcaggtgtccggaacgcccaggtgcgcttccctgttgtatcctgtggggggggtggtccccgctccggctgcggccaggctgcacccccgcacgtgcggctcgcgggagcctaagagctgggtacccgggaggggttgcagagagaacagacggcgcgtcccgggctagtgctttattttaaggggccagtagagagtcgcttcttgcctgtttcccgggacgctctccctgtcgcccgagctcccagtccagtcctgccccgccccgccccgccgtgcttctgttctccttaagcccgcgcgaaacaaacacccggttccccaagcctggggtcttccgggagctcatttcgaaaccatgacccttgaaaccaggaaagtgacaggagagactctggacagcatgggacggaggctgagtctctcctctttgtcccttgttccaactattaaaatgcggcccgggtgcaggtggaggcggtgtgctgagcgggttccaatgcaacgggggaacgactagcaacggcaaaaggctcagctccggagggttaaaatctgaaatctccaacctggcccgaggctggtgtaaggcggctgtaggattctttttgtcacttcctaacaccctgaaatgctgccgtcagcaacatgtctttaagtggggactctgtattgggaggaaaactcgtaaagagtgctgtggaaatcagcctcattccgcagcactcctgaaaacgtgtgacagctgtgcttgggaaagggtttttctcctcctgctccgttatctttctctagtgacagactccagccacaagccacaaagactgtgaagagcattcctaacgaggacgtcagtgggtttaaccattgcgagttaatggtgagggcttgggaattgcttgcccgctcctccgcttcccctaatcattcatccccctctttcacattatctttgctattaattgtgtgtgggggggcgataattttgtacggattaaaattttggtgaggagtaaagggggcacttttttgcatttcaaaggaagctcaaataattttctggtttacatttttaaaaaatttactaggtgatcaaaatatgaaaggagataaggcccaccaaatccaacaggaaaatttctttctaaaaaggcaagaactagcataagatccttctagaaagggcagaatcgagtggcctgtaactcaggttcctacttctcttaatgtcccccatgtgagcagtcaaaccattcaacctccgttttaaatgaggctcatacacaaaatgaggctcagaggatgactgctactcagcctgtgatcactttggtgataattgccaccaaagatgttacagttacgaacaagtgtggtattgaggaaagcatcaactactttttctgaaatcgttattttaatttaacgctaggcgtttggatttgtacgtggaattatcacacggggaccttctccagaacagctttcacaatactttggactgatttaggggtagggtgggcttcatttttaaacaggtgtggagttgggtgcagttctcatgaagcaaaggcccgagccagagacctgttcttaaggaagtactttgtgttttggacaattgttggctccacatttcaattgccaatttatgttaatttgtgcatacttcactggttctggcagtatccttggttttggttttagtttttacattaaaaagaaagttcccttcatgtaaaaaaggaaacatactgatttcctttggtagactcttagtaaatacaccacagggccatgaactggttttatttttccagatgtatttaattaccgtgcatcctcttatgaatgttttaattgaaatgatttaacgttgggaaaattctgaccattggcccattaagtcgggactttggttcttaatacaattagttccttaaccaggatcagttaatttactggtaaaatagatgaggtttgtagaaataaaagtcccttcagactcaaattttaaggtatttgcaatctttaacctaaaaataaaataatgagtagtggtgatatgtgtaatttcacttttcattacatcttgaaagaaaacatgggtttttcattgttaagccagtttttttatagccttaagatgtaattcacatatcatacaattcacacgtttaagtatacaagtcagtggtcttcagtatattcagatttgtgcagccatcactactatctaatgttagaacattgtcatcaaccccaaaaagaaatcttgtacccatttcgcagtcactcctcattctcttctccccccagcccctggcaagcactaacctactttctgtctctatggatttgcctcttctggagggttcaggtaaatggaatgagccaattgatgtctgaagtgtatttgactgttcagtaactttggtcgttttgcacaatgagatgttgctgtattgtgtatgcagtacgctacctaaatgagtgtgttgaaactatttctctggctgaagggttccatgtttggctgcacatattgtgaaggtgagtgagagtgcacacacacagcacacagacacacacacccttcagtgttaactctggttttatctgataggaacttgcattgcccaacagaattttgattctgttaccttgttcataggcctgaaggcatagcaattaagtgaattccatgtaataacctcttataaggcatttgtggaatatccaagctgctttaatatggcttatgtatccagagagaaatgcggattttgtttctttgcctataattgttttatttttatttatttatcttttggagacagggtctcactctgtccatgctgtactgcagtggcctgatgtaataactcactgtggcctggaactcctgggctgaagcagtcgtcccacctcagcctcccaagtagctgggactacaggcatgtgtcaccatgcccgattaagctttacagttttttttttttttttttttttgtagagatagggtatttctatggtgcccaaactggtctcaaactcctggcctcaagtgatcctccctcctctgcttcccaaagtgctgggattacaggcgtgagccactgtgagtggccaattgcctatcattttaaatggaaactgtatacgaaatgatcagatacaacaaaatattgaaataattgtttcaacccattttgtggtaaggaagtttttataaggattatgtatttaaatgtcaataatttcactaaatagcattataaaaaattttggtctagagcagttctttttaatatgtgtacagatcatctagcgatcttgttaaaaaagcagtgtctgattcagtgggcctgggtggggcctgagtttctgcatttgtaacaagctcccagtgggtgctcatgcttctggttcctggagccaggaagcaaagaaggctgttaagcagagaggccctggtgcctgccccagcttgcccactagtttgctgtgtgatcgtgggtaaatcattttctcttcataattttagttgactataaaataaaagaatttgatgaaattatttctttgggtctttacaggtcaaccaatatgtaatttagaaaaaaagaaatgagagagtaatgttatgcttgaaaaccacgagaaaacagctccctgatggtctaaacactacttgaatgcatgaagccagcatcagaagtgtcacctgtagttgggttaaatgctggcatcttcgatgtgcatgcttccagtatgattggctcttctccaagggaactggtggaggaagctataatgttctccctctttaacacttccagctttggcttctcctgacctcttttccttaaatccctttcttccccgacatccaggctcaagccaccctcagaggctgcactcagaaagaagcacgctgaagacccatacatgcaatgcttggttctggaagcttgctcaggaattcagatgcagtgggagacaaaaaggaatggaatcctgctgaataactgggcaggaagtgatcccagaatatgctagcttccctccctctgagtctaaagatctagtaaggagcccacccttggatcttggagagagctcccttttaatatcgggacacaaaccgacattttgagtaaacctcatagtcgaataccacggagtactgtttgtgacaaacaggaagtcattaattctttattatatttttgctctaccgaaagctgttgaccaaaccacctggcttctccgagaaaacccttatctgctacatccaggaccaagcagctggatggtttattgaaaatgccaaagggatcaatcataaaacgtgccacttatgtagcctaaacattttgtttaactttaaacattaatttgctgatattttattgtagagtcaaggcctttgctttgagtgcaaggacctgattggagttcctagaagtctttcttacattaaatcacagccaaaattcattggcttctgattttcagcttcagattcttacattaaagtagaatgaaaacctaaaggcattgggaaccaatctctgggcagaatccctttatatcacctaccccactccccttaaacctttaaatttgcccgtacttacttttgcaactattttctcaagtgactcatttttgttaagactctccaaagtaatcaacctggttttcaaagaaaggaaaaaactctctcgtttggcactcctattttattagtttatgtaatatcgaattaagtttcataattctagtaacaagtacaactggcataaacaggtttgggaacaaacaccactgactcttcttaagtacactacttgggggagaagcagtacatacatatattgcaaaagagcctacaacccaagttctggacaatgatcagtatggtttagaaaaagaatggaggatatggggtaaatgggtggggtcctttaggtaaacattggtaagagagcatctgctatattttgagccatcatcatccatttaataattttaacatgatggctggcttgttagtgtttttcatatgcttctttctgttcaaataccaaatttgtcaagagcagaaatcgttttattcattgttataccccaatgttcattggaatgattggcatattataggtgttacacaaatatttgtttaaaaatgaggattcatatgcattttattaaggtctgtcaacattaaaattatagatttcaaggtatttaaattaacattgatgtactgcaaactctggtaaactatgctaaaatagggtaaattacgtaaattattgttctttaataataatacttttatcacagaataacaatttcagagcttgaagttgctttagaagtaatttgattgctgccaggcatacagacacagaaacaattgaaagagcagtttggatgttctttcattagctttttttttgccttgagctttttttcttctgctgctataaaatacttttctttctctggtgaaaagtacttccttctcatcaggtttttgaagttctggaaagattggggttgaaggctttgtttccctgaaactcattattgccctgagaattaaaaggcaatggcagctttgtgtttccatcctcaccatgtgtattagggttaaatgagtacctaccacaatatcatgcaactagcatgtgccagtctctaagcctttgaattcctgtcacatgtccatcaccatggggctctcaggggagtattggacagctgctcactcagcaagcattcacagagtcctgttcagatgagccaagtactgtgctaagtcttgaagcaaaaaataaacaagactctgttctcaaataaccacagtcatttctgaaaggcagataaacaactataataaaagtacaagatcctgtaggaaaaagagtatctgtctgaggaaaaaagcggggaggtggtatttcaaagagggattccctagggaggcagttactttaaatctgagagtcttcaagcatgagcaggaagataggggtcagggtgtccaggtgtctgggagaggatggtccaggccctggatacaaatgtgtaaaagcaggagccgtggcagaggctgctgtgtgggtatgttgagttgggaatggcctcaatgtgggggagtggggagagctgaggccagattgtaaagtaccaggaaataacttggtcattaccctgttggtcacagagaatcaggaagggattttaagcaggcacatggcagctggagggaaatgacagtctccccaaggggataaaagaaacccactgagagaatcgtttgtgtctaactataaaattccagataaaagtttagaagttctgataaaggtaaaaccttgtggcttatatgaagtttccagtggtgacttagatttgaggagtgttgagaagggtggaagggattaggataacccatgaaagagaggtaggagtgagcaaggtttgttggggcaattctgaagaaactgacctggccatagcagagagtaggtatgggagagagtaggaaatacgatttggtcagggaactgaaagccagatgggagtaatgaattttagttgattacaaatggacacatataaatgaatcttacaaaaatgtttttttgtaagtccattgtttcatcccttttgagaaggaagggaagtattagctttctgggatggaaagatattggggtgatctttggcatgactacagaggggttgaggattggaacagaaccaacttccatgtctatttatttactcgattattaattttatttatttatttttctttttttcttttttcttttttttttgagaaggagtctcactctgtagcccaggctggagtgcagtggtgcgatctcggctcactgcaagctctgcctcctgggttcacgccattctctcgcctcagcctccggagtagctgggactacaggcgcccaccaccatgcccggctaattttttgtatttttagtagagatggggtttcaccatgatagcctgaccttgtgatccgcccgccttggcctcccaaagtgctgggattacaggcatgatggattattaattttaaaagtgggatttgttgttgttgttgttttgtttttgtttttttgagacagtctagttctgtcacccaggctgaagtgcagtggtgtgatctcagctcactgcaacctcagcctcttgggtccaagcgattctcctgtctcagcctccaaagtaactgggattacaggtatgcaccaccatgcctggctaattttttgtatttttagtagatacagatttcactatgttggccaggctggtcttgagctactgacttcaggtgatctgcctgcctcagcctcccaaagtgctgggattaaaggtgtgagccactgtgcccagccatttttttttccttaaatatttgcaagaatttaccagtgaagccagttgggtctggagttttctttgtagaaatgtttaagttatgaagtgtatttctttagcagaggaatattcagactttctctttgtttcaattttggtaaattgtggctttcaagggctttgtccattttatctaagttatttgttggcacaaagttgttcataatattttgtattatctgtttaatcctgttatctatagtatctgtagtgatgttcccttgttcgtttctttttttttttttgagacggagtctcgctctgttacccaggctggagtgcagtggcacgatctcggcttactgcaagcttcacctcccgggctcacgccattcttctgcctcagtctctcgagtagctgggactacaggtgcccacaaccacgcctggctaattttttgtatttttagtagagacggggtttcaccgtgttagccagggtggtctcgatctcctgacctcgtgatctgcccgcctcggcctcccaaagtgctgggattataggtgtgagccaccgtgcccggcctcccttgttcatttctagtgatgtaggtaattggtattctcattatttttcttgatcaatatttctaaaatttattttaatagcttgatacttacatgtaataattatatctgataggtaagttgaccacttaatgaaaaaggagtacattttctagtaatcaaaaatagaatttaagtatctaaaagtaagaattgcttacttggttagaaaaaaataaaatctgccaaaagaaaaagtatttaaacctgatctttggaattttactcttaatggctgtatataattcagtatatttgaacttggtataacaaggtctattataaacaatcttgagttagagtagatcttgagttgagcttagtatttgcttgggtatttatttgtttagtttttgtaggactgttaaattctattttcttctttggaccaactggagatagatactaaaataaaagaagtccttttttcttcctttctaagtatagttttagagcagggtttctcaacctcagcactattgacattttgggctgggtgattctttgttgggggagtatgagggctgtcctgcgcattatagagtgttttgcagcatctgtgttctctacatactacatgttgtaacagtcctctagttgtaacaaccaaaaatgtctccagacattgccagataacccagggagggaggaggggagcaccatattgattaccactacttaaagggtaagagggattgaaaaccttttgtttctcacaatatcataaaatctgagtagtagcattgttgagaacttggttgagcacatctgcagaatgggaggatttcttgtctaaaaggtttttctttccaaaaggaatgcttggttttttttagttgaaggaagtttttttttttttaatctttttcttacatcatcagagaatctggagatataatggggagctttgcagaccacctaagtcattcttccttggagtaaaatggtgcctaaaccatctcgataatgaggccaacctcctggggaaatagtgtgcctggctttccttggtaacttctaatgattagtgcaccttatctctgaaaggactgaatctgtgaagatccttttgcttactaaaatagttttcatcatcttttgttctcattaagtggaaagacatgaaggatctagtcacatccttagttaccttgatggcctttccaaatttagaattcatcttcttagctgtaatcaaatctaaccagattaagcccttaaggcaaccttcctgcacgttccgtccttagtcatgtcttcattacgtttgttcatgtgtttgagagatgcaggagttggaagagaaaggactgatttcccccttgtttagagatccgttttctatagccattgatctctgccattcctacatcccagcccccacaacctagactcctccctgcaaatggagactataagtcaatgttttctgagacatctgaccatacttgcaaaatagttccagcgcaaaaagaacaagaacattggaagcgagggtcagaaggagcctagaaaacctgctatattgtatgtgcattgggtcactgttttagatttagaaatgtttcacaatgtcttcccgaaaagaatgtttaaatggtggattttaagatgggtgcttaaattcaggcatctgttccttcacacaatgggcaaagaatggaaatgtaattagcaatgtaagtcaagctcttaagataatgtgatttgatgcagtactttatattttcctttttgttttctcatttggcatattctgacagtttccatggtaattaaaaagaatttgggaccttaaagggatgaatttccatcctatgaattcttaccattttgcaaagccactgtaccggtttactaaaaactgttttgagctctattatatgatgtcacaaatatttttagatgttttgtaagaggcacaaatatcgtaaactcattaaaaattgttattgaagtataatatgtgtacacgaaaagtgggcaaatcataagtgtacagcttaataagtttttataaatgtaaccagcagttatagattaataagcagaatattaccagccccttagaagccgcctcaggctgccttacagatatacctgatcaaggctaatcacccctaatttctgtcagcagagctttgcactttatataaatggaataatacagtatgagctcttgtgactggtgtggcttgcccaacatttgataacattattttgaaacaggaggatgttttctgtctggaaaagagatctgcttctaaatcattatggttaaaagcatttattaaatgctttcgtgtgtagaaccgtactaggaagtacacatatcattggttcctaccctctattttaagtggaaagcattgacacagcagctgtgagaaggactttgaaaatccttgatgaaagatgagatagatacatgaaaacatgtatacagctggagagattacaaaaataaagtgtccccattatccccttcagaaatggaaagtacattttgaggagttgtgaatgaagacaaagctgtaagtgttgcatacctattcaggatttgatcaacgtgaatgcttgctaacttcaggacttaaggatgtaatagatgttgaggcctgcctcctcccaattagtttcctgtagaaggtgaaattttaggaattgtttgaattagcagtagttagtgaatctttggctagtggatattccaaatggagtagaggtgtggacaaaggcccaaaggcctgggatgatttttggttctcatcctgaaaatggaactacataggaaattgtggtttgccagttgacttttcttctcgtttgtttggacttagacaataatactttgcctatgttccttcagtgaggaactttgtcatcttcttaaccagagtaaatgatgcagtcagcaaaatgaatgctttgtcaccacactgaactagctttaaatcgtatggtgttaccactgcttctcaagtggtggtatcaatttatactctcaccaggagtgaatgaacattccagcttctttgtatctttaccagcatttgctattgtcacattgtttattttttcaaatatctgataggtgtgaagtggtatttcattgtttttttttttatgttgaatttctctagagaggttgaaagttttgtgtaggttattggtcatttgggttttctcttccatttagatccttatttgtatttgtcttgatttgtagtagttctttatgccttctgtatactaatccttagttaaaatgtgttttcaatatcatcttcctctctatggcttatcttttaacttggttgaatacatcttttgttgtactaaatcttttttattgtaataaagtcctaattatcaatcttttcctttaattttttatgacttgtgctttttatctttgccttgttttaaaattgtttctatccccaaagtcatgaaaatgttcttctaatcctcagtattttctaaaagaaagtttttctaaaatcacgcttttcacttttcagcctttattccattgggattctattttttggtatagttttagatagaaagctatttttaaatttgtttatttcctatacagaaataccatgcacttaataattcactctttcctcccgataatatctatatctgtacttccttactatatgtgtgagtacatctatggacttcattctattccttgatctgttttggcatctctgtgctactattacactgtcttcattactatagatttagagtaagcctggctatttcttaggagaaattttccccttttgctcttatttaaaagtgacctattcttgatcctctgctttttttgtgtgttttttttttttgtttgtttgtttttttgagatggagtctcgctctgtgtcacccaggctggagtgcagtggcgcaatctgggctcactgcaagctccgcctcctgggttcacgccattgtcctgcttcagcctcccgagtagctgggactacaggcgcccgccactacgcccggctaattttttgtattttttttttagtagagacggggtttcaccgcgttagccaggatggtctcgatctcctgacctcgtgctctgcctgcctcggcctcccaaagtgcgatcctttgcttttggaatcagcgttttatgctccacaaacatacctgtcaggattttgagtggggttgcagtgaacttatagaataattttttttttttgagatggagtctcgctctgttgcccaggctggagtgcagtggtgcgatctcgggtcgctgcaaactccgcctcctgggttcacgccattctcctgcctcagcctcctgagtagctgggactacaggcgcccgccaccatgcctggctaatgtttttgtatttttagtagagatggggtttcaccatgttagccaggatggtctcgatctcctgacctcgtgatccacctgcctcggtctcccaaagtgctgggattagaggtgtgagccacggcgcctggccagaataatttcatgatagtcaatgtatttactatattaagtctttcatttgtgtatatggtatatctcttcatacatttagattttcctttgtaccccaagatgtttttgcatacctttaaaaattttatttcaaggtccctcatagtttttgtggcattttttaaaggtaaaatgtaaggtaatcccagtgctttgggaggccaaggcaggaggatcacttggggccaggagtttgagcaacatagcgagaccccatctctaccaaaaaaaaaaaaaaaaagccagacatggtggtgcctgcctgtagttccagctacttgggaaacagaggtgggaggattgcttgagctgaggattttgaggttacagtgaactatgaattgcactccagcctgggtgacagaatgacactctgtttctaaaaaataaaaaagtaaagcaattagggttaaatctaattccatgcaatgccatggttcccttccatagacctgtgacttctgaaagtccagctggatggacaaacttgttcagattagcatagaaactgtgaagggaagctgattctgagttatcacataccagcctggtcataagagctgtatatggtaactctgtgactatgtcccagaacctgctgagtagcaaacgtatgggatgcatcatgggctacatcctttgaatagaatttcatctcttcctggaagagaacagaatccatcatcactgagggaaaactcagtttctaagctgagttttagctgcttgcttgtgctatattttccaactagtagtattttcatgaaagatattgatttcattgtcatattgatgcagaatgagaagtcaaatcagttcttctactaattcaagaataaaatctgtttgccaatggaagacaaagctagtgggtaacataccacaattaattttgcttgcctgatattttctccaagagcagggagcccatgagtcctgggagtcacatgttgaatgttaaaacttccaaacagtgatagagttcacaatttagctaagaagggacctcatcaaagtccacaggagtcctgaagatgggatcctgtttttagatatttatgcagaatacaagaaaagaggaaatagagtttgagttagatattggaatatccttccgttgaaggtggttgtggccgggcatggaggctcattcctgatcccagcacttcgagaggccgaggtgggagggtcgcttgagcctagcagtttgagaccagcctaggaaacatgatgaggccctgtttctattaaactaaattttaaaaattagcctggccggtgatacgcacctttagtcccagttactcaggaggctgaggtgagaggattgcttgagcctagtagatcaaggctgcagtgagccatgattgcgccactgcactccagcctgggcgacagagtgagaccttgtctcaaaaaagaataaaaataaaaaataaaggatcgattttatccattcaccaaatacttattagactgagtgctaagcttgtaatagaaggatggttaagtcatgattttcacacccggtaagtgatttggtcccatgcaggtgaattaaggttatatgcagatgagtctgctgtgtagcaattgtactctgtgttggctagtgatgacgtgtaacagtttctgccctcaaggcactctgccttcattgaggatagtcaacaaggtaacacctgtcatgatcccatgtggaaaacgttacggataaaacaggtggaagacccacagtgccactcagtggaggtaaaatgcccgggaggagccttggagggtgaactaaagtgaaatgagatatttttacttaaaccaaccttcaccatatcataacataagaaaataaaaaagaaaataaaaatccttaatatgttaaaatgcagatttcttctataagaaaaatatgacttgatgtgcaccattacaaagaccaagtttacattcaagatgcaaattcttggttgaaagaaagaaaaaaggccagtttttattatcttagagcgatacagctaaagtaacccaggaaagatttaattggagctcttctgttcaaacattacttccatgtttggagatgttattcatgataatgaaatttccttggtcaattcaagattacctagtttccctaagacatttaatggaaaacttctcctggcagattttacatagctgctcaccctgcgaagaaggggccagcacttgggctgtagcaagagcttgatttattccggaaagcagtttgttcagctgtcaaatgagattatatgtgtggctgttagccatcacttcacagaaatattcttattcctcaacaaggcctcaaacttttgtttatttaagggcaacaaaaatcacaaatgtagattctcctaaaacatctctttggaaatgtgatttttcacagggtgctgccattccctgtctgctgatgatggctacaaccaaactggactgccagacattttctacatgtcacctgctgtccctgggcagcagtatcccccactagccagcacacttaggtatgcttaggttttttttttttttctgagacggagtttcactcttgttgtccaagctggagtgcaatggcgtgatctcagcttattgcaacctctgcgtcctgggttcaagctattctcctgcctcagcctcccaagtagctaagattacaggtgcgtaccaccacaccaggctaatttcttgtatttttagtagaaatgggtttcactgtgttagccaggctggtctcaaactcctgacctcaggtgctttgcccgcctcgacctcccaaagtgctgggattacaggcgtgagccaccgcacccggccaggtacacttaggtttgtgtaatcctgaaaggcctcaggcataaaaatccctttttaaaattaacttcttttgtcatatgtttctgtcttgggggtggtctctcaatgtagaaactctagaatttaaaattgaagtctaaatttggatgtgaaagtgaagtttattttttatcttattttagcatttagggatttgagtaaaagtggtggtatttctactctgtgattcaattgcagtttcctcagcccaacatgacaagtgacatagcattaaaaagaaaaactcatatgtgaagtagctgtgacgtagagtgggctgttgattcaaaaggtcgacctggttggaggcttgaaggcgttgggctttccgcctggcagtctctccctcgtgtacctacaggtaatgtttggaaagtcaaggactggggagaaattgagacttcagattccttaagaagcaaaggcgaggttctttttgtctcaagaagagtttgtcagttagactcatggttctcaactagggtagattctgtccccctcaagggacagttggcaatgtctggagaccttgttggttgttacagattcgggggatggggaggtgctcctggcatctagtgggtggaggccagggttgctgctaaccgtcctatagtgcacaggacagcctctcctcaacaaagagttatcaggccccaaatgtcaagagtgctgaggttaagaaacaataaggcagactgagttttgaagtgaggtagaaagcgggactctactccagagacaggctcagatgctggaccaaattgaggactaggtaaaacagggccagggtggaagcagctttctgtaagacatgcccactagtgtgccatgtcagcttaccattgccatggcaacacctgggcattacctcccctttacatggcaatgacctgatgacctaaaaggtactaccccttccctagaaatttctgcatgtaataccccttaacctccatattattaaaagtgggtataggccgggcacggtggctcacgcctgtagtcccagcactttgggaggccgaggcaggtggatcacgaggtcaggagtttgagaccagcgtgaccaacatggcgaaaccccgtctctactaaaaatacaaaaactagctgggcatggtggcacacgcctgtaatcccagctacttaggaggctgaggcaggagaattgctgcttgaactcgcgaggcggaggttgcagtgagctgagattgcgccacggcactccagcctgggtgacagagtaagactctgtctaaaaaaaaaaaaagggggggggttataaatgtggttgcaaaactgctctgagctgctactctctggccatggggtagccttgctctacaggagcagtcacagagctgtaacatctcctcttcaataaagctgttttttcctctacctctggctagcccttgaaatcttccctgggcaaagccaagaacccctgtgggctaagccccactcttctactaaagtagtgtaagaccatcattgcaaacctttaaaacatataacctgtaggaaggtttgggatttgggctggaatagggcaaaaaattctagacagcaaataaagagacccaggtatagataggagttgcccagttcaggaggtactttctgaagggcatctttcaggacaaatcttttcctgatgcagacagacgtagtactggttttcattcattactattgctgatgtgggcctacttgtgtaagtcagttgatattcattaaactcttacaaggcattctttatgataatgaaacataaatgatgatagcatatatgatataaaactgaattgtaattagctttggaaaatagtacttggaagtttctatttaagcctctttctagcaaactctcaaatattcatgtaacaaaagaagacagcataaaacattgaagtgaactgtttttttcatttacccattaatttcttttttttttttttgaggcggaatctcactctatcgcccaggctggagtatagtggcgcgatctcggctcactgcaagctctgcctccggggttcacaccattctcctgcctcagcctcccgagtagctgggactgcaggcgcccgccaccacacccggctaattttttgtatttttagtagagacggagtttcaccgtgttagccaggatggtctctatctcctgaccttgtgatctgccctcctcagcctcccaaagtgctgggattacaggcgtgagccactgcacccggccttacccattaatttcaagcaataggtttaatctttttattttcttctaagagctgctaatgaatagtacaatggctggtttacgtatcgtgtttccctggctttcccaatccttggtgaagatgttaggttcagattatgaaatagacaatatttgaccctttgtggtatacaaatatagcattttcctgtggttctaatagaagaaggtagtgatctaaatacaaccccaccacccctaccagggccgtttccagcctgatactgaagtaggacaaataaattgcctatttttctttctttttttttctttctttctttcttttttttttttttttttttttgagacagagtcttactctgttgcctaggctggagtgcagtggcccagtcttggctcactgcaacctccgcctcctgagttcaagtgattctcctgcctcagcctcccgagtagctagctgggattataggtgcgtgccaccacgcctggctagttttgtatttttagtagagatggggtttcaccatgttggccgggctggtctcgaactcctgaactcaagtggtccacctgcctaggcctcccaaagtgctgggattacaggcttgagcacctgcgcctggcctctttttcttctgaaactttgcagatgtagctatagtctcattctgaccagtcttcaaaggactctggctttagacctggggtttctctccaaaatacttaagagccagaggatgctgtccttcaacagctcctttggagaagcaaagactcatcccccagtttctctcctctgtaagtattgatttctgtgtgttctcttttctgcaggcgtatggtattcctgtttgggtaattgttaaggatgacatgggagaaattctcggttatgttcagtctgtcatttaatttatatttcataaatgcttctcagtaactaaatataggtgtataaaattgattgtaatagatatttgcaggaaagttttcacccatatatttagttgaagtcagtaaaaatgtcattttcagataattattcaatgtcaggtgcttatgtttatacagtttacttattcctaaatatatttggatctctatcttactataaattttcagttggtgcatctttaacatctttgtgagaaaaattcaatataatctcacatactacaggttgtttgaaagtcttattttttcattgtttatgtaaaactgttaaacattcatgaacattatttaaaataaagatgttggtctttgaggatgaaattaagaatgtagaaatgcataccttggtttcccagaattgagttcatcctaatatgaaacagcaagaaatcagaaccctgtttattatagtattatctttgtatttgaaagcaggtgtgtgttcttgaaaatattaaacagaagtcatagagctacatattggccagtcaggaaactctcttcttcttaccttccatcccacctccagactgtttgcctaatcccgctttgtgatgtctgttgtgctggtataacgatatttgaactctctgatgaaaactttggccgcaattgacccttccctaaagttgaagagatttctccaaataaggaaatgaagggagttaagagggtaagtcatacagtttggatgtgtatccccgcccaaatctcatatggaaatgtaatccccagcattggcaatgctgcctggtggaaggattgtgggagtggatttgtcatgaatggtttagcaccatctgccttggtactgtcctcctgatagttctcatgagctctgatcttttaaaagtgtttggcacctccctgctctctctcttggtcttgctctggccatgttaggtgcctgcttcccctttgtcttctgccgtgattgtaagtttcccgaggcctccccagaagccaagcagatgccagcatcatgctttctgtacagcctgcagaaccatgagccagttaaactttttaaaataaattacccaatctcgggtgttttctttacagcagtgtgagaatgggctaatacaataagtgagaaagaaaggaaaatttgcccaactatatatcatctttcccaggtaattgggagttttctgtgctttcattcccatgaggaaatgtctctatacatgctacagaaaagatctactcttttgtgattgtcatagtcagctacagtgatgcctctggaaaaataagactgccacagctgaagcccaagctcttaatgaccaaggtagttatttgctgtgatgttgctgcttttgttgataccatcaaaggcattatttgaggcatagcttgctttcctagccagcttcccaactgtcgttgtgcacgttcattgcccaagtgcaattgcaagtgcaggggctacagtgatgaataagacagtccttgtccttgaggaagagcccacagtctggtgggcggaaaaattataagggttataagcaaaacaatagcaatttttattgtgttcaaaaacgcactttcttctggtgacaggatagtcctaatactggtctacatttctaccacatatgaatatgtaacatgcatttctcttttcttttacatagtagctggctatcttaatgactgtattaacaattttcagattttagttatatctaaatgtcgctacttttgcaagtgaacatcctgctgaaacgtattcagttgggaagaatctggcctttttgaaagggcattttctgaatgtagcaaattaccactgatagtttaatgcaattaggaaaatggaagtgaatggcaacgaaactgattaaaaccatgagttgtgtcacagaataaaccataaatgatatgagtaactataatgccataataagacactgtcattacttggtacttccttcttcagaagcctggtaacagcatcacaggagcctgaaaatggattaagtcattgtttgaatgtggacatattctagtctcacatattttagtctcagatacgatgcttcatttaattatgtctataaatttattacctacagacattatctttagggtcaaggagacaaggtatatgttattgttcccatggtaactttgtacttaaaatggcaggctgcgcttacttgatttaaaaatatctacagtttgattgctgtaaaaacctgtgttcataatttgctcacgtccagtgactcactcctcatttaactggcatttcagcaaatggcttgatcacataaattgtttggagaactaacagaaggttattgctctagggcactaaagatattttagatttctatcatttaagattttgagttttaaaaaatagtttacatgtgtttttgccaagttaagagtgaaacaaccttagtggaatgtttcttttctttttgagacaggatctcaccctgttgcccaggctggagtgcagtagcagtgattatggctcattgcaacctcggcctcctgggctcaagcgattcccccacctcagcctcccaagtagctggaaccacagttgtgcaccaccacatctggctaatttttgtgttttttgtagagatggggttttgccatgttgtccaggctgatctcgaactcctgagctcaagctgtctgcctgcctcagcctcctaaagtgctgggattacaggcatgagccactggacctggcctcatgtttgttgataattcatgggcacagtgatgaattgtactttggtgtgatatggggcatattaagctagcagaagttataaggcagatgtgcctactggcttttcacttgaatttataacagtggacttgaaagtttcgatctatttgtatctctcctctgctgtcacagaagtcccattttagccaacctgctgccttattttttaagatggagcctccttacacacacacacacacacacacacacacacacacacacacattaataaactaatacatgttcttttcaaacaaacttaaacagtgcagacatgctgcattagtttccatccaatagcttggcgtgggtgcctgggaacagctctacctcaggaggaaggtgctgggctttgtggctgcccttaaccactgagagtctttatacgtgactattttgcagatgactggggtttccaacgcacttcaaatttgagacaagcagggaataacaatttatgtagatatatctgagcctgaattgcattgtgtatccccattggtgactccaaagtctcctactttggagacgtgagcaatgacaattctgtgttggttttttctttctgtttagatatccattccaaaaacttggggacagtgtaggaagagaactgcttccactgtgagcttctcttttatccatctctgcctttatggcactctttcattggcagagtgtgtgtgtatttctgtgttggcatctttttttgatggctcagacaacctcccttggtctctgagaaaataaaattatagctctagcctcatgaggcaggcccagagactgctgcctcaggcgcccttcctgctgtatacctcctgaggttggatagagcagctgaaaatccggccgagcctttcagagcctcttaggggatatttaagtggcagatgcacttaattattagatatgttccaaatgcaggagaatgagctttgagagagttttgaatttgggacaaaaggatgcttcttatgaatcaacttgattttcacagaaatcagaatgtgtatatcagtcaagaaatgaagggatatatacacacacatatacgtaatacatatatacatgtacatacatacctattataaaatggcagatatgcaggcagacatgcatatacaagtatgtggtgtgtatataacaaccattgtacacatatatacatattatatgcacatatacatgatacatatatacgcgcaaaaaaatttactgagtccttactatgtgtaagtcctgtttcacctgaatcaactaatgtaatcctcattgtatcacagatgtgacaaccgaggtcacatggctagggagtggcaaggccagtatttaagcccaagaattctggctccagctgtgtttctcacctcctcctgatggagggggtgcagtcagtgtcatttaaaggcatgattgatttggtttgttgggtgttggtgttcataaccacaaagggacctgctgagagagagagagaatggagaatgccatttttcctacctgttttcatcagccagtacaggagagagaataggggaacttgtggctcattttaaaatggtaccaatgatggcacaggcacaccttttttttttttttttttttttacacattttttagagacggggtatggctctgttggccaggctggagtacagtggtacagtcacagctctctgcagcctcagatcctgagctcaagtgatcctgccacttcagcctcccaagtagctggaactacaggggcacaccaccacgcccagctaatttttgtatttctggtagagatggggtcccactatgttgcccaggctggtcttgaactcctgggcttaactgatcctcctgtcttggcctcccaaagtgctgggattaccggaatgagccaccgtgcccagctgtggcacacttttgttggtgggttagatctggggaaagtagtcacaatcaattgggccagatctgatgagtaaggtggatgacaccccagaggtctgtcattttaggattcagtaaaaataatgtaaattgttgatcctctctggaggcacttccaaaggaagagtgggagcatctttggctgccaggtggcttgaaagaacagtttgctgtatggatgcttttgtaattattaataaaacacacctaatttcattacttcattatactctgttagctacaatatagatttgtttgctctaatagaaccccccaaaatgttattcagcatgccagaagtttccatacctctgatgtggaagtccaagctggcacagggacactcctccccaaaggggtcagagacctaggctctgtcttattctatcatactcaacacgtggcttccatttcatgatctaagacagctgctgcagttcctgcaatcaccttcacatccctgctcataggaagaagaaaagggagttcaggcccttctctttaaaggccattctgtggacgttgcatctgtcacttttcacatcccagtagccggaacttggtcatagaatcacacctagcttcaaaagactctggaaaatgtaatctttagctgggcagccagctaaaaatattattaccatagaagatgggggagtagatattggaaaacagtgaagagcatctgccatacttatgtataaaaaaagtaaaactagtaaaaacatatcacatgaaccttcagattttttaaaaatctcagatgttagaataatttgatttttctttcagaataatgatacactggcaattaatgttccacattaacattgcaaatgtaaaactttgaaagacccatgtagcttatggtataactattaagaaatccatgatgaggcagggtacagtggctcacatctgtgatttcagcactttgggaggccgaagtgggcagatctcttgagcccaggagttcgggaccagcctgggcaacatggcgaaaccccatctctataaaaaataaaaaaattagccaggcatgttggcacatgcctgtggtcccagctactcgggaggctgagatgggaggattgcttgagcctgggaggttgaggctgtggagagccgtgttcatgccactgcactccaacctgggcaacagaatgagaccctgtctcgaaaaattcatgatggagaaaagggagagtttttcacatagttgagagtatgaaagcatgttgagtataaattttgttattttgtgaaatgctccaaaattaagaccgaacaagacagaacaagaagatacccaactgtttatggttagcatttgaagttggttcaccctctgcttttgattcatgttttgaccagtgtaaattgagaaaggatatatttcataatatgagattatgctagtttgaagttacattgaacactgaggcctaaccctacctcaaggtcaggtgcagtgtagtgatctaaaaagaatggaggctgggcatggtggcttacgcctgcagtcccagcactttgggaggctgaggtgggcagattgcttgagcccaggagttcgaccagcctgggcaagatggtgacatcctgcctctacaaaaaaaaaaatacgaaaattagccaggcatggtggtgcatgcctgtggtcccagctgctcaggaggctaaagtgggaggatcacttgagcccaggaggtcgaggctgcagtgaaccaaggttgtgacactgcactgcagcctgggcaacaaagtgagatcctgtctcagatagatagatagacagacagacagacagggaagactgggacgtgctataattgtcttgaactgtttattcaaggtaatatctaatatcttcctatgttctaattataagcatatggctctcagctacacaaacttttgattacaaatatttaatacttttcatctaaataaaaggtaactaaagtatatgctgtattttcctcacactgacataagatggattcagtgattttgcagatgtcaagtggagttttcttcaggccaagatacggaaacaaaataaacaaactggaaatttgtaattttcttcctatagtaaccatatggggagtcatttttaaatagccaagattgtatcaagtgcagaaggcgatgattatcctagtggcacttgtaaaatgaagtgacagtttcttacaatgttccaaccttccactgaggaaaagtaggaattcctgccctccctaagctaagtgccccaactatttctttcattgcctgagcagttctctcttttgccttcacattattggctctctatttagattaacattttaattttttttttcaaatttgaaaaaatactgacctttttccagttgtatctatcaaaaggattgcttcaaaagcatcttgttccctagtcttttaccaaattattctaggcacaaacctcatattaacatcaaaatcataaagaacaaaagtaatggaggaggtcagatgatttggggtgttaaagcaagtttctgcagttgggttttagatgctattaaagcattctgtgtatgaagtgctttaaacagtaacaacaatttcatcttttattggttcagcatctcttggctgtctgaactatagagattttgcagcagtggaatatacatccgtagagaaactacacaaaaattgtactttctttagcagtgtttttggaattgaattttagaaatagaagttaatattttggattttattcttggattcactatagattaagcctattcactatagatttggtaagtttgttcacctttgtcttggcctcagttttctgttctatgaaaagaaaatagtggtaggacaaaggaaataacgccctatgtggttggagcctggggaagggcgtctggtggtaataatgtcttaaatgtcacaaatttgtgacagtatttcaggtcagccaggagattggttattggtgagtggagttcacatttgccttaccttgaaatgttttccaacactttggtagcaaactacatcctcagtgtgaagggaaatgtgtaacagtttttctttgggaaatatttttattgacttagctccattttgtgagtcacatattccagcttatagcagagcctgctgcagttagtttgccaggcaaatacccaataagatcacagagctcaagcttgtattatgtaaacctcttggtgtgttattttatttcaggagggcttgagacagactgatgagctgttacatgatcgtggaaacagagcctagttttagaagtaaatttagtttgaaaagtaattgtaaaggccaaaattgatagacctttcatggtctgtgtagctgcctttccaatatgatggtcactagctgtttaaattgaaattagttacaattaagttaaactcagttctttaaccgcagtaactacatttaaaatcttcagtggtggcatgtggcttgagactactatgttggacgacaaaatacagtatatttccatcatcaccaaaatttccttgctggacagcatttgtctgtagccacctaagaaagaattatggtatagcaaggaggaggtttgagatggaagttaagagatgactctattctaatttgggcccttaaaagttctgtgaccatatatctgaaccactctaggcctcagtgcacacatcagtactgcagtgacttctgtatacttttgtatatttatattgcaatgctaacatgaagatcggatatactagtatcattttatggtttagagagtggactttggagtcagactgccagatttaaaataccagttacttctaaattaatgtctgggccttgattttctgatctgaaaaactggagcaataaaatacctcctttgcatgattgagtgttaaatagtttcatacatgtgaagtgcatagaacaattcctggcccatggaaaatagtgttttaactattatgtatatcatccattgaagagtataaggtgctatcaaaagcttttgttacaaatgctgttttcagtttgccgttactttctgggtctttgaacctccttgtaacatgttatataggaatgtaaatgtgccacatggtagcttcttaatgcttagttgtcctgcataaattaatcccctttagaaagtaaattacttacaatttagaatggcatactcatggtctgttctttaatccacctgtataattggttcttctccaaagatattaacaagcttgacgtcgatgctgagaaattctagagcagaagagcagactctcccttcactgttatttgtgttcctctctctccaattccttagattgtaggacgaagtaaatcacaagggccagtgtcttgtttagaaaggttttgtcataccgcacaggcggcctgcatccgttttcagtggggtggtttaacttgatgaggctaatgccaagatacagtactcagagtccaccgtgtttgacatagtcatcaacggtcttccttttggacttctttttggatgaggggaaatgtgcattcgcccagtggctctcaccctgactgtacagtggagtcacctagagagctttaaaaatgccgatgcctggccccactcacagaggttctgatgtaattgtgcagggtgctgactgggcttggggatttttaaaagcttcccaaatgattctgatgtgcagccagggttgagaagtgctaggatggcctgcactgagtgatatggaaaggatactttttgaaatatggcccaaacattgccggttaagggggagccacaccaccctccagggtggaggtagctggtggcttttctccgggtcttgtccagttccacagttttatcagtaataggaatcagtgcaaagtatactgatcagacccatggataacgcggttcacctgaaaggggagactagctgttaggttacaggtgccaaaggccttattgacgggtaggagggaaagatgagtgaatctaaggggaaggcaaaccttttagttactttaaataaaaccaactgagcaggtataggatacagaaagcttagctcaacagctgcatggaagttttggttgactgacagctgcagtagttaagagtgtatacttagaaaccagtcctgtgtttgaatctggctttactgtttcctcctgggggatctggagcatgttccttaacctttctgagcttcggcctcctcttctatttagtgggaataagaaaaggcacccacttaatttcattattatgataattaaatgagatgatttatgaaaactgtgactataatacctggcccatagtcagtaccatgattataaataataagggcatgattagcatcatgttgatcttcgtcatcatccttgtaataagcctgtctgaagagcctgtggcatcagcaacgacataaattgaaatatctggcatggagcatcttcattgttcaaatataccatactaatgtaagatattaacaatatggctgagcacggtggctcacacctgtaatcccagcactttgggaggcctaggtgggcaggcggattacttgaggacaggagtttgagaccagccttgccaacatggtgaagccctctctctactaaaaatacaaaaattagctgggtatggtggtgcacacctgtaatcccagctactcaggaggcagaggcacaagaatcacttgaacctgggagatggaggttgtagtgagttaagatcatgccactgcactccagcctgggcaacagagtgagactgtctccaaaaaaaaaaaaaaaaaaaaaaggatatgaacaatagggcagattagatgtgaggtatgttatgaacaatagggcagactgggtgtgaggtatgtgggaaccctctgtaccatctttgcaataattctgtaaatctaaaaatgctttaaaggttaaaaatgttattgccaatgtagtacttggcttaagtgggaatataatatttttttgttcattttccaacaaatatttgtgtgctagctttgtgttcagtaaatctgaagtttagccctcacatgaagaacgaaaatgtttttgtgttaagtatttctgaggcagacgtttctaagatatgtatctccatatgcatgctgaaccaaatttgatccatttaaaatttctttattttgaaataattttggatacagaaaagttataaaaatagtacaaagtttctgttaaaccgttcaccaagcttcccctaaccttaacaacttacataatcttagtacaactgtcaaaactgggaaattgacactgataaaatgccagtaactatagcatttacttggatttccccagtttttctctttgctgtggcaggatccaattcaggatctcacatggcattgagttgtcccatctccttagtttcctccaacttgtgatagttcctaagtttttccttgtctttcgactttgactcttgaagagtacgagtcaggtattttgtagcatgtccctcaatttggatttgtctgacattttctcatgagtacattaaggttgtacatttgaggcaaaaatgccacagatgggatgttgtaccctttgcagtgtgtcatataagggggcacatgatgccaatatatctcactgctggtgatattaatcctgatcatttggttaaggggggcatctgcaggttttgatcaattttttttaagacaatgttttcagaatagtttcaggttcacagcaaaattaaaagcaaggtacagagatttcctatatactcactgccctcacacatgcattgcctcccccaagttttaatgtattttttataagtatctttgataatagataccactcatgtgccatatcacaatataagagtgagatgggaggaattatgccaacacattaagtggtttcaaatagctgtgcttttgactttttacatgtaatttccataattttctctctttaatctcatttgtgctctcagtaatgacttctccctattttcagagttgtgccaccagtagcaattgataaagcggagaagctgttataattgtgtgtaaagtaaaagtgaataggctataaatcaagacttgagagagtcctctggaaataaaatacattaataggtgttatttgaagcatttttttctgccaattttaagaacgaagtgcaatcttcaatagtccattttaacattaaacaaacctggatttgaatctataagtttgtttttgtttttttagagacagagtttcgctcttgttgcccaggctggagtacaatggtgtgatctcggctcactgcaacctccgcctcccgggttcaagtgattctcctgcctcactgggattacaggcatgcaccactacacttggctaattttgtatttttagtagagacggggtttcaccatgttggtcaggctggtctcgaactcctgacctcaagtgatccacccacctcggcctcccaaagtgctgggattacaggcgtgagccactgtgcccagccgaatttaactataactttaaatggttaagagtaatttgtaaagtcagacgaacctgggtttaaatcctggtattacccctcactagcaaattatttagcttttccaagccacagtctctacaaccaaaaaaccatctcttgggttgtcataaagagtaaatgaaaagatgtagggaatgtgctaggcactgtgtcagtacatgggaagtacccaatcaatgtcagttgctgtctttgatattatcccccatagggcttttgtggtcgcttaagagttgacagagcacaaaaggataaataattagctttacaccctaattaatctgtaattgtgctgtaggactaccaggagacacagaaacagaaaaagcatagagactattttgtatatttattccatcatatttatgtgtagttgagatcattctaaagttagtggtcttgcttttatgaccatcattcctgaatcaatctggagatgaccggagaacacaagagcattttgccccataactaccacataatttactagtaaaagagggatctgttgagattagcttatgaaaattgtcctttggagtcaagtttgggaatatctgatcattaaaaagagtttatgaacttgggtgatttttccttcccaataattctttgaagtactagatatttctaatgaatttgagcctaaaatatgaagatcatataggctagacatttcttttaaaacccataaaaatcctatatttgctctatgtctagaaaggtaaggtctagttaggttgtggtttgaaagatatgagttacaacatgagtgatatagagtacatccattgagtttaaaatttcatctaatcacaattatttcaaactgataatcttttaacagcctagctctatgggtagccgttaaagaaaaaatgtatcaaatctccaatacttagtgaccagtagagtcaaattcagctatcctccccacccccttcccccaatagggacatggtgtcctagaaacagccagacctatactggattccattttagtgctgagcctccaaaatgggtctttagaattaaatttggctattagcccagacttactcaaatttgtaacaagcagtgctttgtatttcagcatgctccctagcccccaactttgtaactggttaggggaggggaagtgggaggaggtgcatgaacaaaaaacaaaagcagctgctggagagaaaacccagtgaaagggggtgaagaaaaacaattcggccacaacagctgttcagattctcaaaagaagaagccttcactttacatttgatctctctaaagtttttgaaggtttcgagatgttctttatttggggagaaatgaaatgaagtctatgaagctggtggattaatgtataaatgaaattgatttaggagaccagtgactcttgaattaacacagcccttgcctctttttacaattctgaactattgtttaatattcagcatcaagatggattcagagggtttttttttttaatcccattgtgtcacgaatggaggatataactggctcagaccaaatcttctcacatccaagatcaaataggggtttttaagcttatggcagtagaataacaagtacatgtggtacaaggctaggaaactgggaaggcaggcagcagtagaaccttgatctatcttgtgggaagctcttatgatagctaattacacatattgctggtctaaaaaatcagaattacccaggcaacatggaagaggcagaatggttggctggactagaaaactccttcttggaggcggtcatcttcatgttgtactagaaaactccttcttggaggcggtcatcttcatgttgtacagatggcctacgtatgtgcaatatttacatcattgcgtttcttagcaccacgggcgagtttggcattttacaaggtagctcactctgaaaggtaattttatcatagtatttaggaaatattccacgtcagccactgagtttaagaaactgtgtgaagaactaaaattcttcatagagccacatttgagtatggaatgatttggtatgctggaggccatagcacatctttgaacatcaaataattggattttttgagcatcaaataattgaatttttcttttcttttcttttcttttttttttttttttgagacagggcctcactctgctgcccagtctgaagtgcagtagcatgatcacagctcacggcagtcttgacctcctgggctcaaacgatcctcttaccttagtctctcgagtagctgggactacaggcgtgcaccaccatgcctggctaattttttaattgtagagatgaggtctcgccatgttgcccaggctggtctcaaactcctgggctcaagcaatcctcctgccttggcctctcaaagtactgagattataggtgcgagccaccacatctggcgtgatttttcttgaaggcagatgtgggcctgaactggaggaagcctgctctgagcctcactctatcttgatcccagaaataaatttattgtatagccttaagttttagagagttcaggacacctagaggatggttgtggtgtaaactgcttgcctggtcaaaccttaaggatctgcttggactcttcaggacacataccccgagagtgtcaggcctgagccccagctggtcccagaggtttaattcctagcacacctagtttgtctaacgtaggggtctgcaaactgtgtctgcaaagagccagatagtgaatatctgttgcaagtaaacggtgttgtcgtagtacaaaagcagcactagatgatacggaagtgaatgggtgtggggctctgtgtcgatataatttgatttgtgctatagtttgctaacccctgatctggagagagggctcccaaacaagtgagtccacatgcctccaacaggactgtgggggatagaactcaggagggattgggataggaaaaaaaatctatctgtattgtcactaacctctaactgaaacagcgtttgttctcttacgaatacaggcagcaaaccagtgacttagcaatacttgtgactttggtcattaatagaaatcaaaggtaatttcatatcccattacagttattgcaggtatctcaaaatatcattaaactcatcactactttggaagtgtatgttatacctccactagcattaacagaacatatgtattctacatttatataaaattaaatgattacatatatttattatatattatgtatttcaaacttgttttttattttgatgtatttcaatttagttttctttctaatgctatgtatattttttcgtgcatttaagaacattgttctgtaaaggagatctggagggttcagctgactgcccagggagtctaagaagccctgtctaactggtgtcttcataatggggagaacctccccttcctcaaatgatcctatccctctcctcccagccactgaggggcagtcatctctagctctacggagatgcccccaccccattttcccatatcatattccacccagccttcaaagccctgcatgagtccacctagtcctttgttcctctggctccaccaccctggctgccagacacaggcattcacccccggcccgtctcatggggtgttctatttgtttagtttatgtttcagccctagtgagagtcagttctggaatccaatggatctgtgattccttgttggaaggaaccacttctcttgcgctgagtaacgcattggtgttggatgacggtgttcatgatgacgaacttatgctgtcctgaccatgcctggagactggccctgcattggagaagatccaagagtctgcgtggtaaaatgataatgaacgtgagcttaggggcagaatgctgatgtgtttattctgctaactatgtgctttgggcaagtgcctatacttattctccctgagcttcaatttcctcattggtaaattggggattatacttacctttcaggatgacatcaagagtaaataatatactgactctaagaaaagtgcctggagtggtgcctggtgcatggcaaatgctcagtacctgtgaggtagtatttgcctgggctggttgatggttgggcgctgggggttagcctggtataaatcgagattttgaggtggtcctgtgaacccaaagatgccttgagaccctgcgtgggagacagatggaaggagatgtctaagcctggtgtcaaggtgctctcaccttgcagaatcacagtgggctgtggtggaccaggagaagaccccttaacaaagtatgggagtgagtctgtctaagtcagctagcccttaatgaggtcctcctcgagtgaagctctgattctgacacccatgttaggttgtggtcatttctaggacccagggtccagccccagagattcctagatagttctaggaccatctggtggaatcaaactatggatagacccattaatatccaactgggtcctctttcgttgagtctcccgccctcttgagggagactgatctttagtaacttctttatgagactgggtcaggtgggcctcctgttgttgtctgtggtgctgcaggtcatgtgctttggtgggcaccagtaactgtcattggaattgccaaggtggtgggaataaagagagatgggcttctctgtgattgaattgaagtttggttgtgagtgtgggtcatgagccctgaccgggtaggagacagaagcctgtggttcttctcctggtttccttagggattttcagctggctcttgggcagctccttcaggtggtagctgttgtggcagaatagaagagtgctggactgaggagcagagacctgggtctcatgagatcatgagatcaaaccacttaaactctgtgtgcttaagtgacttcgttggcaatagagtaataccctccctgaagaataaatgaggcgatgttgagaaagcattttatgagcaagccattttcattaatgcaatgggggaaacatgctatgtctagcttagagggctgaaacggtcaaatgaaataatcaacgtaaatgctaaaaaaaaaaaatccagtccacatttatggaattgcctttattgacaaattgagcgagggtaaacattcgtgtatttaaggcatggagtgtttcccagttgcttttgaaggtacccattgtcacaaaggagtaaagaccttactaaatgggatcttatttgtatttctgtagcaaaggatttttgttaaagaagattcaaactcagagatggtagactgagtctgccaggaaaaccacacacttatactcctgttccatagtcaactaatattctgcttctgctacaaacttaatgatcatataggaattatgaatttagaccaacaaatgccaaaacttgaactatacaagtgtatagttttagtgtaactttgtgttgtcactttttgcttctatgtgacacttagcaattctttttttaaaataaaacaacattagaggtcatttaattgtaatgacaaataaaatcagcaggtagacttaggatttcaaagcatctctttcttggttgggaaagctccctggaggtccaacttgtagtcctaggttgagtagggatcaataggagaatttactgaaggggccctatgctcagtttcaccaagttcacagccaggttcttatgatctgcatccttcaggtacaagtgtgtgttctctactccagtagcagacttgaacccagagtccccagtacaaggaagcacatatttttggattttgccgtgtgaccttgtctggctggctggactttaggaacaactggtcctcatccctggcaggtttagggggagagtgaaaccaagtcagatgactctgaagctccttcaaacaccacgacagaaggaatggattgagcaagaataatttttatagacttggaagtttgagtcctttttttttaaaaaaaaaaacaaggaagtggggcattccagatggtaacacaagaaaccagggagatgagagcagatgaaaccttgagggagaaaatgaaattctctctgaattaggagaagcggctgctttccctcacatcttcctgtgtctgtaactagcttagtgtttgggatgcttattttctattttctctgcatttttttagctgcctcagtgaccacttgaccatttatgccgaggcagtagtggatgtttccaattcagtgctccttacctcttagaaagagaaggattatgctttcttcatgattgtgagtcagtctatgttcagatttacattcaactaatatttttcaaatattggcccagataatttcaagatatgctatctgatcctcaaaacaatcttataaatgaggctcagagaggcaaagggacattgcaagtcatacaggggtttgcatatagcctcctctctgtaagtctagaaccatctctgcagcttcctcctgcgttcaccatgttgtgtgacttttgtaaatacttgaactctatggaaactcaggaatgatgtgaaatgttattagttggaagccttgtcagagaaaaatgggctagagagttccgtttgcaggcttgagactatagttgatgggtctgattctgaattaaaacatcctttagaaaatagatcccgctttttttagagactatccaagatttaaaagttaagcagctttggaatatagcaggcagatagttctcctgtaatgcttgctttgaaaccatgaacaatgtgtgcataatcagaatcttggatttgcttaataccattttttcttgctgaaacattaggtgaatgcagaaaactgcgcccacctgaactacatgacgtcagaatacacaaaacacgcacgtggcacaacctcatatgtctacagctacctcagtttaccccgcgtgttaagagccacacctgtccatacctggtgttatgactgtccctccaatttcgggtaaccctccctccagcccttcccagtaactcaccaaccgcagcccttccgacacccaccccacagccaacttcaggcctttttctaggcgaagtgacacatttattgttgtgtttatgtatttcttaactatttaatgtgtgtaaaatggtgctactatttttattaggttgcaatctttttgtaaatgtcactgattaaatttttgagtgttgctttcctaaccccatttttcccataagccctgtgttttttattgtgcattttgcaaagagtgatgatttttaggaccacctatgaggcattaccgaacaagtgactgtgtgaagcttttggactaaaccttccatctaacttcactctattaaatgagttattttcaggataagacagtctcatctatttacaaatactttatcatataatgaagttctacttatgatttattcagaatccacacaagaaggcgtagatttgctcaaggaacaaaattaatgacattttaaaatcttacaactggagaggatgattaatgggaaaagagctaacatttcatgaaaactagctttatgccaggtcctgttggatgccttccaataatgactgcatttcattctcatgtcaacctgttcgggtggtagggaattttggcatggagagagtgaaagttgctcaatgtccgtacagctcctaagtgactgggctgcgagtcaccactgaggagcagcccatctggaggtatgatcacagcaacatgggctccagactgttcttggtccttgttgttcatcgtctttcccattccatacttgcgtgtttctgtcttctgacacaaatagactactagtgggttcctgtgggttgctgctgacaatccatccatttacccaggctacatttttgtatccatttttttcaaccttttaattttttatcaccccacaacctgggagactttttaagcattttttttcctaattgcctccctatgcaatcttttttttttttttttttttttttttgagacagagtctcgctctgtcatccaggctggagtggcaccatctcggctcactgcaacctctacctcttgggttcaagtgattctcctgtctcagcctcctgagtagctgggattacaggcgcccaccaccacgcatggctaatttttgtatttttagtagagatggggtttcaccatgttggtcaggctggtcttgaactcctgagctcaagtgatctgcccacctcagcctcccaaagagctgggattacaggcatgagccaccatgcccagcccctatgcagtcttaacaccccagatacactgcatatctgtctatgtgctgtgtgtatatttgtgctttatatgcattaaagagtaaagttgtttttgcccctcaagaagtcattttcatcctattggggtgatcttgcctgtgttgaaaaggcatgttctgtatcttcagttatttttaatatgtagatccgcttttaaaattagtatcatgctaccttagaagcatatacctgagtttgtgaagacaagcccccttgtctgggctgtgattcctagtatcttatgatgagcccgacaggatgacacagccaggtgactcacatagagctaagctctgtgagaaagcgaggcctcagaggtagcacatgatttcccttcttccagtttctctatataaagaaataaagagcacacatcaaaccaaacataaatggaaagaaatcaatggttgaatgacacatgattctggcttgtcagccctagttggcacctttcgctccaaatcatcatctttctaagatactaaattatagattccaaccaaggtgattagtgctgctcacactttaatgtgcattggcatcacccatgaatcttgttaaattgcagattctcattcaagtaggcctgggattctgcatttctgacaaactcccaggtaatacagccactgcttggtcccagaaccatactttgagcagcagtagcctaagaatacacagaggcaattaaaactagctctcaaactattttaagaatttcagaaagccgaaagcagtggttctcactcagaagcgatttgttccccaggggccatttggcaatgtcttgcagacatttttggtcgttataactagaggatgctactgacatctagtgggtggaggccagggatgctgctaaatagtctacaattcacaggacagcccccatcagaaagaattatctggcccagaatatccattgtgctgaggttggaaacccttgcctaaaggaaatcacacacttactcccagtaaagcagcatggacaaatacagataccctctctccttggcaagagtgatattcaattcaatgtgatagccccaaatagtttgtagtggtcaagctctgcagttgacattaatagattactctaactgatatggggaagtaagttaattgtaatataaagaaatgcagttaagcagattaaaaggaaaacacttttggagtcatgagctgtcagaggagatttacatgtagcaaaggagaccctgctggttgaaggatgggaatgcctgtcccttattgggcaggaattgggtgggctgaccaggctgtgtacgcctggctggcactgtttattggagtggtgttcgagcgagcccatctggacatttttggaacaaacttgggacattcctttggccttctgaatatgacttgcagctgggtagggaagtagtgcaatattatccacagattgaagattctttcaaacaacagaaataatcaagaattcactgtggaggattttcccctccagagagtaacagatagattgatgcgtagatctaggtatgcttattaacaaaccattcctgtttcatgggatgtacatgtggcagcatctggattatttaatgtgttaatatagtcagtttgtatatgaataatttaaaacagtagcaagagataaaagtagctcatctgaagaagggttgtttgagagctttttttctgtcaagtataattttactctcaggttaaatgaaatttattaagatgcaatttgctcctgggaggtatttgtgagtttaaccacagtctgtcttggaagatattatgacagtaagtaaatgtcacctggataatactgatccattcacagaagggagaaaaagtgtgttgggtcaattaaggtggtttaaaaatgtgttgactctgaagaagaaaagtatctaaagtacacaactctaacaaatctcaaggccagtgggactttacagactgagcccaattgtgttgagtctgtgtattgtatatacttaacacaagcaaacacagactttttctacaaatgaaaacatgtctgctgagcagttgactcagtcatctggaataaatgttctttatttgtgtttccatgggtaaaatcaagttaatgaactgaaccatcacaatttctcttatttaatttttaaaactctagattaccctgtcttctatctctatgtaattcctgtgttagagcaaacataggaaattgtcaatatggcagagtgcggtggctcatgcctgtaatcccagcactttgggaggccgaggcaggtggatcacctgaggtcaggagttcgagaccagcctggctagcatggtgaaaccccgtctctactaaaaatacaaaaattagctgggtgtggtggcacacacctgtagtctcagctacttgggaggctgaggcaggaaaatcacttgaacctgggaggcagaggatgcagtgagccgagatcacaccactgtgcactccagcctgggcgacagagcaagactctgtctcaatttgaaaaaaaagagagaaattgtcaatatggggccatgttttacctacaaaactagcaatttcatgttgttctgtctaatattacttaggaacattttaattcttgcattaaaaagtagcttttataagcatgagggttaatatctaggcataatgtgttttctgaacagctggctctgtttttcgtctctgtgcaggatatgatttcacaccagtaacccttcaacttggggtgacacctttcataggagtcatggtagttctttctgttatttttctagccatatggaggtctcatttctcttaattcttaaaatgatggactacctgtcttctagctgtatattatttacttttttgttcataagcaccatacttaagatttttttcttttatttttaaggagaaaaaaaggctgcagtgagctatgattatgacactacactcacccaggatggagtgcagtgtcatgatcatagctcactgcagcctcgacctcctgggctcaagagatcctcctgcctcagcctcccaaatagctgggactacaagtgtatgccaccacacacggttaattaaaaaaaaaaaaaaaaagtttttctagcaacagtgtctcactatgttgcccaggctggttttgaactcctgggctcaagtggtcctcccatctgggcctcgcaaaatgttggcattacaggagtgagccaccatgcccagtcccatatttaagatttttctaaagccctaattttaagattttcaaaaatgctaattgtatcctactgtttctgccccaagaaccagacacctagatctcaagatatggacaggtatttattggaaagaaatgaggattttgaggtcatagaagtgtctaaaacatcaagatttattaaaatgattttttacagctgatgttctaacattcattattgtttcctatgatagagatacaaattgagtcacttttcaaacatactttactgttgaatacctataaaaatctcatggaactagcagtccttagtatacagtcaggaaaattctgttttacactagtcactttccagaaaggtttattaataactggctatataattctttccccagaatatgttgttctttgtggattttttcaccccccacccccagcttttggtctattccaaaatacacacgggcttgacctaagaattttgctaaaggaattattctcctctagggaaatgaagcagcatgtttcaacacaagcttagaaatcttaaaacaactaaaaatgaaaaaaaaaagtaccaggtcgttattatgttctgcaaaaattagatttacgggttttactgtagccattgtcaatgccttactgagggataggatcatagcagaaagatgctaaggagcttatggtccccctgggctgttgtgattatgtggatatatttagaagctacaaagaaagcagagcatcagctgagatgccccagtagacactctcaaattcagatctctcccattatgagaaaaaccctcaaaagaaaatattcacttggcaaggaatgaagagcttttttactcaccaaaatgatgtcgtaatgtttcagggagaacagtgactgcgacttacttattattgtcatttatatctcctagggctgaacagttgtcagagaggataagagatagggggagtgtatgggaggcctgctttggttctctgcttatataaacctccacattttagcagatttatgtttcatccttaaaatgagttaaaaacagcagacccttttgttgcagatgcaagatataacatgtaaagtggttccatagcaaattgctatttagaaaagaacccaacgttatttttaaccaactgtttgatctcctgtattctttcttatgtggttttatgaatttttgtttcacttgtaaataatcggtagcaaatgagtgtgtgaggctatgatttaatttgtaacaaggtacaataaaatacctcagcctgtgactcaactattttaagaggacaaatatgctaaataggaatattcgtttctaaccctatagtaaatgaaatgtacctaagatccatggctgaaaaaacctgccttatacaaattcacataagagagatcaaatgtggtgaaggttgcttgataaacttctattgtctagcttgtctgatgagctagatttcacagtattatgtccagatttaccacaataatactgcatagtttttttcaagtcttcgatctaagaggttctagtttgaagaggaggggttctgtgtcattcatacagtggctgtgatgcacatccgtttgatctgtgggctcatttaaaggcttagtggactgaaatgttttggggtcacctggaggggatcagtgtgtctgggctttgcttccctgtcttccttacgtatgtggaaacggtgagtgttgttccctgagatgtcctagagagacaaccttttcccaagtgacagtgagtttccgtcttggaatcagctttgcttatcccagggaggatccaggcctggcgccagcaagttctccccatgaggtctctgaggatgtggagagaaggaatgccctgcagagtttcagcctgttactctaaacctccaggcatgtttaagaccccttgggagaagaggagggagacctccatccgtttacaacatctctgcacagaaggcaaattctcttctcttgcatagtaccctaatggcaaaggcatacatgcaccaggctcaattacttttagtgaagaaaataaaccagatctgtggaaggcttcccttcagtgacttggggaactctagtttatgagtgaaagtaaagatacgagctagtaggtgacttttggtgtatgagcccttatttgtggggtattaaaaaccatgggctatccagtaactcagtaactcaggacacacacagcattttgtggtccctgatgtctttcttcgttttggctgctgctttggccattcagtcaaatttgaccattggttttcattaagattggccctcagatacagagcagggaaaagaaatgaaatttaagcttgtacatgatataaattgtcatcaactccattaatgtgttggtcagagagaaggcggaagccaatatttgacaggaagcatgtttttttttttttgtagattcagtgtgaccaccacaccgtctcgtgcttgtaggtaatttaatttaacctaggaggaaaatctagtcatttgagaaactaagataattaattatatgcttttaagatggagttcttagatgtgagatcttggagatccctgagaccatgtttaagaaatgctacatttgtactgaaaatctttgacttgatattaagttatgataaacacaactgccaattcaggtatgtaatttagggatgaaatctgatcataaaatggccgtctagatcagagtttggcaaagcatgacccatggaccaaatctggcccgctgtttttgaacagctcacaagctaacaatggtttttaaatgtttattatgtatttgtttttgagtcatggtcttgctcaagtcacccaggatggggtacaatggtgcaatcatagctcactgtaaccttcaacttctgggctcaagcaatcccaagtagctgggactgcaggtatgcaccaccatacccggtgaaggtattttatttttgtagagacatgggatcttgcccaggctggtcttgaattcctgacctcagtactcctgcctcggcctcccaaagtgctgagattacaggtaaagattttgttatttgcaaagagcttttcagaggagggactaaaatgataattcaccctgtatttactgggtaaacagtattaagaccccagattttgccagtagcagtggcatgtgcctgtagtcccagctactttgggaggccaagacaggagaatcacttgagcccaggagtttgaatccagcctgggtgacagtgagaccccatctattaaaacaaaacaaaaaacagattttgtctgaagaagtgagtattcttggacttctcaaaatgtcagtttggagacagttttggtaggccacttggtatataagcatggacagaaattgattgtgtgtgttgtattaggttggtgcaaaagtaattgtggcttttaccattaaaagtaatggcaaaacccgcaaatattatgatctatgttagtccatgtgagagcatatttatggagaatactgacatgatttgtcaagttagtagacaaataatgactgaacactcaaaggcaacatgattatcctccagctgtgcctaggagattcttgataccattttactatgtcaatattcagctacgtggacaaccgctattgttttgaacgctcgcttttccttgagaaagggatttccagaaaaagaaattctgtcatagcaccaagagctatgctggacaggaggttcaaatgttcatttttctggccctgaaatgaaatgcttcttaggtacacaatttgctgtccaggtctagagccgagcccagcaagaaacatgcccagtgcatggtaggcagaattttctgcctgtggactttcacaaggctgcattgtgggaacagaagctgctcagattgttcattgttctgtgactcctatttggcagccagtggagaattcattatgcagtgactggcatacttttcttctgttttttccctgccctgagtacagcagtgcatccgtgctctctgtaaccccttgcttcaccccttactgttctaatcttcccctccttgccttcctccagcctcactgctttgcaaaacctagagacaagcagacttaaatcatatgaactgattaggggatcaatttcccccaatgctgaggaaacacactttgttctcacatttgggtgggtgagcctgccaccaaatattaaacacccacggacacatagcagtgcgtcggttccccttttggggactgcaagctcagacaaatgtccacaatggcgaacatgccacatttctccctctgtgtttccgcccccaaaagtgtggcctcctgggctgagaggaagaaaattgagaagcagctctttcaaaattaccatttgcagggtttgttgttgttgttgttgttgtttggtttttttttggtttctatctgacttgctttgtaaagctggaagaaaagattagcatgactccgaaagcactattttttatgaattccagagcagcagttctcaacctttaaaatgtatttgaatcacctgggggtctggttaatatgcagattctgatttgttgggtctggggtggggccagatttctaatgaccttccgggtaatgctgagactactgggccatggaccaccacatttgaatagcaagtattaggttggtgcaaaaataattgtggtttttgcccttttttttgaaagtaatggcaaaaactgaaattacttttgcatcaatctaaacactagttcagtggctctcaaccttggctgcacgttgggatcacctggggagctttaaaaactactgatgccagagccccaccctcagagattctggtttaactggtctggagtgtgatctgagcctagggagttttttaaacgcctcagatggtctcaatatgcaccattgtggttatattgcagctttacaggtgtaagaatcggatttgttctcttaaaagggaagataagtcttctttttggtcctaggtcaatctgagctgagttcttcagcccttgaagaaagagcatccttctaactcaccagttctcaaccaggggacatctggcagatgcgtttggttgtcacaactggagttgggggtgctactggaattaagtggatagagtccaggggtgctactaaacatcctacagtgcaacagctccccacagcaaagaatgaaagggccccaagtatcgatggtgctgagacagaaaccctggtatagcttacctcactcctgccctcaaaaggctgggaagttcaacacttccttcttcaatgactattgagagtaactaactaatagtgttacaacaaaggggtcccaatccagatcccaagagagggttcttggatctcatgcaagaaagaattcagggcgagtccatagagtaaagtgaaagcaagtttattaagaaagtgaaggaataaaagaatggctactccatagagccattttatggttgtttcttgattacatgctaaacaaggagtggattattcatgcctcccctttctagaccatatagggtaactttctgacgttgccatggtatttgtaaactgtcatggcgctggtgggagtgtagcagtgaggacaaccagaggtcactctcatcaccgtcttggttttggtgagttttagccagcttctttactgcaacctgttttatcagcaaggtctttatgacctgtatcttgtgccgacctcgtatctcatcccgtgacatagaatgccttaaccatctgagaatgcagcccagtaggtctcagcctcattttacccagctcctatttaagatggagttgctctggttcacatgcctctgacaatagcacgtagctaatagcatttctttcatgtctaattctgttttacaacacactactgtcgcaagtattctgaactggaaagtcagtcttcctcccctgtaaaattaggctattgaaatacaagcttccaaagtccttttcagttaaaaaaaaaattatgtgattggcagggggaatggggagtagttatttcatggttacagattttctgcttctggtgataaaaaaaaaaaagttctggaaatgggtggtgagagttacataactttgtgaatgtcgttaatgccactgaactgtaaagttcatgttatgtatagtttaccacaattttttttaaaaaaaaccatgattctgagatcattggttgaaccataaaccatatgcttgcctgcatctaatgtgaaaccatccctgctccatgttcttagcatcctaggttcgtttccttcttggcactcaccgtggcttgaaatcacatggatttatgtgattatttgagtatgcctttccccactaaactgtcagcttcatgaaggtaagaaccaagtctgttttattcttcatggtactcccaatgcccagcacagttttcctgggatttagtaggcattccacagatatttgttgggtaggtggttttactactagtacatatgttaacctccctaggaacaggaattagccattatccacacatttgtatttagtatcatctgtctcctagccctttgctactggaggaattgtggaatggagaggttatggctaagtactattttatgatgttattctctgggaattggcttagattagaatcacctggagtagttttataattattaatggccacatcacaaggattcaggttcttcaggttctgttgatctgcggtggggttgggcatcagtagtttataaaggtctccagttaattccaacgtgcatcaagacggaaaaccaccgtgtaactccttgcttctcaaaatgtcccaggacaaaggccccaggtaaattgtttgtatattcaagcctgagaaacctacaggttcctttctagttaaaagcccattgttctagttggcctagagagctgttgactccgcaatgaaggaaagtgttgtatatttctggaggcagagagaggtctgcaatgcaaaaatagtttacagagaaagcggtattgttaccatcagaatcagttgtgattctattttagatcattggcttcagaggaaaaaggcaaaaaaacattttttttctacttcatttctagtcttggtttttcaccaccaaacaaaacaggaaaaaaaagggggtgggggttggtggtggcgagggactgcaggaaccaaatggatagaataaaatagtcttgtctcatgcagaagaaaaataaaagacaagttacatctttttctgctagagaaaagaatgtatttcctgtttgccctcgccgagagcctgggcataatgcggcagtgtgcacagagccgctgaacaaagaatacagaaatggctgagaggacagagtttgaaccgccaaatactggctcagttagaaaccatgtgacagatgcagcttctgatttcatttactagggcgaaacagaaatgtgtaagtgtttctctatatcctcggaggctttgagtgaaagaaaatggaaggtaattaattttcccttccagagttttgcatgtacattggaagatctgttatgattgaaagccttttaaataccaagcttgttaaccaaatggcttctgcaagaaagtgggctttataataagccctggctgcataaagaaatgttcccaaaccatgacgttttccgttggtgtttataacattccatagattatgtgagatgctattcgaatcactgaaaaatagttgggtactgaaagtgtctttagggatcatctaattcagtggttctcaatctgtttttctgtcctcaacacacccatagaatataaaattctgcaattagcgccagctgtatgtctttttaagctgggtgggtcatagcagaatcaggaggggtggagaagagcccattttataacaaaaaatcctcagtagttctgagatgcccatatcccactggttctcaaacttcactgtacattggaatcagctgaggagctttgcaagcgactgctctctgggttccatttgcagaaattctgatttaatttttctagggtgcagcctagtgagagactatgaaactctacccaggtgattctaagtgcagccaactttaagtctaatttccttaaaaaccaccactcttttctccctccattgcaaatggctgtattttgaatacttacagaggggagaggttgtatgtttcctcctgtcccatttatttgcatctttgtctctttgatctggagtccttggtcaggaatccaggctcagttatctaatgtctgtgggaaaacgcagcccacttaattataacttcaaggaggaaagtaagcccaggaggctcaaatctgtgactggtctgtggtaaaaacagactggtgggcttctgagactttcctgtggacgctgttgcctctgcagccactggaagagatgtggtgtcctcttgttaccagtgtgtcttgtgtaatcaagatggtatgccatgctattcactccaacatgcttttctgtatcttcccccaagatgtccctacaggccctcctgaaggagaaacccaaagtgattaacttaactcttccctctttagtcctcatcatttgaggttatcttttgtcattgttaccagcagggaaaacacaaagcatttatcagtggacagattggcatggataggatggcagttaatgtcgttcaaagatgaaggctcgggccaggcacagtgactcacgcctgtaatcccagcactttgggaggccgaggtgggcagatcacttgaggtcaggaattcgagactagcctggccaacatggcaaaaccctacctctactaaaaatacaaaaaaattagctggctatggtggcatgcacttgtagtcccagctactcgggaggctgagggaggagaatcactggaaccctggagacagaggttgcagtgagccatgatcatgctactgcactccagcctgggtgatagagtgagactccatctccaaaacaaaaagatgaaggctgtgttagagggggcatttgtagactggtacccaacatcatacatcaaacactgagaacaagagtttctagatttttttttttttttttttttttagtagtgacttaaggtagagagaggtggcacttaggagatgtcattctctttggtttgatgttgatggtcagtcctgttcagggctggggaagtgaccatgtcagcagaagaacgactgcttagggttttgtggcctcttttcatgtaggctaagagaggaaatgtcttgaaattcgggtatagaggtgtggaatgactgggattatatagggactctatcccttccatgccctgtaatgtccatagtgctgggaacttataaatactgcctttgtgtggaagcgtttttcaggtactcaagtaaagtaactctatcctgatactcacagtactataaacataaagatgaaaaaatgcaggatttaggggaaatgttttcagatttcactggagaaaaatgtagtagcctacaaagatagcaattgagttcctaaaggcatttgggttaaattaatcattgattaaacgtgaaacttcagagagattttgctttctgattcattagcttagatttgaatacatttgcatccctgcatatgtagaaagctaattcagtgaggtctttttgcagcacataatgaaaaaaatgaatgtgttttatgcttaggtgttgtagaatcaggagaaagtggtagataggtcaaaattttatttctgttgctaacttaacatattacaagtatatcgcaaaagcatacgtatacattttgtgcttcttaggcattcgttctttgtgttttagcttaacaaaaagatatgtcagtttttcatttggagccattataacattggaaagcagtaggagtgaaaaactaaaaccactcgaaactcaaacataaaatactatcagacttcctctctaaggcagccttgtttccctggcacgcaccctttgcttctccgctcattcttgcggtcactgactgccttgactgtacttcataggcaccatccatcacgcttgtctgcagcagtgacttaagatggaggggggtgggaccacaagatgcctggcccttggtggggcggggacggggggttgttgttcatacaaaagacctttgcatccttccgaagcgggtggcacctccctgccatcacttgggcatcctccaccagcctctgaagatttcactgaggaggaggggccagaagtagcagggtataggatggaggccagggccacctctaggagtcctggcccgctcaccccaatcagactttacatgccttctttcactattgagaaactgtaagggttaattttggggatgtcatttttgaatgcttctatttgccaggggcaaactgattaaaaggaaaaaaagagagagattgagcttaaacttcctgaacatctatttgaacagctaagaattcctttttctaaggtggcaagtaagataattaatggaatatttggtgcttatgttatctaatatgttagtttgggatgaaataaagtcacaatgaaattttattttttatatgatacctatatactttatagtaaaccaatcctccgtgtatacttgataattttacttatgcacagtttaggactttgtaagaaaagtggtacagatagttgttttcaaatgtcctgttctgggaatgcagagttggggaacaagatgccttcctgtactaagaaattactggatgtctccctcgatgaggtgacatatgaagaatatatagagatgcccaacaaatgttattttctacccctttttctgggtttttcgttttctctcctataaattttgggcaggccgtgtgctctgttgggtcgtgtcatttgagtccatcactacataggaccttctctcaatatttcaaatacttacacaagctagaggttgtatgtttccttctgtcacatttatttgcatctttgtctcttttatctggagtccttggtcaggaacccaggtttaattatctgatgtctatgggaaaactcaacccacttaatgacatgctgcattattttgtagctctcaggggaaaatgtggcaagaaaatggagactgcttattatttcttcttacgccatggttccagaatcttttcatgagagtaaataaaagtgaggtaaaatctgcagaatccttaggttagagagtttgcattatcgattgataggtccttaaaaacattttctctttatttcagaacaatggtttatgacaaccccattcactactcttgaaactgatgaggaacatcagattatgtaatcttgtgcatttggctaagtcagaggaggcctggtgaattcatttgtcattcagagtctagaggaatctaatatttgtttccagataaaaacctgactgagaaagtatatatttctgacatggagaactatgctagatattttatataatatgaactattctagagtattctagaccagcactgtctgatagaaatgtgagccacatatgtaacttttttaaggttagcagcctattgaaaattatttgaatggataaaatcaggtgaaattaactttttaaaatttatttattttttgaaatggagtctcactctgtcgcccaggctggagcgcagtggtgggatctcggctcaccgcaacctctgcctcccgggttcaagccattctcctgtctcagtccccctgagtagctgggattacaggcgtgtgccaccacgcctggctaatttttgtactttttagtagagacagagttttaccatgttggccatgctggtcttgaactcctgaccttgtgatctgcccgccttggcctcccaaagtgctgggattacaggcatgagctaccacgcctggccgtgaaattaatttaacaatatgtttaaaatttttttttttttggtttagagacagggtctcacgctatcgcccaggctggaatgcagtggtgcaatcatagctcactgcagcctcagactcctgagttcaagcgatcctccttagtagctaggactacaggtgtgtaccaccacgcctgactaattttttttttttttttttaagagacgaagtctcgttatgttccccaggctggtgtcaaactcctgggctcaagtgattctcccaccttgacctctccaaagtgctgagattataggcttgtatgccactgtgcctggccctaacaatacatgtcatttaacccagtatttccaaaatgttatttcaacatgtgaccaatataaaaaattactgagttgttttacattatttttgaagtccaatgtaaattttacacttagagcacttctcatttgggattagccccaatcatatgcccactggtgacatgtggccagcggctaccatgttggacaacacagctttggaccttcattcctaaacccaggcactgagagattgataaccaatcaagactcctgctccaatttagaaaggggacttaaacattgagaaaaggagctctctgaaaaaaaaaatatgaaagactccttcaaatagttgatattagaaactaaaccactttccacataaaatctgtgtttttgtctgaagagcgcagtggggaactagcaatttgtaaaatgtttctatgtgaattggaagaacattctgccttcagattgtgcttctggaaaaccagatcaggatgacattgagaggcagatgattgtattgtagcttttaagagaataagctctgtagcttcaatgcctggattcacagccaagctctgctatttaggttggtgcaaaagcatttgcagttttggccattgcttttgatggctaaagccgcaattgcttttgcgccaacctaatacttgctcgctttgtgatctttggcagattcctcttcatgtgtacttttcctcacctgaagactcaggacagtaatagtaactatctcctagggtcatgaggattaaataaactaaaacaaaggcctcagattggtacttagcagtgagctattctattacagcattagctattaaatcatcatcatcgtcactgaaaattgtgctcttatatctcattctttttttttttggtgacagggtcttgctctgtcacccaggccggggtgcagtgatgcaatcatggctcactgcagcctcagtttcctgagttcaagcgatcctccttagtagctaggactacaggtgtgtaccaccacgcctgactaattttttttttttttttttaagagacgaagtctcgttatgttccccaggctggtgtcaaactcctgggctcaagtgattctcccaccttgacctctccaaagtgctgagattataggcttgtatgccactgtgcctggccctaacaatacatgtcatttaacccagtatttccaaaatgttatttcaacatgtgaccaatataaaaaattactgagttgttttacattatttttgaagtccaatgtaaattttacacttagagcacttctcatttgggattagccccaatcatatgcccactggtgacatgtggccagcggctaccatgttggacaacacagctttggaccttcattcctaaacccaggcactgagagattgataaccaatcaagactcctgctccaatttagaaaggggacttaaacattgagaaaaggagctctctgaaaaaaaaaatatgaaagactccttcaaatagttgatattagaaactaaaccactttccacataaaatctgtgtttttgtctgaagagcgcagtggggaactagcaatttgtaaaatgtttctatgtgaattggaagaacattctgccttcagattgtgcttctggaaaaccagatcaggatgacattgagaggcagatgattgtattgtagcttttaagagaataagctctgtagcttcaatgcctggattcacagccaagctctgctatttaggttggtgcaaaagcatttgcagttttggccattgcttttgatggctaaagccgcaattgcttttgcgccaacctaatacttgctcgctttgtgatctttggcagattcctcttcatgtgtacttttcctcacctgaagactcaggacagtaatagtaactatctcctagggtcatgaggattaaataaactaaaacaaaggcctcagattggtacttagcagtgagctattctattacagcattagctattaaatcatcatcatcgtcactgaaaattgtgctcttatatctcattctttttttttttggtgacagggtcttgctctgtcacccaggccggggtgcagtgatgcaatcatggctcactgcagcctcagtttcctgggcccaagcgattctcccacctcagcctcccaagtagctgggactagagacatgcgccaccatgccacgctattttttaaaaatattttgtagagatggggtctcgctgtgttgcccaggctggtctcgagctcctgggctaaagcagtcctcccaccttggccttccaaaatgttgggattacaggcgtgagccacgtgcccagttctgtatttcactttcacactctctatgctccacttagtgtttcagttgcctgtttcagttgctgggcctatagtggtgggcaaggtagacaagattcctgttctcacatcttacattttagggatgggaaataggcaataaacaagacaggagaacaggcaaatgaacaaggtatttccagagtgtgagcagagtgttcagagagtctctagaacaggttaacatgaccatgagaagctggaggtgatgtttgagccaagacatgcatgacttggtgcaaatttggggcagagcatcaagcccagggaacggcaggttgcaaaggccccatggagaaaccggtgtaacgtatttgaacacctgaaagctggctcctgtgtttggagtgtaagaagggggtaaagattggagatgaggtcaataagcaggcaggggctggaacctcaaaggccttgcagagcttgataaagagtttgaaattttattctaagagcctcgaaaggtttaaggcagggaagtaatagaacctgatttgccttttttttttttttttgagatggagccttgctctgtctcccaggctggagtgcagtggcacaatcttggctcactgcaagctctgcctcccgggttcacaccattctcccgcctcagcctcccgagtagctggaactacaggtgcccaccaccacgcccggctaattttttgtatttttagtagagacggggtttcaccatgttagccagggatggtctcaatctcctgacctggtgacccgcccgcctcggcctcccaaagtgctgggattacaggcgtgagccaccgcgcccggcctgatttgcctttttaaatggtcactctggcttcaggagatttaatgggagcaggagagagacgaccactactatctgctttcaagaatgtaagattggacatagctctctgtcccctgctttgagcatagctgattcctctacaacaaccccatcactggccttgtgttgtgaaagagatcattttctgcttgtataggagagtagagagacctttacgctaacgtggcctgccatttcagactatgacataaccatgcacatgctcgcacattcctagaagaatccgtgtgttagcaaaaggattgttgtgttctttgcgaagcaagagcaaagaatccctcacagaagctgaaaattgccactgatgagtcaaatggccatgctctggtcttcataaacaaaaggcaggctctgattcctccaagtgcagctaattttcaggtagtactaatgggtttatactagcggttctcaaagtgtgcttcctggacgagcaacatcagcatcacctgggaacttgctagaaatgcaaatcctcaggtcccaccccaggagacatactgaactctgaagtgggcccagcaatgtgttttaacaagccctccagctgatgcacctcagaatttggggaatccctgttttttgctgctagagatgattgctcagagtaaaaagcactactaaacatggctgaggagcagagtgatactcctttcattgtaatctttttaatgtaaatgctgagtatttgggtagcttttggaatcaagtgtttgaaccacgccttttgtgtttgaagctattcatgttttatttaggttcttttgttggatgctgctgtatggtataatatttacaaggtttctgggctggcttctccttactggaattttcagaattgatgtaattacatcctccctgagtcgaatttaacagtctaaattggaagaagcctctggctgtcctgatagaaagttcccactgaaaacaaccagcagcattgtatttgaatctttgttgtccacaggtagactgtctatactacagcttcccttcagtgagtttttaacccctgggtggctcatgctgccagccaatctgttcttatgtggatcttcaccgtaagttatgacctgcttacggaaagcagacagatttttagtttagatacatcataaaaggtatatctacttgttgggggagggagggaaataaacattccaaatacagtactgttgtcaaagccaaggatgttctactgtggggctgttcttatatccctgctgtatctgtttcctgtggccgctctaagacactaccacaaatttagtggcttaaaacaatgcaaatttgttatagtcctggaggtcagaagtctgacgcaggtctcactgggctaaaatccaggtgtagatgaactgtgtttctttctagaagccctaggggagaatccatttccttgccctttccaccttctagaggctacatgcattttttggcttgtggccattttcctacatcttcaaagccaggaactgtgggttaagtttttctcacatcgcatcacttggacctcttctgcctctctcttgtacacttaagtaccctgtgataacgttgggtctacctggatgattcaggataatctttggtcatctgattagcaaccttaattctatctgcaaccttaatcccccgtttgccatgtcatgtaattcacaggttccaaggattaggatgtggacatcttggggtggggggtatgatgctgcctaccacagcaggccactaaacttccttacagcctcagtttccttatctgcataatgacattagtaaaaaattattgaaggctctccttgagcattacaggagatacatgtgaaattatttggcacagagctgcccttcagtagatgctggtggcctaacactattttatgttcacaaagtgtctacatagattcttttaaaaattatttgaatgcttgcttctcactcccagacccctctgctctgttctttggtaccccttcccccaccttcccattgggtggtctccctgacccatgctgataggaataattagagcatatgcaagtggaaagggtaggggagaggaaaaaaaaaaaaaaccttcttgtctctaatcagttactattttcccccatactttaaactctgaatagaatattcgtaagagtttgggagattcctttgatttttttttttaacagctttattaaggtataattttccatttgttgttctctaccttgctagagttacttctgacctcgtcaaatcctgattcaatcaaaccaactgtcattaactatttggggggataattgttgaaatttgaatataggcagatcttggatgatattaagaaacattaactcttgtatgagtgataatagtgttgtgcttatgtaagaaaatgcttattttttcaagatacttactgagatatttagttgtgaaatgtcagaaggacttaaactaggggaaaaaaaaggcgaagcaaatatggtgaatttttttttttttttttttttttttttggcagagtctggctctaatgcccaggctggggtgtagtggcatgatcacagctcactgcagcctcaacctccctaggctcaggtgatcctcccacctcagcctcccaagtagctttgactacagaaatgtaccaccatgcctggctaattttcaggggttttttttgtaaagatgggattttgccatgttgctcaggctggtcttgaactcctgggctcaagcgatctgcctgccttggcctccaaagtgctgggattacagatgtatgccactgtgcctggttcatttttttaaaatattagatacaatcaagtgatgcaaaggacccaggtggccagatgtatagtttctggaacaacttctttttcttaatacttcacttaaatgacttggttctctgtgaactttaccaattctagtccactcactcccaaactctgctctgttgacatagctcatgctttatcagatgtcctaaggaaactctacttcactatccttgtcaagtttacatgctcccacaccttttggtggaacataatttacattttagagaacactgggatcttgttaggtttgtttcgtcccatatcacaatccactcttcaactgctagatgatgcatcccacttctagaaagagagccttacttagtgggactgagagctgctctaatcatctgcagttctagctgttacgcgtttcccagtggatcttgagctgccttggggtggtgaggggctgttttgtgggagtgtaaggtcagggaagtgtcctctcctgccctgtgacccaggccttgcaatgatactgaaatacacagctggaaattgtgtgatccaaaaaatggtcttgtctgtgcacttgcatgaactacagccctgcccccaaattcgggagttgagatggtgttcccaaattactccagtgagttgtctgttattccaggaggtgacacagcatcatggtatgtgcatgatgtcacctcagacgttgccagacaacaagcccactcaagtcggacatacagcactttataatggaggctgggttccaccgagaacagccattctcttgtctgctgtccccagtgattataggcagatgtgctgtgacttgagcttgcacaggcttaaagttccttctgccttcagagtcagcagtcagccatcttcacaaatggaagattgttccagaccaccattgaccatctggctggatccatcccaccatctgccctgcacagtggcctctcatttcctaatgtttctcataaacagcttaaagttccctgtgacattatctactgcagcagggcttttggtaccactcctgggcatgccaggaacatagggcctatgggtattcatcagagaacatttgtatgtcaaaaattttaacaaatgagacttccattttgaagataatgatgcagacatgttgtacgttcacttatgtgtcttccttgataaccagtcaacaatttatcagtgatcctttatggacatattaatacacttattggtgatctggaagtagtgtaggacctaatctgtaatcttaaactgtgcagagccttgaggatggccattgtttgttggttatggtgtcctccttgatctttgatgaaagaaagattgccttaggtgcttatatcaagttaatctcatctctgtgacaattgaaattaccattggttctcttctttccacataacacatcgttgtaactcagcatgtctttttcatcgttgttcttgtggaattcttttaatttaatttattgtggtaaaatatgtccaacataaaactgatcattgtaaccattttaaagtgtacaattcagtagcatttagtacattcacaatgttgtacaaacatcactatctagttctaggacatttttgtcatccaaagaaaaccctataccattaagcagtcactccccatctccttcccccacctctggcaaccactaatctgctttctgtctctatggatttgcttatcctggacatttcatataaatagaatcacacaacatgtggcctaccgtgtctggcttctttcactgagcataatgttgtcaacattcatccatgtcgtagcatgtgccaggagttcattcctttgtatcgttgactgctattccattgtacagatagatcacatttcatgtatccattcctcagttgatgggcatttgggctgtttttaccttgtggctattgtgaagagtgctcctgtgaccatgtgtgtacaagtgtttgagcacctgttttcaattcgtttgggtatgtagctagaagtggaattgttgggtcagacagtaattggatgtttaacttcttgaggagctacccgtgcggccttttgctcatgccagtcctcctctgccatatgatgtctgttctctttcaaacctatgttaggactcgcctccaccttgattccttttcctgatagtcccctgcagcttcccataattcatgcatccttactagtccctatgagcacccctcattcagctctgcctggagaaacttcacttttgcctcctcatatattcatctggggttaccctacttcttttggctttgaggatgtttttcccactaactgcatgcaactgtcaccatctcaaggatggagatggatactcgttctctgtgctcaaaggcacttgtcactatttttgcctttctattgttgggctattctagtaacagctggaaattacagaaataggttttgattttattgctcatcaaggtcaggtttccactgaaatacaggcatcatagggcctatcctgtttgaaatattaaaatgtcagaagattcaaacaggccaaagagggagagtttgaagcgggggtgggggggggattggtatgtgtatggagtataaataaagaggttcaaaataacaataatagcattaatgcaaccttcttgagtttgacctcgtttagtcttcacaacgaccatgtgagatggagatttagtgtgcatggctcaaagccacacatcccttatgtggcaaaatcagtatgtttgactccagagtctgtgtttttttgtttttgtttttgtcttttgtttgtttgtttttggagatggagtcttactctgtcacccaggctggagtgcagtggcacgatctcagctcactgcaacctctgcctcccaggttcaagcaattctcctgccctggcttcccaagtacctgggattacagggatgtgccaccatgcccagctaatttttttttttttttttgtatttttagtagagatggggtttcaccatgttggccaggctggtcttgaactcttgacctcaagtgatccacccatctcagcctcccaaagtgctgagattataggcgtgggccactgcgcctaccctgggcctcccactttaaaagttgctcaccagttcttgtatccctagcaccttccagaatgtgttgagtatagtcagtgctcagtgaatatttattgaatctaattgtcaaggaatatgccatttgctgtgttaattttccccaatatagtttttgttgttacatttttctccttaagccctagaaaagtgtaggctttttaaaaaatgaaaatgtttcattttatttcaagaaaggagccttaatctttatttgtatctatttacaaactgttaaagattttgactgcctcctaatgtctttcttaatctcacactttttgaataaaaagtgttaatatatccgttgtaaattgctggcagctcaatttgaaatatctttttgcacaatatgtactattaagtattctcgtgttattgctcagggtaagaaaagatgactgtttttttgccatttaaagcagtcgtctttttttaatgctgtatttaatttttaaaagacaaagtacagcttaatgaaacaggaacttgctgtttcaatgtgaaggacatgatactccagacacattctaaaaggaaatacatttttaaatataaatgtttggtgtttaatcattcattaggcaaaaatggagacatttgagttgtctggatcccttgagcacattttcatggcacttacatgtaatgaagcagctggcccaggatatattcataatcagtgtcactggagggcttaccatatgccaggcttggttctaattgcttaatgtggattgacccatttaatcccaaaataaccctacaaagttgatgtagtcatccctcttttaaaattgagattaaatttgcatagcataaaatgaaccattttaaggtcaacaatttagtgacatttagtctattcaccacattgggcaaccaccagctctatttccaaaacattttgatcaccctcaaaggaaccccataatccctcgtttaagaatcgggaaacagagacatggagataagcccctttccttaagttacccaactgggaagtgatggagccatgtttgagcccggacactgggactcaaggccactctctgtcgctctctgaagatctatactttagtcccactgccaccttacccacctcctaccaacctccagtgtagtgggggcaaagcacttcacttctaacctcaggttcttgaagtgaaaagcagtaagataatgtgctggttgccaagatctcagggctgcaaaaaaaaaaaaattccttacgctattctccatgggaatcaggccaaagcttttcttcatcaaatttcccgaccccatttctgcagaacaaacagcacaccaggcagggactcccctctgtttcttgatatcccacttccacatttatctattatcatcactctctcattcatgtttcagaagattcccacctcttcactagggtcgagactagcataaaacaaaagagatgaccagggtgcgaaatggaagggggcactccctctcagggtcctgtaagccgagtaagtactctctggcctcacgtagtcctggtcctgccccacacctcctccaagatcatgttcagttgctactccctctcattccttgcctccctctaaagaattctaggatccttttcacttctgactccttgtcctgtctctgaccatttatgtccctcctctctggagatgctcctgctctgttcgccctctaaattgtcttttttttttttcttactctatatccagctgggtcatctcgtccgctctgtgtgctactgtctttgtgttaactctcatacctgcagttctctttcaccctcagcctaggtgaccatatgtcctggttggcctggaaagtcccagtgtatgcttgttgtcttggaatcattattggcagtgcctcttgtcactctcaaaagtgatatgtaggcttggcatggtggctcacgcctgtaatcccagcactttgggaggccaaggcaggaggattgcttgagcccaggagtttgagaccagcctgggcaacatagtgaaaccccgtatctacaaaaaataaaaaaatagcccggtgtggtggcacatgcctgtagtcctagctacgtggaaggctgaaggtgggaggatcatgagcctggtaggttgaagctgcagtgagctaaaatcacgccactgcattccagcctgagtgacagagtgagaccctgtctaaaaaaaaaaaaaaaaaaaaaaaaaaagtgatgtcacatattgcagccttctccccagcactcctattctgctagcacgtttctcaggcatacaaaatgcaacagatcagaaataaaacttctcagggtcttgcctaaaggctgcaccacctcaattttctctatcttgactaattatatccacaaggaaagctgttggctcttcataaactcaatctcagttctccaaggctgaaggaagaccaccacacctggaagaacagctggacccagcagtctgcacctctgttccctgtcacccttccttggaatcaagggctactgctcatttaattctctagcccagcacttcccagcagctctttccgccatgacagaaatgctctatatttgtgttgtccgatttggcagccactagcacatgtggctattgagcacatgaaatagggcttgtgcagctgaggaactgacttaacaaagtacaagtagctagtggctactatatgttatagagcagctctacctcagtacttctcaaactttaacatgcatacaaaacacctggatctcactgaaaggtgcaatctgcttcagtacatctgcaacaagacctgagcgtccccattgtagtaggcttccaggtgaaactgacactgctggtctaagggccacactttgaggagaaaggcgctaatctaactcgattctcatccctggctcacatgagccacacgggggaaggtttaaaaatgtgtcagatgcccagggcctttcccaagccaattaaatcaggacctcagagagtaacctgggcattgacatgttttgaaagctcctcaggtgattctaatgtaagatgagcccagactgagctgctcaaataagactttactaaagatttagggttaagaagatggaattaaccagtgaatacaagtcagttagccactgggatttctgtgtggcacctactcatcttcagcctgaagtccctaatagagtctctgtatctgccttctcccccagatctcctgaaactggcagagaatgaaacagctctaacttcttttttttttgttttgttttgttttgttttgttttgttttgtttttgtttttgttttagagatagggtctcgctctgtcaccgaggctggagtgcagtggtgtgatcatggctcactgcagcttcaacctcctgggcccaagtgatctacttcaacctcccaagtagctgagactgcaggtgtgcaccactgcacctacctagtttttatttttttttgtagagacagggtcttgctatgttacccagcctggtctaacttctttaaatagatctggaaggtgccagacttagcctcacagttgtaaaagatttctgtctttgcaaagggctgttctagataatgtggcttttctgacatattgcatacatactctttgaattactttatacttttcttcacacacatgttcattgtatactttttaaaaagcaaatacagagaccagagctgtttaatagctgaggacctccctggactcagattctccctgaagcagtgttaggggctctgttttctgtgttcatataaccctcagtccataccttgttggaatggttgttattgctttatgatttctctatttgtacttctttctagactgagagctccttcaaagtagggccactgccctatttctctctgcctgtctatcccggccactatcagaacctcctggggaattcctccctcagacctactggttcagaatcttaagtggatgagccctggaatgtgtatgtttaaaaggcttcacagatgatctttattttcagacaggaatgaacatcattgccttagagactgacattatatctggaacatggtaaacattaaataactatttgttgagtgcatgaaaatcagtcttaaattcgacttgtggcatctcgaggcagatgccaccttagccaagtgatcaaggttaatgtcatgagtaacctgcatcaataccatttgccccccatgcaatgcattgcaaaggatacagtattactactctggtttccttccaagtgatgcataaccccagctgaatcatgaggaaacagcagacaaacccaaattgagggatattctacaaaatttgtgaccaatactcttcaaaagagtcaaggtcatgaaaaacaagtaaagactggggaatttgcacagattgaaggagaccaaggagacaggacaactaaatgccgcacaagattctgaattgtatcctggaatggaaaagggacattagtgggaaaactggtgaaatccaaataagttctgtgctttagttaacagcattgtgccaaggctaatttcttagttttgataaatgttctgtagttatgtaagatgttaacataaggagaagctcagtgaaggatgtattggaactctttgtaatatttttgcaacactgctgaaagtctgaatttatctcaaaaccaacaaaaggttaaatttaaaaaatgaatggaagataattgaaatgtcactgaacaagggcattctggaaggagagtaaagaagtccaaggggagaccattggttcgacaatcggaaccaaactggaccatcatagattacaagttgatgcccctatggttttgtcaaaactccctcatgtttttatagctattttgaggtataatttacataccatacggttcacccatttaaagtgtataattcactgtgttttagaatatttacagggttgcaccaccatcatcacaatctaattttggaacgtttttgtcccctttaaaaaaaaaaaaaacaacctatatccatttgctgtcactcaatatcccaccccaccagctgctgccaagcaaccattttttcctttctgtctctataggttttcctattctggacatttattttaaattgaatcatatgtgatattttgtgtctggcttctttcacttagcatgatgtttctgaggtttatccatgtggtagcatgtgtcagtacttcattcctatttgtggcccaataacattctgttgtatgaatacggaccacatttatttattcattcatcagtcgatgaacacctaataccttttggactattattctgatgggtttggttgaatactagggtagactgcccttccagcctcccatgctctatgcatccattgctccagaagatagactcttaggataaagagttgacaccatctccaagcatcccaaacagcattgtgtacttatatacatgattagccactttggaatgtctttagtgttaaggcaagaaatgtccttagagtcccagagagggaaaaaatgtgggttatgttatgtccaaatccataaccaccacttcagggagttgtgcagtgaattgctttattgaataagtgtgagaaaggaaagatattagttgtccaagaatgctattgccaaactttgtggaaacagagtattttctgtggaaacagcatacattttattctgtgccatggaatttcccctcatttgacccaaggggtaaagaaaaactcttatgcaaccatcccattttaaaagttattcttttatatgtaggctggttaataaccaacaacagacaattttatctaagatgactaagatcttgcatttcgcttttagtgagagctgatttacatatctaattcatgttctattagcagagttatgggaatataaggaaatgcaagaaaaacccaggacttggatcagattttaaagtcctacagttatatacagttgtgaagatgtccttcaaaatccagaaaccaaacagactctgtcatcttactttttgctgaggtgttggccttttatttttgaaatctagcaattttcacttcttgttatctaaaagttattaatacaaagcatttcctcccgtcatttacataactcttttccagcagtatgcacacgtacacacacacacacacacacacaatttaaatgtctatgagcaacttttgactttctggaaaattctttccccagcttgaaactttctccatattctggtgtttcacctgaatgtgaaatgaagacatttcacagaatctaagagttcagaaagaggcaccgtgctagatactcatgtgcatagtttctggtcttctcactggcccttccagtaacttgtggttattctagaagtccatgtccagaacagaacactgagcaacagatatcatctgggatccatgtttttggtctaattggccttttgggtgaacacatcatttgggctcaagttgatgattgtatcaagtaagccttttcagtctcttctgtgctgccactgagcctgttccaccaccaccttccctcacccccatcttgaaatcatgcatttggttgctgagacccaagtgtaggatacaaccgtttgttcccatgaccttttcaggtcctcctcatctttctggtttgtcttcctttcagcatctggtaattttgttgttgaatgggttggcctcacttcctagcttcatgttacctgcagacttggtcacgaagatgtgtataacttcatgtgagccattgataagcagggcaaaatagggaaagtgccacccccacaccatgcctgtcactggagactgctcggcagtttcatactttattacccctgagatctgttgtgaatcagcctcactaaaggtcttcccctctacattcccttgtgaacaagaatagctggaaagcccttacaaatgccttgcctgccaggcacagcggctcacgcttgtagtcccagcactttgggaggctgaggtgggtggatcgcttgagcccaggagtttgagaccagctggggcaacgtggcaaaaccccatctctacagaagatacaaaaattagccaggcgtagtggcacacacttgtagccccagctgcttgggaggctgaggtgggaggatttcttgagcccaggagattgaggctacagtgagctgtgattgctccactgcactccagcctgggtgacagagtgagaccctgtctcaaaacaaaaataaatgcctcttcatgattcccatggtttgtgtctagagatttccctcagcctaagaatctaaccgtaccaagtgaaagcaagagaggctgatcttgcatgtaatagtcactgaatgttctaagtgcttgcagaatattcttcaattgtctcttctagactcttgactaggatgtatatcagattcaccaatctgtggtttttgaagcatgttttttccttttcccttttgaaaactgcaaatgcatctctctgactccattcgtattacaggggaagatttagttattttatcttcaagttctccaagtatctgggtataatttgtcttcactataatgctaaaattcatttagaatatcttctaatcaatttgggacctcagttctctcttcattagatttttttcgtctactcttccctggctgaagctcattgtttttttaaaaatagatatatattttaaatttttaaatatttaattgacatgtaataattgtacatatttatggggtacaatgtgatatttctgtacattaatgcattgtgtaatgatcaaatcagggtaattggtatatccatcacttcaaacatttatcacttctttgtggtgaaaatattcaaattcctgtcttctagcttttttgaaatatgtgttgttaactatagtcattccagtgtgcattagagcaccagaacttattcctcctaactggtgatgttgtacccattgagtgacctcttcctacttttttgagacggagtttcactcttgttgcccagactggagtgcaatggcgcgatctcagctcaccgcaacctccgcctcccaggttcaagtgattctcctgcctcagcctccctagtagctgggattacaggcatgtgccaccacgcccggctaattttgtatttttagtagagacggggtttctccatgttggtcaggctggtctcaaactcccgacctcaggtgatccgccagcctcagcctctcaaagtgctgggattacaggcgtgagccactgcgcccggcttgacctcttcctacttctaactcccctcaccataaccctccatagcccctagtaacttctatccaattctctacttttatgagctcaacttttaaaaattccacatacaagcaggatcatgaggtatttgtctttctgggcctggcttatttatttcacttaatatgatgtcctccaggtgtatccgtgttgtcaaaaatgacaggatttattgttttttttatggctgaatagtagtctgtgtttttatccaagcagtcagaagcaaagtgcagaagagaatggggtttttttctttcattttttatttttactttttctttttgagacagggtcttgctctgtcacccaggctggagagcagtggtacaatctcagctcactgcagccttgacctcttggactcaagtgatcctcctgcctcagcctcctgagtagctgggactataggtgtgcaccaccatgcccagctaatatttttctttgttttttttttcttttcttttctttctttctttcttttttttttttttttttttgaagagatggatttttaccgtgtggtccagtgatctgccggcctcaggctcccaaagtgctgagactacaggcatgaaccaccgtgcctggctgagaatggggttttctttgcctattgtaatggaaacataaatccgtgaatttggcccgtgacctctttgctgttttttatcacaatgtcatgaactgctttgcagtttacaaagtgcccgcatgtgcatgtgatctttacaaccaccttgtgagctagtgagtttactacctgtattttagaaacaaagaagcagagttgaacttgcatttagtgacatggagggttgggtgacttttccaagttgtggagcctgttcatgaccaagttggatgcctcccagctttttcactatgcaatctttgccacatttatcacatacagtagtccccctttattcacggtttcactctccatggtgtcagttacctgtggtcaacagtggtccaaaataggtaagtacagaacaataagataagaaagagagactacattcacataactttgattacagtatattgttatagttgatctattattagttattgttgctaatttctcactgtgcctaatttataaatgaaactttattgtatgtatatacagggaaaaacactgtatatagggtttgttactatctgcagttttaggcatccactgggggtcttggaatgtatacctcatggataagtggggacctgtactttactatacgttggaagcacacctttctgactttctcccctgaaatccttgtttactctttaattcatgccattctctgtctttcatacacagtatgtgggaagggtgatgcccataagccactctaacttcctgcactccctttcatttctctgtggggctcaccgatgagtgagtatatttccagaacatcatttctgacatcatccaaatcctctaaagcagccttcctttaaaaactccaaccctggaatctaatctgcatttttggaacgtttgcaatatgctgaagtcagagctactccctttgctgtgccccacgtgcctgggcaccagcccctcggctccaccacctgatgtgcaagtcatgtcagtgtcctcccaagattcctttcacttccccaacttggtgcccaagggggatctgcactgggtctagtgcagcatcccccctaacgtgctttctacaagagggaattggcagcaatgctaggcaaggcgattcagaatcagcgactctacttttttgctgaataagacactgcagatctatttcgctgatttatttacattattctgcatgtccttggagagatggcagaaggttaagggacagcatcgattctttcagattcctcaaggctcttgcagatttcccatggtcctttgtactacaaagtgggagaatcaagcatcagatgaccttttcaatgttactctgttggttcaatctgtaacaactttttctcttgtcttcaccaacctctcactgctttccacaaaaaatgaaccatggcctgctattatttgttttcaattctgaatataataagatatcataaattgctttcacgaaagtactgatttgattatcacttatgatacaaattatgaaactgcaacatgagtgttttctctctgattcctttcaccatttcactgcagacttgaaaagggaccagaatggaccaaaaagaaattatttctttgttgttttgccaaagacctttcctttcaaaatgcacacatcctggagttttgaaaactgctataattatcacaaggcagtctttctgtgggaagaaagtgagtgaatttcccattaggagatcatggttaaaataatctctcggctctgggaccaaatggaactagaaagtgtgttcaaaagctgcattcatttcagaagggagaaagaacaacctttctcataatgagccttgggaagcagccagcgtggaaaaaggtcacacaattgccactttggtatctgaataactactcttagcttacttttgcttgtggtgtgatagcttttgtggttttctctggggctgaatccctgctgtcttcaagcatagttttcactgagtctgtcttggaaaccactgtgcgtgtggcattgtcatctaccatttttataggagacagaaacagttactctgacccaagtgactgaaatgcagctcagtaaattttttttcccaatagtcttagcatgtggataggacatttgttcttatccagaaatgaaatgtgttaagattgtgtgaaattatctgtatcttttgctgctcatttttcaaagattgccccggagggtgttttggtgaaattatttatggaatatgtaaaaatgttcaagaccctttatcagaacagaactgaggaggatgctgttcctgaagattctgcctactgcctatccaagatgcaaaatattagtggtattgaagagagatgagaggggagattattttaaggttatgtgtctttctacaattataccaatttttaaagtgtatttccagctgggcatggtggctcatacctgtaatcccagcactttgggagaccaaggtgggaggattgcctaaaccttggaatttgagaccagcctgggcaatgtagcaaaaccccatctctacagaaaaaaaaaaaaatcacaaaagttagccgggcatggtggcatgtacctgtagtcccagctactggggaggctggggtgggagggtcacttgagcccaggaagtcaaggctgtagtgagccgtgattgtgccactgcactccagcctgggtggtagagaccctgtatcaaaaaataaaaataaaaaatagtaaagaatatttccacaaatcagaagtgaaagagacagctcttggagaagggttcatattcataatacttttctcattgcttattttccaaaagctctaaaatggacttctatgtattaccactgcttcatattgcccacctacccaccttgttgctcctgtcatctaatgttatgaaaatagtgtttgggatttaaagcggaagccatgggttgatttttaagaagtcacagaagccaagactgctgagcactctggtgtcatcagaatgaacattccctgactccagtgagtatcctgacgtgtgtagttaactctcacaaactcaggcacgtgaatgatctcagcagaagagagagaagggccagtggtttaccccattgtctctcccctctttcaacatgggtcttgactaccttgcttccaggaagcaagggtgacagctgaaaaccaaccggaagcgttatttttgttgttgttgttttttgttgtagttgttgttgctgttgcttttgagcctccaaagaccaagatccacttaatagaccgtggcatttttgcctcatctactgacttaagaacttaatccatgaccctgtcactacaccccctgcacccccacccacgcacatttacatgctcactcgtacactcattcacactcacctctacctttagatttaacccactgagctgtactgagccagatgaactggactgttgattcttaccatttctggatcgtgggttcctgaagaatctggtgagaagttgtaaaccctcttccctgaaaagtgtctatacaaatgtgtgcagatttggcttatgattctggagggattcatggccaggaaatccatgttaggggatttacttttcactatataccctttgtttctgttgtgaggttgttactgtctgtgtatattacttctgttaattgaatctgtctaggttactttttcaattaacaaattaattagaagactaagagcctaaaagagatttttcttatctgattaagttcagtattgaatcctgagagtccatttgaaagcatagtattcgtcggctttttcaattgcaaaatatttatcgtgattgccaagaaatattgctgagagccaaaataataatagaggaaatgatctacagttgaatttttatctgaattattttgaacatagaaaatgaatttttgtaaataaaaaaataatagatgttggtgtggatgcagtgaaagggaacacttctacactgctggtgggaatgtaaactagtacaaccactatagaaatagtggggagattgcttaaagaactaaaagtagatctaccatttgatccagcaattccactactagctgtctacccagggggaaaaaaaatcatatgaaaaagatacttgcacgtgcatgtttatagcagcacagtttgcaattgcaaaagtatggaaccagcccaagtgcccatcaatcaacgagtggataaagaaaatgaggtgtgtgtgtatatatatatgtatgtgtgtatatgtatatatgtatattatatatatatgtatgtgtatatatatgtgtgtatatgtatgtgtatatatgtgtgtatatgtatatatatgtatgtgtatatatatgtatatatgtgtgtgtgtgtgtgtgtgtgtgtgtgtgtgtgtgtgtatgcacattcattctgtggaatactcagccatataaaggaactaaacaatggcattcgtggcaacctggatggaattggaggcaattattctaaatgaagtaactcaggaatggaaaaccaaacattgcatgttctcagttgtatgtgggagctaagttatgaggatgcaaaggcataagaatgatacactgggatttggggactcggggggaaaggctgggggtggcaagggataaaagactacacattgggtacagtgtacactgcttgggctatgggtgcaccaaaatctcagaaatcaccactaaagaagttattcatgtaaccaaacactacctgttccccaaaaacctattgaaataaaaaataaaatattaaaatgaatttttgtgttaatggtctcatattcaggtgggaaaaatcttcttacagttgccaaaaatggttacctggtagtatgaaaagggtaagagttgataatcctcgagaataaggataccttcctacagtgttttcagcatagcttattttgtgtgattctttgagagcaaaaaaaaaaaaaaaaaccccacgttttgggattgtagtgactgctttgccttgattgggctcctcatgggagccatttcttatactgaatctttcaccataccaaagagtgttataaccttcatgtacattttaaatgacagtcatattttacccttcccaacagggtttatgtaacatctttgtgcagtatgcttaaaatccacaaaactaaaatatctcaaaggagaaaagagaggttagtgatgaataaaaattgtagtgaagattgtcttgttttttccttctaaaattccttcctgtgtaaaagccgcctggccaactgatagtttttctttcaactcactgtgaaatatttttcttagcttgcatgttagcaccaagtgatgtatccattgtcactactgtgtgatatcagttgctgaggtgataaaacatggatttcttttttaacctggtactggaatggaggatggggaagaaaagagagtcaagaaaaggaatgatgcaactgacaggcatacattagtgaggtgccctattcatttatttcagtagctgtacatccttactttccagcactattgaatactctgtgggtggtaggatcgtgtgggggaaagagcatagttataatagctgacatttattgaacatttgctattctaagcacattatttatattaactcatctaatccctatgacaactatatggattagctgggttcaaatccggactcctccacttcctagctgtataaacttgtgcaacttcacttttttttttagatgaacaaaaactatccatctcttagggtagatgttagcattaattgagatggtagttctattgcatatataatcatgtctggtatataaaagaactcaaatgatgtaaaaaaaaatctctgtacacaaagacttcatggcagcatgattcataatagctccaaactgaagacagcccaaatgtccttcaactggtaaatagatttaaaaaagaattgtggtatattcatagtatggaatactactcagcaatgaaaaaaaggacatggatacacacaaaaacatggaaaaatctcaaacattatgttaagtgaagaaatagaaacacaaacatactgtgtgatttcatttatgtaacattctagaaaagcctaactgtggcaacaaaaagtagatcagtggttgccagaggttggggaaggagatcagctgcagaaaggtactaggaaactttgtaaagtgggggaactgttctgtatgttgattgtggtgattacaaaactgcatatgattactaaatttcgtaaaattgtacacttaaaaatgggtgaagcttaatgtatgtaaattatacctcaaagctagaaaaacacttgctgcaaattgtaaggttgtataacattagactttctcatattttagaacagttgaatgggttttatgcagctcgggttttcagagctacttagattatctcaaaggaaacttaatgcaggtgctattgagcacgcttcatacacatgcctatgaaaggtacaatggatgatgccaaagggacctgtgatagtctgtattagagaaattgtagagaaattgcagacagtttatatacactaaaccatcaagaaatcccatgagaattgaggatatgtgtcgcaggtgagtattggggcaggtcagaaagaagggagataatttagtagggataggggtggtcagggaaggcctctgacagaaataagacttgaaagtgttggataagttttctggaaataatttgagcagagatgtggcagttacaatacatacttaaaaatggctggactggagtatgttggaaagactcgaggactttgaggtctgtcagcttcacaaataaggttgcagagtgttcccagttctctagcctggagcttgtgtgtactggttcttaccctgattatgtcctcttccaattctgagtttagtgacgtttcatttattgcctgagattggccacgctgggaatatttaaagcgtgcaaattgacaatcattttggaaatctgtctcccccaacttcctacccaccccaccagccagttgtcaaccatttaccagcacactactgattgtaatcctgagaattatgaacttcagagaggggaacgaacagaagatccagaggtggctggagaggtgtagagagagccagaggggaaaaagatactcgtaagggagatgacaaggcacaaatattcaatgctgaaagagaagtaggatttttgttgttgtttccaagagaactgaagcagtaggatgccttatcacaagcacacatgtaaaaagcacctctcatacaagtcttttcagaccttcagtaaacagtgctcctccttgcctcaacttgtctgatatatacacagcactttgatggtcaatgcatgcagtgcagaattaggtcctcccttctctgtgcttcctggtattctttcagtttctggcacatggaaggcagtcgtagtggctgaatgaatgaaatcatgaactaatccttattgcggtattgctcatactgtatgcttgcaatacaaaaccttgcttacttgtttatctacctcattgaagtgcaaacttcagaagaaccaggaattttgtatcttgttgtaccctagcacttgccactgcacagttggtgctcaagaaatgcttattgaaataatgaaattaggcaatttcagttttagataacatgcaattaccaaaagatcaaatagcattctgttccatgaaacaaacccatgtcctttcttaaaacattcaaaagaggtgctattgagttatgtaaaacatgctagtctctattgtgggagggcattagtctgccaatatctcagtttctttttaacagtacagaaattgaagcaacttactatcaaagtttcttccagatctaagatgctatgattctaagaggaaagaaaattcagaccttgtgggcttaaaaccaggggtcctttattgctttctgttaaggtggaaagttatatatgacatagacattttctgtacttttggcttctttatatggattctatctatataagtgataagtgattaagtgaggttggctagtaattattgcctcactctattcaatttctcttctgtcttatctgtggtaggctgaacaatggcccccctagatgtccaggtcataagccatgaaacctgtgaatatgttcccttatgtggcaaaagagactttgcagatgtgattaagttaaggatctcaaaatggggagattactctggattatctcagtgggcccaatgtcatcacagcatccttataagaaggaggcaggagagttagaaggagatgtgaggatggaagcagagattagaaagataaagatcggaaagatgttatgttgctgactttgaagatggagaaaggggccacaagccacagattataagaggcgagtagaagctgaaaaaagcaaggaaatggattctcctttagagcttccgtaagaactcagtcccccagtttgggcaatatggcaaatccctgtctctacaaaatatacaaaaagtagctgggcatggtggcgcatgcctgtaatcccagctacttgggaggctgcggcagggggattgcatgagcccaggaggtcaaggctgcagtgagctatgatcgcacctctgcactccagcctgggtgacagagtgagaacctgtcaaaaaaaaaaaataataaaaaaaaaaataaaggtgcagacaccttgacttcagcctagcagaactgattttgaacttctggcctcaagaactttcagagaataaatttgcattgttttaagcgattaaatccgtggtcattcgttacaacagccataggaaactaataaaacatctcttctgaagatttaaaaatagcattctttgctttccaaatttcactgtgcataggaccacctggggatcttgttaaaatgcagattctgattcaggggggtctgaggatggtcatgaagatttacaattgtcttgagatcccagatgctgctgctgctgctggttgtagcccacactttgaatgggaaagctctggaggaggtattcattgtctgggcttctctttcctttattgcctttggtcatcattactaaaatattgtatcctgttgggactctttggtttctgtgagcatgtagagaattagaaagccacaaagacttggagtagagccaacatggggaggattttaaaaagctgcaattgttcaacctgaagaaaagacagaagatgatttaataatgatatgtaagaaaccagagagttaatatgtgggaaatggtgattaactgcccctcatctttactttacaggataaaatagcaagaagaatttgggcttaagaactccatactggcagggaggtggtggttctctttgactgttagaattgtacagctgcaagggccctgggatccatctagttgtacccactcattttgtagatgaaactgaagctgagagtgacctttggaaggtcacaagcaaatgacagaatctgtactagaactggtggcttggccatgttcactgcaccaccgcagtggaggctgtgccatggggtttagataattggtagttgctcatcactttgaagtgatttaaaattggggctgtcccagggagccttctagggtggcagaagtgttctgtatcttgctcttgggttcagttatacaggtgtatgcatgtgtgtgtgtaaaactcatcaagttgtaaacttgacctttgcatacttgaccgtacactgattattcagcaattttgaaattttttgctagcatttagaaaatgaaaatgctgaactcttcgttgtagccaaacactggaaatgatccaaatgtccttcaaattagactagatacataaactgtggcaaatttatagaatggatttctatatagcagtgagagtaaatgaactgtaccatacagcaacatagatgagtctcacaagcatgttggtgactgaaagaagccagacacaaaagagaacattccataggattctatctatataaaagtcgaaactgagcaaacttaacatggccttaaaagtcaggggagccgggcgcggtggctcacgcctataatcgcaacactttgagagaccaaggtgggcagatcacttgaagccaggagtttgagaccagcctggccagcattgtgaaacctcatctctactaaaaatacaaaaattagccaggtatggtggcacgtgcctgtaatgccagctgcttgggaggctgaggcaggagaatcgcttgaacctgggaggtggaggttgcagtgaaccgagatcgcaccactgcactccagcctgggtgacagagcgagactctgtgtcaaaaaaaaaaggggagtggctaactatgagggaagtattagggacacaaggggggctctacctggctacatggttatatccactttgtgaaaatgaagcacaatgtattcatttgcacattttctttatgtacatttcaattaaaagttaaaattggttgagagaggttgggagaagaacttctcacaaacctctgtatactattaagctttgaagaatttaggttttttaaagctttttaaattgacaaataataattgttcatatccatagagtacatagtgatgtttcaatgcatataatgtttagcagtcagatcagggtaattagcatatccctcatctcaaacatttatttccttttgttaggaatgttcaatatcttcttagctatttgaaatgatatattgttaactctagccatcccagagtggtatagaacactaaaacttattcctcctgtctagctgtaattttggtttcattacttattttttaaaagcacaggtggaggtaattgcattagaaaacatgtactttcatagaatccctggaagataacttgctgtggagagaaaccttcagttaaggagtctgtatatttaaatctcagttctaagccaaaagccatctcttctcttgtcagctttctctctgagctagtacagtctttctttcatgaaaatctatgaagccagcaccatcctcagatcctttttggccctttgtagttctacagaatgggggcattttttaaaagaagcagcttgaaataaatagtaattttgttaggagacaatgttgtcatgccaggcacacttccctgcagcagtgcctggagtgccacagttggtttcaaatggtgtgaagcggttccagacaagcagccgaccaaacagaacttgtcaccccaagccagaattcccccaaagccatatctgcttcctgccactggtggtatagtttcaaaccagctggctagcctacctgagataatttcatcatgtgaggttgtacagaaaagggttgacttgaccaatctgagactatcttggacaaggccagcttgcaaggttggcccttggctggcatcgggaacttggtggtaagcagttccctgcagtgataagaactttccctaagtgataaggctggttcaggatggctagactgtgctaacactatggcttatgctgaacacctttccttccttcctggagtctggaatttcaatatgtttaggcagagggtgcctccatgaccagcctgcctttctaaccagcttttctgggcagaactgtcacacatattattgtgacttcattggtaggggcaaagtgtgcccatgcgatatctcctgggaagagagagcataaggaagtctgcatgtggattcttccagactccacgtgtgtctttttccctttttttttttttttttttttttgaggtggtgtctcaccctgtcgcccagggagtaacctcagctcactgcaacctctgcctcccaggttcaagtgattcttatgcctcaacctcccgagtagctgggattacaggcatgcaccactacgtctggctaatttttgtatttttagtagagatggggtttcaccatgttggccaggctggtcccgaactcctgacctcaagtgattcacccacctcagccttccaaagtgttgggattacaggcatgagccactgtgcccagcttgtgtctttttcctttatgatccttgtatccttgttaagttgctgtaataaatattggctctaagtacaactatatactaagtcccatggatccttctgtcgaatctcagaacatggggtggtctttgggacgcaggtacctaagtgaatatttaaagtagttttcagcttttttcctgatgaaaataaggtgagaagatactcctgggtgcttctggtgggagtacgaacatggaacaacccttgtcgaggacatgttgtcagtttctagcagatcatacattcattgaccctttgatccaggattcccacttctggaaatttatcctgtagctgtaacaatacctgtacaaaatgatacacataaaaggtttttggctgggcatggtggcgtgcacctgtagtcttagctacttgggaggctgaggcgggaggatcacttgagcccaggagtttgaaggtcaaggctgcagtgagccatggtcatgccactgcactccaacctgggtgacagagtgaaacccagtctttaaaaaaaaaaaaaaaaagtttttgttgtactcttcccccagcctttatttgtaatagcaaaagaccagaaactagtattgtcctgtatggggctgctgagtctctgagggtacattcacactaggaatgactgcagctagaatagaacgaagaagttgtatgtgattaatagaaagttttctcatgtgaattaaatcaaaagcagggtacagaacagttaagtctagtactgtgtgctccttttctgggcgaagggtgtgtgatgctctgaataactattaaaagtggtgacctgtagggggcaagttagacagtgaatgaaggcagaaatgagaactctgtgtatacttccttatattgctttcatttttgtgtcaattacctattaagttttttttaattgaaaatgaaaagagctgagaggaggcagtctgcttgaggtgaatcaaaatcaaggtattataagtgaaataaaaattttacatacttaattttctctttgtttacatcaggtatggcccatgagtcagccacctgtttttgtaaataaaaaaatcttggaacacagtcatgtccattgttttacatatgctccttggctgcttttttgctacggtggcagagttgagtcattgcaaaagagaccagatggcccacaaaacctaaaatattgactattctggccgtttacaaaaaagtttgatgaccctgcacctgtagtgtttagttatggcttatatcagtgttgatgccctgcctaaggatatcaggatggattggaatttgattcatctgtagtaggtaaggccaatggtagtcatttgaaagatgccattttttataaactctgagcaaactcatgttacgtgattgctggggggtcaggggagggggattttactctacaaagacacattagtctatttctaaaacctgccaagagaaattttaagaagcaatgaatgatctcttctctaaagtgtggtgcctctgagacaatctaccttcctggcaatgataccctagctaaatgttgtctttgaagatttatatcatcagaatcatggaaactggacctctccaggagaaactgaggtctgcactgtgcaagatgggatcattgtccctcgatttcagctggttttttttttttcattgcatgcctgaggtgactttacccatccttccagaacaaaatggattattctttgagatgtctggtgattatcataaaccattatcatatggttctgtgatataggaccgtaagcaaggcatttgaataatcatgattttatatgagtaatgatgatagctactgttcactgagggcctactgtgtgtcaggcagcgtgtaaggtgttttatgtgtattacatctatttaatcttcccctcaaccttcagggattgatatgatcattttcactctacaggtaaggaaaccaaggcttagagtttaagttactgaagaggtgatgttgctggtaagtggcagaggtgaaattagaacccagctctggctcagaatctatattctgttccatacttcagtgacttggaatgggaattagttacgaggtagaaccccattcagattaactaactttttttttttttttttttttggagatggagtctcgctctgttgcccaggttggagtgcaatggcacaatctcagctcactgcagcctctgcctcctgggttcaagcgattctcctgcctcagcctcccgagtagctgggactacaggcatgcaccaccgcgcccagctaatttttgtatttttagtagagatggagtttcaccagttggccaggctggtcttgaactcctgacctcaagtgatttgcccaccttggcctcccaaagtgctgggattacaggcacgagcccccatgcctggcctagattaactttttttcaaagaagtgagttcaatatagttttaatttattggtaaaatgaatcattacaaatattttaaataacgataccaataaaaacaatgcttttattcattgcatgtcctaaagactacatgtagtttcattgacgtcttccattgactttgtgaaagatatttagtattctcattttttcaaagaagctggatattaaagagcttaagtatattgcccatactcacatgtatggttcaaccaaggtccagactcccatcccctggaacctgttctgtctactgtgctacatggatttaaggcttgaattagtaacttggcagactgactgtccaagagacaaacatgctgttcaaagtatttgtcctagtccatttgtattgctataaaggaacgcctgaggctgggtaatttataagaaaagaggtttatttgactcacagttctggagactgtacaagaagcatggcaccagcatctgcatccagtaaaggcctcaggaagcttccactcatggcagaagggaaaggagctatcacatagagtgtgagagaggaagcaagagaaagaggggaaggaggtgccaggctctttttaacaaccagctctctcaggagctaacagaggaagaacccactcactcccttccactcagagaggacattaatgtattcatgagggattcacctccgtgactcaaacacctctcattgggccccatctccaatattggcatcagatttcaaaatgagatttggaggggacaaacatccaaactatagtagtgttcctatattttattattttttgagacagagtcttgctctgtcacccaggctggagcgcagtgatgccatctcggctcactgcagcctctcctttgtaggttcaagcgattctcctgcctcagcctcctgagttggtgggactacaggtgcgtgccaccatgcctggctaatttttgtatttttagtaaagatgaggtttcaccatgttggccaggctggtatcgaactcctgacctcaggtgacccgccccctcagcctcccaaaatgctgagattacagggatgagccaccacaccgggcctatattttattactctcccccccacccccaaaataacatatattaaaaatgttgcttttggccaactccctgattctgtttctattccctttttgccatcaattatggtagttatgttctaacaaattgatttttactttcttgtgctgatgactttagcaactcctatgtgaaggtaattgctagttttattgtcttaacattatgctaactgttagtgtaatccagagtaatcaatggtatccagcctggagctgattatgttcaattgtttcaccaatcatttgtctgtatttatgatacacccatgtacacatctggcctccaggcaatggcaatgactgtgtgtatgaaagaatcaagtgaatgtaatgtaaggcagtgtgtgattatgtcaaaatggatgggacagggtgttggtgccgtaagagttcacagaaagctaaagtggtaagaaaatgccttgtggaaaccctgatgattctatcttcttggcgtcagcctacttttgaattcagcctacctttctcaaattctgtttctacctggtccaagtcaccatcatctctgatgtggattactatgcttactccctatttcttccacatttatttttttaaacaattgtatttgggtataatttacatattataaaatttaccagagtatttccatcactcagtaaaattcgatgagcttatttacagttagttcctattcccatctctagtcccaggttccttgaggaaccatgcatcaagttttcatctctactgtgtgcctgttttggacattttatgtaaatgggcttacatatgttcttttgtgtctggcttttttctctgagcatggtatttttcaggttcatccatattgtaccatgtattagtactttgtttttattgccagaaaatgttccacagtgtggattgaccatattttgtttatccatgtaccagttgatggatgcttagattctgtgaacattcatgtacaagtttttgtgtggacagaagtttttatttctcttgagtatatacctaggagcagaattatcatatgataactctttaactttttgagaaacttccgtattgtttcccaaagtagctgcatcattttatattcagtgtatgagggttcctggttttccacatcctcactaacacttgttattgtcttttttcttatagccattctagtttgtgtaaagttgtatttcattccctctttcagtctctaaacaaccggcagaataattttttattgtttttttacaaatgcatatctgctatcttacaccctgactgaatctctttaatggcttccatcacatgtaaaataaagtctaaataaattctttgacctgttgtcacaggtcgggttccctaggaagtacactctgagatggagaggtttgttgaggattgctttcagggtaaacacctgtaggggcatgaaagaagcaggactgagcagagggagaagttgggctgcagcatcatcccaaccaaggtctcagcttatcctattggaaccttcagaggtgggaaggctctgcaaggttggctggacaaaggatctgggtctttatgcacccatattgaccagtcactgagtgccagatgcccctgagccagggacatgaccatgggcaagacggctttcttcagtagagtacaatcactaggaggaagtcctcagccacaagctgtcatctgtcaactttgccagcagctgggggtatcagtatatcagtccggaaggaggggaatctgggtgatatattacagcatccactatacctgagctgagagccatcacattctggtcttctcgacttatctcttaatacttcctttcttgctgtctgggctctagccacactgctttaaatttctttatgttctcaagtttcttccaaccttaggatctttgcacatactattcctattggtttatggccataccaatttaaacacctccaatcttatctagaaagtgagagcattttaaaaatcagtgtttaaatcgtatttgtaaagttgcttgaaaaaggactaggctattaggctagtgttaaagctgtcatttggagggcctttttagctttattataaattccaatattgggaattgctcatttgacatgatgtataggagccattttctaatggaccagcattaatccacttatagctgagtggccaacagattagcaagcacttccattttctataaagaaatggatattgtaaaggcctgggtgatgctgaggaggaggctcaataggatcatatttcttgtattcaaactgcaaaaatataagtaggattaatgttatgttagagtttagatggaggtattaatacattgcatttagaaataatacactgaaatctataaagaacaagagtatttgtttaaagtagactttggagagaaactcattggtaaatcttgaaatttggtctctaaataattaaaagttgtttggattttttaaaaaattgccatgtttccctcttaactgattttctgccaaattttcctgttcagcactcagaacttgggcagcagttggtgtgtaagggatgtttgcacacatataagatggtgttttttccttcatctctaatgatttcataaggtctcagttctatatgacatttggattttgaatttataataccatgtttatatatttaacatggacacatggcaagtgctgggaattaaagctaaatatagacttgttgactgaacaatcaaactatctgcttgtcttagtccattagtagtagtttcactggtatggttgatagaaagcactcaccctcctcatacgtgcatgagacgaggccaagaagtgattcctgtgtaaattggcagccatgacagtaatgatgtttgcctaaaacatgtgtcagtaataggaaagatgattaggcaaagaagaaaaagtttaaaaaaaaaaaaaaaaaaaagctggcgcagtggctcacgcctgtaatcccagcactttgggaggccgaggcgggtggatcataaggtcaggagatcgagtccatcctggctaacatggtgaaaccccgtctctactaaaaaaaatacaaaaatttagtctggcattgtggcgggcgcctgtagtaccagctacttgggaggctgaggcaggggaatggcgtgaacccagagggcggagcttgcagtgagctgagatcacgccactgcactccagcctgggcgacagagcaagactccatctcaaaaaaatgaaataaaaaataaaaaaaaagatggtcgagggagagatgcgtatttgctctgagtgttcagagatttccttacacttctctatatagataagaaaacaaatatgagcccacagtgggtataaagcaacctttttctaagaagtggactggaaataagtctggtttttggttcaaggagggcctgggaagtatccagcatgatgtccgggaacacagatcagaagtagacaactgagcctagaaatgctggggttgagtgggagatgggatggatgcatgagtaggtgggtgcgtgggtgggaattcagaatttcgtagaggaaatggaagtagggaaaagggacagcactcaggtgggaaactcagaggtttagctgtcactgggagacagccaaatgggagaggaagggaaaggtggaaaatgagaaagagagaaaggaatgcagaatggagaacggggttttggcattcttttctgtccttacttgttctacctgtgataaagaacccatcagtttggacacagtgtcccttcatggcctggcaagaatcctcagtaggacacaacctcctacgtgggagtggtgattcagaggaaacacatggtgaggataattaatttggaggttgaccatgttctgtgtgggtgtttacctctttcagaacatgtagctgaaagttcagcgtgtactattgaaaagctttcttgcaacgttgctggctgtccttggtcttgagactaaagcatcccatagaagtggtggaacgctaaagattgaaacaaaccactgaaaattgatttataaatatataactagttgtaagctgaagactaaagcatcccatagaagtggtagaatgctaaagattgaaacaaaccactgaaaattgatttataaatatataactagttgtaagctgaaatctaaataactttttaagttaaatatatatacaaaaatattagaagaaggagaattttcactctcaactcattcttgcatagaaaaataaaatctatcatctctgtatattagaagcattttgtttttggaagaggttgttggaataggttatatggaaggccatttcattcaaatgaacaaaaattacgtgagatggaaattggcaaatttatcccaagtaaatactgaaaaacctggaagcctttcaggtgctcagatttccactatagaaaagaaaacattctggccaggtgcagtggctcatgcctgtaatcccggcactttgggaggcccaggtaggtggatcacctgaggtcaggagtttgagaccagcgtggccaacctggtgaaacctcatctctactaaaaatacaaaaattagcagggcatggtgacgtatgcctgtagtcccagctactcgggaggctgaggcatgggaatcgcttgaacccaggagatggaggttgccgtgagccaagatcacaccactgcactccagcctgggcaacagagcgagactccgtctcaaaaaaaaaaaaaaagaaaaagaaaaaacgttctgaaaataaataaaaagaaacattctggcacatattagaaggtaccagagtaagagaggcaagataaatcccagctttgttggtcatactgcatatcaaaaacaatgaattgtcttttctgttttcttatttttgtttagagcatagtcagtggttcaagaactctaagccatagatagctcagacactaggaaagatgttggctgactttgagggggaaccacttgtagctatagacaaccagaaaatgctgtggtccataccatgaaatattttgtcttactgaagtttgaagatccttccagatcccggcattgatctggagaatgatattctccacatacttgggctccaagtctttgtgtccagggcttggcaattaccttattgtatccagtggaataataattttgatgctatttgttcaaataattctgaatgtactaaatggatgacattgttaaatgggacatttggctgttacaggatgtgtgtgtgattgattaaagcaaattttaactgtcagaagatgaaggcactaaaagtttttgccatctaacaagcatcagtcagatatgaaaataggtgtttccagtcacttttattaataacataatcaacatttgtgctaaactagagttctttcaaaatggaatttggcaatgccaaaatagccaaaactacaaagctaccgtgtggtactggcctaagaatggacatatagatcaataggatatcattgagagtccagaaataacccttatgtttatagtcaattgattttcatcaaggatactaagacaattcagtggggaaagaatactcttttcaataaatggtgctgggacaattggatatccacatgtaaaagaatgaagttgcacccctacctcatatacacaaaaattaactcacgatggatcatagacctagatgtaaaaactaaaattataaaactgttagaagaaaacacaggagtaaatcttcatgaccttggtttagacagtggtttcttagatgcaacaatagcaacaaaggaaaagaatagatacattggactttatcagaattaaaaactattgagctgcaaaggacaccatcaagaaagtaaaaagagaactcacagaatgggagaaaatatttaaaatcatatatctaagagacttgcatccagaatatattaaaattaataataagacaacccaaaataaaaataaaggatgtgataggcatttctctaaaaaatttacaaatatccaataagcttatgaaagatgttcaacatcattagttgggaaatgcaaattgaaaccacaatgagatatcacttcacacccactatcatggctgaaatcaaaagacagtaaatacatgttggtgaggatgtggagaaactgaaaccctcacatgctactagtgggaacgtaaaatggtacagctgctttggaaaacataatggcagtttctctaatggttaaatataggattaccatatgacccaacaattctactttcaggtatatacccaaaagaaatgaaaacttgtgttcacacaaaagcttgtacatgagtgttcatagtagtagtgttcataatagccaacaggtggaaacaactcaaatgtccatcaactgatgagtggatcaacaaaatgtggtatatcctgcaatgcagtatgattcagcaataaaaagaaaggaaatactaacacatgctacagcatcaatgacccttgaaaacattaagtaaaagactccagtcacaaaggactacatatccatgtgtccagaaaaggcaagtttatggagaaagtagaaagtttatggagaaagctcctaatggttgctttgaaccagagttgaggggtgagggtagggtagggaggaatacagattgactgctaatgggatcttttagtagggactgaagtgttcaaaattagatcgtgttaacagttgcgatcatatattttgaacaagtggaaaggggggaatatattaaaaattgtacacttaaaatggtgaattgtatggtatgtcaatgataataaaggtgtttgttaaaaaaatgagttttggcttcatcgtaatcagtgaaagaaatatgttgagtaaatattaatacattattttatgctgtgtccattgactcatattttaatctgggaaatatgcatctttaattactgccattgtgtgcttaaggctgatgtgtttgggtagcttttaaaaaattttttttcttttaaaaaattttttgtagacatgggggcctcactatgttgcccaggctgctcctgaactcctggcctcaagcaatcctcccatctcagcctcccagagcactaagttataggcatgagccaccaggtctggccacagatctttttgacaatggaaatggttgttctttgatcaggtcaataaaataattactgctggcagagggatgtgcctcctgttcaatgtggaggtcattaggggcccctgggcttcataaaccacagggggaaattgagaactacttagtgtttctatgcactgagctcctaccgacgtaatgtgttaggtgtctaaatttgcactttatgatatatttcgccaaattttctctccctggcaatgaagtgatgtttacttaacagtttcttaaaagagatggtactctgtgatccatttttatttatgataggaaaattacacttttattttaaaagccaaaggtcatagccattgcagatattctagtaattattatttgagaaatcagttctcactgaatgcaatgacaattttctaaacctagaataggtgctgtggcgtggtaccagaggagtaacatatgtggcccttgttccatgagagatcaaagtcgttttggaatgtaaaacttaaacacatgaatattttggagaaaaagaatgtcatattgtagtaaattggggggacatagacctatgacatggtgagaatcgattcattgaggtttcccacaagctgtagcccttgagttgcaccttgaagatgaatagaatagaattagaacaaatcgaaagggaggaagagtgagaaggaaactggtccaagaagcagaggtgagaaggtacatggggtagccaagagaaacatggtgggtgagcatggcagagagtccagcaatccatgaaggtcggtgatagccagcccatctattaagcaggggttccattgtagattggttgaacaactccatgaaagtgttagttctggacagataagccttggcctgtgatttgaagtgggagaacatagaagtagaaaaccaggtagattgccattacctccacccaagtctgaggccaggaggagaggctgaagaaaggggtgagggtggatttaaactactgacaaacacctcccaccaccgcccccacacatgtatatttggtgactaatcaaatgtggggaaaccctagctaactcatgtattttagagagaacatgcctacgatatgtaaaggcattctgtagatcttggatgactgctccagactctaaggtgatgtgaaaatatattatgacaaccatcatacagacatccagagggatggaagtgagataacttcccatagcgacctagctggcaaatggcagagctgaggttctgaagtcttgaaatgaagatgttggaagggtagtgatgcctttgatgggaaggacagccttgggaaggatgacggaggcatctgctggggagtgggaagatgaactcaacttatcatactgagtttaggaggatgtgaaatatttaagtgaaagtatgtgtacgtataaatgtgtatatgtgcatggatacatatgtatatgttatgtatatataaatgtgtatgtgtgggcacatgtgcgttcatgcatgtacatatgtttattcatatatgaacgtctaaagtatgcaggtatgccttatgcatgtatatatgagacatgcacatacacccatgcatgcatatatgcaatcacatactttcacttaaatattttacatcctcctaaattcaaaatattctaagctgaattcatcttctctgtccctatccgacacctcctttgtgcttcccttcatacgtgtgtatatgtgcatatatgtaaatgtgtatatacctacatacacacacacacacatttgtgtgtctgtgtggtaaatgagccattagagcttagaaaagaaatcatggcctaaaatttagaattgagagtttggagccgggaggaatcatgtgaatctattataaagggtaatgtccggggagaggagagagaggagccttttgaacattcacagatagatcacagggagaaatggagatgtagccacaacaaaggaagattcgctgggggtggaggaattccttcttacttgggcaactgctctagggagtgctagcttccaagtaggagcccaagaagtatcatctgatgtttgtcagtatttttaaaaatatatttattgcgcttctactatacaccagtcaacaagtgaggggatggggacaccaggaaatgtcaggcgcgtggtgtcagccttcccggagcccgcaggcagggaggtcgtgctaaaattgctagcatagcacactgaggtgagctgtggcttcccagtacagagcagcttagattgctgtaggtgggtggctggaggcaggggttacagaagagagcatcagagctgagcctggagggttggtggcatgctgcttagtcaggtactcctcttggaggacaggaatgaggtattgcatgtaaattccttagctaaatgaaatatgtctttaaaacttttcgtccaagtattacatgccttctcaagctatcattttaataaggtccacattgccaattgttttcatttgtggattgtacttttggtgttgtatctaaacacctttgtcaaaagccagttgactacatttctgtgggtctatttcagggcgttctattctgttctactaatccatgtacgtccatttatcactaccacactgccttgatctgcatagctttatagttgtcttgaaatccagtagtctgagtcctctttgttctttttcagaataaccttggctatcctagattcttttcctttccgataagaactttagaatcagcttgtcagtatctacaataaggcttgtcaggattttgacctgattgcattaaatctataaatgaaattgaaaatgaaaccctcattttgaacatcagttttccagttgggctttaattcctagaagacctggaattaggagaggcccaaattgagacatgatccaggccaatgaaacatcacttaacagggaaagaggggtgtgtgtgtgcggtacatgagaaagcgagatggaaatcagaaccagaaagaggctgagccaggatcaatgactggagactcggtcccacaggcatggatgttggtcccagtgtggtgtatcgctgaaaagagtcaaactctgtaaaaatatttaaagaagtttattcggagccaaatatgagtgaccacggcccaaggcacagtctcaagaggtcctgagaacatatgtctaaggtgattgggtaatagcttgattttaaacattttaggtagacaagttataggcagacatcaatcaatacatgtaagattggttcagtccagaaaggtgggacatcttgaagttggtggggcagagtccagaccataggtgcatttaaagatttcctgattggcagttggttgaaacggttaagctctgccttgaagggttgaaatcagcaaaaagaaatgatagtagttaagataaggggggttgtggaagccaaggttcttcttatatagatgaagcttccaggtagcaggcttcagagagattagatggtaaacatctcaaagtattatgggacctacaaatattctgtttggtccgttctgagatctcagttttaatgtgaatgctggtcagttgtgccttatttccaaattgggaggagggtatcatgaggcatcttggtctgaactagtttttcagatttactttggagtccccttggcaggaggggtccagtcaataggttgggggcttagaattttatttttggtttacaggaggatgggcagagctgagcacctaggcctgagggagagggacaatgtctaggcctctaataaaggcaataggctacagtagttctgcagggaccatgtgtaggatgccaagcacatggtcccttgccatcaggttcagctgcctccccttcctccctttgggcaggggaaggcaggaatgcatgggccttccagagcctagctcagcccccagctggtgcctggttccaccttggcccttaggagagctctgacactctgaatgtcactggccttgtcttaggggccttagaaaccaatgagtgataattaaggaactggagcttgtatgaagaaggtgccactttaagtgtccctgatggttttgagttgccactaaagagctcagagccctttcaaagaattcagtctgagccagatgaatcttaatttctcaccctcaaattgagatgcagtcctttggagaattaatatttagtggcatggaacacaaatcatttcttttgctggactcttaaagatgtactagattgattttgtttttatgacctttcaaaaacatcgcagtctgttttgctagctccagcctgttgaagttttagaactcatctttagcaacatcaaaggtgacagggacagcctttgagaaaggtacgcatgaagtgattgctggcatcccatagtcaagtctcaggataaagcatccatattgcctttttttttttttcttttttttcctttttactagtggagataggaaacctataaataagcatggcagaggtgtcccctctgaagattgccccttactaagtatttacagtaactggatttctttattttgtcagtttctccaggaagaaaggtgatgtcatgctccatagcaagatgagagaaggagtttagggtttgtaatttttttttaatcaaagaatttaattgcaatttaatgacgagagagaggatgtttattacacggtggtccaataaatactttctaataagtttttaagccatttgagggaaggcttgctacaacaaaattgacaatcaggcaagccgctttgaaggaagcaaatccatgaattttcagacactgttgctaagcgcagctttgctttcccctctgcttccccccccccccccccccaccaacttgctttgaaaaagcaaagcttaaaagcctctattgtgtggagggggggaatatgctaatttgcagcacatttcccatcagactctttttttggcctgtcatagctgagatatgaatgatgataaagagaggagaaggtggcattatgagggttcggggttttgttattgtgcagagagaaaggggatgaatagggtggcacctccagtcacccgtgaagcccccctgggtctgcgggctgcctggagttgagtgggttctcatgggtctgttctgcccttcccccaggcactgccacaatctactggtgactcagcggccccctcgggggaaggccgtgtgtgtaaaatgaataaacacgccagggtggggaacttctacaggggactaggaaaggggacttctacctcctagataagtcgtaacaaagaaaaagagaaatcagtgttttgacatggcagtaacaactttatgagatatcaaggttgtgattgaagggatatctagatacatatcccttcaaagctgtcatgtcgtggtttcatacaatttgggttgcgtttatttttgtcaagtcttcagcttattcagttggctctcttgccggataactggatatgtagttaaatttttatgcattaaacattgatttttatggggcaaagttagctagcatttctgaacaatgagacaacagtattggatgcttactcctgtgttcaacaatatgaaaaacatgttttccttcttgctctgagtggttgattttttttgcaggaaagcgcattgattttgttcctcgtgagcactccttagctcagttttttaaatgtatgaattttataactgaagaataatgcatgcattagcaaacagctattaagacctgcaaaagtgcttccaaattgaaatttcgcatgagtcattggaggcaatttgtatatgtcaggtacacacgtagtgtgttctgtatagttcatgaaagtgaatcgtttgaagctagaaaaggaatgttaattgcattctaggtttgtgttgagtacttagtcgatactgatggtagtatgctttaggtgtgaaacaaaaatataggatgtctttactgcaatagtaaggtgcttttaaaaataaatacataaataaataaacatagcatctttgcttctcttgactctaaattctgaacagctaaagcatgacaaatctttgcactgtaaaaatgggacgttatttatatccacagaacttcattggatagaaactagggttagagctcattcatttacctctacaaataggtagctcacttatccagatgcatgcaggtattaaatgattaagcctctgtagatttttttcttccttaaattaaggtctggagtcttctgtttggtgagtctttcactggtatggtaagcatgctttagcattagaatcacacaacccatttaagttaccattaatttttttctgattgaagttgtagcagatcaaggatatcatcgtgaaggagcagatcagccacctgtatgagtgatttaaagtgcaaactgctactggttgtaagctcaagacttgtctcattcaaactctggcaggtcacaaaacgtttaacacatcttgcttattaacctcaacaggtggtgtaagattagcatttgagagccacgtgttctgaagaccatcctgcatttgtttgagtcagctttggcatgcggctaagctgtcactctgttcatatcttcagaaactagaagctaatacattgtcttgccaagcatttttcacatctagcactgatggtgtacctctgtgttttactataaaatgtaaaagttgaatgaagttgggagttaagcagactctgaaagtgagacttcttgtcactgatttgaaactcagggatgcactagcccctcttagttcttgatgtttcaggcaaaaccctgatgatggtgccatgactggaaaaaaatcctgtatagacagctttttaaaaggtacacgtaagactagcttttatctacatgttgtatttaatacttaatctagccaggaactcttctcatctgtttactacatcctcatttaatcttcccagtcacttgaaggtggatatgactaaatattacagtgtacaggtgaggctctgaggcaccaaggagttaagaaacttgctcccattgtagagttgaagaaaaactcctagctttttcactggggtctaggacaccccccaaaaaactgaaattcctaaaagtgtatcagatagagaacttctgattatttctcaagtacccattcagatagtatttcttctaggaagccgtgcttgccacacatcctctgccccttccagcttttattggccattcttgctggcagagttaagcttgactacatacttgcccccatggttccactcatccttccatgggttgtatgagtttgggaaggctgaggaccagatggctcttgttggccatttagcaacaccaataatagttgtcccgggctagatgctgggtctatactggtgaatgaatgagacatggacccaacattcatgtactcatgcacggtttagtctgctgagatgctctgtggttctagctgccatgacagtggcaccacccccacacacagggaaacaggtaaatatttgctgaataaaaaaattaatgtttgtgtccctctgttcacatgagcccattagctcctccagtgagaagcagtctccactctttttatatccacagtacctgacacaatccttggcacatggctggtacttgataaatatccattaagtaaacagatgagttattaactgacagctaagatgtttcgaactggtatgtcttaatacgatgacaagtatccatttattcttatgtaccactgttgctgccttccactgagaagctttcctgagaatgagtgggatctcaggttgagagctagaaattgcttataatccaaggttctcccctgtgagtgggtggagcaggtgaccattatccatctactatactctgacagagacaggttgacaagctccatcccagagttttattgccttcatgaaaaaaatttttaagccctactctggcctcgcctatcaatcatcacaactactttttattgactgttccttggtcttgagcaaagcccatggcatgcattcgcttacttaattgtatggcatggtttgtcagtggcttttcattaaaaagataaattgacattaacaagcattgatttccaaagatttatgttgtcttctctattgtgctctctcttggcccagtaagattttacttttaaaaggcattttgtaaaaatacaggaatgtggcttggcaaagatgtatatctttaggaagaattatctctgcctagtgaatatattgtagatttggcatttgagccttatcctaacagaatatttgctttgctaactatacatcaggtgaaaaaagagcatgtttgggtgggaatcaagagacttgaattctttagtcctatccatcctgattacagactggaaaaggaaagatgagctggatggttttaaaatttccctcctgttttagaattctgggcacataatgtttatttcaaataagaccggataatcagaagaattgaacaaaattcttctcgttgtagtttctgggaagaaatcctaggttgtttgactccagtgccttcatcttaaatgtctgtgtggtaaaatgaaggtacatagcctgccctctcagggccctgggtgacattgtcaccttcatggcatgaaccaaagacaaagcccaatggcagagcactagaaaccttcctctctgaattgaaagccatcacttagttaccacttagaaagcacgttagcccgttctgattccacttgagtgtatgactaactgacctcaaattgtttgtacattgaaagcacagatgaacacagttttgtttttgttttttaatagggtctctctttgtcacccaggctggagtgcaatagtgtgatcatggctaactgcagccttaaactcctgggttcaagagatcctcacccctcagcctcctgaataggactacaggtgcatgccaccaagcctagctaattttttttctagtttttttttttttttttttaagagatagagtcttgctctgttgcccaggctgggctcgaactcctgggctcaagagatcctcccacctcagcctcccaaagtgctgggattacaggagtgagccacagtgcctggctgacacaatttttaaagtgtaccattatgttgctaacattgcactatcttattctcaaatatatggaaagaggttttatcaaatagcttgtgaggtcagcatagacaatagcattcacttgatctagtaatcctatctaaaaatagaaaatacatttgtttcggcaatacagtatgtcattgatgtagaaattatgaatgtacaattacaggataaattaaaactgcccagcccttaagttattatgggttaatgcgagtggatatttgtcatctgctgtatgaatgtcagcgtcatacacagatttttagggaatgctgaatgtcagacagctcacaaagaagcaaagatcataactcactataacctcaaactcctgggctcaagtgatcctcttggctcagctcttgagtagctaagactacaggcctgagccaccaagcccaactgttcctcagattttgacctttcctctgagatgatctaaatctgcagattctgtgctatgaaaacattgtgtgctttttaatgacttaaaatattattggtagattccatgagatcactgagatttactcttcattggttgccctttctacccaataggatattttatgtttgacctggcagggatcattatttcaagttgtcccaatgcttttcaattttcaaaggccactgactatttagtggattaaaggacctaaatgacttcatcctacttctaatttccatcctagaaggtaaacagatgagacaattgaacagaagattgcatttgaataatgtgaatatattttaaaatgtgtggccttgtcttagtgtgaattatcatcagcaatagaccaaatgaaatagctccaatttttgtgcagtttgtgttttataccaaccgtggaccacccaagcagctgacccaacaaggcactggttttctgtagactttagtctgagggccattgacttacatatctataagtcctgggtactttcctgaactagcaaaagcaagaatgctaacatcagaaagtaaatttcggatacttcaacaagccacatgttggtaaatttcaaatattttgtctaactgcgtgttggatagtcacgttcttctgtaaattaatggttttcagtctttggtgtatctcagaatcacctggtgtgaggctgctgggtctaggatgttcatctcccttcatttgagtaggtagcttcatgaaagtcacacttgcagtagagtcaaaggaaggtgacaactacatgctcactcagatcacctgaatccaccctgccagttagagggctggcaaatatattcctcctagtctatcaatagcctgtttttttaattgtaaaaagtacataaatatattgttttaattatatttaacaaattgtaattcccagttcatgaaaagatcttaaccaatcttaaaactctctatcagatttctgttgagggtggggaaatacattcgaatgttaagtttggtttttcaatttttatatatttgatagcactaaattttatccattttgtttctaaaatacatctccaagcagataacagagcctgaattttattataaaatatctttgtaatggttttattggtttatcttttcattttttgctcttagcaatctgaagataataatttcagtgtaactgctttgagaggttgaagggcacaggttagtaagatcaaggctgagaaaaacttaattgcaccatatactttcaaagaaacagttttgacatcttgccccaaagaacgccaggagcccagtggaatccatcccagggttggatgatgtttagaggtcagtaagagcaggtgcacagtcacttgacctgtacagtcagaggatggcttaggtcaataggagtggtgatggagctggggccatgcctgctgggttgtagggcttcctacctgatgttcttttttccttataaccatcctgctgaactggtcacttaagacctagcgtatcttagagccaggacaagctctataagcatcttgtccatggcctcgtgactggcaagtgacagagccaagattagaaccttagaaccgagacctcccaattcccatcccaaccatcagagccaaccatctcaatagatttttgagaccctaaatgtttagacagggcctgattgtaaataaaccagtttccatgtgggtcccccaagccatttgtgtgtgtgtgtgtgtgtgtgtgtgtgtgtgtgtgtgtgtgtgtgtgtactgagctcttctacatccctttactcaccatatattggaccgtaagcctgtgcctgccttgtactatagtatccatagcttatttatgaaatgtcattgagccagtaaggggaaggtaccagtgacctgccacagcagcaaaagaacagactcctatagaatcatcacatacacccttaatcccactgaaattgcattagcatgccaccacatggccacagcgacccctgccccctttcccttgcagtgacaatttactggatcaggccttgcagtgaggggccagcttctgaacttgcagagccaggtacaaaatgaaaatgcaggccagttgttcaaaaggcaggaaaaaagggccattcacgatactaaaataaaaacgtttccctttcttccagtttctctctcgatttgtcaagacatttttgtttgcaacttaatgtcattttaaattattagtgtgaatcttaccaaccatccttcaattgtacagtgcaaattttagatgcaagtttaagaccatttgccatgtatgtgggatcactgacacacaatttgtattttgtagctagtacatacgtgtattttatacgaactagaacagtggaaatgctgcacaaagttaactcaattgttttgattttacttattgatattagcacatcctcaacactccctccctgtggcttgctagtaagtaaggaagaactgaaaggaaaaggaactcggttgccctatctttccctttccttctggattattttcagtttaagtgcttggccaatacagggaagtaacaggagtaaggaaggatatggtcaggttccttggtcattcatgtctcttagaactccagtaccttctttctgcatttgaagcaagttgagcttagaacagaaagtgtgacctttaggactgttcacaccagtgcttacttagtcatagatggaacatgcttaccttttacggactttgagtccttattgaactccccatgcaccagggattcacaagaattctgagctcatgggacatcatgaatgtggtatgcaaatgaggtggcaaggagcacgtagctcctttgctcacatgcgtgcatcatggtcccgttggacttcacttgaaaacacaggttcgaagataaaatgattaagaatttcaagacagtgccatcagagtattaaaccaagcttcaggcccttctgagggcaaggctctatgcacatcacatgcccctgaagctgaccctgcttgcctgattctctgacatgaagaaagaaattccactgtgctttaaaaaaaaaaaaaaaaaaaaaattcaggacagatttaatttggacttgagtacccaggtgttagcaatatcctacagattccagaaaacaatttagtccattgttgaaagagtacccttgaaggcatgtctttttttaatcccattatcttattcatctcagttccttttatttatttgcaacttagtcaatctcaggtctcacatccaaattggacctcctcagggaggaccatgctacaatttgaggacagagcacaggtctggggtgggaccgggtggagtggggagtgcccctagaaatccaggccaggcaagggcacagaaatgaacttttcagggtcagggaaagatctagaaggacgtgaaatcaccagctagtctttcctctctctacctctccctgggacctgtatgatggtggtgggagcataaaggactttgaaaatagaaatagcattttgtaagtgtcatgtaggaggtatcatgctgaggtgctgcatgcagtgttacactcctaacaatagccttatgggggaagttctcttatgagtccttttggtagacaatgaagctgaaactcaggaaggtcacatggtatcataaggctggtaagcattggagtggggctggcagggatgctggacaaggttgcagacatgagagccttcctgagttgcggaagtgtgtggccccatgttttatcagagtttgaaggggaactccagattactaggttttggggagatagttgcaagtgatggaatagccattctgagtgaagctttctttggtggtgacctggaatctctgagttcaacagttgatgctgctgatcacctagtcacctggggccttattgagcttttgttcctgccatcattgctgcctgactcttggtttccctactctggcatccagtggcctgagtcaaggttcagctcagcttctgaccagcttcttgaccaccttggccaagtccgtgtacagctccctttggtcttcgtttcttcatccatgcaagggggatggatactgtcatgaaggcaaaaatgaaagaacttgggttaaagttattgtagtagtgctggtgctgaggagaccctcagctttgagtgttggcttctgtccattcctcctgagctactgtcacatctcatgtgggtgcagtgggtcctctggacacagcgttgagcccagtccatgggttcctcatatagccagcaccttggcctgtagcaaataaaaacaaaccacttgaaaggaactcgccaagtatccctgatagctggcactcacagtttgtttgtgtgatgactttgcgtattagtcattttcctgttgcttataacaagatacctgaaattgggaaacttacaaagaaaaaaaaattatttcttacagttacggaggctgagaagtgcaaggtccagggggctgcatctggtgagggccttcttgctgatggggacagtcccaaggtggtacagagcatcacatggcaagggggctgagtgtgctaactcaggtctctcttcctcttcttatgaaaccaccagtaccctcccatgataatccattcatccattaacacattaatttattaatcatgaatgattaattatcatgacccaatcacctcttaaaggactcacctttcagtactgccacattggggattaagtttccaacacatgaaatttggggatacgttcaaaccataacagttggtgatagttgcagaggagcatgtacaaagattagaaaaatataaccaacccctgggtttgttggatgctttctgttgctcagatcattgtgacatgagcactgtaggaggggtggatttgaaggggtctggttccccaagaggtatgtgggcatctgtgtgcctgcatgagaaagcacctttcctggcagcccgacaggtagaaactcattaatccacacattgactctatttcagggaaagatgacgtcaactcctgcatgttgaaggcagggagtggctgaaacagcatcaaggcgtgaaggcttccctgagccaccctgagttctcagaagggttcttaaagaagtcacgtcatctttatcgctacttctgctgcacttatcccataattttccaacttctgttgtgagaacttttacagcccaagtgtcctgtgatttaaccttcaatttggtaatgtctgtcttcctttagcaaagcaggctgaaggtgttgagatccgcctaccttgggaagctttccatggtggcacagtattgaaggttaggcctcatccaagttggcacaagcctttgtctccaacctgggtgggaggaaggtcaaggcagatgagtgtcctttcagtgcagggaactgccatccagggaggcttgcatttataactgagagacagcggggtgagttagaatgctaagaagggggaaatgggctgggcgtggtcacacctgtaatgccagctatttgggaggctgagacaggcagatggcttgagcccaggagtttgaggctgcagtgatccatgatcgcaccactgcaccccagcctgggtgataaagtgagacctggactctaaaagaaaaaaaaaaaaaaaaaaaaaaaggaagtcggtagttcaccaaggaggctttctaaaggagatggactttagcccgtgcctttcaggaggggacttggagctggggagatggggagacagtgcgattgggattttggcagatgatataaggcaaatcctcagcagagcaccccgggttccaccagctttgtggttgagttgcagactctttgagtgagagaataacccagccccggtggtttctgctgaaccgagaaggaactgctccagaaacatgacagggattccaataacggcggttaaacagctaacaaagaggagtctggaaggctggcccttgttcatgttggctggaacatgctgggtagatgagttaattgggggccctcacagggaatgctcattgtgccactcttaatgagagaatccaagtgccccatgggatgtaataattaggaagcatgttgtcagtagatcagctgtctgtctcctgatgtatgccttgtgtacacaggaagaaatagaagctttcctttaaaaaaaaaacaaaaaaacaaaaaacagggtctcactctgtcacccaggctggagtgcagtagtgtgatcatagctcactgcagcctccaactcctgggctcatgcgatcttctcacatcggccttctgagtaactggaactataggtgtgccccgctacacttggctatcttgtatgtatgtatgtatgtatgtgtgtatgtatgtatgtattttaatagaggcagggtctttctatgttgcccaggctggtcttgaactcctaggctcaagcaatcctctgccttgacctcccaaagtgctgggattacaggcatgagccacactgtacccggccagaaactttcttaaagctagtttaaaaaccgatcatttggtcctcatttcccattttggctttgtttcttcagtgtggctctgtcatgttggggcccattcccctcaggatgctgagacgtaaggtaagggtattccttgtctccttcactctacctccctagggtctctgtgcccctggaaactcagccctactcaggtccccgggcagtctagactcagggcaatccacctacctcactaagacccaagatcatcgtgccttccgttttgtcacccataaaacagagctgatgctttctccttcttagggctatgaggtgaactaaatcaagacacaaatgtacccttctcaatgctggacaggttgcccttttaacctctccatccctaccacctcttctaagatgaaattccttaaatcttggagttggatgacttttccttttccctctatttcctcttcctcacttccatttcagaaggagaagcatcacatcctgccacccacagctggccctcttcctctcctgtgatctccattcatcatctgtccatcttcaccggcatcttttgaaacctgtctttcagtggccgtcactgccttttcagcataagacatgtttgggcctctcttcctgactgtgtttttctccttaagctgcctgcatctttctctggccttcccctcaccaccaaatttctttagaaagtgggctgcccctgcttcctcttcttcacctcccaaccgaacttctgtagcccccctgtaaagtggtttccattccaggctttgcactgatgctggcaaggacatcggaattttccatttcagtggcctttgccaagtcctcgccttctggttgccttgactgtggggacaccccctccttcttaaaattccctcctcctctgtgacagggccctgtcctggatctttgccaacatcttgtgcgtccttcgagggtggttctcccactagagatcccctgaattaggaggcacctgaaaggttttctcctctgtaccttctgccttggcatcccacccactcctgtgatgataataggttcctctctgctggtggtaacgctcaagtcttcatttccaaactctgcttaggttgagcagctgcacagacaccacccacatggcttccaaacttgatagtccttctcactctccttatctggtgtgggtaggattgtgtcccccacccccctcaaaaaatatgttgaagtcctaactcctgctacctatgaatgtggccttatttggaagtagggtctttgtaggcataatcgagttaagatgaggtcatactcaatgagggtaggccccagtccaatgtgactggtgtccttataagaagagacacagacatacacacacagagaggacaccatgtgatgacggaggcagagatggagtgatgcatctgcaagccaaggaacgtcaggattgcaggctgaaaaaaggatcttcccctagagcattcagagaaaacatggaaaacacggccccgcccacaccttgactttggacttctcagctccagaactgtgagagaataatttctgttgtttaaagccacccactttgtggtactttgttctggcagccccagaaaaccaatacatcacccgatctctccagttccctatgggactcactatccttttagggatccaagctgaaagtctcaggatcaaccctgaatctctccctcttgccttaatacccagcttttcatttctgcctcaggtgagtatgcagtccccacctcttccctaatcaagtatggtcgccctgactctgccctcttcagtctcctatctgtccatccagctgccctctggacaattttcctaaaacagctctgattgtgtcaccatcatcgtagcacactttgtctgtttccctcctgcctccagcagttggctgcatattggaattacctggggagatttgaaagctctcatgcccaccacacaaccccatctgtcaaatcagaatctctggaggtgatgccccagcatcaatattttaaaaacttcccctatgattccagtgcacagctaggcctgagaaccatttgctgatagaatatcacaatagccagacaaagcttacggaagaaaagatagctctaaggcaatggttctcaactggggatgatattaccctccaggagacacttggcagtgtttagaaacattttaggtcatcagaaccggggtggtgctcctgggcatctactgagtagaggccagggatgctgttacacatccacaatgcccaggacagcctcacaataatgatccagccccaaacatcactagtgccaaggtggagcaatcctgatttaagagcgaggagaggagcagcaataccgaccttgactttgggacagacagatgcagtagacaccagtgctgaggaggcacatgccccctcatgccgcagtactgcctgtgctgtgcccatttggcagcccagtatgttgaaacttttcatgcagcaccagtttccatcacaggaagcctcagcctgctggtgccaaacttattctcttgctctccttttgaaaatgaggttcagtggaagctgggtgcggtggctcatgcctaatcgcagcactttgggaggctgaggcaggcggatcacttgaggtcaggagtttgagaccagcctggccaacatggcaaaaacccttctctactaaaaatacaaaagttagctgggcatggtggcacacgcctatagtcccagctatttgggaggctgtggcaggagaatcgcttgaactcgagaggcagaggttgcagggagccgagatcatgccactgcactccagcctgggaaacagatcaggactctgtcaaaaaaaaaaaaaaaaaaaccaggttcagtggaatgtttttgtcaggagagaaagggtcattacaactcaagttggcttttgccaaactcagcaatcactgttttggtggctcctgaggctcctaatgaggacactgacagtcgttaaataaacaagtgattaagttgagaagagactggctaacagaggttccatgtgtgctcattgtcatcgatgttagccagtttcatgacagtgacctgcctgggctccacctctaccattaaagagaaacactagcaatgacggcttatagttcacgtagctttaccatttataagcattttcctatacaccaaccagtttgatttgtcttttcaagtcttagctttatgcagtgtcatttcctataaaggaaagtatagcaaatatacaagaggtactcagaaaatacaagaagaaaaaaactaaaaagagtaagggatcaaaagatatttttttaaaaacccacattggatgaaaaatgagaaatttaattccggtaatggaggacaaagtctttgccaaattgataaagctttgggaaattctgattatggaaaggacccaaatgtagacagtcacattctaaattcctggctccatgctatgtgtccagtttctgtgtttttaaatgtatgcagcatttttaacatcacagaattattaatatgttgaatatcgttgctactttatataaaaagtatcttttctgtctactatttaagaattcttgctgtatttatcattctgttttctccaagtagacagagggccgatgtatttgataccagaacacatctttgattttgtcatggggagcagtgtgaaaataggagtcacaagaccaggcgtggtgactcatgtctgtaatcccagcactttgggaagccaaggtgggcagatcacctgaggtcaggagtttgagaacgtctggccaatatggtgaaaccccacctctactaaaaatacaaaaaaaaaaaaaaattagctgggcgtggtggccccacgcctgtagtcccagcgactggggaggctgaagcaggagaatcgcttgaacctgggaggcagaggttacagtgagccgagattgcaccactgtactccagcctgggcaacagcgcgagactccgtctcagaaaaagaaaaaaaaaaaataggagtcacttaacacaaacttattttaagcacaatttatttataatttagaaaaaagaaaaattgctgtgtaatggggcttgaagagaaaaagaaataaaatttgttgagggaggtgtagagcttgttctgggtattgatttcctttgaggggcaataaggaaggattatgccagggtgtttcttgttgcttaaatgttccatgaaacaccaaaattgcagaggtattagtagttagaaagaatgtggaaacatccctccttctgattaatgactgccccctgaggagtccttcaaaagccagaagaaacctaaaatatcatcctagaaagttggaaggaggcatttgacaaagtctttgctagctatgtgactaggataaggatgtgtcagtatatcattatgcaacttgatgaattctcggtcagctgaacagtcatagtcatattagcatagaatagtgattcgggtcaggcacgatggctcatgcctgtaatcccagcactttgggaggctgaggcaggcagatcacctgaggtcaggagctcaagaccagcctgaccaacgtggagaaacgccgtctctactaaaagtacaaaattagccagggtggtggtgcatgcctgtaatcccagctacttgggaggctgaggcaggagaatcacttgaacccgggaggcggaggttgcagtgagccgagatcacgccattgcactccagcctaggcaacaagagcaaaactccgtctcaaaaaagaaaaagaaaaaaaaagtgatttgatttctggcctttaataagtgcttaatgaatcttggatgaataaacgaatgaatgaacaaagaaatgaaagaatgaaccagccaactgaccaggacgatgtccatagaggtctacatgggattccctcaccttggtcttgttgtgttcaacatttctatcaatgatttgaatcccagacacacaaagcatatttactatacttggaaacagaacaaatctgggaagatcattaatgtaatagatcacagaagaaaaatccaatatgatcttgccaggttaaaaacagggccaagatgtacaggcatcagccaaagccctatgtatgagtttaacatgtcaactggaccttgggagcctcctattttgagggtgatcgtgaaagagactgggaagtgttatatccttccccatcattcagccttctcacagaagttccaaaggctatttggtggtaaaactcctttctgcttgctagtcctcatcctttttcctccttttatggtatttgacactattctacactgttaacttgatgcccttcacagaacctttctcgaatttcatgattccactttggtcttatttccctcgttttctaatttgtccttctttgtttcttttaccctctttttaaagtttttcctttacctttacatttaaaaggtagtgtaccctaagctctaatcttggcatacttgaaatctgtatctctccctggttgtttaacattgatttaaaatagattttgttgagaacccgctatgtgcccagaagtgttccaagagctcttagaatacagtggagaataagacaacaatttctgcctttaaggagcctgtattctaggaggatgggaagtgatgaacaaataagtgaataacagtgttgagtcgtggttaaagctatgatgaaactcaaatccagattaaggggaccaggaatgtcagggctgctattttagacaagagtcagggagagtcccctgagaagatggcatttgagcagaactgggcttcttgtactcccagggctgcctccacactgaagactcccggatgctgctctctggccagctcctctcttctggagccatattcctgaatgcctcttagtccctgcaggatgtcctaagagcaccttcaaccacgcttgataatctcccctaccaaacttcttccttctctttggttccccatattggttcccagcatgaccatctcctcactcacccaagctagaaactctagcctccccttcaaatcctcctccacccctactcatacagatccaatccaatgacatctgggtcctcacttcctccccgtgccatagttcaggttcacactatctcttactggtactgttgcaggagactcctgactagtttgccagcctctagtctcatactccacccaccctgtcttccacgttaccaatagaatgacctttgtaaagcacgatcagctctgctcttgagccttctatctctacctactgcctctagggctagcaaggtgttcaacctacctggttcccaacctactggctcagccatctcccttcagtccctctgtcagaaaaatcacttcctgaccctttgacagtaccctctttttcctctcatatgcccttcagtttttcctagaactctttccgttcctctttcctgcttttcccttccctaccctacccagcaggtttctaagcattactgcaatagccaactcaactctgcaaagcttttttcaaattctcttccccctccatccattttctttgttgtgatgccatagtgcttgtggcaggcaggagcaccctgttttagaagagttttctgtgtcccattagccgtgggttacctggagacaggcatcgtcacttgtgcatgtctgtgctgcttgtagatgttggcactagggaggttacttcatgcatgtttactgagctggctgcaattatacagaagacttacaaacatataagtcaaaccacgtgaaactgctgttcttcttggtcaatatcagcaatttcatatgtttattctaatctgttttgttcagtattttgtattcctgttttggctttcagaagtgttcttaccttcaaccagactgccttagagcatggggctcaaagaaatattttcagctctggaagacattttccatcctacttctacatatagaacttttctggccaaaaatggatgcatatctcagaaatgtaataagcaatactcttctctcttcctcttgacaattgtttttcaaatggtttatcataaacatcagtgagatcttgaggctgttataaagtgatataatggtaatttctagaattgtaatacattatcctagtgaaaagaaaatgatgaagttgtgaatcaggcaaaagtgatgaattgctcatttccatgtagtttttcaggtggaaagtagatgcaggtatcaactggaggatgtgtgaatattttgtctaatggttttgatctcgatatagaactagagttgttcttaaattaagaatgtctttcatattctgccttttcaccagcatcactattaaaataatattcttaagcaacagccaaaaaattattaggatctgctggttctataatcagatgtttttgctggacactttaaaaaccaataacagctaatcacagtgtcctcttttgtgctgaattgaattttgttttggttttaattctcatttgaactgctgggaaagcaagcctgttacataccaacacttgccacctttctatatttgaatggacctaagtagtctttgcaaaaaatgtctaagactgtcctatccggacacaccatagggttttcccatggaaataattatatcacaaacgaatcttttttctaaagtctgtggttttaggctgccatacttctcaatcccctgaccaggagacaataaaattggctggggccttaatttgagggaatacatatttgattgtgggcgtggtcttctaagacaatggtaaagggaaaagcaagatgtaaaattaaacgttgaaacaagctaaactggttttcaaaatcttctcgactgtaacacatctagaagttctaaatataagaaggtttgagggattatctaaaaccaaggtattaaaagatcaggtttttagaagattttgattcagtaccttatacttttttttcaaggagttgagcaagaaaccatcaaaacttaggagagtgattttaggagagggtggtctccaacttgtctttatgtttgcttccaagataagtgttaagcccaaccaactagcagactattcatgatctgggaatcctatcagtggtcatccctgtatttgacttgagtctctctaattttttatagggacggcgaaggccagttggtcagccaaatgcataaaaaatggtgcagaaattagtgatgcttggaaacatggctcataatcatgataaaggcttatatgttggtatgggttgagaatgttggcctcatggtatctgggtatgcaagaaggcaaatcattattggtatactagcctttatgttgaatatttagagagctcttgaaaacaccccttcgatttggagtgaggaattctaatgagtaaaactccatgtagaaataaccatatccgattaaaaaactattttgattttcattccaagaaactaccaaaatgtcagctcgatatacttgtgaacatgttatgcttatttttaaataaggaagggtgcctttttacaaattaggcttgagtttctcttactatcatatatattaactatagacaagggagtgggttctaataacaaattgctacattgctatcgttaaatccgtgtttgagttttcttccctctaatgtattttctccccctctttaatttatatttttaaaaagcaatgtacttatctagaaattgtatgaaagacaaatatttaagaaagtaaatagagactatgggcacgtcctttgaatatgttttgccagggtcgaggggtaaatgaaataaactgatacatcataaatggaccacacaggaaagaaagtgtcatgcctatgcaaagacatgcattctccttagagacgacatatattgctgtcgaccaacaaagtcacgtggtgggagggggctcttttctttctccttcacatcccctcctctgatgtcacaaatctattttttcctgggagaattaattagcattcattgggtgtacttggctagaagaaatgaggtggggagaaagagagagagagagagagatcgagattgagatcttaagaaagagagcaaggaggaagagcccggtggggagcaggtccttctcccccacccccctacccccaactcccactggagccgcattgagactgtaggcaccaccgggcgccgaatggctgttttctaactgggatcctcggtgacgtatggctgcctgccccttggcagctgtctttatggaccagtaggcagagcgaaattgacgctgacaagacttttgcatcttggaagggactgtaatctactgtagtgaagaacagagcctctcaatcagacgggtgtaaataagagacggaggggagtccaaaagaaaaggaagaggaggaaaaacaagtgtgtgttggggggaacagggggaaaagcatttttggtggatggtatgaagccagccatggaaactgcagccgaggaaaatactgaacaaagccaagagagaaaaggtacccagcgctctgacaatagcctgtttaaagcttttcactggggggtgcttaaaaagggttagctgggttttgtctctcttttaaaatggctctgagacaatccctatggcatggtcttgctttcagggttgatttttttcctgtgggctgatgttaagttaatagagcagcctttcttcaatccattcctgttccaaatctttctaccgacgtgatatttcatagagggatgtctatagtttgtcaccttgggctgatgcattggggaaactgtctttttttattaatataattaatcgtaacttaggtcttgtgtcctgcatgttatattccaggaacgtggaatgtgtagttttctgctaatgctgaggaggaactggaggggcatgcatgttaattctgctttggttccgctaatgctgtagtgatttgggcattctctaattttcttattctaatatgattgctctttcttgtatcaggccctgactacgacatgtaataatcatttacagttggagcttcagagaggggacatcagctctgtcacccagtgctgatggaaaggcagggcgggggatcttctgctaattatgacttggagactggggggaagaaaattgataaaggtcctatttcttaaagagaatcttagaacgtaccacaattttcatatacagaatggttttttggagaataaagtgtttttgcagtaagaaaatggcagaaaggaactaaaattaatctcttttttctaaataatgactgatttcaagtttgatgtcccatagaatcggctcagccactgttaggttaatggatctcactgcattgtaattttccctcactcaaagtcatagactgtcataaatgcccaaaaacatattctgtaaccgcagtggctctaatataaaaagccatcatgctaaggttatttctcacagcccttgcgtccactgatagtcactaaagagtaattcgccagtacggggacaaaacttcgttttatttataaagatacaggctgaaccatatgaaattgctgatagtcaaccattttaaacctacaaaaacggcaattacatgtacttcagcttcacagtatgctggggtaaagactgcttgtttttatataaaatttctttggtacacaataatattttatcctaaacagagcaattttactttttaaattaatttttttaggtatcacacaatacacataacataaaatttaccattttaagtatacgattcagtggcattaagtacatagcaccttaattttaaaatcgtttgtttagttcaatcctcttaccaaatctacacctccccaccaaaaacccagcctgtattttcttgtgtgtctttaaaaaaaaaaaatcttcatcaatgaccaaatagctataagagaagctcttgggaatatttatcaagatgaagaagtgagatcaaagttttttccatgatgactagagactaagttgattgcatgttgtcggggtatgataatgtaatagcattgtcccaaggaagcctatcacgattttatcctaaaatgatgattttacttagtacatacttttaatttttattaatgtggtattcaaccatggcagataaaaccgttttggtctttgcaaaaaaatcccttttttaaatttctctctgaaaggaagcaaaggtcatataaccaatataaaatcattactacacaactgtgtatcttatcacttagtcttatggactgctattattttatgtcaattaaatcttatttaataacagatctacaggttgctagtacatccctgacaacccgtatatgaaaagtcattagttgtgattttagagacaaaattagaagcaaaagataatttgtgaaggaactttaaaaattacctaaatgtataaacactagctgcttgttaaataattcaaaaatatcacactaccagaagctagtgtgacatgtatggtacatgcttgaataagaatacaagccaggggatttgtttttcctgatctacagcaagaggggttgtgattgttgtgtgacccaccataattgttgatctggagggtggcttatctaatctgcatttagatgaacaagttcatatgctggctacacaaaatcaaagcccacacaagacactttgtagtttcccaatttgctcacccatcatcattaaggtacacataggataaaatgatagccacaaatgtttctgcgtgattgtcacatcagtattccttcagatttaactttaagtttattaaaaaattatttttccattgaaattaacatttgaaaacttgacataattatttatagaatgtgttatataattcttgagctggtggatccgttttttatgtttttcttttaagcctttcagcaaaggattttattcattaaatttaatcctgtaaattttgtcactttacgcagagttttttatgcacatatatattttttttcctgtgtttctcctttcccatctgttttcagtggttggtgatggagtgatgcctgtctcttaatttggggcattattgcccaatggctaatacccaatagcatgtgaattaatatctttggataattattgcagtgtctattaagaactaagaatgtaaattaaacttagctttataaattgaccttgcttttctagttgggatctttcctgggagtttcagcgggacaacacaacccagctattgtgattcactaactcctacaaagagagctctttctttaaacttaatcacaatgactttgtttctactttagacaaaattaatccatgtccttaaaaaaggaaagcatttgtgttttttcagtctgatagttttcatcacagcatgctaccagataccaaaattcacaagagtatttagtagatatttagggatttttaaggaaaacaagcagattttcttagatggatgtaagaaatgccaaattattacaaatgatagtttttaaattaaaagcattaaagtgtgaagattgagtaagcagattcactgacatggaataagcagaggaaatgaataagacagaatcaaaagaaatagatcatggaacccaataataaaaagatggagagtcggtttccattgatttcagtggagtattacttgttgtcatttcatttgtgaaaataaatgcatctgaaattgctgagagtggataatcactgagtagaaaaacaattgaatcataacaactttgtatgctctattatgggggaaaaatctatctgttatgaaaattattttcattatatgtaggtaattgaattctactgaaacaattatagtcaggttagttaacttcctatgaatcgttgctgaaataaattacaggcatcaaattaaattcctaaccacacaggaagaaaaatatagtgaatgggaaacaatgtgtaatttaaaataaattacaggatatagtcaaagtaagaaatgaatttaaattattgacttccttaaaaaattaatacatctattttaatctttttgatcaaatagatataatttcttatttttttttttaatttagcaaaatgtatgcacttttggctctcatttttcgtttaggaagaaaagcactcctctagaatatacgacttgtgtgattaaaaacccaaagggacacataacacacgtcacactattcctgatgatctgcgaattattgcattttgaaatttgtgttgacattttctaacttggctatataaatatggtacagaggaagttttagatgcagttattatctgtaagaatttgccaaggtggacatctgaagagttggtgtctggggaataggctgtagagaaaagtggctggccagatggtgcggaacatatgtggtaggtatgatacagcttcctttgattttttttttttttttttagaacatttaaatgtggaaaagatctcaacgagccatttggtacatcttctacttttacattattaattccattaggatttttttaaagacttggccttgctatttcgttagaaaaagaattctgggccatttctggaaatttagatttgccttccctgaaattgagtgtaaaccctgaattaagattattatgattttcaagatcacatttctctgttatttggaagtacagggtcaatttagactaaatgatcttaataaagtgactttgtcttgatgtatctgagaacatgcaaaataaccagtgtccccatgacttaaacttcccctctctgtgactgtgatggattggattggattgttacaaagacactctcgcttttttctcctttggaccaaatgtacatacatgggagatagttggccaggagtagggatggccatggaacggaggaagaaagtgaccacaccgactgtttttaagagaggaaggttacaatcccagtttcacaaatgtgctttgttgttcattcatttattcgtttaatggtgttctctgccgggtgtggtggctcacgcctgtaatcccaccactttgggaggccgaggcgggcggatcaagaggtcaagagatcgagaccatcctggctaacatggtgaaacccagtctctactaaaaatacaaaaacaaaattagccgggcgtggtggtgtgtgcctgtaatcccagctactcaggaggctgaggcaggagaatggcgtgaacccgagaggcggaggttgcagtgagccgagatagtgccgctgcactccagcctgggtgacagagcgagactctgtctcaaaaaaaaaaaaaaaaaaagaaagaaaagaaaagtgttctcctttgaaatgtcattcttcctctgtcccttcagctcacgttacaggagtacaggggtgctaagtcatcgtagggaccattaggggtagtataatcttggttttaataataattttgctgattggtggcagattaaatagcagacaaaatgccatagacgagaattttgatccttagccagctgagtgatatttctcgtcaaagagtgtataagagaaaatgtaataatttcctatttgataagctgattttatcaattgcattaactgctttatgtagccaagccttattatgctgtatttaaaatcaagggtcaacacactttttccgtaaaggtcagatagtaagtattttaggtgctgcagaccactcagtgtctgttgtaactattcaaatctgccactatagcatgaaagcagccctagatagtatgtaaacaaatgggtgcaactgtgttccaataaaaccttataaataaaaacagatggctataatttaccaacctttactatatttatagcattgttatggcattccttaatattttaaataatagctaaaaatgaaagataacaaatatagctttgaaagaccttgctcagtgaatatggtctttcttggaagctcagtgtttgtcacttagttgcttccggtgataatttcctaggtgctaagaagcatgacagtctgaagttcatttgttcagccttctcgctaaattacattaaataagtaaatggggaaaaataaacaaggcattgttttgctttcctttttgcaatttccccttgtttcatgcccacctttggcaatgaccactcacagctgtgtctgtcttcataagccaccactggtcacctcatctctatcttcactctcttagggggaacattttgcagttttccctctgcagggcataaaccattttcccatttcttgccaggtgcccagaatcaagacattttaaaagaccttttgagccaaggcatcctcttggaatcctgtgactgccttttaggtgttgggatcctgtccttgggattaaaatgtatactgtgttttttgaaattttataaataactttatatttaatgcctttatttaaatttggctcaaaaatataaaatagaagtgatttttcttttctttcatatctaaagatttactgttgtaaaaaggcccctccagaagtgtaagtccaggggatttggaacacatccatccagttgccgatcccatcggtgtgtcttctggatctattctttttttttttttttttttttaaatcctgaattaagggtcttaggcatggctgccatgtttttctcagaaaacacgttaacattgagcagtccatggtttttcattgtcattgcctagcagcctatgcttgcttgcctgaacatctggagacttaccccatccatatgaggagatgagcacagagcatggatgaatcttctgcagagataccctgaattgcatggcctggcttgggtaaaagtcagcatggtgggggatctagaggtccatttctggtccacagggtcccagggtgctcccttcctttcaaccaaatatttattcagccagcgtttattgggcacctgtgtgctgagtatgtagagacaaattttttaaaaggataaaaatttccagatcaaaagtgatagaactacttagaatcctcttgcttaggggtctatgtggagggctcatagccccctttaccaagaggaaatcagatcataccatgaagtgccttgaccttctgttttttttctgtcagccccactgggttttcttgcctttggagaatgtagcaacatctatttctgagagagaatctcctgaacagtaaagcaaaaatctaaatctgttttttgggggttttttttctttctttttttgagacagagtctcaccctgtcacccaggctggagtgcagtggcatgatctcagctcactgcaacctccacctcccaggttaaagtgattctcctgcctcagcctccagagtagctgggactataggcgtatgccaccatgcccggctaattttttttttttttttcctgagatggagttttactctttttttttttttttttgcccaggctggaatgcagtggcgcgatctcaactcactgcaacctccatctcctgggttcaagcaattcttctgcctcagcctcctgggtagctgggactacaagtgtgcgccactatgcccagctaatttttgtatttttagtagagacagggtttcaccatgttggccaggctggtatcaaactcctcacctcaggtgatctggctgcctcggcctcccagagtgttggaattacaggcatgagccaccacacctggccaattttttaatttttattttttatatattttttttatttttagtacagacagagtttcaccatgttggccaggctggttttgaactcctgacctcaagtgatccgcccgccttggcctcccaaagtgctgggattacaggtgtgagccaccgcacccagcccacaaaaatctcaatctaaggaagactgaaagttaagaaattttaagaagcctgagataacatcagtagcttaggacctggaccgtttctttaggagacacagaagcacaactcaactgcaaatgcacctcagaaaaactctcattgggttaactgttgcctcagcagaagagtagaaaattgcaatacatgcagaggtcacagtaggatgtatggtggtttccaaagtgtgccctcttgagtgaaattgctaaggttcacattcaggcttctctacctcctggctgaaagatcttgggcaagtgatcattaccttctccttgcccttgggttgttcccttgtaaaaatggaataataatagtacctatttcagagggtggttgtgacaaatgtaataagtaccacatgctgagtgcagtgcatagtacatcataagcactccataaatttttgctgtcatcatcattgaccacaaaaatagtttcattgtgcagttctgatcttatcccagcatcttttctgtacctccctaccctggttttaaatgagttatgtataccttaccttgaagtcaaaaagattttttctaaaacattctagaaaagcaggtttctgcttccaaacttgaaataccttacaagttttcagagattgtggagagtggagttgggattttataaaggctttgtgaggttttacttgcctcacactgtggctttagtaggttcttctcctcagagacctgagctgccagatggtgcattatgacctgatcttctgatggaatcattacccacatcaatggcacaatttttttttaatccttaaatatttgtggtgccccagaggatataaccccttattaggttttatgggattctcggagataaactggccatagcgaccttatgatctctttgagatttcaagattgtaattcaactaacttttatgagaagcctactctgtgccaggcaaattggtaggtatttttctttgcaatcccctaagaagtgggaaatattgtatcatattaccagatagagacctgagtcctcagggagtgccagctgtcaccatgtgtgtaattaagcagtggttcgagcccaagaccagtagccctttctgtatagcacatgggagaaaattggaacaggatttaatccagaacattctagactctgacgttctgagtttaagataaggtgacagacaatactgcagacgtcaatgggaggacaagcatttcatccaagaaacagcagaccattaggttgtttgccaggttttctggactagagctgggtacccttacagagagggagcctgcgttcacctttgctagtgcagctggcaataattatagtgctctgttagtgctctgttggtctgaaaaggaaacagaaagaaaaatattattgtgaggagccaaattttcactataaatagtatcttccccaaatgagcattttaagaagcaggatatggtgtgtgttgggggaaagatgtagaaaataaagatcattttggtgatttacataaacttcaatttagaaacggaggacattctcaatggatcatgctggtactgaagggttgcatttcaatagcatattttttaaactccccatttcctttctatggtaaagaataaataaaaatgctgatatagaatctttgctggagatagagacactgactctttgccacctgaaattggcagtgaacagcagagctgaaatggaaattggcaggtaccactggatgtacccaggctcaaagaaccaccagtaccatcccgtgccaaccctgggggacagggctagccccttgagcagtccaggtaaatacagccttggggtgaattctaatagcaagtcaactgttatctttaatattatttgtaatggctcttgcagcttggtgatattttatgttttgcttggtgcattaatttgttcacacgggcatgggtggaattcgccctataaacattttttaatcatctttctttttctctctccctctccattccaccccatctttctccactttcttctccttcttccctcttccctctttcaccttcaatcacttcgtcttctcaaagggaacaatgtacagtgagatatgcctttggttaaccatgaaatttccaatgcctgaaccaataatgggggaggggggccacccacatcccccatgtggccaagaactgggccagggccttcaaggagccttggccctgagagtactgtgagtgtccccaaatgtcttcccagccctgctgctctgcaccaccctctcacctcagtcattgcctttgagaaagagaaatcaaagctgtgaaagtaggattggataaccatgtacccgattcccatcaggtaggttcagtgggtccggtttccattttccttgctcgtgaggaacattggccattcagaaccgctaggtgctggatctgggtgaggtgtgcgacagctgatttggggacctagaaggggcaaaaggtgaagcagtatgaacatccaacctcccacgttcccaaaaccaacacaagttgtaatgcccagctcagttagctaaaactcagtgattttgccagtgtacaaccatagttcaaactacataaaatgcagacataaagggctggtggtaggtcggataaacacagtaagaggcttaaagtatttctgtgattttgcatcaatccataacatttctcccaaatgcttgctaactttttcaggagtaaatgtagcatggtacagctccagaaagggcaatcccaaggtacaatgtaagttacccattgaattacaaagtcataaaatccatgattaataaaaccttttcctttaaaatctaaattgtgttgtcaggttaattaaaatgaaatctgacgttggatttagttctgtcttgggttatgcattccttcatctgtcctatggctatcaggtgttggttctgtgtgtgcctgtgcagcgctggctaaatagggtgagcatgaggtgacatcagccatccattctcatggatcctataaagaatatggagggttctggaatcttgatttaaaaaaagtcattagacgtgatatatccatacaatagctactattcagcaataaaaaggaatgaaatatttgtgcatgctacaacatggatgaacctcaaaaacatcatgctaagtgaaagaagccagacacaagagaccaaatgttctaccactctgtttatgttaaatttacagaattggtgagataagaagtaggttaatggttgccagaggctgagagaagggaggattggggagcaactacagatgggtacaagggatcatttttgctgtgatgaaaatgttctaaaattagattgtggcgatggtcacacaacgctgtacatttactcaaagtcattgaattgtatacttgaaacaggtgaattttatagaatataaattatatctcagtaaagctgcttttgaaaaaaaaagcagcaaaaaaaaccatgagatgtgcataattcaagggtggggagcggggaaaggggtattttttaacataacaagaagcccccaagttatcagaaacaactgcttgagggaggagtccctcttcatcttaagagtctttaagagtcttcattttaagagtgttgaatgacatcaggccagctggaaacccagaaaaatacttattcttttctgtattttagttcactaaactggtaaagaataaacacaatatcttattgggggggaataaaagaaacctctatcaattgctcttgaagagttttctccacttgttgagcagttccctgtaaaagcattgcaataatatttgtgtgcttttgatcctacggtgaaacaccagaatctgggcattcatagcagcagtggcagctgagaagaaaaatacgaggctccattttctgtttttctgaaactgatttctttcagaattccaaagaatttgggtttccaaaagataacatagtgcatacatcatgtactgcatgataccaccactgagtgtctctgcagatctaactcattaatctttctggagagcccaagactataaacaactccttgtccattcaggtgagattttggcaccaaggaagaggagatcagaacaggttttgctgccagatgagttaggggagaaaaaaaaattacttttcaagttttttggaattccataatgatatgatgaaagattgtggaagtctaatagtatcaggttgctggtgatactactgcaagcgagaattccatgaactaacaggttcttgcctgagggggagaaacaaaatcactgaatttgatttaaagaattatcttcccagatcctgaaacaatctccacctacacatagttttaactttttgtgtgcattgatggaaataattggaaaaaagatgcctccacggggactgttaatgtctggagctgtctgcagagaccttatgtgtgatagtgtaaagcctacagcgcaggccacagagtgaagggacccactctagccatgccatcgcctttccagacacttacagattttgttgggtcctaaatcaatgccgttgccattctatacttagatctccaaccccaaccagatggtatgaggcaaaaaatagggaattctgtatggctcttttttttttctttttttttttattaatttttttgcagagttgtcagcctttttccatgggggaaaaagaggttttgatacaggctgaccaggaaatttttgccaaaggaaaatgcctctcccactcatgcagttactgtagcagagactgcccttctccaggaacttccttattccccattggaaaggtcatggcggttccagggtccttttcatggttttctttttcttgctactacttcccagtagaattccatctttaggggttagatagttattctttccttatctctttttccttttcaatttttagctgcgttggacatgtagtgtccacatcttttctgccttcaggagatgaaatgatgtatgaccacatgggctacccccgccccccgccccccccgccgtccatgatgctgccctaggggcctggcctgaggtggtggtctgagatgcaggcaagcgatgaagcagggagtagttcatgctaagtctccagtcagtggcatattgtgcttaacattggagggagcacttccagactgttgtagattgtgttacacaggctccagaggatagcctaagacaatctagattctctattccaagtgcgggctgtggaccagcagaatcaacacctccaggagctcgttagaaatgcagagtcccaggtcccacccagccccactgaatcagaatctgcattttcataagacttccaggtagttcctatgcacattaaagcttgagaagcagtaattaagagcaaggtccaagagcaagaagggagaagacaggaaggaattgattatgtgaatttaccctcaagagatctagaaatctttatctttggaaaagataaagaattgctcaaggtattcatcctttcttctttccgtttctatttaggaagaggcatgtctaagcaatgccaaggcagtcattaatctgttgagtcctggctggtttgaaaaacagtgaccttgcttctcttacctgcttgtctcatgagggggtttggggaaggggcagtgaaggtgagaaaggtttgtttctttgtggcaaagtgagggccagaggagaaagtagttgatggaagcttgggagaaattctcaaatgtctctcatctccctctttaatataatccaatgacatgcaagatgccgtgactaaatataggctgccatttttagtggactaagaatggttctttatatacagttaaatctgtaattcagaattcagtctcacaaggaaggagtagaataaccacccacttcacatatcaccaatttccgcctctcaaatccaaaatgctctgatgtttcagttaaaatggccacagataattccagaagtcgggacaaagagcacaccctctacatagggactgtcacagaggatgtcgggagaggagggccctctggagtgttggtatttagcaagaagcccaagtgttgtgatttgcaccacagagaatggattcctgagtcgccacggggttgtggggtgggggcgggtagcagactgacggagggcccagcactgctgttaactcatgttgcaccttgtctgcccagatgtaaccacaggctggctcctgggaactgcagactttatcccttggcccccttctaggctgagcctgggacttctctctcactgatctgctttgtagagggacacctgtagctataagtcctgggaaatgctactggatttttgtcattgttctttagtgtcactctttcctaacctaaggttgtaaggccactaagttcgaggtcttctcccaaaccacttgaaatgtattttaagggggaagaaaaacccttaatccttctgcgtgtaccattccacctctggccatagttgggtgtcgaccataactgacagtctggtcgtgccgtgtgggttctgctggtggtatcattctgtccccagaggctggttgcagaagcttttgtagcttatccagcctaagccagtggatgctctcagtctgtctgatgccttccagttactcaagatatttctgattacatagaggtaaatggtgaacacagtggaagcacgttgtagctcaggctcatgccgtaaagtccctgagatttttagagtactttgccttttgttttctgaaatgtatcaattctttcattttcaaagcacctgcagttttcaccaaaaaagtgccatatacagcagttaacgattttatagtttatttactgactgctatggcagtctttatatatatatatataaaataatttatatatagctgtaaacaaatacttatcgatataagtaatttcttgattgtttttgaacgttccattgtttatgcgctatattgttagtctgtgattagcacctaattatgtaacaatggcttactgtgtgtgtgacatatcagctccctttgtcttttggtcttacctttgcttctcaccttagagtaggcagacagagaaagcagagataaaaagcagatcgatgagtattgagtgttgatctcgggctttctgtcagacatgtctgattgtagggacactgacttggattattcaagactgagtacttctcggtctttgagaagtagtgtcatctggtctttgctgcctttgaaatgtcccttatgttatatgttttcatataaatctaactagagtccattaaaattaattttgctttgaaatcttttgccacccttagaggtaactggaattactctgaagtagctggggagtagctgaaatcagccacttaggtcttcccacctcctcaggctgtgtccttttgggtgccgaagttcactcccaaataagccacatataccctcaccccctgagtgcgtccacgtctatgaaaagcttatatgaattggcttttgtactaaacggaatgctctgggtgtcagagtcatttaggtgggacaaatcttcctctgaagatcatcatgcttgtattttctggagacttccatgaacaatgctttcacccccaaggaccagctctaggggtgaaatgtcaggctggtaggagaggtaatgggatcgaaacaagacttcctgtgtcttgagaaaaccttgtttatattcatgtgctgtttcccagtggcaataaatcgagattcctgtgaggatttgacagacgaggctggtgatgccacccactgtttttgtaaagaaaatgttatcggaaccagccaggcccatttgattgtctgtggctgctttcgtactccactagcagagttgagaagctgcaactatacaccctgcaaagccaaaaatatttgccatctggtcctttacagaaaacaattgccaatccttgaattagaatttgcaaagtgtgtcaaaatgcaatactctatctactgatgttaggcaacacctaaaaactttgctcggcactcagtttcctaaaatcttctccatcaaacatccctcatcctctgccctccaggccccagaatccttgttctctgtggggaatagggactccctgctcacaggctgtcaactaaggctcagcccttcttcagagaatttcttggtactttctagaagctcagcccctctggcctctttcaggtccttctctgagttttcccataataaaccaagtcccgttaagtggatactgtgagctactttcatctagtgttctattcagtgcactttagcaagttttatttcctgtgtatagaaaagatatttgtggtttactaaatgtagtgctggggatcatttctttctttttttttttttttaagtatgaggttccaatgccctgaatcggaatcgctaagaatgctggttaaaaattcagatttcatatgggcatggtggcacacatctgtagtcccagctacttgggaggctaaggcaggaggatcacttgagcccagaagttcaagttcagcctgggcaacatagcaagacccgatctcttaaaaagaaaaatcagattcccagtccccacctaccctctctgcgatgggtcccagaaatttggcccattttaagaagctcccccaggcaattctaatgcacagtaaagtttgaccaccactgctatatacatagaaggccataacccctcattataacatctttggtaaagtatcgtttcagttcagcctgtgtatgtatatgttcaacctgtatatgtatttacagttaagatgctcaaagtcaaacctccacatccttagcagacagtactattgaatttgaagtaaattcctcttgaagtaatgtttcgctattgccactatatctttgtgtataagagccaatgcaaaaacattagattgtaaagctgtaggcaaacatcagagctcaggctgtgtgttagttatcaattgttgcataacaaattcctccaaaacatagtggctagaaacaaaaatgtatattatctcggcttccttaggtcaggagtctggactcagcttagctgtctcagaaactctaatgagatttcagtctcatctgaaggcctaactggggaaggatccacttccaagctcattcatgtggctactggcaggacttggttactttgggactgagggcctcagttcctcacaagctgctggcctaaaacctcccttgatttttttccatgtgtgggctctccatagctacttcatggcatagcagatgacttcatcagatagagagagcaagtgagcaggtaagagaatgtgccagccagagagacaatgctaacaggacagaagtcaattttttgaaacctaatcagggaagtgacatctcatcacttttgccatattctagtcctaagaagtaagctactaggtccagcccacattcaggggaaggaattacacaaggccatgaatgtaggtttgtggggatcattgggggtggtgtcttagctgcctgccacagtctgtataaacatttcacagtgcaaatgcatcctccatctccttaatgatcataacctcttcactttctcaaagcctcacctctcagagaatgtatcactgggttaaatgagtacctggcaggtgtttgacggccttcctgaggtactagactctaagctctctgtgagcagaggtcttcatgccttgctccctgctttggcctggctcgggacctaggaccaagaaagcagtcgttcatagtgttgaatgatgatcactttatttttagcactcatgatgtgtgactctatatgaaattgtctaattttagtgtccattgtgtacatggctcatttcctgggccaggctggtcaagaccttgcactctgagagttgcataggagctcagcaggtgtttgttaagtaagttcagattggctactcgttgtcaggagtttgagaccagtctggccaacatggtgaaaccccatctctactaaaaaaaaaataataataataataatacaaaaatcagccgggagtattggtgggtgcctgtagtcccagctacttgggaggctgagacaggagaatcacttgaacccaggaggcagaggttgcagtgagcagagattgtgccactgcactccagcctggacaacagagcaaggctctgtgtcaaaaaaaaaaaaaaaaaaaaaaaaaaaaaaaaaaaaaaaattaggttggctaatcgaggtttctagaatcatctgcatgtaaatagggttaactttgtgggatgattttcttgaataagaagttctcagcctgagcttcacagtagaaccctggaaggaaggggaggtcttttaaaattccgaagccacatccagaccaagtcattcagaatcttgagggtgggacccaggcatcagcgttcttgaaagctcccccaccaggtgatcctctgtgcagccaaggttgagaaccactgtggtagaccagtgtttcccaatccgggggagtttctgcctttcaggagatgccttttaggcatctagtggtgtagaggtcagggatgctgctaaacatcctacagtgcacaggacggcccctccccaacaaaggatggcccatgccaatagtaccaagagttgagaacccctgggctaggtcctacgctttgagtcaggaaattggttctaagtgaagcagtagaagtccatggggtagctttgtcccagatgttaagcttattgcaggcatggatagcttgataagtctggaatattatatacaatctatgtatcggtgtttcctgaagagaaactcactcttttaaaaggcacgcagtgcataaaccaatacatttaaacctacatatatttatttatgcaacataataccatacacgtgtgtttgcatatagcacgtgctataaacaccctatgcatacagagatgtatgcagggcatatgagtgtgttattgtggttagaggaacaggtatgtcttcctcagcgccctttattttccttccccctcactgtagcctcctgccctctgcttgtctagtaaaagccctaaggcctccctgacccttgctgtccttaccctcagtccagaggatgcctctgctgtgccttgctgcctggagggttcccatcacccaggttaatgtggctcttggctttcaccaccaatccttagtttctcaaaggggttcacaacctttttaaattactagtgtgtcttgtagaaattgaacttcacaaacaggtcttctgaaaacgctttcttgtggtgtaattgatatgcatatggtgcatctctttaaagtgtctgacaagccttgacatacgtgtgtgctcatgaaagcagcaccatgagcagcatggcaatgtggctgccactcccaactctttccatccttcctatgctcccactctccccaagcaaccactgatctgctctccttctctgtggattagtttgcattttctagaatggcccttgtgaagatgtgttcacataaattctctcaccctttctcacccgaatagaaaatgttgcatgatgttgattgcttaatagctccacagctttgtccaatttttatccttcctgcttttactgaagatgtcctgcccccatgaataaacctcagaagacccattctgccaccgcctaccactgaagagttgagcttgcacccactccagtccagcccacacaccagtgccagattcatctcttaaaagcacatcctgagtcacgcctcgcctgctcacaaaccttccctctcttccccttgctgcaaagtgaagcacagaggcttgaggctggcttggacatcttccatggaccaggcaatggggggacctaccttcctgacttctccccaccattaccctggtgtccttgatgaactcggctacaccctgaacgctccccacgtctcccacatcacatgggtcctgctgtccttcctttgtgcttttcatggaatccttctgttcttcaaggcctcttcacctcctgccatccataaacctttgccttagcaacccacaccaaccaaagagatctgtccctacctcactcccccatatccctgtgtcagcactctctttattctactttagtgataccttatgtgtctgtgtgtcttaccgcccccctcaccccacccacaaggatcaaagccaggagggcacacttgcagaccccaccacagtggcttgcacatggcaggtattggacagacactcattgaatggaatggaatccaggaaagtagagacactgtcgcccagatggtcaaggaaactgattgctgctaaagctcaaaattgcagatattaaatacttctcaaatgtctggagtagcctccagattgctgtgctcttaaaatctgtgtcatctggacttagagctggcttcccctactctccattgatctccatgattccttgctgtcccactttaccaggctaaaagcctttgggaaaaccaaagccagttcccacaaaaggcaaaggaagagactaacaagtatctggttgttggatttgtttattcccagtcatggaagcgtatcattgcttttattgacttgcttatcttctgctagtaccatattgcaaatgttagaggctcatctattttaagacttccatagtgttttcacaaaaatgaaaatcccttattaaacagattttaggacaagcttctaaaaggacctgccaaaaagtgatttcctttctatcattagaaatagtttccacattcttatcgttatgtagttgaacttttatgtccaggactgcatgaaagacgtgagaactgagaagcaacctatatttgatttcgcactttgttcttggacaggaagcccctgtcaactgacttcacatctttttaatgcactatattagtggttcacagaactttctgggtgttaggtccctttatgtgcttagaaacagttgaccccaaaacgcctttgctcttctgagttgtgcctataaatattttctatattagaagctagaactgagggctgggcatggtggctcatgcctgtaatcccagcactttgggaggccaacgtgggcagatcacctgaggtcgggagttcaaaaccagcctggtcaacatggcgaaaccccatctctactgaaaatacaaaaattagccaggccagccaggcacagtggctcacacctgtaatctcagcactttgggaggccgaggtgggcggatcacctgaggtcaggagttcgagaccagcctgaccaacatggagaaaccccgtctctactaaaaatacaaaattagccagcatggtggtgcgtgcctgtaatgccagctacttgggaggctgaggcaggagaatcgcttgaacctgggaggctgaggttgcagtgagccgagctggcaccattgcactccagcctgggcaacaagagtgaaactccatctcaaaataaaataaaataataaataaataagccaggcatggcagcatgtgccttaattccagctatttgggaggctgaggcaggagaatcacttgaacccgggaggcagaggttgcactgaactgagatcgtgccactgcactccagcctttgagttttttaagatggagcgagactccatcttaaaaaaaaaaaaaaaaaaagaaaagaaattagaactgagaagtttattacttaataataaacttagtcatttaaaataatagcaaatccattatatgtcaacctaagtaatgtttaggaaagataacgattttcaaaaagaaaataatattttagtgtgaggaataggactgttttacatttttgcaaatctctttaatatctggcttaacagtagacagctggactcttacatctgcctctgcattcattcagaggcatcttggggtatcttgctttggttgaagtatatgaagaaaactcaaatttctcacaggtatgtgcttggagaatggaggagtgttttaatggcctttgcagataattatgaaattcttccttgatactacaccaaaattcagcagctagtggtttcttaaagactacttgtaatgtggaatctgaaaccatattgatgatatttttgtactcttttccactaaaattcattgcttgatcttgcactttgattgactcttatattcaagaattattttcccttggctatttggaaaatattggttctctgagttgtgcagatcttccagacgttgacacatttaattaaaccatgtcaaaaaaatttcattggttaatgtcaccaccaatttcatcaagaagtctggtaagtatttggaagctgtcagtctcactatggcaggtacaagttttccaaaattgattggcaacagatactatcagttgttttctttgaagtgacaagctgttcatttttgggaaagtttctgccaaatacttaagtctaaaaaactatatcttgtcaggcattctttcaagaaagggggtgtttgcccccagaaaggtacaagtttggctcataactcagttacataagaatgtttcctgcagcccactgtcacacgctggtttgtggtagaagggctctctgcatcctctcactcatttcattacacaaactgttcgaaaggcacatactcgggggttgagatttaatcaaattaataattttttattgcatcgaggacatttggaagtgaaactggctttttaatttattttcttgcgagcgcgtggtagtgaggaatgtgttcctgctaagtacactatggagccactgcccgattcacgctcaggcatcagcagttttactgtgcaaatgtcaagcagtgaaaaaagtaaataacatcttggtgctattataaaaagttttggcttcacagtcctcctgcaaggatcttgaggtctgccggggctgcacagaccgtctttgagggcccactcctggctcagagtgagactggtgggcaggcaggatagaatctcttgggagctcaatgtcctttccagacctgcctgaacagaatctgcgttttaatgaagtcccgaggagatttatacgcaggttaaagttttcctgtagtcccagctatttgggaggctgaggcaggaggatggcttgagcccaggaggcagaagttgcagagagctgagattgcactgctgcacttgaacctgggtaacagagtgagattgtatctgggaaaaaaaaaaaaaagagagagagagagagaaccactgctctttaacagaggtctgcaaaactttcctttaaagggccacatagtaaatacctgtggcaacaactcaaccctgcctttgtagcttgaaagtagccatagaccatatgtaaatgaatgagcgtggctgtgtgccaatacaactttatttatagacacagaaatttgaattttgtgtacctttcatgtgtcacaaaataggttttttaatatattctaagcggttaaaaaagtaaccacttggaatcatgtcaaaatcattctgagtttgcaggccatgaggagagccagatttagctggtgggccacagtttgctgacctgtgctatataacactgagtgctcattgaagttaccgggggagcttcaaaaaaacaaaccccaaccctctaattcctgagtcccgtccccaataaattctgataaaattggtctggggtgaagccagggcatcaggattttcagatgctccccagattattccaatgtgtaggaaaaatggagaacctctgctctataatgttttccaagaaagttagttttcttttaagcatttctttttaagattttagaatttggcagtgtcaccaaatgtctgagaccagaattatgtattgtaaccttagagcagggtttctcactcttggcactgtgaacccaaagctatctgagataggtctcaatcaatttagaaagttaattttagcaagcttaagaacctgtgacacagcctcgggagatcctaataacatgtgcctaaggtggacggggcacagcttacttttataccttttagggagacatgagacatcaatcaatacctgtgagatgtacattggttcaatctggaaaggcaggacaactcaaagggggtcagagggtggcttgcaggttataggaagatttaaaaattatgtaaagacctggaatccatagaaaggaatgtctgggttatgatgataaggggttgtggagagcaaagttttatcctgtaggtgaagcctccaggtagcaggcttcagagagaatagattgtaaatgtctcttagcagatttaaggtctgttgatgttaatgctggttggcttttcctgaattccagaagggaggagggtataatgaggtatgtttgactctcccttccaatcatggcctgaactagttttttcaggctaactttggaatccccctggcagagaccaggaatctattcagatggttgggggtggggtggggggtgcttagaatttttttttttttttttttttaaacggagtctcgctctgtcgccaggctggagtgcagtggcacaatctcagctcactgccacctccaactccctggttcaagcgattctcctgcctcagcctcccaagtagctgggattacaggcatgcgccaccacacccagctaatttttgtgtttttagtagagacggggtttcaccatgttggctgggatggtgtcgatctcctgacctcgtgatctgcctgccctggtctcccaaagtgctgggattacaggcgtgagccaccccgcccggcccagagttttatttttggtttatagcactattggcattttgggtgtgaccattctttatttggggatgggggctgtcctgtgtattctaggaggtttaggagcatccctggcctctacccactagatgccagtagtgtcccccaccctcagttgtaacaaccaaaactgtctccagacaccgctaaatgtccctgggtggcaaaattgcctggattaggaaccagtggtctaaacgatgtagatgttttttgtgctacttcagagaatctccacattggagctattgacatctggggctgggtaattctttgttataagagcatattctgtacactgtgggtgttgagcagcatccctggtctctactcactagatgccagaagcaccctctcccccagctttggcaacgaaaaatatctccagatattgccaaatgtcccctgaggggcacagtcaccccctgttgagaattgcttggccagctcagaatcagggaagcttctgtccactgacattcactgctgcttctcttaggattttcgccctctccattttcccattgcttgttgcttgaaagttgtaaagcttggttcctgcatcttttctttttaattttgtggctcattaggaatcagtaatatagcaaggaaggccccatgtagagaggtaagggggtggtttttttgtgtggtgtttgttggggggtgtttgggagggtgtgtgtgtgtgtgtatgtatgtgtgacattcattccctggggaagaatctgagcccttgttcctgccagccctacgtctgagccagcattaaatctgcagccaagatcacagacaacttgggcaaatcacttggccattatgaactcacagccatggcaacggccatccacaagcctgaggacaaaaggtgttttattctgttgttctgcacaaaaggttctagggatactggagacaaaatagcctttgagacttaaaggcattgatgtgtattttttttttccctactacatggcttatatttaaactgtcttaggctaatgtacactgtaatttttgtgtgaatcaaaacctaaaattctttttatccagaggccagctaaatgaaggcataagacagcccaacagaggcttttagggtttggtgagaggtattgagaattactagtaaaatgtgctagaaagcctggcattctagcctggccaacatggcaagaccccgtctgtactaaaaatacaaaaaattagctggatgtggtggcatgtgcctgtaatgccagctactagggaggctgaggcataagactcacttgaacccaggaggttgaggctgcagtgagcggagatcacaccactcactccagcctgggcaatagagtgagactctttctcaggaaagaaagaaaaaaaaaaaacctggcattgattattatttttttacatgaatacatcacagtcatcaaaaaaatgctttccttattttttctcgttcacgttacccaatgttgtcattgctggtttgaagcttgggaaaattcagtctgtggatttataggagcatccaagaaaagcactgatcttccttagctatcgtaaacttttaacagcatggtgttctgctggtacttggcaccacccctatatttaaaaacatcagcttgcctatgactactaaggacagcctgaatcccagatctacttcctttttgtgcacaggcactcccagcactttagggggtggttggagtgtgtgtgtttagaaatctgctttctcaggtgactcaattcccgtcttctcagaccctgtctatggcatgacactaaagcatgaaaaattccaaggttaacagtacttgtttggctcacaaaaatgcactctagctgcactcttttcaagatggctggacaacttggaacattttgtttttcttaactgtagtccttggaacttgccatttgattcacaagtgactggagggttatggccaaacccagtgggccacgtcttagagaaaaaacatcacacaccatcgaatatgaaagcaggcacttcaaacagactcaggatgccacacctgagaccgggaagatgccactgttgactagaaatgggcttctcaaattttcatgtgcacacaaatcaccccagaggccttgttaaaatgcagattctgactcagtctggggtcacttccaacattctttatttctcacaagttcctccctgctgaagctgacactgctggtccaatgaacacactttgcaaagcacatggaattgacaaatgacaaatggtccactcatatcttttcttgacctctgatagttttccttgttgcccagtagaagctgccagcatccaagttcagctcttctcagctacagatccatatatcccttcacatcatccagagtgatctttcacaaccccaatctgtttcccatgcttaaaaatgctccctggcagaccaggcatggtggctcacacctgtaattgcagcactttgggaggccgaggcgggaggatcacttgagcccaagagtttgagaacagcctgggtaacataaggagaccctgtcactacaaaaaaattaaaaaataaaaaatgagctgggtgcagtggcatgggcctgtggtcccagctacttgggaggctgaggtgggaggatcgcttgagccagagagttcaacaccgcagtgagcagtgattgtgccactgcactccaacctaggcaacagagcaagaccctgtttcaaaaaacaaaacaaaacaaaaaaaaaacgcagtggcttcccatgattttgttttttttgtctttttgtttttgtttttgtttttgttttgagatggagtcttgctctgtcacccaggctggagtgcagtggtgcaatctcggctcactgcaccctccgccttccgggttcacgccattctcctgcctcagcctcccgagtagctgggactacaggcgcccaccaccacgcccagctaattttttgtatttttagtagagacggggtttcaccgtgttagccaggatggtctcgatctcctgacctcgtgatccgcccgtcttggcctcccaaagtgctgggattacaggcgtgagccacggcgcctggtcaaggcttcccatgattttgaagataaagtccagaattcttaaggtggcctggaaagccctaggtggtctagctcctatattacctatatcctctagctcctaaataaacacatttagctttttcttactaactttttgcagcagttttggttcctctaggatgagtgtgtgatatgtgactaaattgcccagtgttcaaagatatcatgcacactgtgaccagaggtggcttctatactgacatagaagatacagtggagagtgatccatttatagattgttggatatctaccacacatgcaatcttaaccctgaagataactggtcaaccaagctagaataagctctacatccagctgtattatgtcctataaatttttcccatattttatgtcactagcttctagtcatgttggctggcacagtccgtaagagttttatctgtgccagtggagcaaagatggtgatttctgttctataggagccagggttcctacagccacaaataaaatcatctgctgaaaacctaagagcattggcatctgctgagagagcatgattcattgaagtgatcccccaaattcttgagttcctggttttccctgctgttataaaactagatccacagcatgaggtatatacagagtccttgagagatataaattggagggaaactttagctttgatctagtattgaatttgggattgaacagcatcattcttctaaccccacttggctttttgagcctgggagagctgtgatatttctttggaatgctctaaccatttggatgaaagaccgtttgaagtggcaactgtggatttggaaggatgagttctatcgttaaagggcgagtgtgctgcaccataacacctaaccctaactccaaatgatgaaaaagggtgtgggtttagtttaaaaatatatatagatgtatacatctatatatacacacagagaattaatgaacaattttatctggttatatatcagtgtcaccacatcagctgtttaagtattctggatactagatctttctgtagaaggacccatccagtatgaattatttgcccttctgatcttccctgtcccccttctctccactctctttccactggctctgcaggggtctgtatctttgcccccatcatgctggactataataattgtgttacttgtctgcctgcagtattggatttatcttgaagccagaaaggtatcttatttcagttttgtgtacttggcacccagtaggtcttcacaaaatactgaattaatgaaatccaacagaaaacccagttagaacccagctcctgggttatagaaaatcaaatatgtgacaattcaaaatgtatcttccaaagcagtgtgttctgtgatgatgaaatgtcctatatctgtgttgtccaatacggtagccactagtccatgtggcttttgagcatatgaaatgtggtttgtgcaacagaggacctgaaattttcattttatttaattttaaataaacgtaaatagctacatgtcttagtggctaccattttggaccacacagccccaaggcctcacatctttatcctttaagaaccagatacaactttgttagccaggaaagcaggcattcatctttttcttaacatgatcatagaggctgagaatgtggggaggttgtggatgatacaatacccatgtctgttttctctttataatgagatacgtcaaggccaaggattctagtttctcttagtttgggaacctggagagaatttggactttgagttgcattcctctcacctcagtccccagaaagtcatgtgacaaaataagattgagctctaacatctctgctcacaaatcccaagtgtctgaagctctttaagatactgacttgctagtgaacttgaaccatattgtgcactggttccctttttctttttttgagacggagtcttgctctgtcgcccaggctggaagttcagtggcgcaatctcggctcaccgcaacctcttcctcctgggttcaagcgattcccttgcctcagcctcccaagtagctgggactacaggtgcccaccaccacacccggctaattttttgtatttttagtagagacggggttttactgtgttagccaggatggttcccattttatatagtttccccaatccacttcagggaagttggtcttcctaaaaacagctgctcatcttttgaaattaaaggaagcacagctttcttatgaagccctgatattttttattttctaatgaactaaagagaaatctagtaatgagttttcatagtcactttccataggtttaagcgaatgctagtttaaaaggaatgctcactaaaatgaaaacattcatctatggtgttttatgctgggttgtcattccatgacaactatgaagaccatttgggggattttttttttttttttttttttttttttgctggcttaatgtgcttgccctaaagtaatgaagtgcccttgattgctgctaaacaccataatgcgtttaaagttcaatttccccgacaagccatttacttaagggtctggataatataaacagagacaggaggttaggagaggtactgacattatcctgaggccagtgctgcctttactgaaacgtaaatgtctccaaactgaaaacgtcacctggctctgcccctgaggcaggtctttatggacatctcaagtaaaagtttattttaaaaatgaatacaagtctcgtcttttcaagattaagagtgacttacggctgtctctccttcattccacttcatggatgttcattttggttttgtttttttcttctgttcttttttctccttcaagtacttaaatatcacccaccagttctgggttctgactctgaacgtgtgtgtcggggaagggggcaggtggaagccggggaggaggaggactgtgaatgaattgcttgggctgactgggctggggggaagcatttttattaaaaatttgagataatttctgatgtcaacttgaatgaaacttgagtagacccacttgagtggctcttggtgactttgttcttcactgaattatggaccaaaatacctgtgacctttccaaaacaatcaccttgctatttgtttgaacctggcgacggcataattgctgtatcagattctcccagttgccccggaggtccagggcttggggaaagccgttggttgccacagcagcagacgtattgaaaccccagaactgtgaggctggagacgacctgactgttgcttttcttcacagagctgcagcttcactgctgtcctctcttttgactgtgttagtggaatgagtgcttcttgttggcacttgagcggggctccccccaccactcagtcgatcaggaagctctagaactgtaactaccttataactctttgtcaattgactgctctgccattcactacccttccagattctgagcaaattaagttacattcccttttggagcctcagggtcctcaccgcagaatgtgagatcacggtaactaccacactggcccttgggatgtcgaagtattaatattaaccatagagcctgagaggggagatggaaaattgtaagccttctctgtgaatatggggtattcttgaagaccagaggtgttcttgcccgtaacggctatattttctctcctttgggttcaggctgctttgaatgctgcatcaagtgtctgggaggagtcccctacgcctccctggtggccaccatcctctgcttctccggggtggccttattctgcggctgtgggcatgtggctctcgcaggcaccgtggcgattcttgagcaacacttctccaccaacgccagtgaccatgccttgctgagcgaggtgtaagtatccggttccctttaaaaatgcatctaaggcctggcgtggtggctcatgcctgtcatcccagcaatttgggaggctgaggcaggcagatcacctgaagtcaggagttcaagaccagcctggccaacatggtgaaacgccacctctactaaaaatacaaaaaaaaatttagctgggcgtggtggtgcgtgcctgtaatcctagctacttgggaggctgaggcaggagaaccagttgaacccaggaggtggatgttgcggtgagctggtgagccgagatggcaacactgcactccagcctgggtgacagagtgatactttgtttaaaaaaaaagtatctgagatgcaaccacctcatgatgtttttcagaaagactacagtgtgctttcctagcagaagatgaatgcttttacttaaagctcactttatgtagttagaaaaaggttcatgagagaaggaaaaagaaagggcctagaatatggtagctgtttaggccccagggtggaatgttacttgggaatggtaaggtgcacacataggacactccacacatggtagctgtggacatggggagctgtgacatggtgataggtgatgctgccgattgtctcaacagaattgtgttgttcccaagtaacagatgcctccagctttctcccaggaagtgaccatccctggaatggtaggagccctgttgaggactgaccccaactctaagcctacaggagcagtattttaacattaactcttccagcagaagagcagatcccagggcatcctccattgcagaagagcagatcccagggcatcctccattgcagaagagaggaaggtccaggggtttagcagcagatctctgcctttctttctggaaacattctcaatggagtcgcagtgactcccacacatagattcttgtagctgtgcaagctcagcagcaatctacttatttccttcacatgtcttcccctttctccatttccttctaccgtttctttttcttcccttgaatcccaaagttccagtgttagtgtgtcttatgattataagaaacttcttcaccagactgaaaaagacatgaatgaatttttatggaatggtcatggagtcatgttggagactcttcagtccttagggaattttattctttcttatctgttcacaaatgacctccaaagaaatgaacacaggttggggagattataaggagggctcaagcaggacaggggactcactgagttccaactatgtgcaaagaagaaatgtttaccaagactgaacctgggaaaggtgtgttgatttaattaggtagtgatctcagtctgtggctctcaaacttctgagaagctttaagaaaatccccatgccttaccccagaccaattaggacataatctctgggggcgggatccaggtaccagtattttccaagctccccaggtgattccagtgggcagccgaaggctgaggacatgtcatttgtctttgttagcttttgtgggacaaactgcattgtgaattaactttctgtatcttaaacctactcgacctactactatttgtgtggtgggagtcacagtgcaaaagacatctccccagattaccccctaaagaagccctgagtgcctacttaggggttttatcagagtgacattaaccactaggcctggttgggaggcattttgaaagggcagaaagaacatgttgtccattgggccagggttcagatgctggctttgccactaactgtgtatcctccgatgaggagcttaactcctcaatgcctgtgttttacttatgtgcaaaatgaggattctaacccttgccgcccaggactcaggtaaggattaaaagattacaactggatgctgccctgagcaaaggaaacatcattcccaccttggaaggaaggcccaggttgctgggacatgggcagggatgccgcccaggatgccccacaagtccatcaaagccatcagtggggcgagtgacgcactcacaggaacatccccctcatgtcctctctccagcgtccagaaacgtagtcactaccaggcagtgaatttaatggttcaggatctcttcttctctttgtaggatacaactgatgcagtatgtcatctatggaattgcgtcctttttcttcttgtatgggatcattctgttggcagaaggcttttacaccacaagtgcagtgaaagaactgcacggtgagtttaaaacaaccgcttgtggccgatgcatcagtggaatggtgagttgaacctctgataactgattgtttgatatacaaccagagccatgccttgatgtatttccttgtatttggcaaaagctaccaggtatcgagcgtgaatggagggtccatgacacaaatattggctttaccaatttagagttaggactataaaaaccttcaacatgctattgatagtaaactaaagtctatggctggcagaaataaatcaaatgttttcatcagtgtaaaggtgaaaagggtgctgaagatttttcaaatgccaagttcccactatagaaggaggtaactttcatgtggtctcagtgctcccctttggttgtctttaaatatggatcatagccataaagacatacatgaaccatggaaaatcgtcctgatccttctgtaaatacttaccagtacctgctgtacagagcgcctagctgggctttgctagccactagaggtgcaaagattaaaacacaggctgctttctcaagcagcttatagtctaagacaggggttagcaaactaggggctgtgggccaaatttgacctactacctgtttttgtacagctcaagagccaagaatttttttttttttcttttttttttttttttgagacggagcatcactctgtctccaaggctggggagggcagtgtcgcgatctccactaactgcaacctctgcctcccgggttcaagcgattctcctgcctcagcctcctgtacaagtcaggggaatggttacttttgtaggggaaggaggcagctgttaaataaaatgcctgtggaaagcagagggaaaatagccacaaatagtgggaatcctcctccaaaggaaaaaaaaaccaaaaacatctcctcacagctttaaaatgacagctttccccctcacttctacccatcaagtttcaaaaatagaggtctagtttccaccagggcacagcattaagtcatccactgcctgatgtttaacatatttggatcctttgagcattggtcaggacacagtacatggtggagaggagaggagcttgtttgtacttgagctagtggcacttcacctagagatggggacactgtgagggatccacagcccacctagcatggcccgcttttagctcttatgtcagattttgttggagaaagtcgaaagcccccttagactggagaggagcttgaccatcttgcttgatttcattgccagtcattcatgcgctgtctgcatctctggccactggcacctcatgtgcttccgtttcatccatacgcttaacagatcacaatgctgacctgccttggagggtgtgaggaagatgcaggtgacggggcagggctgaggatgctggggacagaaacaggacagaaagtcatgtgaggtggagaaggtggatgagatctgcccgctagggaagcaaagctgccactccatcaccaaaggcctttgtctcctcagtcctgtgaacccaaaagtatctgaaacaggtatcagccaatttagaaagtttattttgccaaagttaaggatgcacccatgacacagcctcaggaggtccggacaacatgggcccaaggtggtcagggcacagcttggttttatacattttagggagacgtgagacatttatcaatgaatgtaagatgtacattggttccgtccagaaaggtggggacaactcgaagcagggagggggcttccaggtcacaagtaggtgagagacaactggttgcattcttttgggtctctgattagcctttcattgaatatacaattcacatgggagaggagggtagaggaatagtcacttatgcctggtctggcttggtgaaaagacagggcagaggaagcaatcagatatgcatttgtctcacatgagcctcagagggatgactttgagctctgtcctttgtccacgaggaatttccttgtgggcaaattgtgagggaggtatgtagctttatctttgtgctatcttgtttaggaatagaatgggggatttgcctgtcgcagttcccagcttgacttttccctttggcttagtgatttgggggtctggagatttttctttcgtagtcctgtgtgggaggtttgtgcccaggaactcactgaggaagcagctctggacgctagaggcctccatgacagggccagctcgcagcggggacctctgggagggggacagtggccttccctctggagtcctggcctctgacagaagggaaggctcactgaagccaagaaccaccagctccctcctgctcaggtcctgttttcttttgaagggaaagaaacctagtctggagcagcagtgggaggaagtgggaggtggaactgctgaaatctgcttctctgaatatttttggagatgcaaatgcttccttgcagtgcaagggaaagtgtctcgtttctgcagtttcctggcattgtgaccatcaggaggtggcctccaaccgcccaggtatctcctgcagcacagaaagttaggggtgaccatcaggtctccaccatcagcttcaaaatagaaaagccaaactagcactccacaccctctgtgggcgcgccttctgagaacacaaataccacgtttttgaggccgcctcacaaagctctctgaaaagtggtcaaggcagaggaaagccaagcaacgggattctattcttcctggattgcccatgacagtgtgtgggtgaacacctgaagctttttccctaagccgttgctttgcttgcaaagctgctgtgaatcttagagacaaaagaaaagtagaggaaaatgagaattttatagatcgagcattaagcttgtattcgtgattatttgaaacttttggtaattttgcagaatcaggaaactagcaaagttctttttgagagggcttcttgtggcaattgctattctctgtgagccaacctgttacgaaaaataaaggtaacttttgagaaattaatatgaagttataattcagtggtatatggaatacatccagaatctatcccatgttaagtagcatgttctgcattttcagaacggctatttagaaagagcacctcttgagaggctgccactgattagctctgtgaccttggatgagtgagatcacctcttggggtctcctgtccttgttagttaagagtgacccgaaaggccctgacattgcttcgggcactccaattctagatcctctagctctggggaatgtggctggctcttacttcccctgctcccgtgctggcttttccttcttgctaccaatgccggggcgagggtccccacaatgtgttccacaggtcagtattgggcctgaaaatgcacaatccttccacttaggggacacacatctacctgtttcagtgatgattgtccttcctcttgttttggcctagttcgttttcctcacctatgtgcttggagtggcctggctgggtgtgtttggtttctcagcggtgcccgtgtttatgttctacaacatatggtcaacttgtgaagtcatcaagtcaccgcagaccaacgggaccacgggtgtggagcagatctgtgtggatatccgacaatacggtacttccttctaattcacccctcccccagttatttcattatcctctcgtgcatatgtctggacctaattattacatgcgcatccttttaattgtcatgatctgtttcatcccttctattagagtaattttatacttttcccttcaatatgctattttctgggtggaaacttcagggaggcttttagcttgctaggtatcaaaatttcgttatattttcatgttaagtgtgtagtgaaagaagcttttcttaatatgaaactactttataatgcagttcaatcaaaaaagacttctggatctccgctacaaaaagattgtattttttctttattttcagttttataacatccaactttccattcaaaataatattgcacacattgtataattcaattaatttgcacatccaactcctcaaatctggtctttttaaaatgaccaactgcttaaacttcatctgtattgaaaaatacaacattagatccagccatattttaaagtcatcagaacatactctataaatcattatcagctgttagaaaccagttcaaacattttctaatgagtgagatccttacaatggggatctaaggttggttcattgtgacaaaccccagaagagaccactggctcctcctgtcagttaatttgggacttgacttcgctgctgagtaagagagggcagctgagtaagagggcagcatcctgagggaggagtctaattactgcttccagccaccatggtaggaaatcttttcttggcagaaacaaccgggggtgggggggaatagctttcatcagaattgaagaggaaataactgtccttccagagcttttctgaagagagatgactatttcatttttgctgtttttctcatgtggcttagtctcaacatcttaccttacaacataatactaaatttgcttgaaactacctatcagactaacctcttctcacaaagaccaaggctgaacaacactgttctttatgatagagctaaaaacggagcctaaagttggctgttaaagttatttgtaaatgaatatctaaatgtatatcattctcctattccttaaaagtaagtgttttgccacaaatttttggtaatcagcaatcatctttttaaatcctctatatttgcctatttattgttatagttactggtttcactgataatttggggtaatttcccatgcttctgaagtataaagatgtactcttggcccgtgtcaaggatgaaaggaataaggattttttttcttctaatactcctttccttaacctcctaggagtgtttaatatttaagcacaaacttatgcattaaaggggaaaaaaagcagcagcccactggacaactgtcattgcagaggagcctcagggtttaagtgagagagaaatcatagactctgcttgtcccaccctctggggtaaaggacagtagtgttttttctttttaaaaaatttccggccacgcacgatggctcatgcctgtaatcccagcactttgggaggctgaggcgggtggatcacgaggtcgggagttcaaagaccagcctggctaagatggtgaaaccccgtctctactaaaaatacaaaacttagctgggcatggcggcaggcacctgtaatcccagctagttgggaggctgaggcagagaactgcttgaacccgggaggtggaggctgcagtgagccaatattgcagcactccactccagcctgggcgacagagcaagactgtctcaaaaaaaaaaaaaaacaaaccaatttgattttcagtccaaaaatattttctaatacgtttataagacataataaaaatgaatataaaaacaaagacaaagtacaaatccagagttttttattggattcccacaaacataaattactccgtcaaattgccatgaaagtttgagtgtatacttgcaattttggaacttaactcctggcagaccagtaacagagcttggacagcaaggccacagaccacagcattcatgaggaaatgtattttgacctcaatgtgataaaatgctttatgagggggttgtcctgcagtaactatagggaaagcctggctttgaaaattaatgtttacaaatatgaacttccaaatgtgaaccctcactgaataaagcacaatttgtaggggaaaaaaatatcaggctgtttaaatctcttatggactagttggctttgcttttggcctattgttcaaatggggctatttattccaaaatgcttgttctgcagacagcagatccatcaattcttaatgaagaacatagcctacaattacactgtaactggcatccgaagtggtggggtctgttaagaacatgaggcgctatagtttgtactaacatcctattggggttcattttacaggtatcattccttggaatgctttccccggaaaaatatgtggctctgccctggagaacatctgcaacacaaacgaggtaaactcatcacagttcagaataacccttgagtattaggctgagaaaaaagggttctcccagctgtagaaagagcgagagagatggttaaaatgccattaaggaaagctccttgtttagaatctttaagatagagctatatgtaaccatcactattcagccatttttgacctacaaaaatggtcacttcatatggtccaacacatttggtgagaatccttaagaagtggagggcttttcctttgggcaataatttagaggtgatcccaaacctagaaatctaataatatatctagattcttctctcacctcttctacttctactctttctactttgaaagattttcaaagtagaacacctgtcacagaacggatgtaagttaattttcatagaggagtccctctatttcatagaggaatttgtgtatatacccaacttttaataaatgaggccacagttaatcatttatatttctggaatgacttgctacttctctaattctcattcgtccttactagggagtgtgtcctaacaatttggtttaaattgtctcagccctagaacattcttcagtcattggcttgtaactgtttataaaggaaaattcttaaatgcattcgtaggtgcttgtatatttaagaaaatcctggcaagcttttaagaagcagtgagttacagaaataatcagctcctaccctatctgacttgtcaatttgtatatccataatatgcagtggcttgaagcagggctccccaccgtggctgcatgttacagccatcaaggcagcactatgttatactgatggctgaggcccagcccttaggtattcagatttaatcgatttggggggcagtctgggcatcagaaagtttttaaagctcctcgggtgattccaccatgaggccagagcatgaagagaaggcaggcctgtgcccagtcttgcagagaagagctgcaaaggagacagatgaagcagcaccccacaatgagtgtaggccatttcatttaacatcaaatgcttatgttgatgccctgttcttttgtagttctacatgtcctatcacctgttcattgtggcctgtgcaggagctggtgccaccgtcattgccctggtgagtaatggccccaagaccaccctagtctagcctcctccctccagcttctaaatgacagatttcccttccagcttttaccagcctattgaagccaatgattctggcactcaaccttggttaactggcgcctgtgttaacttaccacatgtagtttacagaaagtattagttggttgccttggcactgattgtaggtgatgtaatttggactctggaaagaaaagagggtatcaacacctatcaactaggcctagcatattaccttgttgcactgagcacttagcttcatgacttcagtcgcagacagatgcaatgctcacgtgaggcattacccatttctttgccaagggatattaatttacaagtggagatatgcacatatacatacatttatatagtcactcatacagggtagctgtgttccataaagtcacctcaagcaatgaattagcgaatgctggaccactgctcctaggggaaatacatggctaggtttctgtgagcctctggtcacatcattttcagcaacctatcaacacataagcttgtttcgtgtgtttctgtgtaaatacaccgtatttaatatatattgttgattccttaatattgaattcatggccaatagctctatccctatgcctgaatgaagcttctctaatgaacattttctctggtcaggcagtttgcaaccttcttgcacttagggactctagacagcactgcagcactatgcttgggagccattttaagcagcaaaatcacccacaaaatgcacaaaaatgtgaaaaacgtggcactaaatatacttcgagtatacttatttacagtctgagagctgaaacaagaaggcagagtattgccttgttcagcctcagctgggaatgtgcataccgggcaactcaactttcaccgctctgcacatgtctgctaataactgcgaaagaagtgcctcaagtattaaggattacaaatgaatcttagcaagtaggcagtcacaaatgtggaatctacaagtaatgaaaatcaactgtataaatacacgctcttatgtatgtatgtttgtatacatgtaattttggagggcttggtttgtgatttcaggaaaaccaactaagattggtagagcaagggaaaaatctcagctgcttgtaaattattcattcccagtttttctgaccattaaatccccttagaatctatgaaaaaaaccacctttaaaatcatggggtgacctgttcttttggttgagcaacagggaggaaagataactgcctgctgctgagcaggtggttttggaaagatgagaggattaaggcatttagcttcatccttctcatgctgttgacccagctctctgtcttgttattcttgaaacgcatccaagtccttttagtaaactcactgagggcagaaccaatgacttacattgtacatgtgtgatgagaaaaagtttgtgtgtgctagataggaaaattgtctgttgtgattttaagtgggaaaaaaacaccttagactatgagcaggcacccgtccccacccaagtttagaagtgtcatggcatcggccctcactgcctgtatcttactgtcctgttttgttctcttccaccagctgatctacatgatggctactacatataactatgcggttttgaagtttaagagtcgggaagattgctgcactaaattctaaattgcataaggagttttagagagctatgctctgtagcatgaaatatcactgacactccagactaaagcagagtctaggtttctgcaattttgttacagtaatttgtaaatagctttagtaaactcaccttgcatggtagattaataagatgacttactgtacatgaattacacaataatgagatctggtggctatttccacattttgaaaaggattcagttatttactgacagtggtgagcatcctttttaaaataatgttctcatacttaaacattagagagcagtatctttaaatgaattattaacactttggaatacttacattttctgttatttttgattgcctgataaccagtttcaatgatgaaaatgaaaacaagtgctgaagatgaaatggaagagaaccgttttaatctggattttgttttgtcacacctggaaaatactttgcaaatatgttctaaattgaaaacaatttttttatgatcacatggttcactaccaaatgaccctcaaataagccagatgaaaatttgaagaaaaaggtcacccagttctctggaaaaaaaaaaaaaaaaaaaaaaaaaaggatttatatgtgggtagttttttttttggtacaacacaatcattctgttagagcccacaaaattggtaaccttaaattgtgtgttttggtaagtaataactaactgtttcctcatagctagttctcaagctgcatgtaagattttaacgggaagagaaaataggcctggacctgaaggtctcaaatatgttgagaagaaagtatgaactataaggaacttgagatgtagatttattttgcaggaaatacgaggaaaataggaaagaagtgtttgccgcatcaagtgtaaagaatgatactgaggatttttacattttatgaaatgaaataatggcatttacaaaatgaaaaatgtagtttcacaactaagttttgttaacagagactgcatgctttgcttatagttcttaattttggttttgacattcatttaattttttccatgttaaatatgtagtttaattatttactcaaaataaacattgttcatgcttttaggcctttgggggaattgatttttatccacaggtagaaaatggtctttgcacacactacacttatttcaaatatacaatgtgctcccgaactttcgcattagtctttaaaattactctcaaaatggtattaaaaaaaaaaaaaaaagcaccctctcgtatttcatttttgctttttcttaacaatacctttggccatttttttccagttcactatgtttgtatactaacttttcttcagccttttaatgcgaagccaactagtagagcatgctttcaggatctgacagctctgctagtagagcgagtatttattaatacagaattaaccttcgcccctttaaagtcaagtctgtctaatctaactagcgcctcgctttgccttctcacaatgctcactagccatcatgctcacccttctcttccagatccacttcctcatgatactgtcttctaactgggcttacttaaaggatgcgagcaaaatgcaggcttaccaggatatcaaagcaaaggaagaacaggaactgcaagatatccagtctcggtcaaaagaacaactcaattcttacacataaatgtttgccagagtgtttcggccgacgtatttacagctctgacaaatcatcagacagctgctctgcagtacagatgtgtatcccaccaaactaatgtagatgtacaaacacttcactgtctgtctcaagctgctgggatgtatctctaggaaaaccttccagtgggtaaatctttttctttagaacaaatattggaggtttcatgttagccattttaaaaggcaacactttgacaaaatgatcgttcatactttgggaatttgtggcatgttcacatttattgctagggcaattctaccaagacactcaatggaatatgtcacactccttaatagggacctgtgactccttaataaggacctgtgacatgcccagcatcaagggataagaccgtaaattcacatatatgccatctgtcctcaagtgttatctacataggaaataaaatggaattgatgtaaagttccatttctgacagctgacatttattaaactttggatcaaagataatgtgattcttatgattgatttctcaaactagcttttccctcccaagtccaggacccattaatttcctgagccaatcagaaatatatttttcaataatgctaaaattagctacaattctgctgaccctactattaaagaatctggatgctggactcactgacaagctttccagaagcaattttataacagatttcattttaacaaaatactgatccaattttcattattcttgagaaatgtcagctttgccttaatgagtatttgctttaaatttctaagaatttatatcataactagagacccaaatatctttcacagaattttgttccataaatgtttttcttaattattaagaagtgttaccttattaaaatgaccaccattctaaaccatttttcagtggtctggatacgaagtttacagtttcataccaactatctaaaacctaattgcaaattgaccacagacctctaacctcctacttttatagacttgaatacttaagtaatttaaattagggttggtatttcatttttttcttatctaaatcttagtttcctggaataataaagtttgatgttcagcaagagaactgcttgagtttaagccattttcaaaagaaacttgccttttacattattgtgttccagaacattaagtgactgtaggtactgggtattagtgatggtaaactttgtgttgctctttatgaaatgatccatataactgttgggtgcatcagtgcttttcaaaggggctgcttactatagggttaactatgtatattcattgttaagagttaacttgtggtttggctgtttcctggattttataacatacatgtgcagaaatgtattcaaatgaaaggaagcatacctttatcaagatgctattaaaattgaacatcaagtataatatttcatttggattctcttttttggttaatgcctaaaaatgcctatttgggatttttttttttttttaaattaagagaagctctcttctgtgtagaacagttgttccaaaatagcttagtgttttgttttcctgttgcatgacagatttaactattctttccagcagtggaggtgctgtcagagtccagtgttctagaagaggcagtgtctaaagcctaattttacttttctaattctggtagctattaccaggaatttttgaaagttttgtttaagtagtctaatattttttatgtaaagagcattaaattttgctatgtataaatttttgtaacctaacagtgaatcaatattttctatcagtgccaagggcttcctgtagttctattcaagtgttacaataaatatttgtagataatagtcaatacttgtgtatgcttattttaaagatctatttaggtggaaatagttgtggatgtactaagagtaatgaaataaaattatagcttca

SEQ ID NO: 37160 - DNA, 167776 bp, Homo sapiens; identical to SEQ ID NO: 37159

SEQ ID NO: 37161 - DNA, 14449 bp, Homo sapiens
tacgcgccttggggtccgggtcggctttccccgggacccctggccggaaactgagccgttcacttccgccaccagccggaagttttctgtcactggacgccaaggagttttcggtggctcagctgggtaaccggggatcaccatggcggcctcattggtggggaagaagatcgtgtttgtaacggggaacgccaagaagctggaggaggtgccgggagggtgttgggggctaactgggaggcggctgggaatagggcggagaaggggcttccgggaggagggaagcacgtgggaggaggcatggagagagaacagaattcagcccggaagaatgggtcctgacccggctgtgtggaaaagctggggcgcaagaagggagtggctgcagaatcggggcgccccggggttggcgagggaacgagggtctcgacagatcccgacacagggcttgtgtggtcagcgactgcgggacccggaggagtagcggggctcttaacaaccgccccgaaggtcacctattgaagtagaccccaacccagtgtcccgacactcttctgggacttatccacatcccgctgctgggccagggctagcaggacccagagagggcgtgggacggagttccacactgagcagtccgtgcctcaccaccgtcctgaaatgttctaacctcttttcgcgtgtgtgaaatggggatgatgcaggacatttgcttcacagcgctatagagaggaggagtaaaggaggcagtggatctaaagtttctgtttgcagggactttgtggctagcaagtaacagaaacacacagggagctcatgtaagccaccagatgactcctgtgggaatatagtgttatcgtgtcccacaggacctgaagttctctcaagaagctgacttgtccttgttctctctggatgctgatccctattcctgttcatatctttcccctttcttccctgctgggggatggaacaatgaggcttctaccagatatcagctccgactggctttgcttgaatcaagagtttgcccctgttcaatcagccatagccatggagtgggggtcatgtgtgggggatcaggatgacacccactggatatgtctgaggcagaccagtggggtgtaatcactagggacacctacatttgcctgtagtgtagggagggactgatgtcactttggtgccaggactgagtggccttctcaggaaccagagccttttgccgaaaaaaggtttgggatcctgaggccagaccagtcaggcagtccaccctgaacagagcccatgcaggacagtgggcatgagaccccaaacctctggctgagaatattgccctcacttaaagaaggagctggaacccgagtgcagtgcctcacgcctgtaatcccagcactttgggaggctgaggtgggcagaacatctgaggtcaggagttcaagaccagcctggccaacatcatgaaacttcatctctactaaaaatacaaaaattaactgggcatggtgacacgtgcctgtagtcccagctactcgggaggctgagacaggagaatcgcttgaacctaggaagcggaggttacagtgagctgagatgacgccactgtactccagcctgggtaagagttgagtgacagagtgagactctgtctcaaataaaaaaaaaaaaagaagaagaagaagaagaaggcactagagtagccaagggagactccttggagaacatggacttgaacacttggcctagaacaggtagtctttttttttttttctttgagacagagtctcactctgtcgcccaggctggagtgcagtggtgcgatctctgctgactgcaacctccgcctcctgggttcaagcaattctcctgcctcagcctcccgagtatctgggattgcaggcatgtatcaccacgcctggttaatttttgtatttttagtagaaacgggatttcgtcatgttggccagactggtctctaacccctgacctcaagtgatccaccctccacccatttcggcctttcaaagtgctagaattacaggcatgaaccacctagcccagctgtgtttttgttttgttttgttttgtttgtttgtttgtttagacaaagtctcactctgttgcccaggctggagtgcagtggcacgatctcagctcactgcaacctccgcctcctgggttcaagcaatcctcatgcctcagccttcctggtagctgggactacaggtgtgtgccaccacacctagctaatttttgtatttttagtggagatggggtttctccatgttggtcaggctggtctcgaactcccgacctcaggtgatccgcccgccagggcctcccgaagtgttagattacatgcgtgagccaccgtgcctggccgaacgggtagtcttaactagtggtatgccattggcagactgaggaaacctatggaatctttctcaggaaaatagtttcaaatgtacaaaataaaatacatggtattataggctgggcactgtggttcatacctgtaatcccagcactttgggagactgaggctcaaggaggatctcttgagccgaggagttcaagaccagcctgggcaacaaagtgagaccctagctctacaaataattagcctaagcatggtacctgggccacctgtggttctaggtacatgggaggaggatctcttgggcccaggaggttgaggctctagtgagctgtgtttgtgccactgtactccagcctgggtgacagagagagagaccctctctcaaaaaaaaataaaatacataggattacaaaggaagtcaactaaagtgaagtacaattatcaaaatgttacaaatatttgtgatttagttatatatactttattaatgcattaaaggattcaatctaccaatgtatgagtaattatcttaatttttttttttttttgagacggagtctcactctgtcgcctaaggctggagtgcaatggtgcaatcttggctcactgtagcctcaaccttctgtgctcaagcaatcctcctgccccagcctcttgagtagctggaacttcaggcacatgccactatgcccagctaatttttgtattttttgtaaagatggggttttgccatgttgctcaagctagtctcaaacttctgggctcaagcaatctgcccaccttggcctccaaaagtgctaagattacaggcgtgagccacaggacccagccccttaattttaaaatatcaagataaatgatattttgagatatctgcagcaattgtaatgagttataacaacatctgtgattttagtagggttaaaagtcacaggcactgctagtaatattttggtttgttacctatattcataattgaaaaagttactacatttcaattaagggttactaagaataaagttttttttcccaatccatgttcataggccttctgaattctgggtatcttctgttagagaattcctggtctaggaggatggctagggtttctgggagcattgagaagagaagagtgtgttctggatgggggcttagcacaagcagagacctgacgtagaagagatagagaagcaaggagatggaaggggctggcttgctggggtgggaccctgaaagccggggtgaggcccacaggcctgagttggtaagctttaggagatgggcagcagagttatcgatgagaaaggcggatgacagctcacgtgctcacatggagaatcactagatggtgataagtgttctcttttctcttggaacaggtcgttcagattctaggagataagtttccatgcactttggtggcacagaaaattgaccgtatgtctctgttttgttttatttttaaaagatggttggatttctctgtcttcctgtgacctgactttctgtgtgtctgtttccctgataagtgccggagtaccagggggagccggatgagatttccatacagaaatgtcaggaggcagttcgccaggtgcttgccctgcccttgtcccacacttgctcttcttgtccaggtagcttccagggcctgcgcctgctagaaacaatagagtagacacagtttgttgagctttctaggaccggcccagagtcctctagggttcagttaatattggctttggaacactgccttcctttgccagccttgaatacatggtatctcccccagaccaccaccatacactcccacgtacacacagactccccttcccccaaatgctcagacaatggattccagccctacatcctccccacacacatccaccgctgcattcacacatgttcgtggaactgagaaagcacgctgcggagagtcaggctgagtgtgaatcccagctctcccattgctgtgcctggagcaagctttaacaatcggccaaagcttggtgtcctcataagataagagattggccaaagttaagagattggccgagggcagctcccatggtgctgtctgccacagatctcagctagctgagggctggccccagcctgggtgacgcgggtgacctggacgttccaggtggggatggtgatcatgggtctcagggctgtatgtctttgtgctgcaggtacaggggcccgtgctggttgaggacacttgtctgtgcttcaatgcccttggagggctccccggcccctacatgtgagtgactacctccacccccttacagggcgtcaggcccaaaaccaccagaactgcaaaatgatgaggtacctgatactgcaggtcattccctgtcttagcatcaacagcctttcacgttgtcccgaggaaagacgggataggagaagcatgcctttcttttgtaaagtgtgagaatgcgacctgtaagtggagatggtaaaggggaccccacgcatttgagaagtacattcataggtagattaatttcaggaaagagaaaacaaggaagttggaatctaaaacttgatttctttcttcctttcttttttttttttttttttttgatacagtctctctctgttacccagacggctggagtgcagtggcatgatcatagctcactgcagtctccacctgccaggctcaggtgatcttcccacctcagcctcctgggtaactgggactacaggtgtgcgtcaccacacccagctaattttttgtatttatttatttatttttaattttttaattattttattttattttattttattttgagacaagagtctcgctctgtcgcccaggctggagtgcagtggcgcgatctccgctaactgcaagctctgcctcccgggttcacgccattctcctgtctcagcctcccgagtagctgggactacaggcgcccaccaccacacctggctaattttttgtatttttagtagagacggggtttcaccatgttagccaggatcgtctccatctcctgacctcgtgatctgcccttcttggcctcccaaagtgctgggattagaggcatgagccaccgcgcccggcctgtatttatttatttttggtgtgtgagacagggtctcagtctgtcgctgaggtaggagtgcagtggtgtgatcacagctcactccctgggctcaagctatccacctgcctcagcctcccaagtagctgggactgcaggcacatgcctagccagtttttttgcattttttgtagagataggattttgctacgttgtccaagcttttctcaaactcctgagctcaagcgatccgcctgccttagcctcccaaagtgctgggattataggcgggacccacctcgcctggctcttggaggcattctttttcatttccccttggctgtcaatagggaacagcctggaaaaggtggtaagaagatccagctgctcctggtgtctgactgtcctttctttctcttgcagaaagtggtttctggagaagttaaagcctgaaggtattatctgctttgtttcttccctggatctgttgggaatgagaatctgggctttgtctaggggagggaccccaactagtaatcaggagtcccaggttctagcccccaccatggagcctccacctcattttccccatctagcacctgcagctcgtaccctgtactccagagagcactgtgtgggggagggatgatgggagctgcagggttgaggaacaaaggggctgtacttaattctgggtttcaagaggaacttggcccttgtgactgccttagccagggcctgccctgggagttggaggactgcccctcctggaccccagcagtgcatatcctgtcacccacagttgcaagccaaaatgtcccctctttatgtgcttttatttatttagagacagggtctcactctgttgcccaggctggagtacaccggtgtgatctcgactcactgcaacctctgcctcttgggttcaagcgattctcctgccttagccttccaagtagctgggattacaggcgcccaccaccacgccctgctaatttttgtatttttagtagagagggggtttcaccatgttggccaggccagtctcgaacacctgacctcaagtgatccgcctaccttggcctcccagagtgctgggattacagatgtgagtcacaacacccagcctatttgtttacttatttatatttttgagatggagtctcactgtcgcccaggctggggtgcagtgcgtcaatctcggctcactgcaacctctgcctccctggttcaagcgatcctcctgcctcagcctcccaagcaactgggattacaggcatgcgccagcacgctggctaagttttttttttttttttttttgagacaaagtcttgctctgtcgcccaggctggagtgcagtggcatgatctcggctcactccaacctccacttcccggattcaagcgattctcctgcctcagcctcctgagtagctgggactacaggcacgtgccaccatgcccagctaatttttgtatttttagtagcgttgggatttcaccatgtaggccaggatggtctcaatcttctgacctcgtgatctgcctgcctcggcctcccaaagtgctgggattacaggtgtgagttaccatgcctggccttttttttttttttgtgacaagtttcactcttgttgcccaggctggagcgcaatggcacgatctcggctcactacaacctccgcctcccgggttcaagtgattctcctgcctcagcctccctagtagctgggattacaggcacctgccaccatgaccagctaattttttgtattttttgtagaggggtttcactatattggccaggctggtctcgaactcctgacctcaggcgatccacccatcgcagcctcccaaagtgctgggtttacaggcgtgatccactgagcccggcttaatttttgtatttttagtagacacggagtttcgccatgttggccaggctagtttcaaacacctgacctcaggtggtcccacctcggcctcccaaagtgctgggattacgggcatgagccaccactcccagcctattttatttttttgagacagaacctcactccatcgcccaggctagagtgcagtggtgtgatcttggctcactgcaacctctgcctcctgagttcaagtgattctcctgcctcagcctcccaagtagctgggattacaggtgcccaccaccacgcctagctaatttttgtatttttagtagagacagggtttcaccacgttggccatgctgatctcgaattcctaacctcaggtgatccacccacctcggccttccaaaatgctgagattacaggcatgagttaccgcacccatccttatgtgcttttaaaaacactttacattatagagcatttcaaacctgcatagtagaatatcataataggataatgggcataaatatatacagttattatttgtcaattaaaaaaagcatagtagaataatgaacctcagttgccatcaaccagcttccagggttatcagcacgaggcctattttgtgacatctgtaaccccccttatttttcctcagtccagtattttaaggcaaatcacagacatcatatcatcagtaagttcttcagcttgtatttatttttatttttatttgttttaattttttttggagacaagggtctccctgtgttgcccaggctggagtgcagtggctcaatctcggctcactgcccaccatcagggctcaagccatcctcccaccttagcctcctgaggagctgggactacaggtgtaagccaccatgcctagctaatttttgtgttttttgtagaggtgaggtcttgctatgttgctggggctgatatcaaactcctgagctcaagcaacccacccgccttggcctcccaaagtgttgggattacaggtatgagccaccgagtgcagccactgtatttctaaaaggtgaaaaatttaaaaactgttaaacaagtaaactataatcattttaaaatactacataatcattttttggatttccttggttgtagaaaaagtgcctattacagttggttagtttttgtgggtttttttttgtttttgttttttctttcctgagatggagtctcgctctgtcgcccaggctggagtgcagtggcccgatctcggctcactgcaagctccgcctcccttgttcacaccattctcctgcctcagcctcccgagcagctggagctacaggcatcagccaccacgcccggctaatttttttgtatttttagtagagacggggtttcaccgtgttagccaggatggtctcgatctcctgacctcataatctgcccgacccggcctcccaaagtgctgggattactggcatgagccaccacgcccggcctacagttggttagttttgaatcaggaaatcaaacaaggtccacactgcattggctagttttctgactttaaataaagccttgtatcgtcagcctgtgccagagggaagcgagaatgcccagagacttccatttcaagcctagtcccactgccttgggctctgccgcccccgctaccccaattgagacctaatttccccttttagggaattcctccctccccacccttagtgggcgtcttgggagtgggggtgggagttggccattagggatgcactgagccctcactgcccacccgcaggtctccaccagctcctggccgggttcgaggacaagtcagcctatgcgctctgcacgtttgcactcagcaccggggacccaagccagcccgtgcgcctgttcaggggccggacctcggtgcgtacccaccttgatgcagttcccgccgcgcgccgccagggggtgccgcgacccgagccgaccgccccgagtctgcgggagggtggtgggaggggcgccttggggccagagatatctgtgccttgctgagaggctcccctgcgcagcataggtagaagtgctgtggatcctaggagggtggtggaaagggttccctggggccagagtagttgcctacgccttgctgaggggtgcccctgggcaggacaatggaagtgttgtcaattctgaaacctgtttgacccctgaggctgttgtttcagggaaacagttggctaacagctcctgaggcctgatagacccagaagtgcaaactgaaggtgacaattcccaaagctatttttttctgtttattttatttatttatttattttttgttagtgagaaaccacacttggatcaaagctacatctatagcccagacttctctaacctcagatttccttattcaactgccaaggtgcttgactatctctcagcctttccagcttttcatgtttatgtataatagaatcttaattcttttttttttttttttttttttttttttgagacaaagtcttgctgtgttgcccaggctggagtgcagtggtgtcgtctcggctcactgcaacctccgcctccagggttcaagcatagaatgttaattcttggccaggtttggtgatttacacctgtaatcctagcactttgcgaggccccagcgggaggctttcttgagcccaggtgttcaagatcagcctggacaccataacaagaccccatctttgcaaaaaattttaaaatgaggccgggcgtgatggctcacatctgtaatcccagcactttgggaggctgaggcgggcggatcacctgaggtcaggagttcaagaacagcctggataacacagcaaaaccccgtctcaactaaaaatacaaaaaatatctgggcatggtggcaggcacctgtaatcccagctactggggaggctgaggcaggagaatcacttgaacccaggaggcggaggttgcagtgagctgagatctcgccactgcactccagcctgggcaacaagagtgagactccgtctccaaaaaaaaaaaaaaaagaggctgagcacagaggctcacacatgtaatcccagcactttgtgaagcaaaggcaggaggattgcttgaggccaggagtttgagaccagcctgggtaacatagccagaccctgtctcaaaaataaataaatagccggacatggtggtgcacacctgtagtcctagctacttgggaggctgaggtgggaggatcacctgagcctcggagtttgacgggacagtgagctatgatcgcactcctgcactccagccatggagtgacggagtgagacccagtctcaaaaaaaaaaaaaaaaaaacaaaccttaattatttgcccaaacttattccttccgtgagatgtattcaacaccccctactgcctatcactgctcacgacagcctccacctcccaggctcaggtgatctcccaccctggagagtaactgggactacaggcgtgcaccaccacacccggctaatttttgtatttttggtagagacagggtttcactatgttgcccaggctggtcttgaactcccgaccttaagtgatccgctggcctcattctcccaaagtgcaacctccatctcctgggttcaagcaattctcctgcctcagcctgccgagtagctgggattataggcgtgagcaaaaaacatttgttgcgtggttgaggttcagtaactggccttagtcacgcagctcctcacggcagaagcagaatttgcctttgggtctaaattacttggcatctatgtgactaatcccaatcatgtaccacctccgttgtattttttaaagagtaaaaaaaaatgtttttgagacagggtcttgctttgtcacccaggctggagtgtagtggcatgactaccgttcatagcagccttgatctctcaggctcaagtcatcctcccacctcagccttccgagtagctaggacctcaggtgtgagctaccacatctggctaattaaaaaaaaaaaaaaaattggtagagatagagtctgactgtgttgcccagactggtctcgaactcctgggtttaaaccatcctccctcctcggcctccccaagcgctgagattacaggcgtgagctaccacacctggtcccttgtatttttttcagttagaatcttttgggtttttttgtttgttttttggagtgtttgtttgtttgtttggagtgtttgtctctgtctgtcgcccggactggatcacagctcactgcagcctcgacctcttgggctcaagcagtcttcccaccaggtagctgggactacaggcttacaccaccaggctaggctaatttttgtattttttgtagagatggggtttcgcctttgccacgtggctcaggctggtctcaatttcctgggctcaagtgatcttcccacctcagcctcccaaagtcctgggattacaggcatgagccaccgcgcctggccagattttctttttcttttctttcttttttttttttactttgataacaacatgacatttcatgtcactggattacaatttgttctttttctaacattttcactgtggaatttccctactacagccagtacgtattgtactcactaatgtgttcatgaagtggggagttgggtacctgcttcctgttgcggtgtttcatcttattgttaaagtcttccttgtattttcaggaacgctgtcatagtagccggcatctggcttgtccacggagttcagggtacttagcttcctattaggagaaaacgttttctgtctatctttctttctgtctatctttcaaagtagcctcattgttcttcagtgatgtcccaatttgtcccgggtgtggctggcgagggcgcgtggccccggaggtgctggtggtcctgtgggtccatgcctcctccctgtgtgtgagggaagagctgccccgctctgctttttattgtattcagcaaacatttgcaggtgctgtaggggccttgcaactacattttgcgtaagttgggtcaaatcaaattcacagactcaccaaactcatactggccactgccctcctcgtgcttgtcctctggacccagttacacacctgtcccccctttcctgtggcagggccggatcgtggcacccagaggctgccaggactttggctgggacccctgctttcagcctgatggatatgagcagacgtaaggagccctgcttttcttccctggggtgtggggttggtacagccatggtttgggttgggccagtgccccgcccaagtgcaggcatgcggatatgggcaggggaggctcccagggtgctgttccagccacaggcagctctgctggggtggacactaggaatctgggtggcccagtccatggttggggaggcagccagatggcactgagagtcctgggctctaaggctccaggtcaccccacatcagctgtgtagccagtggtttcgcctttctggccttggcttgtaagctgtacatctgacttttttttttttttttttgagatggagtttcactcttgttgcccaggctggagtgcaacggcgtgatctcaactcactgcaccctctgcctcccaggttcaagcaattctcctgtctcagctgagattacaggcacgcaccaccgtgctcagctaatttttgttatttttgttagagacggggtttcaccatgttggccaggctggtctcaaactgacctcaggtgatccgcccacctcggcctcccaaagtgctgggattacaggcgtgagccaccgcgcctggccacatctgacagttttatggcatcattttctgacccccatctaggttgggaaaatgtccaggcttttgcagcctctggtgggcactattttatgccctccaagtaccagttgttctctgtagttcgcacaaatcgccccttgttcacacaaggcacgggccattgttggaatcaggctttccaagctggaggggcccttagggagcgcagtgtgaggccccacaatagccccagcaggggtgaggacattgtggaaccagccactagccatatggggctgtggagcacttgcgtgtggtgagacccagaaacggaatatttctgttcagcgttaattcatttaaatagccacacctggctagtggctactggccgccgtcttgcacagagcagtctgcaggccacgggcggggtatgggattctcacctcactgcggtgctggcatggaggtcgggcccctggccagctgttcaagtgctcccccgccctcagcgcatgagaggagactgctgtgtttgctctgtcaggccccactgcttcctgtcaacagatgacaaagctgatcaaacatgcagctcatccccccctgtccccagcttcccttaatgacttttgggcacactagagcaagtttaatacccctccatgctcattcatgggggtttctgcctacaggggaattgaaaactttatccgatttttaaaaattcactggctgccaggagctgctgggccccactcccctttccttggggtctgtgagctttggtctccagggatgagatgaggtagggttgggagggggtgcacttccttcctgaatctgggctccctgagctgctactgtcacccctcaggtacgcagagatgcctaaggcggagaagaacgctgtctcccatcgcttccgggccctgctggagctgcaggagtactttggcagtttggcagcttgacttctgcagctggaggaggcccctcaggccggggatctggggagggctagcccaaaacctcccgcatcgggcaggcaccccctgaagtacttccttcagggtttcccctttgtgagggtgtcgagtagcctcaccggcctgtctggaggagcagctggctctgctctgagaaactctggcaagtggacgccattctcttgcccttaggattcactgctctctcctacagccgccaggcctggggtcctgaaaggaccttgggtggtaaagctgtacttggtgggagtgagggcgtggggaggaaccatgcaaatcgccttccatggtttttaaatgcagtaaataacatttctggatgagacttgtttccaaaataaaccagctatatctgttttg

SEQ ID NO: 37162 - DNA, 49435 bp, Homo sapiens
gcgtgatcggtttccggtcagtggtgtggtaccgggtacccggagacgtgtatcggacggtgggccgcagccatggccgagagaaaacctaacggtggcagcggcggcgcctccacttcctcatcgggcactaacttacttttctcctcctcggccacggagttcagcttcaatgtgcccttcatcccagtcacccaggcctccgcttctccggcctccctgctcttaccgggaggtaataaggggagggcggccccgtgtgtggtgggaggcgggcgggggacgtgcaatgacaaaggtcagacgggagtttttccttctgcctcgagctaccctctggatagcttgccaggatcattactggccaggtttgagtgggtcgggggctttgggatcttggaggtggcaggtgatgagacttgctcttcacggaaaccccctgttccgagttgtccagagtgctggacattcattcgtaccctggcattccgcaaatctttgctgaatacccgttgttggtacgccaggtgctggcaggaaatgcaaataaattaaacagtggccctctcctagggtacagtagtctgtctcccactaggagactcctaggatacggtaagatacctcctaggatggactgtgcccctctcctaggatacggtacactgtctcctactaggagattgttgtgatacagtacaatatcttctaggttacagtaagatatcttataagatggactgtgcccctcttctagaagcctgtaatatttgtgaagtagacatatacaatgcattccttatctttttttttttttttttttttttgagacggagtcttgctctgtcgcccaggctggaatgcagtggcgcgatctcggctcactgcagcctccaccttccaggttcaagtgattctcctgcctcagcctcccgagtagctgggactacaggcgtctgccaccatgcctggctaatttttgtatttgtagtagagacagggttccaccatgttggccaggatggtctcaatctcctgacctcaagtgatccgcctgccctggcctcccaaagtgctgggattacaggtttaaccccccacccattcctcatctttcaagacaatacatcacttcttccaagaagctgtttcttgttctcttaggcccccactcctatgtgcactcctagctcttttttcatatttgtattattgtccagggagattgctttttgatgattatgtagcattgcccagagcatagtgtttaagagcacagactgtctgtattccagtccttgccctgccagtaacttgctgtgtgactgtaggcattttactttacctctctgtgcttcagtttctatgtatgtgtagcctcacagaattgtaattagaaatgctttaatttttgcaaagcgctaagtatagtgcgtgccagacagtgtgatttaatgtttgtgaaataaacacacctgcctctccatttggactgcagtcttcttcagcagctatgacctaattgcctttttatctccaggatcttatttagggcctagtacatagatcctctttggatgctgagtttccagtgaataatttattcttgtttgaaggatgaaagacagtttcatggagaagcgaagacaggcacactgggaacagctgtacatgaaggttcccctgcccatgtgttatgtttcttcttgatgcttgtcactacctgacatgtacacatatttgtttattccactgcactaggatgtaagaccatgaaagcaaaaacttacttttattcacgattatattcccactgcctagaatggtgtgtggtatttagtagaccaattattcagtagatgtttgttgaatgagtgaaaggatgggagtcaaaatgatgtctcattttgacctgtggttgaaaggttaggtgttgctgtctttggtgaagaaccagcatggttggagcagaatgctgtgggaggatgcaggaataaatagggctatacttggggttttctaattatcctctgcaccattaaagttgtttggttatgtccgtcttccttgctatgtagtgtttggtttgtgtgtgtcactgtgaattcatgctaaacgttttcattgttaagtctggtatagctacacctgtctttaatgcttttgtttcttggagacagtctgtgtgtgtgtgtgtgtgtgtgtgtgtgtgtgtgtgtgtgtgtgaatattaataattttagaactaaaattcatctctaaaaatctcagaaacccattcagagaatttccagagacaaaagaagaacctgtctccctggaagcaacagttaatcatataagtggaagagagacacaggaagcaatttcatacattcagcagacatggaaggcctggcacagtggctcacgcctgtaatcccagcactttgtggggctgaggcgggtggatcacctgaggtcaggagttcaagaccaacctggccaacatggtgaaaccccatctcaactaaaaacacaaaagttagttggatgtggtggtgggcgcctgtaatcccagctactcgggaggctgaggcatgagaatcgcttgaggaggaggttgcagtgagctgaggtcatgtcactgcacactccaccctgggcgacagagtgagactccatctcaaaaacaaaaaccagacatggattgagcagtttctatttgccaggcactgttccagaacctgggagacacagaagagcagacagccctgccctcaatgactgcacagtatgtgtgtatacacacacacccacctgtgtaagcaactgtgatacaggtttagaacagttagaaagagggattgatagatggctatgaatgctacgggtatcaggctggctgagccggggaatggatgtcccttaggccttcagggcctcttaggggaggtgatgcttgagctgagtgttgaaggatacatagaagtgagggaaactggagagacaggcatatgtgaagtctgaaggtgtgaaaaaatcttcagatttggcaggagttagtggttggtggaatgggacagggatggagctcatccctctctcctgtcccttcacctttgtctcctctcccctgtgtcctctgcccccagtagatcactttgactagagtgtgtgcagtggagtggcctcagtgatctatgggccacatatgccatactcaggaggagtttgtagttcatcttgtggggtgttggggagcctttgaaggattttcaacaaggcagtgaaattagacgtgtgtttcagaaagactggagttttctctagtcgcactggaataaggttgactgtagcaagaggattcagttgggaggcatagtgagaggctggcagtggctatggcagtctagcctgagtcagccacattgggtgtgaggagcagggagcagatgtgcgagatgtgtggactatacagttgtagagactcacagaagaccagagtgtcagctctgtctgtcagaacagaggcccatttttgtttagttttagacccaagactgagctctgtacctggcacagaatgcatcctgagtaaatatttcttgaataaatatttgaatgattaaatgaagggtttgagagagagggaggagtctcagacttgaggtttctggtttgaatgtctgaatgaatgttggcaaacatctgtggagattgtgaaatacagaaaagggagcatggaggtgggtagttaagataaactccgttttaggcttactaagcatgaggtatatgtgactgaatctgccaaaaacattgaggaagtagttggaaaacaagttctggaacacacgagaatggtctgggcttacgatggagttgggagtgtcacaaatatacaagtgcctgttaaagttgtggctttagatgacatgtgtccaaatgaaatgagaaagtgcccctgaggtgagggtagcagtatatggagagcacttcatttgtagttgatgctaatcagaaaaaaagtttctcggaccaggttgacctcaagtttttctaaaggatgaaagataccactgagtttttttttttttcattcttttaattgttgggaatgaactaagaaatacaaataagtccaagtgagggtcactgacctgaaaagaggggtgggagctggaaatatatcagagaagtggaatgattcaagtagacacaaggccttgtgcagcaagggatattttatttttagttacaaagaaactaccaaaaggagtattttgaatggtggagtattttagttaaactgatgtgtgtaaataatgagagctcaagaagctcaagccctagtctcagcagaggtcaagaagcttggagcccggagcttggaataaggctgcctgttggcaggtctccaagggcagggaccgaagtgtgcctgtgtgctgtgagtgagtccagccctctgatggattccatgcctccagcaaggaggtaagagggaatgaggcaggagcagggaagattaggaggaggaatatgaaagctacaagctagggaacataaaagtttcgtaaggaataatagtaacgtggacttttgaggtgatatacagggaagatgcttttattttacaacttggtagtagaacagaagctaaattatttggagtcgttaatacccacagtgaacatcaagttgggcaaagggatgggagatcttcccttggttagaaagtgaccttctcagcaatttggtattctgtaatgataagtctgtgatagtgcatgattttagggaatggcaattaatggttgacctacttgggaatacaaataccacgtgttcatttgtacaataagtgctttgtaggtgagattcctgacacaccccttcttgtcaacagagttatctttagtctcttgttatcactatagaaataaaaatatatgtatttgggtagtcgagtaacagttgaattatttcttaccaagaaaaaaagataaaaaataatatgtaaggctgggcacgggggctcatgcccgtaatcccagcactttgggaggccaaggcaggcagatcacttgaggtcaggagttcaagaccagcctggtcaacatggtgaaacttcatctctactaaaaaaaaaaaatacaaaaattagctgggtgtggtggtgggtgcctgtaatcccagctactcgggaggctgaggcaggagaatggcgtgaacctgggaggcggagcttgcagtgagctgagattgcgccactgcactccagcctgggcgacagagcgagacgccgtctcaaaaaaaaataaaaaaaaaaaaataaataaaaatagtaagtatagattttgtttctatttttaaaaacatatacaaatatatatttacaaaataaataactatttgtatttattttagaagtatggaagggtatgtagcaaaatgttaacagtgttaacagcgtgattgtctctggcaggtgggcttatgaatgaattataattgtttcctcttatgttttcttattcatgttttctagtttttcatttctaagaagcaagttttcaaagaaaaaaagaaaaaactgtttttttctgtaatgcagaaatagcaagtttgaagaacaaataaggaagtataattgctagcccttccttatagaatcgtatctgcggagtgatagagtaccctttaaaccacatgctctcctgttccatttcagaggattccacagatgttggtgaggaggacagcttccttggtcagacttctattcacacatctgccccacagacatttagttacttctctcaggtatcaagcagcagtgatccttttgggaatattggacagtcaccattaacaactgcagcaacctcagttggacaatcaggattccccaagcccctgactgctctcccttttacaactggatcccaagatgtctcgaatgcattttcaccatccatttcgaaggctcaacctggtgctccaccttcctcactgatgggaataaattcttatctgccttctcagccaagtagtctccctccttcatattttgggaaccaaccccaaggaattccccaaccaggatacaatccatatcgccatacccctggcagcagcagggctaatccttacattgcaccaccccagctgcagcagtgccaaacaccaggccctcctgctcatcctccaccttctggaccccctgttcagatgtaccagatgcctccaggatctttgccaccggtatggagacatgattttgtgtcctacttattcactctgtgtcttctttctcacctgaacctatgttttaaaaaacatttcacatcttataatcaatatggtgacaaattagtttcagagggtattctttgtaagctacatgaagtaaacattgtcttaaagatagcttattggatggctcatattttagtgtatattacctgtttattgaagcagtaactgattttaatgagttagctacgtgtcagtatttccagattttagagtacggtaaaaataagtgttgtctagagacataggagaattgaagcggttattgtcttaacagactgctagtttctcatctttcaattacactagtcaatcaaaacactcaattacagggactaaaattgattacttcagtaatttctttatggagtttggatctagatcagtcaaactctatctagggagagttggtggaataacgtatgcattgggtaaatttcatgaaattcccttatgcatttttcccaactaattgtttatttgatttccaaagaaaaatcaacagaattaaacaaaaagagaaatgattaaaaagaattaagaacccatttcagtgtggtggagatagcagtattgtgatcagaatgtaactaacttctctgttagagatagagaatggactctgttttatcatttcatttaaatcataccaatacacaaatttttgacaatgttggatttcggcattctgaaaagtaaccagattcatagcatgtggtatatagttagtatttttgctaactataacaaactaattgtagtttgttgcttaaatttttaaaaaggtttttagataaaagtttaaaaaatgataatttcaaacttgaagaaaagttgcaaaaataaaaagagtacaaagagcactctaatatcctttactcaggtttacttatcattaacatttcatcccgtttgttttttaatttgtgcatgtgcacaccctggcatatgtgagccctccctcttcccccatccctttctcctgccccttcctcctgcttctcctcctgcccctccctcttccctcccttcccctcatcgtttttttctctttctgtatatatgcaattttggggggaatatttgaaggtcagtaaaatacattatgattctttactcctaaattcctggtgtacatttgctaagcataaggacattcttcttatgtgcacagtgcagctatgaatctcaggaaattgagtgttgatgtaatacttcaaaatgattttttagaaattatatatgtgtatgtatatgtacgtgtgtgtgtatgtgtgtgtgtgtgtgtatatatatatatataaaatttttttttttgaggccaggtcttgctctgtcactcaggctagagtgcagtggcatggtaacggctcactgtagcctcgaattctcaggttcaagtgatccccctacctcagcctcaccagtagctgggaccacaggcacatgctgccatacctggctaattttttttttatgttttgtagaaatgaggtctcactatgttgcccaggctggtcacaaactcctgggctcaagcagtcctcctgccttgacctcccaaagttctgggattatgggctaaattatatatttttttgagactgggtctcactctgttgtccaggttggaatgcagtggcgcaatcacagctcacctgcagtctcaaactcctgggcctcaagtgatcttcctgcctcagcctaccaaagtgctgggattacaggtgtgagccaccacacctgtcccaaaatggtgtctaattaaaaaattttaaaataagtctagtctgattttaaaatcgtttttgtagaaaatttgaaaaatgcagaatactcaatttaataaaaaatgtccatagataaccactgttttcattttgttatatgtctttttttggcaaacatataatacctatggtttctataatctattttttttttgtgtgaacatactttaaatgttactaagattttttctaaaacattaaaatttttttctttttcttcttcttttttttttttttaaagagtggggggggggtcttgctctgtcatccagggtggagtgcagtggtgtgattacagctcactgcaaccttgaactacacttcagcctcaggagtagctgggactacaagtgtgccccaccatgtccgtgtgatttttagatttttttgtagaaacggtattgctgtgttgctcatgttgggctcaaactcctggcctcaaatgatcctccttccttggcctcccaaagttctgggattataggtgtgaaccatcgtgtctatcctctaaaacttttatttttgtttatttacttatttttttttttagctatctcctgcagaaaggatataagacatttttaatggcgctggaggatctagcatttgagttaaatattatttaatcaggtttctgttagacattttgattatttccagtgatttcctattttatttatttttttgcaaacattccaaatttattagctatgattttataatcaacattattgaggtataatttacatacagtaaaaggcatccatttacagtatacaattcgatttatttaaagtgtacaattagctgagttttgacagttgtacacaccaatttcctattttaaataaccttttgatgtatatccttggggataactttttatttttattttttatttattgtttgagacagagtctctgtcactcaggctggagtgcagtggtgcagtctcagctcactgcaacctccgcctcccgggttcaagcgattctcctgcctcagcctcccaagtagctgggattgcaggcctgtgccaccacgcccagctaatttttgtatttttagtggagacagggtttcaccatgttggcccggcttgtctcgaactcctgaccttaggtgatccacccacctcagcctcccaaagtggcaggattacaggtgtgagccactgcacctgggctatttgtttttataattctatctttaggataaatttttagaaatggaatgagtaggtcaaggagtaggcacattttaaaggttaaataggccgggtgtggtggctcacacctgtaatcccaacactttgagaggtcaaggcgggctggtcacttgaggttgggagttcgcaaccagcctgaccaacctggagaaaccctgtctctactaaaaatacaaaattagctgagtgtggtggcgcatgcctgtaatcccagctacttgggaggctgaggcaggagaatcgcttgaactcgggagacggaggctgtgcattgcgccgttgcactccaggctgggcaagaagagcaaactccgcctcacacacacaaaaaaggttaaataaatcatgggagatgtattgctagattgatttctgtaaaggtgttagtttactttgtgttctgtgagaaggtctggttcaccttgtaattgatttttttctaaattttttaatttttaatttttgtgggtacatagtaggtatatatgtttatgggttacatgagatattttgatacaggcatgcaatgtgtaatcatcacatcaggataaatggggtatagatatccctcacctcaagcatttatccttgatttggggttttgttaggtttaaaaattcttcttaaaattgctttggggtctagttattacactaagtaattgtccagatatacatgtaggataatctactaacatcagtttgggtgtgaagcatattcagaattcttttggacaagcatgacagtcttaactttgccgtcccctccaggttccttcttcagtgcagtcaccggcacagcagcaggtacctgccagacctggggctccctctgttcaagtgccatctccttttctacttcaaaaccaatatgagcctgttcagccccactggttttactgcaaggaggtagaatacaaacaactgtggatgccttttagtgtgttcgactctttgaatcttgaagaaatctataattcaggtaaacattggtcatacatcattcatatctgattttaggaagagaaggaatgagatcatttattcatgatctattttctgtgaatgtcaaataccttaatccttatagaccccagactctgtaccttaaggtgacgatattagtataagtcctgagttacctgggtaaggtatttgaagaaatgttttagtaatttacttcgtagtttaaaggtattttgaatcagagaagttgagcagttcatataatccaggtttcaatttttctgtttcccttgttcatttgtagttatgggggcatttataaagggcattctgtggaactctctatcctggagatgctctgtgaaaaaagggttccctggtcagatgagttttggaaatgctgctctctgtatctaggtcttgagagagatggtgtgcaggagtacattaatgctttgagaagtcctgcagtgtagaaatgtgtttctttgtttatcctgatatattattatatcactgtattattgtatgtagatattattgttctgataaaaaaaatccatcagttctttgaattatgtttttaaagtttgccctagctgtttcttttctacttaagagtcataattttgagcagcacagattaatcttaaacttctattttgaaataaaaatgagcctagttttttgtctttaaagattgagtagtcaccgtattcattatttattatttcatttttattttcttgagacagagtctcactctgctgcccaggctggagagcagtagcgcaatctggactcactgcaacctctgcttcttgggttcaaactactatgcctcagcctcccaagtagctgggattataggcgtgtgccaccacgcctggctaattgttgtatttttagtagacagggaggtttcaccattggccaggctggtctcaaactcctgaccgcaagtgatccacctctctcggcctcccagggtgctgggattacaggcatgagccactgcgcccagcagattatttattattttacaatatgccttgcagcagttaggaaaagtgttaattttgttctctagttcagccagatccggagagcgtggttcttggcacggatggagggcgctacgatgtttacctctatgaccgaataaggaaggctgcctactgggaagaggagccagccgaagtgagacgctgtacttggttttacaagggggacacagatagtcgatttattccctatactgaggagttcagtgaaaaactagaggtacgggtgctttatttctttatgagtttctttaaaaaatgtaggtcctatatacattggtgagtaacatcattcacagtggagcggactttacttacaagacagcttgttttgatgctgttcacagagaagattactttttaagtggtgtcatcactcatgaggtgctaatcgtggcatctgtgtctaaagatagaatatgatttgcagagacacatcacagatctaataaggtgcttgtgtcaagccttcaatagaacctaggccgctgggatttgttgttgatagaagatgccaagcatatggacattttcaaattagtattcagtaaaaggcttgaaattaacctctgatttgtgaaaataaataaatagaattggaagaagtgtcttgagtcttattagccatcttaaatctataatttcttcaagaaattatatgttgttttatataattgtgttaaatgcttgtgttaattctacttaagagttgaatgttagatatttgaaatacgttcagtgaattcagttgcatagataggaaatgagatacagaacattttagttaacttctggctgggtgtggtggctcgtgcctataatcccagcactatgggaggcctaggtgagcagatcacttgaggccaggagttttgagaccagcctgaccaacatggcgaaaccatgtctctactaaaaatacaaaaactagccaggcgtggtggcacacgctagtagtccgagctactcgggaggctgaagaggaaggatcacctgtgccagggaagttgaggctgcagggagctgagatcatgccactgcactccagcctgggcaatgggaatgagacccttcctcagaaaaaaaaaaagtatatatttgtatatgtgcatatatgtgtgtgtgtatatatataaagaaaaaagtgtaaaggaatgctgatatctatagcttaattttagatataaataaacaaataaagatatattgtaatttttggtacctttttggtaggcccctacgaagctatcatgtccccagattaaatgtttagttttactattttgaagctgaagtatatattttcaagtccaagcagtgtctgaaagtctacactttctcttaactatatttgattttatatgggtgacatagactttgaagcgggatagatatccacatactgaccactgcagcaacacatggctacctagggagaccttagcttttgttcggcttcttccaggaaactcaaaccagatcagggaagaggcagaggaggttaggaagtgagaaagccgataatagaaagggaacaaaatgatacgtattgctcagcatcctgttggtgatcctcttctgtcagagcactaagacaaaacaacggaagggttggagacagagaacacctttaatttgatgaagacatgattattgtctacgtggaaaatcaggagaacctctagaaatattagcaccaatacaagagtttttttgcaagtccgtgtatataaaattaacatacgtaaattagtaacattcctgtgccatagaaataaccaattaaaaatagaaaaagaagatactatgtatttataacagagagactatatatttataaaactacaggcaatgtaggaaaaaagcccaagaaaagtaccggtaaactttatggaacactgaagaacgtaaaaggtgacctcaagaaatggagctaggctgggcgtggtggctcctgcctgtaatcccagcactctgggaggccaaggtgggtgggttgcttcagctcaggagttccagaccagcctggacaacatggaaaaaccccgtctctacaaaaaatacacacaaaaaaattagctgggcatggtggcccatgcctgtggtcttagctactcaggaggcagaggcagtaggattgcttgagcctgggatcttgaggctgcagtgaactgtgatcgtgtcacagcactttagcctgggcaacagagcaagaccttgtctcagaaaaaaaaaaaaaaaaaagaaacggagctaaacattatgttcatgtaggcactatcataaaagatgtcaattcttcccaaattatcagataaattttaggcaatcccaatcaaaattcacatcagggtttttttttttttttggtaaaatttgcaagctgcttctaaattttttgtggaagatcaaaatgtcaaggataaccaagaccatttcgacaatgaaatgtgaaatctttaccagataatacttactataaagctgtggattgaaagggaatatgaagaagtgaaaataatttatttatttattttttaaacaggatctcactgtcccccagggtggagtgcagtggcgtgatttcagctcactgtaacctcagcctcctgggttcaagcgattctcctgcctcagccttccgagttgctgggattacaggcgcctgtcaccatgcccagctaatttttgtatttttagtagagacagggtttcaccatgttggccaggatggtctcgaattcctgacctcaggtggtccacccacctcggcctcccagagtgctaggattacatgcgtgagccaccacacgtggcctgaaaataatttttaaggtggtgaaagttttctttctttaatccttgttgtttgtggccttgcttttagaaattatgaattatatttgaagttttttttttttttaaatcgaagaggagggtcagaagtacaaaagactaggctgggcatggtgactcacgcctgtaatcccagcactttggaggccgaggcgggctgattgcttgagattaggatttcgagaccagtctggccaacgtggtaaaaccctgtctctactaaaaatacaaaattagccaggtatggttatgcacgcctgtaatcccagctactcaggaggctgaggcaggagtatctcttgaacctgggaggcggaggttgcggtgagctgagatcacgccattgcactccaacctgggtgacagagtgagactccatctcaaaaaaaaaaagtacggaagactgatgaagaggaattgttactgttactcaatgattgtccaagaaacagaaggaaatacttctattttcacgtgattgtcaaatactcactgttactagttttaaaaaaaagactttgtaacaatttttacttgtcaattaaaaaaataaatgaacaaaaaaaaggacttgtggatatgccagaggctccctcttactttgtgttgaatctctccccaagaggtcctcacgcttgttctttatagaaactagaatagtacgatcggccctccgtatccacaggttccgtatctgcagattcaaccaaatactctgaaaatatttagaaaaccacaacaataaaaataacacaggctgggcaccgtagctcacgcctgtaatcccagcactttgggaggctgaggtggacggatcatctgaggtcaggagttcgagaccagcgtggccaatatggtgataccttgtctctactaaaaatagaaaaattagccagatgtagtggctcattgcctgtagtgccagttactcgggaggctgaggcaggagaatcgcctgaacctgggaggcggaggttgcggtgagcagagattgcaccactgtactccagactgggcaacagagcaagactctgtctcaagaaaataaaaaataaaaattacagtttaactattgatatcacatctacatttcatgaggtattataagtaatctagagaagatttaaagtataagggaggatgtatgtaggttttatgcaaaaataatgctattttatataaaggacttgaacaccagggattttggtatctttgaggggtcttggatccagtgccctgcagaaaccaaagaaagactatatctggaggaagagtaagaagatggttggacagtgaagattttggagtcagaaagtcctgggtgatattactccagcccacatgaaaaaaaagaaaaagtcagtcctgggtggcaatgaactacagttctcccattgctgcttcccagttgtgtcatcttgtgcaactgtatacagtacttaaaatgtctattatgggttgaattgtgtctccccatcccccaaatatgttgaattactaatccccagtgtctcagaatgtgaccttatttggaaatagggtcattgcagatgtaattagttaaggtgaggttttactggaataggatgggccccaaagccaatataacttgtgatgtgaagacagacacacagaaagaatcccatatgatgatggaggcaaaggctggagttacactgcaagccaaggaaagccagagattgccagccaccaccagaagctaggaagagggaaggaggatttctttatagctttcagaggaacggtggcctgccttcctggcacctaattttctacttggagcctccagaactatgggatgatacattttttttctaagtcactctgtttgtgatactttgttaatgcagccctaggaaatgaacagaccatctaaaacttggttttcttcattatataatggggatcctgttacttaggcgtgattgagagtaattacttcaatggtatgtgtaaggtgataaaaaatatgttaaccagtcaggaaatgagaactgctattactgttatttttatcaccattatagtgaccgttttcctccatactttctctccatgtggtataaatttgtcatgttggaatatatgttgtttcccccattataggctgaatataaaaaagctgtaaccactaatcagtggcaccgaagattagagtttccaagtggagagacaattgttatgcacaatccaaaggtaatgatggtgttcaaaattttaaggtattaagttcattttaatatttttctgtgtatgtttgataaattgttcatttttagtaacttctacagtgggaatgtttttgtaacaagtgcattgcttttaaaatactttattattatagtggataatacagatattatttctatgattcacactgatcatagaaacaaaaacacaaatttttcgtagggcgaggtgcacacctgtgagaggctgagacaggtggaatgcttgagccagggggacagcagaaccctgtctctataaaaaatagaaaaattagctgggtgtagtggcacatgcctgtagtcccagctactcaagaggctgaggtgggaggattacttgagcccgagaggttgaggctgcagtgagtcaggattgctccccgctgcactctagtagcctgggtgacagagcaagacctcgtctcaaaataaaaagtaaatttttctcaggctgggtgtggtggctcacacctgtaatcccagcgctttgggaagccaaagtgggaagattgctttaggctaggagtttgagaccagcctgggaaacaaagagactctgtctctacaaaaattaaaaaaattagctgagcatagtggtgtgcacctgtctagctactcgggaggctgagatagaggatcacttgagcccaagagtttgagattgtagtgagctgtgatcacgctcactccagcctgggtgacacagcaagactctgtctaaataaataaataaaataagtatttcttatgaagtttctgtttatggcaacatgataactggagtttagtatgcaatgtagaagttgcttgataatttttttcacttgatcagaagttggcaagctttttctataaagggccagagacaaaatatttaaggctttgcaagttacatgttccctgttgaagccaccagctctgccaccgtggtgtgaaagcagccagagacaatgtgtaaaccaatgggtatgatattttcaatgaatctttatttataaaaacagatggccagatttttctgtgggctgtagtatgcctgtctgcccttgatgtggtttgctctaacctttcaagtaaaaatatgtcctttttctttttatttttatcgtctctatgagtttatcttgtttttaaaaaaatattgattgctggtattctgattctatcatttgccaaccttaatttctcagagctccaagttcctcacctgcaataatgatctcccagggtcatattttagatgaagtaaggtaatttatgcaaaagcatctagcatggggcttagcacacagtagtttctgagaacataggctttttatttattcatttgtttttatagaaaagtatataaaaaacttataatccaactacttctatagtccttattgatactgaaataaaaataacattcatatgccaacaaaatgtaaacagtttaaaaggatattaaatgaaaaataaaagcctcctatctctgccttcctcatttctcctctccatagtaaccactcttaatctttttgtttgtttttttaagaaataaggtctcactcccttacccaggctgtagtgcagtggccaatcacaactcgctgcatcctcgaactctgggctcaagggatcctcctgcctcagcctcccgagtagctaggactacaggtgtgcgccaccttgcctggccagttttaagacttttttttgcagagatggggtcttgctatcttgcccaggctggtcttgaactcttgggctcaagtcttcctcctgcctcggcctcccaaagtgctgagattacaggtgtgagccaacacgcttggctaaccttttttttttttagataaacattttgcatactacatcaagtatatattcttttttttttttttaaagaaaattttctttgtggtacagggctgaatttaatacagttggtttaacagaatggatttcctaaaaagtggtagggttttgtcattatgtttttgtcactgaaattgaaattgtagtttaattgggaatcttactattttgaaaggattttgctttacttgtttttataagacaaagactcttcaattgcaggttacttgtccttgatttctttttttgtttttattttattattattattttttttttgtagagacagggtctctaactttgttgcccaggctgctctggaactcctgagctcaagcggtcctcccatgttggcctctcaaagtgttaggattacaggcatgagccactgcaccgggcctgtccttgatttcttttgtgtaaacctggagttttatgttagcttttatttttgtttagtttttttttgagacaggattttgctctgttgcccaggctgaagtgcagtagcacaaacacagcttattgcagcctcgacctcttgggctcaagcaatccttctgcctcggcctcctgagaagctggttctgcaggcatgcactaccatgcctggctaatttttaagttttctgtggagatgggtctcaccatattgctcaggcttgtcttgaacgcctgggctcaagtgatcctcccacctcagcctcccaaagtgctgggattacaggtgtgagccaccatacctggcctatgttattagcttttaaatcaaggtgtaatacttctgatttaattgtataattttcaacataagcattggaaaggtatcgatttgcttaattttggtggttaatgaacactagcaagactccttcaaagtttgttttgggggaacagtactaataatttataaactctccgtactctgaggtatagcttattatgtgttaaactacttagcctgtagtggaaaagaatttgttaatgagctttgtcataattctgttgcatcttgaaggttattgttcagttccagccctcctcagtgccagatgaatggggcaccacgcaagatggacagacaaggcccagggttgtaaagcgtggaattgatgataaccttgatgaaattcccgacggtgtgtatagtttgtttagaactgaggtctgttttagtcctctccattttagcatcattctttagaatgatgaagaaataaacagttattagaatgccctgccacagcagccattgcaccaccactcccagctaatatttctattttttgtagagatgaagttttgccatgttgcccagacttttctcgaactcctgagctcaagctatttgcctgcctcggcctcccagagtgctggaattacaggcgtgagccactgtgcctggccatatctttctttttgattttattacttttgtatctttattttttaattgatacatattaatggggtacacctgatattttgataaatgcatagaatgtgtaatgatgaaattgaagtaagtattatgtctatcacctcaaacattcatcatttctttgtgttgggaacatttcagatcttttctcctaggtatttttctttttctttttcttttttttttttttttcagacagggtctcactctgttggccaggctggagtacagtggcgtgatctcagctcattacaacctccgcctcccaggttcatgcgattctcttgcctcagcctcccgagtagctgggattacaggcgtgcaccaccacgcccggctaatttttgtatttttagtagagatgtggtttcaccacgttggccaggctggtctcaaactcctggcctcaagtcatccacctgcctcagcctcccaaagtgctgggattataggtgtgagccaccgcaccctacctctcctaggtattttgaaatacacaataaattattgttaactgttgtcaccctactgtgctatcgaacagtagaagttattccttcaacatacctgtatgtttgtacccattaattgacccctttttatcttcacttccccccgacccttcccaggctctggtagccatcattctgcccttacctccatgagataaacttctttagttcctacatatgagtgaggacatacagatatctttatctttaaatttggaattctgttaaaatacacataccacatagtatagattctaaaatatgttttgttgtgtggagaagcactttgctggttggaactaaggtttggcaacacttttaggcttgtggttttacacctcactggtttgtattcctctggtgcggggattgcagactttttctgtaaagggccagatagcagataggctttgcaggccacatggactctgttacaaactactcagctttgctattgttgtgtgaaatcagctgaagactgtatgtaaacaaatgagcatatccgttttccataaagctttttttttttttgaatggagtctcactctgttgcccaggctagagtgcagtggcgtgatctggggctcactgcaacctgcacccgctgggttcaagcaattcttgtgtctcagcctcccgagtagctgggattacaggcgcccaccaccacgcccggctaatttttgtatttttagtggagacagcgttttgccatgttggccaggctggttttgaactcctgacatcaagtgatccacgtgcctcggcctcctaaagttctggaattacaggcgtgagccaccacacccggcccacaaaactttatgttatttttatgtttttccttgaatggtttccccttcgtcaaaaactttatttataaaagcaggtggctgggcctggtggctcacgcctgtaatcccagcattttgggaggccgaggcaagtggatcacctgaggtcaggagttcgagaccagcctggccaacttggtgaaaccctgtctctactaaaaaaatacatatataaaaattaactgggcgtggtggtgggtgcctgtaatcccagctactcaggaagctgaagcaagagaattgcttgaacccgggaggcggaggttgcagtgagccgagatggcgccattgcactctatcccgggcgacaagagtgaaactccatctccaaaacaaaacaaaacaaaacaacaggtaggatgtgggtaggatttggcctgtgggccattgtttgccattgcctgctttggtgtatgtgctttggtttcttctgtactattacttaagaatggattttatttttacaattacatacacttcatgtttattgaagtgtatgtaaaatgtttcaataaaatgtatgtttcttgtaaaataaatactcacacgatgaaatctgagtaatctccactggggcttagtgtcctggggagttctgaagcatcacaaggttgtggagcctccatagatacaaacctgctgctcatcatgtgctattagcttccaggaacagagagagcctgctgcctccacctcttgttctagttcgcttttatatgccaagagggacaaattgttcctctaatttgataggggtaatgaggcttattctctttgaagggtcatgaatttctttggcaagtttgtgatgacgaaagggatatctagaatattgccattaggaaaatccaaacaaattcccatcttttatgtaggtttaaaaattttttttgataggggagatgcctcaagttgaccatttggtgtttgtggtgcatggcattggacctgtgtgtgacttacgctttaggagcattattgagtgtggtaagtgttgggtatattgtatttcatgggatgatctgagaactaatagaagagctttggagtattcatttttaggatagttcccagctgtgtactacttgctgaggagtctgtaagaggaaatttaaatggtcagtgggaaatactaagttgtacttgatttgctcttgtgacatatgtgacgcatacaatcccagactgtgaggaattagaagggatcttggaagtagtttagccttgttgacagcctttgcctgagcacctgcagcagctaggagcacctctgcattgaatggatttatagtcagtgagttgggagaagttgtttaatggaaacatgaatctgcctggttgacttaaatttttgaagttttatttttatgtccatgtaataatagttcgtatttattgaatatttggtatatgccaagtatcttagatgccttgtcatttgaccctcacaaataaacctttggggtataggcgctgtcactgttatcgccactactgtgactaatgaggaactgaggcctgggatagtgggggttgggggtgaagaggtaaggtaggggttgggggtaagtgaaactctcccttatcacagtcagtagggcctggagcctggagccggcagtgtgattccagagcctttccccaaggtgccacgctacctcccagcagtggtggttaaactgatatatcccaagcatctattcctttgcaataatggaaagtttaaaagaggttcccaaaagttacttattcctttctttttaaaaaattttactaattctcttatcctcatttttttctttaaaaaatgtatctttatgttattaaaaatactggcatatttgaggtaactgctgactagctatcaagctaggagaatttaatttattttctcttttttttttttcttttgaagtggatgattttagggtggtttctctcaaattgctgcggacacatttcaagaaatctttagatgacgggaaagtaagcagagtggagttccttccagttcattggcatagttctttgggtggggacgccacaggtgtggacaggtttgtggattttgataacttgtttttcagattagtcatatttaaatttaagatttaaaccgtaatatgaaatagtttattgtagcttcaatcaatatgtttttaaaaattgtatacttctgacatataattaaatattggctgtaaagtttacacactacttttctctctgtgtgtgtgcattccttttgtaaatatttaagagaatcttaagaaattttagctggttttaaaatacaattttaatctgtagcagtttagacagggggctgtcctttatgtagtaggatgcctaatgggctttccaccccaacaaaaatgtctccagaaattgccagatgtcccctggagggtaaaaatcacccctggctgagaaccacagattcagaatattgtttctcagtggagatgctcttgtcaggacaattctttgctgtcgcagtgcagaccacttaacttccttagtgtaaaggccactcagtactagcagtgctcaccaggcactgtgacaattaaaaatactctgctcaattttgaatgctcccaattgagaatcataaatacaggtaatagttatgctggcacatgtctagattttagtgaacaccgtaatgtttcagggtacatagtttaataaaactatttctacaaacagcgttttgtctatgttaggccctattgtaagggtgttttctttctctgtgtgtattcctaaacttcattttggtcattctcaaattagggaagatttttcattccatgtagccctgttttttctgtttgatattctctttagtccttttgacccacaagttttgtcaggtgtccagatttgcagttaactggaagaaaaatggaagagtaatcttccctctttaaaaataaaatagaaatctttgcatatgacttatatagcaactaactcttcagagaatcccaaaattcatagtatagttataggcacaaataactttaaaaaaaaaactgaattgtttttgagacagcatctcactgtcacccaggctctggagtgcgctggcatgatcatggctcactgtagacttggcctcctgggctcaagtgatcctcccacctcagtctcccaagtagctgggactataggtgcaagccgccatgcctggctaatttttaaattttctgtagagatggggtctcactgtgttgctcaagctggtcttgatctcccgggctcaagcggtcctcctgccctagcctctcaaagtgctaggatcacaggcatgagccaccacatgtggcagcacaaatttttttggtttacctttatttatacttttaattttttttttgatgtggagtctcgctctgtcacccaggctggagtgtggtggcacaatctcggctcactgcaacctccacctcctgggttcaagcgattctcatgcctcaacctcccaaatagctgggtgtacaggtgtgtgccatgacttgtggctaacttttgatttaaatttttttttttttttttgaggtggaatcttgctctgtcgcccagactggaatgcagtggtgcagtctcagctcactgcaacctctgcctttcaggttcaagcagttctcctgcctcaccctcctgagtagctgggattacaggtgtacaccaccacactcggctaatttgtgtatttttagtaaagacggggtttcgccatgttggcctggttggtcttgaactcctgacctcaagtgatccacccacttcagcctcccaaagtgctgggattacaggtgtgagccaccgcatctggcctatcttgatttatttataatgactatctacagaaacaactcatagtctgtggggttttcttagtgtattttcaggagtcaaaaatctaaactttaaaaaaatctgtaaatttaaggtagatgctgactgaatgtgctgtatttttctttttaaacaggaatattaagaaaatcactttgccaagtattggtcgatttcgtcactttaccaatgaaactttgctagatattttattttataacagccccacctactgtcagacaattgtggaaaaagtaggaatggagataaaccatctgcatgcactctttatgagtcggaacccagacttcaaaggaggtgtctctgttgctggtcacagtttaggtaaaactgtcaaatattcacattttaaatacaatttttgttgagtcataactgctttcagtgtaggtgatattgttagtgcaaaattaagaattacagattttaagtttcagaaaaggtagaaatgaatgctctgagtttagattctgccttttctatattcacctctagtattacctagggaatgctatgtattttactttattctgctgtttgataaaataattaattatcaggtcttgaataacatgtaacttctgtatgacttttgactatagacagtgaaaaaagaattagtgttataaaagtacctactacattataaggcaaaatgtttctttttcataggttctttaatattgtttgacatcctgtctaatcaaaaagatttgaatttatcaaagtgccctggacctcttgctgttgctaatggagttgtgaagcagctacattttcaggaaaagcaggtacgtctgtacgtggccaattaacatttcgatttagagtctatggagctgaacaattttcaaaagtctgaactgtttcttgaaacttttgtttgtttgtttgtttgtttgtttgttttaactgagcctcattggttgcttgggctagtcttgagttccctcctggcctcaagcgatcctcctgccttggcttcccaaagtgctggcatcaataactcttcagagaatccccaaattcagagtacagttataggcccaaatataatagcttccgtgtccagccctgaaactggttttacatattaaagtacaccgaggtttagaaatggaatggaatcatatagctcattatttgagtttctcactcttcttctttatgggttataaatttaaatgtgaaagtttgtgatttttaaaaatgtaaattataggaaatggagacttgagtgatttattaaatttatatacttttcagaatattcaatttttttttttttttgaggcggagtttcacttttgtcacccaggttagagtgcaatggtgtgatctcggctcactgcaacctccgcctttcggtttcaagcgattctcctgcctcagcctcccgagtagttgggattacaggcgcctgccaccaagctgagctaatttttgtgtttttagtagagacagggtttcatcatgttggccaggctggtcttcaactcctgacctcaggtgatgcacctgcctcagcctcccaaagtgctgggattacaggcgtgagccactgggcctggccagaatattcaaactttgaatggcaaagtactgtgcctaaaattatgatttctgtgtaaagcaaaattgtttgagagttttcgtagatcagcagtcattatatgggagtttttctgagcttgtaatgtttttcatacttttttttttaaagatgcctgaagagccaaagctgactttggatgagtcgtatgaccttgttgttgaaaataaagaagtcctaactttgcaagaaactctggaagcacttagcctctctgaatattttagcacttttgaaaaggaaaagattgatatggagtccctggtactgatcatagtttgcttcattttgtttgaaattgtttttcttgtgtagattgaaaattaagaataaacattttcgtatcaaaatacactccagagtagacaaagactgaaatgttttaaaaaattgaaaaacacagaagaatatttttttataatctgaaaggcttttctgagtatgatgcaaaatccagaagccatcaaagaaaaaaattgtataacagtagacaccataaacaacatctaaaggccagtgatacatttgcaacacacattatagacagagggcttacttcattgattttcaaagcttctacaaatcagttacagaaagaccatcacatcagtgtgatatgtaaataggcaaagaatataaacatgatttacagaaaaggaaataacaaatggtgtcttcgcatatgaaaactcataagagaaatggaaattgaaagtacaatgggattttttttaacttaccagtttgaaaaaataggaagtttgaaaatatgctatgtggccagggtgaagggaactaggcattgttatatattgttggtcagactgtaaaatattacaaactctttggaaggcagtttggcaatatctttaagaatataaaaattaccctttgcttcatcagtttcattgccaggaatatttcctatagagaaatattcaaacaagaattatctacaaggatactcacagcagtgtttgcaaggtaacaaaacattagagacaccattggtgttgaggagtagggtgctagtgaaatcatttatggtgcatccgcataacggagtaccctacagctgttgaatgaatgatgcagtgtcagagatacccgtctctaaggtacatttacatgaagagagcagagttcattactgtgtgcatagtagagcacacacacagagaaaaacatgtaagtgctatgcatacataagacatcgcttcaaagagagcaagtttccacagttgcgctgagaggagaattctatgtttgggacagcagtgggaggaagatatttcatcgtatgcttgactatagctttggaattttgtataccatatgtgtattttctgttaattaatagaatgatttaggtgtggaagcctaagattttatagcctaaactgatgcatgatttaaatacaaaataactaacttgtaaaaagttgagtggctcttagattgctttagatgatgtggtttctttataattttcatattctcatttcagttcttctatcactagattgattaatgtgcttgtctgtttccttttaaagcttatgtgtacagttgatgacctgaaggaaatggggataccccttggacccagaaagaagatagctaactttgtagaacataaagcagccaaactggtaaagttcacctctgactcaagaaaaactaaaactcatggtgtgaccagctcgtttatattatagaaaattttaatactactatggttaggtaagctagtttgctccctacctagggcacagtaatggagctgatggaaacccagacttaggagtcagagttgggcttaagtccacattaggctaagtgaccatcctggttttcctgggactaagttcctaggatgaagggctttcagttttaaaatggatatttaaggttttcctggtgcaaacagtggttaagttctgacaaataaattctcagctcaactgctcattaactgcgtattaatgagcaatttgtatttggttttattcatttgtttattttgagatgggatcttgctgtgtttcccactgctggtctcaaactcctgggctcaagctatcctcccgcctcagccttctgatcatgagtgattttcttaatttttctgatcctttgttttcttcatttctaaaatggaataataccttccttacaggattggagtaagcatgaaataatgcatgcaaagcttagcaccaagtaatagctcactttcttcccagtccttaccatctaaagagatgaggaaaaacatacacactgaagtcttaaacactaaacagcaaaaattgttaacaatacaaaacaaggcaacagctaaaaagcatttaaaactagaacaactggaaaatatacttgttttattaattttaatttattgatcaaattaattttacagaggttttctaattagaaaaattagatgactcttagggtggccgtcttatttgtattgttattaacatgctctttgatgatccttccatcttttgaatttctatggttctattattttactacctgtttggaacttaacctacatcatttctttatatgggaaatgactataaagtcataggactgattttttttttaatggttagcttaaggaattgagtcttctcagcattttattgaatagcagctacctcttttgagtcaggcactgtgttcaattcttgggagccggagattaaccaagagtgtgctgtctagttgcggggagcacgttgagctcaaatgacaacataccagccccataatagcgtgctgtgtgtgctgtcctgaggcagatgagaggtggcagttctggcttgttgagacaagcatggggttggtgagagaagacttctccaaggtgatggtgcttgagcttgaaggaggggtaaggtcaggggagatggccttctggaatctggcatgtgttttcctgtagcatcagggaagctggaaactgggaagggcagagggttccaaaggcccaggtggcaggtgtggaggcttggattttctcttgtaagggagtggttttcaaacatgttcttatggccatgaaagtcatggtgtttttaaacattacaaaatgctgacctgcttattctatcacaagttatgatttagcaccaaatcatctgtgtagtctaaattttaattttaacttttggactgtggagagtttgcttggtcacagtgcacagatgaagttggaaaggcgtgaagtggaggcggctgcaatcttacatagtagtaattgtaattgtacagtgactgaaagagagatgataggggtataaggtaggaggtggagaggaagggagcaactcaaaagacattttagacatagacaagcagtatttgattaagtgctgagaaaggttattagttttggcagttaagaggtatctttcatgtcatttttcttgtgtgttgaatcgttctgtaattccaatttacaaagagcttttcatctcacctgagcctcacaacaaccctgtgagtagatccccaggcttttgtctctgatgagcacaatagtcaaactgagactaggacacaagcatgtcagtgttgtttctgtatacaggctgcgtgctccatacagaaaaatgcttgtctccgtgtatacatcagtgaagcaaaagcctataaaaaaaaaaacaaaaaaaacaagaaatgagaagctttgtgttcaggccctacaccatgttcttaatttattctgtaatgaaagggaaaaaagtagaaaaggattctatagttcttgaagaatttctagaaggagactggtttatggactgcagttgcttagatatataaattatggcattataagaatgttttgaaatgagcaaaaatctatagagtgatcttattttttaaattaaaaggtaattgcctttggatgaaccatgaaactttctcagctgagttgccattgattgctttacacttcttacagataacaaggtgctactagatcaatacaaaagtaatatggtgtgtcctgttgatttactgtaactgaaataatgggaccaaaattagcgattattttataacaaggagatcaaatatttgtgatatttgtgactgtgtgctttttttttctttttaaagcatcttagtaattttcatttgaaaaggaattgtttctagtgttggggatattgatagtcaagtatgtatatgttggttccgtttttttttttttgaaagggagtcttgctttgtctcccaggctggagtgcagtggcacgatctcggctcactgcaacctctgcctcccaggttcaagccattctcctgcttcagcctcccaactagctgggattataggcgtctgccaccacacccagctaatttttgtatttttagtagagatggggtttcaccatgttggtcaggctggtctcaatctcctgacctcaggtgatccacctgccttgccctcccaaagtgctgggattacaggagtgagccaccacgcccagcctatgttggttcacttttaaacactgttggttcacagtttaaaaagtattgcaaatttaacaaagcaactcttggcaacaggacagtttctgatctccttagacagctctcagcaatttagaatgttttatgaatttaacaggaggtacttctgagtgagaaagcagatttaaagtgaggaaccctgaaaatgttccttatttcggattttaggcttaattttgtgttgcctccgaagggcagagataaccaagccttctaaaacattaacggtggaaacagttacaagctggctaagagttttcttttttatagattgccttttcaattaaccagttacttactttcctgatttcctggtgtttggaattaaataataagatcattttggccagctgtggttgtttaggcactgtcgatagctgtttaaatcgagactaacacttagccattcacagcctaacaagtccccctcccacccaactgtttaaatttctctgatgttattgttgctgctgtattcaaggcaaattagaaaaccagtgtgaatggcttttctctcgttatagagataacaccttttttttttttgagacggagtcccgctctgttgctcaggctggaatgcagtggcggatctcgactcactgcaacctccgcctcccaggttcaagcaattctcttgcctcagtctcctgagtagctggattacaggcgcgcgccaccatgcccgggtaattttttttgtatttttagtagagacggggttttgccatgctggtctcaaattcctgacctcagatgattcgcccgcctcggcctcccaaagtgctgggattacaagcgtcagccactgggcccagctgagataacaccttttatatagatgccccaaaacttttgtttatttatggaaacgcatagatcttttaaaaaattatattttttgagacaggatctcactctgtcactcaggctggagtgcagtggcgcacgcatggctcactgcagcctccacctcctgggttcaagcaatcctcccacctcatcctcccaagtagctgggacttcaggcatgcaccaccatgcccagctaatttttctgtttttttagagatggtgtcttgccatgttgctcaggttggtcttgaacccctgagctcaagagatccacccacctcagccttccaaagtgctgggattacaggcatgagccactgtgctgaaatgcatagatcttcagtgtgcagtagggtgagttttcacgattgtatgcacttgtgtcgtcactgcctaaaacaagaaattgaacatttctgagttcatttctatgttctgtgttcatttctgtttcatgagagagctcaggtagctccctcatgcttctttctagttaactcctcctaccacaaaaccactcttctgatttccttcaatatggaatagttcgcctattttaaaaattcatctaagtagcatgaacagtatgtattcttttatacctggtttcttttactcagtatttttgagattcgtctaatgagagccaatacttctgcttagttgtaactgtcttgctatactttctttgcttcttaattatttttcttaagaattttaaactatagacatcatgacatttgttccctaaatatttagtatgcatttctaaaaaggacatgtaaacattttttttaatttaaaaatttttttgagacaggtctctctctgttgcccagggtggagtgcagtggtacgatcacagatcactgcagccttgaccttctaggctcaagtgatcctcccaccctagcctcctgagtagctgggaccacaggtgtgcactaccaggcctggctaattttttcttttttctagagatggaggtctcactatgttgcccaggttggtcttgaactcctggtctcgagctatccttccaccttggtctcccaaagtgctgagattactggggtgagccactgtgcctgacctggacatttttttaaattagctgaagcaaaagctgcagagaataaaaaggcattttttaaagtaatcacaatgttgttactattcctaagaagtagctaatcattccttaatactgagatagcatgttttgtaatgatagctgagagctgaactttttctcatgattatgttactaaattttggtattttacagaaaaaagcagcgtcagaaaagaaggcagtggcggccacttctacaaaaggacaagagcaaagtgcccagaagactaaagacatggcttccctcccctcagaatccaatgagccaaagaggaaacttccagttggtgcttgcgtgtcttctgtgtgtgtgaattatgaatcttttgaagttggcgccggacaggtgagtttacatattgactggggctacatagttcatgttggaatcataatctttatcatttgggttggctttaagttctttaaatatttatttaacatttatttgtgatgtggaaaaaactgattttctcttagtgaaaatttttttcttcttcaacagtgctcacaataagggattaaatgcatacagaacgtgttgtctaacttttgaaattgtctctatttcagttttcccaccgctcatacttttatagcatcagtctcttatagccactaacaacagaagtggccatagttaagaaattatgttcagaatatacttcagtttctgtgagagcaacttggctgtattcactcaacttatgtttcctagtactcataattcttcccttggggaaaaagtcttataaaaattgaccaatgctgcatttaatgatatactttaacatacttgtatcacagtggcttttagaattattaaaatccttttagacagtgttactgtcaggatatttacagttgggtatataaagatgcatttccataagtaagttcatgaaggtacaaaatgaaattggatgtttgatttgtattaaaaatgaagttttagaggaatatattcttatgtaagtaaatgttcctttacaacttcattttcttttcttttttccctttttggagacagagtcttgctctgttgcacaggctggagtgcagtgatgcaatcatagcccattgtaacctcaaaacaagggtttagggtttgggtttaagggatacctcctacctcagcctcccaggtagctgggagtgtagccctgcaccaccacacctggctaattttttcattttttgtagagacagtcttgctgtgttgctcaggttagcctcgaactcctggcctcaagcagtcttcctgacttggcttcgcaaagtgccaggattacaggcatgagctactgcatcgggcctccagctgcatttttaatgactgccgtaatcagtaatgactaatttcactgtttggagagataatgacttattcttatttccttattattgaaggtattagtttcttaaggctgccataacaaagttccacaacctgggtggccttgaacagtagaaatttgttgccacacagttctgcagagcagaagagatagggtggtggtgggactattttctctctgaaacttggaggggaatcctttcgtgtttcttcgagctgctagggatttgctggccatctttggcagttataggtttatagatgcatccctccaggcttcttttctatgtcatattctccttatctcttaatatcatcttccctctgtgagtgtctgtcagtgtgtccaaatttcccctttttatgtatcagtcagattagggccaccacagtgatctcattttaacttgattacctttttaaataccctatttccaaataaagtcacattatgaggtattaggggttaggacttcaacataaatgttttgtgaggacacaattcaacccatcatattaaacatgtaggcaatttctactttttactcttttaagtagtctagtgatgaacattttaaagccagttttctgtgcacattttttattatttcttccagttaagttggtagacatagggtagctgggccaaaggatggacacagtcccttcgctgggagagacatcaatctgtattctcactggcagtttagaaggttgcctgtttcctctgtccattgccagtactggtattatcattttcctttaaaaatatgtagtagtttcactttgacaacgctattgtaaagaattaattttttgtgtgtattttcatacagtttttttctttcttgttagtacttcttactttttagtatttcatttacgtttctgataaccccatagggaaaatggtatcacactgtatttctttgagcactagtgaggttattttctcatatgttttttaaacatttttcttttgtgaagtgttgaatttacctgtttttctatttggtttcttttttcctttactgacatttataaaatatttacatattaaggttattagctccttgtcatgtatgttataaatatttcttccagtttgtaattgttctttaactttctttttcttctttttgtttgctggaacaaaactgtcgaatttgcaaatataagggcaagcctaggaatgtgaagtctagactttgttagaaggggcagcttagtgtagtagaaagagaattggatttggaattagaagtcccacatctaagtcagcactccatcactcactggctctgtgttcttgggttaagtcatgtcacatatttgagctttgccataggcataatggttcttgccttgcctccctctttctatggacctctgttgaacacttggattatgccattcattgtgcttcactctcaagatactaaaataaaaagacacatttcctgctactgagaaacaaatgaaagagctttgcaaattgtacagtgctattcagatgacagtgctttctcttgagagaggctacatgtaagctactcaaaatgtgctctttcaggacaaatcatttttctgatggaaagaaacttaactggagaggatgatagttataatagtaacagaagtaatgctcattgagtgcttaagctgtgccgagctcgtgctaagcactttatgtggattaggttatttatttttcaatcacatgtgagcttggcattgttataatccccattttataaatcaggaaactgaggtggaggagagagaggttaagaaacttgcccaaggtcacacagtgaatgaaaccatgattcagacccaggcagtttgagtttagaagtctaaagttttaaccatatttataaccataataaatatagtaattcttatatactattatgccgtgcaaaacaatatgtaaaagtatagccagaggatataatagtctataaagattttaaagagaaattttttagtactttttttttattttttgagatggagtcttgctcagtcacccaggctggagtgcggtggtgtgatcttggctcactgcaacctccacctcccgggttcaagcgattcttctgccttagcctcccaagtagctggaactacaggcgcatgccaccatgcctggctaattgttttatatttttagtagagacagggtttcactgtgttagccaggatggtctcgatctcctgatctcgtgatccgcccaccttggcctcccaaagtgctgggattacaggcatgagccaccacgcccggcctgaaaattcaaaagaattttctactaggtgacattggaacaatcatctttcattgttatttgattctttccaggtttctgttgcttacaactcattagattttgaaccagagatattctttgccttggggtctccaattgctatgtttctcactattcgaggagttgataggatagatgagaattacagccttcctacctgtaaagggttcttcaatatttatcatccggtgagtaattgaatttactttgttttttaaaatccttttttcttttttaaacattttttacttttttatagagatggggtcttactatgtggaccacactggtctcaaactcctggcctcaagtgatccttccatcacagcctcccaaatcgctaggattataggcgtgagccactgtgcctgaccttttactttcttttttgaagaagatgaagaacctgtcctctttatcctagtaaattctcatattcttatttcttgggaattaatacctatcttgattttataaggttcagctttctgttctaagaggtatagtctgacactttccaataaacttatcaaaagcctttgttcagggaaataattcttttgctttgcttgcaaagtaatcttacacacaaactagaaaatcttttcataattgtcagtatttgaataaggtgtggagaaaaataaaaatctctgatttgccatgtatccattttcttacccagcgaaggcatataactcaaaacagctttcataaatttcttttatttattcataaattcttctatttatagcttgatccagtggcatatagattagaacctatgattgttccagatttggacctaaaagctgttctcattccacatcacaaaggcagaaaaagacttcatttaggtaaaaagcaaatactataaaaactttttttcctgtcatttgtaatctgtaatgaattatgaaaattttgacactaaatcgtctctgagagaattaatattatttaagtgcctactatgttcagaacttttaaactaagaatttggaagagctttaacaaaattacaaatgaattatttctctttgatggcattctaattgtcaaggtaattaggaatagggagaagttggtaataaggcaataagatgcataattagattttgatagagtttggttacaagttttggaattaggaagaagaacagtatttaaagtaatgaacagaccatcaagaaataaacttgatgttgtcgaagtgagctgttattttcttgctaactagacacaccttcctgttaaaaaaattcattaaacataatggattggtgattccaagttgaatttaggtttctcttcttcctgttaatggtgtgtattaacgctacatttaaaagtttgggtggaagggatgggaggggtagaagagaaggaaaagtgattacgcactcttatgtgaaagtgtgttttttgtttgttttgctaacatgctttttaaaaatattgaactcttttgaagttaaaataaggcatgcgtttgataactcagagaccttgaattcacatgtgattattagacaacagtagaaaaagtgaaggagcagggatttcttcatttctaaattggagtttaaattgtggttttatcagaatgtttaattctccacttgaacctgggaggcgaaggtggcagtgagccaagatcgtgctactgcactccagtctccgagagactccgtctcaaaaaaaaaaaaaaaaaagaatcctcaaaaccacttcctgtttacagattagaaaaacagtgatttttaaatctcgtaggcctctttttatttttattttttattttaaatagagacagggtctcactatgttgcccaggctggtcttgaactccaggcctcaaatgattctctcttcttgacctcccaaagttttgggattactggcatgagctactgtgtctggcccctatgtttaaacttacagtaaaaacaaacaaaaaaggcataagaatgtgcttacatttttttttttttttgagtcggagtcttgctctgttgcccaggctggagtgcagtggcacaatcttggctcactgcaagctctgcctcccgggttcatgccattctcctgcctcagcctcctgagtagctgggactacaggcgcctgccaccacgcccggctaattttttgtatttttagtagagacggggtttcaccgtgttagccaggatggtctcgatctcctgacctcgtgatccacccacgtcggcctcccaaagtgctgggattacaggtgtgagacaccgcgcctgaatgtgcttacgtttttatggtatttgaacttcttttatttggagagagaaaatttatagatttttgctggatcaagtttagtcattaaaaaaaaaagcaataagactatccatgacattttaacatgctgagggttcttggctgaggcactccgtatatttgacattgaaaagaggaagaaacagtcttatcctgtctgagaagagtgttaacttacaatttttgtgaggcagaagtttacccagtgactaattaacttgttgtgtcatcttaatctctttagaattgaaagagagtctctctcgtatgggatctgatttgaagcagggttttattagctctctcaaaagtgcttggcagacattaaatgagtttgcccgtgctcatacgtcttcaacccagttgcaagaagaattggagaaggtggccaatcagatcaaagaagaagaagaaaagcaagtagttgaaggtaaatttgacatttgaggcattttctaatacaaatgtttcatatgaacataatacttaaaagttatatgatgatgcatttcctttctagactttttggttaaattatagaagctctttaaaggaaaatctgttaagataaactgtactgtcaatagcattacttcaaaatccatgccatctttttttagtgggtttttatctgatagttactgaactttttcctctgcaatttaaaaattatattgagattcttaaggccagagtggaatatccgagttgagaactcaatttgttttagggtttgcattttaaagactcaatctgagaggttttcttcctgaaactgttgtttaactatgttacagacttgacatgcaatgtgaaggtcatcgtgctgtgatgtttttgacttcttcagattctaatcctgtttcctttctttctacaatgctttctcaccccttatcttcacaacttctctcagcttgttggctcttttctcctctctctcgggtaaccagcccctcttcccctggctctttggaggaacggggagtgagcctggtagctcctcaggttgctacatgcgtcaagcagtattctcattgagcccagaaagtcagctaaagtcaaaggataaagattaagtgattgactttgatattgaaatggtttaaattctagcagaaaaggttgttgaaagtccagatttttccaaggatgaggactacttaggaaaggttggaatgttaaatggaggccgccgaattgactacgttctccaagaaaaaccaatagagagttttaatgaataccttttcgctcttcagagtcacttatgctattggtaagtgttcttaaatttggtaacatttgagtgggcttttggtgctagcacgtgcagcaattttagttttagtgagattcttttactgatacaatgtactatgaatattcatttgaattactatatgttcagaatcgttatttttcccccttagttacccacaagatggcagtatgtcatctgcttttgaccaaagacccttggttcttgcacactgtttttgtgggaatgcctttcacagtgggagtggtagggactttgaaatgccattctttcctgtatccctgtcaccaaggagaattgcaacacagctattttggagctaatcagtattcatctagtttttaaggacagctctgagattacgctgctttatttattacactgagattacattgctatcatttgcccttcttagatagagttgaatagaatagaacctgcattttcaaccattgtgcatagaagttaatttcttctaattgtctcttaagtaaatatgcttttccttttcatagggaatctgaagatactgctctgttactacttaaagaaatttatcgaacaatgaacattagtccagaacagccccagcattgatcaaacttcagttttactgtgtgagtttatccttattgaatgtataaattctgaatgtttgcattctcaaatctgttgtatggagttgatgttgactgattttgcttttttctgtttcctctgagtttttgtcgtcgtttttaaaaatttgcaatagagacattaaggaagataattggtttgtaatttacatttctgatttattacagtcttctttctaaatttacatagaatttgagttatttttagtttctttttaaaatagattcccaagaatatcagttaggaattcctttggttgcaggttcacagaacccagtttacaatacattaaacaaatagaggtttatttttcttccgtaacaagaagggttcttctgttgagtgactccaccagatacccagagtgcttgcctcttcccacctgaatgttggctcttgctgcctcatagttataaggtgcccccatggttgcagataccatatctacattcacaacatgaataagaggggagagggtagtactcctcacatctgtcgctcttaattagggaagcagaagcttgtccaaaaatttactcatacctattgactaggcctgtgtctaatgtccaatatctccagtctgtatgaaagattgtagaagtaatgttttgagcattcccaatctttatagagggaaagaatagagaaggaggttaagtctgtgatgggtcagctgacgtgcagctcagccacactctgtattcctaactgtcctcctgagacaccagatacctggttttcctcactagattatgcattacttttaaaaacaagtaatgtgttttttacaaagttagaaattttaaaggctttgaaagaatcagacacaaaatgctgagctctaaattactgaaatcaaaggaagttcctgccatttttggttttctaatagtaagtggtaaatgaacattcccttcagcctcatcttctacctcctcgttttagagaggtaagtacttttagtagggcttccttagagaaagttttttggctccatttccaaaattaaacttgtaacaaagtaaaagaaaactaaagtgtaggccaggcatggtgtctcacacctctaatctcatcactttgggaggccaaggcgggcagatcacctgaggttaggagttcgagaccagcctggccaacatagtgaaaccccgtctgtactaaaaatacaaaaattagtcgggtgtggtggcgggtgcctgtagttgggaaatgcaaggccagaagtgaaagatggctttcccataactcatccccaacctccctgcctagaggcagccagtgttccacgttttgtgtatccttccagatatctgttaacacatcacacacacttttaagtttttcttttttaaaagacaaaagaggctgggtgtagtggctcacgcctgtaatcccagcactttgggaggccgaggcaggtggattacttgaggttaggagttcaagactagcctggctaacatggtgaaaccctgtctctactaaaaatacaaaaattagccgggcatggtagtaggtgcctgtaatcccagcaactcaggaggctgaggcaggagaatctcttgaacccaggagttggaggttgcagtgagctgagattgcgccactgcactccggcctggatgacagagtgagactctatctaaaaaaaaaaagacaaatgatagcaaaattgacacaccgttattacctttgtgtctttgagattgtcccatatctatctatccatccattcatccatctgtccgcccatccgtccattcatccatccgtccagtatctgttgagcaccttacttaagtgccaggtattattttaggtattgggtttcacagcagtggaccaaagcctctgccctcaaggaccttttttcctctaatggaaggcagacagcacgtggacagttgaaatgaaccacatggtaaagactgagcagctggacaaggaggagaggaattcatttgggatgggttcaagttattaatgtatataagatggcaagggacccccttcacgggtaaagtaaagtgtcatttgagcaagcgagccaggtggatatctggaggaagaagaccacttcaggtggagagaagaatctggatcagaacatgagagtgacctcgttctttttaggtattccattgactattgcaccataatctgtttaagcagtccctactgatgggcattgaagttattctaatcttttattagtatgaacagtactacagtgatacgtgatattttaatagttgcatttcattccattttatagttcttttattaaaatactttattttaccccattgttgggtgttagatgattttccaaattttctccattataaataactctgatatgtagttttacacactttttgccaatctctgtttgctttggatacattcttagaagcagtgttcttatttctgagaatattgcatattttgaaaagatttttggctgggtgcggtggctcatgcctgtaatcccagtttgagaggccgaggcgggcagatcacttgaggtcaggagttcgagaccagcctggccaacatagtgaaaccccgtctctactaaaaatacagaaaaattagcagggtgtgatctcacctacttgggaggccgaggcaggaggatctcttaaaacctgggaggtggaggttgcagtgagctgagattccaccactgcactccagcctgggcaacagcatgcgattccgtctcaaaaaaaaaaaaaaaaaaaaagctttttgatccctacattttgctaaattgcattccagaaaagttgctcaattttcatatttaccatcagtatgtaaaggccagtatgcttgcactcttggaaacactgggtattactgattaaaaaatttttttttgctaatttgatagccagaaatagttataataccgtttttacttacatttctattattagtgaagttgagctctttgggtgtatcttaactggctgattatatttcttttgtcagttgcctgttcatgacctttgtgttttcttggaggtacggggtagggtccttttctttctttattttattttattttattttattttttttaagacggagtcttgctttgtcgcccaggctgtagtgcagtggcgtgatctcggctcactgcaagctcctcctcccgggttcatgccattctcttgccttagcctcccgagtagctgggactacaggcgcccgctgctgtgcccagctaattttttgtatttttagtagagacggggtttcactgtggtctcgatctcctgacctcgtgatccgcccgccttggcctcccaaagtgctgggattacaggcgtgagccaccgtgcccggccagggtccttttctttcttatggatttataaatatgatacttaaggatattaacctttgtcattataagtattttttcccagtttgaaattagccttttatttttccttatactttggatttttttggcggcagtttgaggggagcatgttttaaaaatacgtagccctacgctgggcatgatggctcacgcctgtaatcccagcactttggcaggccgaggtggacggatcacctgaggtcaggaggttgagaccagcctggccaacatggagaaaccccatctctattaaaaatacagaaattagatgggtgtggtggctggcacctataatcccagctacttgggatgctgaggcaggagaattgcttgaacccaggaggcggaggttgcagtgaccctagattgtgccactgcactcccacctggatgacagagcgagactccgtctaaaaaaaaaaaacaaaaaaacaaaaaacatagcccagtcttttatgattaattattttttagatatttacatttattttctttttagttctttttttccccatttggctttgtaatttagaagagtaaggtgtagagaacaatttaacttttttcttacataatcgtttctgtctgtgccatatattgaataatgtacccttttgtcattggtttgatatttttatcatatgccaaatattttgctgttgtttgacattttaattaatatttgtttcctaggctttctcatctcttctggtgatttatttgtctatgatacttcattgatttcaagccatttattttccacattttaacatatttaaatttgtaatgcatcttaaaatctgctgttggggctggtgcagtggctcatacctgtaatcccagcgctgtgggaggattacttgagcccaggagtttgagaccagcctgggcaacatagtgaaacctcgtctcttaaaaaaaaaaaaaaaaaaaatttaagtcagctgttgccttaacggaagttgagttctttctgagaagctgtgcattctcttctgctggtcactgggggaggggctttaccaacttgcctctgcttaagctaatttctctgcttgggattttttaggatgatgctggtagtgtgatttcagcccccaaaatttgcagggatggggttgtcagttcagatattggagtttttgttccctctttccattgtcaaggaagaggtgcgcaggcctctttgccatcccttctgcatgtagttgcttgcttttatccctcattgagactatagatgtttagtcccccactttttgtgaggggttctcctttgagactccctttctgggcatctttttatggtacataacagtgaagtgtcacaatcaacagtgtcttagatttggtgaaatatggtgttttaataattgtaattttttacataatatctggcagtagaagttctcagtataccatagtctttgcagttatcccgaatgaagttcgaaataatttaagttcccctgacgctctctcccctaacaaaacaaagcaagacaaacaaaaccaaaagaatagtaattctaggattttgccatcaccttatatggaaaactcagaaccttctatttcacatatgattcgttcactataattgttttatttacttcttcttacacttggctgtaaaatttaggcaagaatttaagtttctaatactatactaatgtcataagataatccatttaaaatgttaacaattattctatacatagttcattcaagcttagatcagttttgctgaatggttgttttatgttcatgtccttttagacctttttaggattgttctttgaaaagcctcaaattggccaggtgtggtggcttacacctgtaatcttagcactttggaggctgaggcaggcagatcgcttgagctcaggagttcgagaccagcttagcaacatagacaagacattacttgtctctactaaaagtaaaaaaaaaaaaatcactggggcatgatggtgtgcacctgtagtcccagcaacttgggaggctgaggtgggaggattgctggagttcgggagattgaggctgcagtgagctgtgatcgtaccactgcactccagcctggattatagagtgagaccctgtctcaaaaataaataattaaataaaaaataaaaaagcctcaaattaacatggcagataactaactttattttttattaatattttagctggtcacggtggctcatgcctgtaatcccagcactttgggaggccaaggcggatcacaaggtcaggagttcgagaccagcctggccaaatagtgaaatcttgtctctactaaaaatacaaaaattagccgggcgtggtagcacacacctgtagtcccagctacttgggaggctgaggcaggagaatcttttgaacctgggagactgagggtgcagtgagctgagatcgtgccattgcactcctgcctgggcgacagggcgagactctgtctcaaagaaaaaaaataaaataaaatattttaattttttgagaaggggtctcactctgtcacccagcttgtgtgagtgcagtggcgcaatcttggctcactgcaacctctgactcccaggctcaagcgatcctcctaacttagcatctcgagaggctgggaccacaggtgtgcaccaccacgtctggctaatttttttattttttggtagagacagggttcccccaagttgcccaggctggtctcgaacttctgagctgagatgatccacttgcctcggcctcccacagtgctgggattacaggcgtgagccacaacacttggccataactaactttaaattgtgtcttttactctctgtactggctttgctatgaagaaatcatgctggttaatcttactgagtgtttcctgggcattcttgtccctttggaaggcctgaggacttgcttacaggctgtgctctttggaggcggtttgcagtgtttgtcagtaaagttgagcactggattgtccattttttttttttttttttgagatggagtctcaccctgtccccaaggctggagtgcagtggcgtcatcttggctcactgcaagctccgcctcccgtgttcacaccattctcctgcctcagcctccagagtagctgggattacaggcacccgccaccatgcccagctaattttttgtattttcagtagagatggggtttcaccatgttagtcaggatggtctcgatttcctgaccttgtgatctgcccacctcggcctcccaaagtgctgagattacaggcgtgagacaccgtgcctggccgattgtctgttcttttacttcagaaaagacaacgatgcatggtatttgactgtaaatttgtaaagttcactgaggttttttttttttttcctttttaagactttcttgtctgcacagaaagtcccagtacaacttccattgctgagaaaatcctcagaggactttcccacttcgctcctgtgatggatgacagaagagtgattcattaacaattgctcagccacaattctcggatatagggattcaaaagacaggacacagaactaacacagtgaaaaaaatcagtaccacatttggacagtataggtgagaaaacataattataaaaatgatgccatgaaaaattccacagatcagtttagttgtatagttgtcaaagttatatgtgatatcaatgaagaaatatttgtagcatgtaaacggttatttctgtttcttaaaaagtattgttagtgggctattaaacttggatttttctttttattaatgcagtatgttctttttattcaagtatgaacttgttgagaaactatagtaatatgatttttaagagatttatgttctacttaaaatgtgaattgtacttctgagctgccttaatgcaaggtcatttatatttgttaagaggaaataatcaagatcactcatatcccaactgaatctgaggttttataaatccctcaaacgattgctgagagcctgattgtggaaagaagtgagatgcaccttattttcaagaagtcctgggaagcgctctcctagcacgtccatttccaggaggagaagcaagcagatgagaggttttccattttgtcatccaaggtagctgtgcacttgccttgttgctgaagttccaataatgtgaaaaccaaagtagaggtttttttcttcttctttttgttttctattaatttcacttataccaaagtgtttgaaagtatgaaatgtgttgcttctgagttatataaggctacttcatgacaagactgctttgtaatatttcactttgttttactacaaattcagatcactttgttttactataaattcagattatccaaatattttcctaatactatgtgggaatgctgattttcttttgttacgtagtggaaacattttgcattgtttacatagttctcatggaacatggaaatttttgaaagtgatatatgatacacattttttgtgtatgtattctaattagtgtgaataaagcagtaacattaatgcattttttaagcagcaaacttatgtatttctcttgtcttccttaaaagtgtccccatgaactcagtgtttattcccttttcattttgagtacctgcttatatggtcagtatgtaacgttagcattggctcctaatggtagaattagaacagcaagattgtagagctgtaattgactccagacaacatagatttcagccacctcattctacagctgaggccaggacaataaatgcctttcccagactgggtagtggcagatctgggatggaatatggttttcttgattccctttcagccttcatttctctctctcaggactactactttttaattacttttcacttaatttcccaatactgatgaaataaagaaaaatgagggttatttatatacatttcaataaaatccaatttgatttttcaactt

SEQ ID NO: 37163 - DNA, 3017 bp, Homo sapiens
agatggccaccagcctcggctctcccacgtctacacccatcacctccagcctgagggcgcaactgagaggaactgagacccaagcagctcagtaaagtatgtctgggggtcaggggcaccccatctgggccagggcgctgctcaggcaggagagcaggggacgaaatccaagcgcagctggaatgctctggagacaacagctgcttttgggattccgttgcccgctgtccagccgttggcggggggcgggggagctcctgcccccaggtcactcgccctggggccacatcagaacccgcccatccccagtcccaggaggaagacccgggagtaggttgtgaaacggagtctagagggaacaagacgctcacctgggccacagaacaatagaaggggaggtgggggcctcccctgggaccgggtcccgatccggattagatccgtggggcaggattagccctgttggtcccacgaagcctgggccactggtgcggtgacggtggtggggcgggcttcggaatccgtcaggagggaagcgcgcccgtggggccggagaggaagtaaacccgcgcgtccacctcggggacacccccgcgctcggtggcctttgtccggtgacgctgccagcgcccggagcaccaggggccgaaggggtccacagagcagccgcgggacccccggaaacccattgcgaccggccccaggagacccaccaccaggctcccactgtgccgagcttcccgctcgcccggccccgcgggtagcgaaagcgacaatgttcccctgaggccacgacagagccggcgtgccgagatgcccaaaccccgcgcgggggccagcgactctcgcgccagtaggcccttgacttggatcaagacgggggacgggggactcccaggacgcgagcagagtgaacgaggacaaggtgatgctccacgcgcttctacttcaagtctggtccggttcggcctggtctgggccagccgaacagccacccaaacactatcacagcttgcccttccgcttgctctggctgcctgcagacttggagccattttaaggagaaaccacctggccacgccccctagagaacccgagaagccaatccacgctcggccacgcccctctccgcgcgctgcggagaggccaacggtcgcgcgggtgacggttagggcggggcgtgcttccgcgtctagccggagaaacttgagccggctgccccgcccacggtgcccgaagccccaaaggctggaattaggggctagaagtctggcacccaccgcctggccaggtgttcgggacgcgaccaggtgggcggtcgccccgccccgggagcgcggcttaatagctgagagcccgggggccaggccgcggctgcggcccaggcaacgccctgagggtggccacgctgccaggtgttccactcccccgggactatgggcaagggcccggggcggggagggcggcaggtgctgacactggagctgcgccggaggtcggggaactcggcctcctaagactgaggacactcgcctgctgggccggtcgagctgtgcggtgccctccgggacgcagggggcgctgcagccacgctgggtcaggctccgcagggccctcccaacccggggactaacggcgccggtgacgacttcgccgcgcgttggtcagccatggccaccgctctcgcgctacgtagcttgtaccgagcgcgaccctcgctgcgctgtccgcccgttgagcttccctggtgagcttggaccccgcgccctcgaccatccagccccctagggccggcgactgccagcccagcaccttccggcctctcgggctgcccggcccggccccgcgcccctgaccctttccctccgcagggccccgcggcgagggcatcggctctcgccggcggatgacgagctgtatcagcggacgcgcatctctctgctgcaacgcgaggccgctcaggcaatgtacatcgacagctacaacagccgcggcttcatgataaacggaaaccgcgtgctcggcccctgcgctctgctcccgcactcggtggtgcagtggaacgtgagtcctggcccgcagtgtggaaactgaggcccagagtcacaggccctcaccctgcttggtccctgcaaacttggctttcctctgtctcctcctgcagtggatggagatggggagaggctgcgtggatttgtcgtattaaatgtgcctcctccctgcacaggtgggatcccaccaggacatcaccgaagacagcttttccctcttctggttgctggagccccggataggtactggggaaggggagggagaacagaggtgttctgggccccagaaggcgacccccactgcagcctctcaacagaactgtagactagccacacccacccttccctagagatcgtggtggtggggactggagaccggaccgagaggctgcagtcccaggtgcttcaagccatgaggcagcggggcattgctgtggaagtgcaggacacggtgagtcccgggactggggcatgctgcggggagcacaggcctggcgctagacaggctgatgctggccttttctttgcagcccaatgcctgtgccaccttcaacttcctgtgtcatgaaggccgagtaactggagctgctctcatccctccaccaggagggacttcacttacatctttgggccaagctgctcaatgaaccgccaggaactgacctgctgactgcactctgccaggcttcccaatgctttcactcttatctaccctttggcacttatcttgcttatcaacataataatttatacacttctcccattttgtatcaggtgtgttgctggccaggagctgatggctcactgggctcttggaggggaatgtgaagaaaccaaggagtcactttttcatctagattacttaggattccttgacttttcagaagtcgggaagcagtatgtttgcctgttgtagacctacttgctcacatgcagatttgagaggacctcaacggcttttctcac

SEQ ID NO: 37164 - DNA, 16669 bp, Homo sapiens; identical to SEQ ID NO: 36933

SEQ ID NO: 37165 - DNA, 18328 bp, Homo sapiens
agttgccgctgtcgtccgcagagccagttcctagcgcagagccgcgcccgccatgagggagatcgtgcacatccaggcgggccagtgcgggaaccagatcggcaccaaggtgggcctggcgcggtgcagggcctctccgcgggtcggctgctggcgggccccgggtctcccggcgcgacccccgccggggcgcgcacccgctgtgcgcccctgggtcctcggagcccggtgcggacccgcgagggccgcagggagggagcgcccggggcgtggccggccggggaccttctactcttcgctccccacccccatcccaactgggagcggctgccggcggctcaggcgcgcctggaattcggccgccggggcgcctggggtgggcgcgggtggcggcgtcccgggctctgggttctgagcgtctgtccccccgccttgccctgcccaagttttgggaagtgatcagcgatgagcacggcatcgacccggccggaggctacgtgggagactcggcgctgcagctggagagaatcaacgtctactacaatgagtcatcgtgtgagtagcaaggccgccgcgccctgcccggccgggacccgcgtggacgctccggcgccgcctcttagcgcggcgagtttgcttcgggaaaagttctctcggggtgtagcaggatgcccggccactcccttcgctcctccggggcgggaaatccgccgtcagtttattcaaacagctcgattcagcctatcctgagggtctgagcgcttgaacgggaccacccgttagcgttgtgaaatcaacgtagcggttcctgcccagccttctctgtctagccgggcgcggtggctcaagcctctaatcccagcgctttgggaggccgagactggaggatcatttggggccaggagttcaggaccagcctgggcagcataggagaccaccccccgcccccctcccgccccgatctctacaacaattttaaaattagccgggcttggtggcccacccctgtagtaccagttaactgagggcttgagctcaggaggtcgaggctgcagtgagctgtgatcgcgccactgcactccagcctgggtgacagagcgagaccctgttagaataaattagagcgtttctcaaggatccttgggaaaaacaaagcttccccccccccccccccagtttaaaacgtatctcttattggggattcttggctaaaaatttgagaaacgctctcttaagtgacttttctggtcccttgcagacctctaaaaagactttaacctccctggaagctgaaactccaggcagttctcagcaacgagtggagttttattcatttacgcagcaatgacaaaaggctgggaacatcagggcatggaagatgaaatttctagaggacactaaggatagttccagtatacactgcacttcatgttaatccctcacccagcttgggtacatccattttcgatcttggcgagtgcactgcaggacaggagttgaagagcaggtcctatctggaatcatattaaccgtgtcctcaccgggaacaagttctagcccaattggcatgaaatttccacacaagaacactctgactcaaaatgagagtgactctggggaaacagccagtggcgtgctccgggtaacaaggttctcagactgcacatgggcacatgtatgtgtatgcatgggggaggtgtcacaaagcagagaatttcatccaaacctggcaatttgctgtaaatacctagtttatttccatggagctaaagttgtaaaacttcctaacaggaaagaggtgtcagggtgagctggaaaatacagtaggcaggaagtcaggggacttgatttctcatcctgcctcttcctggaacctcctctgccaggtcatgcctggactcgttcctcattccagtgttaaggttctaggattttttttctttcttttttttaagagacagggtttcggccaggcacggtggctcacccctgtaatcccagcactttgggaggccgaggtgggcagatcacaaggtcaggagatcgagaccatcctggctaacacggtgaaaccccatctctactgaaaatacaaaaaaaattagccgggcgtggtggtgggcacctgtggtcccagctacttgggaggctgaggcaggagaatggcatgaacccaggaggcggagcttgcagtgagccgagatcacaccactgcattccagcctgggcaacagagcgagactccatcgcaaaaaaaaaaaaaaaaagacaaggtctcactctggagtacagtggcataaccatggctcactgcagtcttgacctcctgggttcagatgatcctgccacctcagcttccagagtagctaggactagaggtgcacactaccacacttagctaattttcttggttttttgtttgtttgtttttagaaacagggttttgctctgttgcccaggctggtcttgaactcctgggctcaagcgatctgcccacctcagcctcccaatgtgctgagattacagggatgagccagtgcgcccagccaattctgtgattctaagaaagttcctgtaccctttctgaaaagaccctggttgatccattccaggcagctagaactggtgggacttgaaacggggaagtcaattactttagaaacctgaaagtaactcttgtgggtggttcttttctcctccagctcagaaatatgtgcccagggccgccctggtggacttagagccaggcaccatggacagcgtgcggtctgggccttttgggcagcttttccggcctgacaacttcatctttggtaggttccatctttctcactttcttcttcttcttttatttttttaaatcaaatattttatatgccagatttaaagcatcatgtgtcatagaaaaagtgtgaatggaaatcagtggttcccagccccacccctcccatccctagctgggttcatcacaaggaacagttttttttaaatcttgacttttttggtgggaaggaacctctatatctctaaatgaaattcttctactggtagttcttgattaaaaaacaaaaatcaagccaggcgcggtggctcatgcctgtaatcccaccactttgggaggccaagacgagcggatcacgaggtcaggagatcaagaccatcctggctgacacggtgaaaccctgtctctactaaaaatacaaaaaattagccgggcatggtggcacgtgcctgtagtcccagctactcgggaggctgaggcaggagaatcgctggaacccgggaggtagaggttgcagtgagctgagattgcactactgcactccaacctgggtgacagagcgagactccatctcaaaaatagcaaaaaacaaaaaaacaaaaaccaagaaacaattttagacattagcttctttttccccatcattataaagttattttgccatttgtttttggttcctatattggttttatcagaattaggtaaatcctttttttcttgcttcttccacctaaaaaatgatagtaaaacatatctttctgcagacttctgaagaaaattatataaaattacatgaagtggtaccattagtgttatcaagtagaacctacaggataggtggcagatttggaagtttcccacctattttaatgttagagaccacatatctattgacattattgctaaaaaaaaaaattcctcactcaatcaaacatatttccaatacctgtgaaaagcagtgtcttccaagaaaatgtgaagaatttgaagactgattctggcttaaaagcactatggtgtaggaatcaaatacatcatgaaaaatctacattctaacccctttctcaaaaggcaccaggaagagatagtttaatagagggtaacagacaatcccattatccaaaccattccagagagaaaatgatggaaaacttcccaacatttcctatgaggctaggtagcttctactagaacatacaagtgaaagctgtatatcaaacttacttaaaaatatagatgcaaaaatccaaaataaaatacttagaatatcaaatgtagttgtgttttttaaaaaatatattaatagcacattgtgaccaagtaagactgagaggcagacagtgtaatggttaggagtctggctgtgctgccagactccctgggtttaaattttggcccttccactcactatgtggccttagacttatttaacttacttgtgacttaatttcctcatcacaagtgggactgtctacctcttagtgagatgtaaggattaaataaacacttagaatgtctagtacaaaataagtgtttgagaaatactagcaacatcccaggaatgcaaggatggttcaacattaagaagtctactaatagattaaagacaacatcttaatagatgacccaaaaaagtgggttttttttctgactcccagcaggaaacaattttttaaaaaagattaaagttttggaagccaggagcagtagctaacgcctgtaatcccagcactttgggaggccaaggcgggcggatcacctgaggtcgggagtttgagaccagcctgaccaacatggagaaaccccatctctactaaaaatacaaaattagcccagtgtggtggcacatgcctgtaatcccagctactcgggaggctgaggcaggagaatcacttgaacccagcaggcggaggttggggtgaaccaagatcgcaccattgcactccagcctgggcaacaagagtgaaattctatctcaaaaaaaaaaaaaaaaagataaagttttggatgtgttcctgatttgtagaggacaaaaaaacttctatgtaagctggaagtagaaagaaacttcctttatttacagattatctaccagaaacccatagcaacattacactccctggtgaaacagaagcatttccagcagaattaggtataagaaacagatgtccattgtctctacaattattccatgttctgaaggctttagccagtgcacaaaaaccagagaaagaaaaaatgcaaatcatgtaaaggaaaagacaaaagtgttatttgttgatgaaatgattctcttggagtttccagataggctatcagctgaaaaatgactagcacttacaagacttcagtaagggagccagacacaagataaaatattcagaaattaatagttttgcgatcaggttaccaatctttctgatttgcctggaactgggaggtgttccccaggacactagactttgagtgctaaaactgccagggtcccaggcaaactggaacagatgaatcacattaaaagcaataatcactggggaacacatcctattcacaactgtaataaaagctataaatacctggggacaaaatttactactaactagaggcaagagggaattaaaacaaaatattctcccaccagattggccagtatttcagaagctgctaagacctagtgttggtgaaggtgtttgggaaaataacagctgttcagagaactacttagtagattgagcaaatcaataatttccatccaagagttccagttcaaggaatctgttctgcagaaatgctcacacatagagattgcagattggcctccagaagagctgaatccatttgcatgcccacggggggtgtctgagagctcctcttgcccagtgtcatccttgtcaattcagagggactgctctctgagtactgtaataaagacctgacttggataacattaatattctgtattgtgagaaaggaaaaaggacgatcctactttatacagatcagcattgagtaactcacttactaagtaggtatagactcagcagccacagcttctttctggaccacattcccaggtcacagagttaacatagccaggaagaaagagcaccgcaccgggagagggaaactgagcagctgaccctagctctgtgcccgctggcagcatcagttcccttctctgggggtcttcattttactatctgaaatgaaggaccccccccaagcatcttggggtcacagacccctgtaagaatctgcgagaagaaatggccctatctcccccacttgttgtagaattctgcccagtcttctccttgaggttcagtggatttttggtgagaatctgagcgagcggacagctaagatttcttgagtctgaattatagttggctgagtctaccgtagtctcagtaagctttaccagacacaattcatgtatttccaactaatacaccttttagaaatcacacctcttctttgataggcagtgtgtgcacatggtgcgtagctggaaaggccatacagtgaaaacccacctccctccctgcctgcctccctcgcaggagtccttcctgagattgggaaacagttacaagcatatctgtgaatttttatagataaaaaagatcttaaagttttacatatgtaaaatatataccttcttcaaagaaggatatgaaacaacagtaaaagacaggcataaatgtagcagtttacaacacagagtcaactgtgagctcagctgtggctgagaattaattttagctctgggtttctggcaactaaatccaaaaaaggaagcacagcaggtgacacagctgacattgtctcataaaggggaatatatgcttttaatatatttaaaagggagctctccccaccatcctgagtgattcgtatttatttttaatttgtactttgctttgctttttaaactttgctttttttttttagcaaaaactaatataaccacactcttaaaagtttaaaactagagttaaaaaaaaattctgtatgttcatcatcttagtgtaattattgtcagcactgaggtatttttttcacctttgtttctttttgctgactctcattattgtaatcatggtatcatttatatctttttccattgaacattatattataaaccatatttcacatttagtttctaaaatccataatttttaatagctccataatgtgtaattaattctttatgcaactttataatggccaataatcaggaagctgtttcttttcagctttttgctcttaaaaggaatattgaacatcttgattcacttaaatttgtctgtttctcactttgatttcagaatagattctcaaaaagcaaaattactgggtcaaagagtgaagagatttaagccctttttacacacttccaattggattaatgccaccagcagtgtctgagagcgtagtttttgctgcacttttgcctgaaattaaacttttcaaagaaacgtagcaactgaatgcttattttatgagagactcagggctttaagaactactttataggaaatgtaagaacagctctgaatttggcccttctattctacactgacgtaaattgtcagcgtaaaacagagaaacctgcacacatatcacgccaggactcacgcatagaggagccggaaggcaggacattaaaatgcaactcagcgcacgctgcactgtttcccaggggaagggtggttagccgaaactcatgccacacccattactgctttttgagataaaataggaaaaaagtatataattctacatagttgagtaagttcacactcacacttgttacacagggcttcatgtaccagtggccggttttatttcttaaatgggtagtaggtgtgtagagattcatattatttttcatatgcttttgcatgccttaactctgtcaaaaaaaagatatcagttgtctcaaaggtgtggtcacggaaaaggcagctttcatggagaaggttttcagcaggtcatggctgtctggccccggcccagtctgccccaggcctggcagcaactgagggacccaacccagtctggatgggtgccccgaggaggcctcacccaccagcagtcaacgcagtgcagccaggacctggccaggtctcaagagagagtcgaagccatgaactgatctttatgacatgagtgcatcacaaactattgaagtggtgagaagctagtttctcacagctgccactttagcaattgtgagttttctttggtttatttgaattgaacattgggagagtgtaaggtctttctagctgttgacaaatgggatcacgaagattaagacaaattaagacagacctatggtgcccatttagttatctaattgtccctgtaagccttcaaaaatgttagaaatgacctttggcacataaaaactgtccccgaaattgcttcttgcatctttgcttcatctgacttgcaaccctatttttgattcagaatgttttaagttttcaacaggttgtactaacatgatatgtctttaataggaattttagcaagttgacaccattttgagttaagaattgtgacttgtttaaatgaatatgcttatttgttaaaataacatattatggagaatggagaagtatccagaatgtataaacattctatattgtttagctaaatagtttttaagtcgttctccagtaaaagaggcagaattgtctgtgaactggagatgatccatcctcactggctttataccatattgttccagttagagttggtaaattacaataaaccagtgtcattccatttccaaatagagtttgaaatgatttaggaaacactcacttacattagtagtgtatacttttaaaagtgaaagttacctgtaattccagcactttgggaggcgcagacaggcagatcatctgaggtcaggagttcgagaccagcctggccaacatggtgaaaccctgtctctcctgaaaatacaaaaattagccaggcgtgatgagtgcctgtaatcccagctactcgggaggctgaggcaggagaatcactggaacctgagaggcggaggttgcagtgagccgagattgagccattgcactgcagcctgggtgatggagtgagaccctgtcaaaaaaaaaaaaaaaaagaaaacttcccagttgggcagtggctaatgcctgtaatcccaacactttgggaggctgaggcaagtagatcacttgagcccaggagttgaaggtcagcctgggcaacatagtaagaccctctgtacaaaaagtttttttaaattagctaggcgtggtggtgtgcacctggggtcccagctattcaggaggctgaggtgggaggatcacttgagctagggaggttgaggctgaggctgcagtgagcggtgtttgcgccactgcactccagcctgggcgacagagcaagaccctgtctcaaaaaaaagaaaagaaaaacttctgtaatgaattgctggttgcatagcagtcatacctactctattgttggaaagttttgtgggaaaagaatgaagcaccagaaaggtaaacgttcttccagcctctttctgtatttctaactttttcttccagattcagggctagaagagggggcaggagtgcacagacccttgacacttattccatcacccattgtgagcttgaaaccagaggggggactcagagaaaaccctggggacctgttgcagccccactgccaaaaagcttagagttggcagcctcctgctaactgtctggagtcactgactaacatcacaccgtatcagtacagaagatgttcagttcacaactcccaaatatttaactggaacatctgttgctatgagacagtggcaaaatatttttcagaagtcaccagcttcctcctttcatcaagagcacagaaaacttcatggctattcatgctataaatattgaggaagctgggtaaatggtgtgagctgcagagggagtcaagttcagcatctccgtccacttacagctagctcaggtctgattgattggggttctatgtttgccaaaagccacctactattttcagttgttggtttctgctattttaatgaaataggtcccaggctattttgacagctgccctgggtctttcctttgtaaaatgtgacagttctagcaccgagtgtggaccagccccgagcttgttcctcccaatacctatgttgtagttttgccaggtgctgcctgctaggttgggtggggaaggggtggagagaagttggtgggggcttaggaaggacggtgaccattttctcgcctactaagagaaggcagtcagctaggattcactgtgcaacacagctgggcaggaagaagagaatcccctgtttgtaagagaacagtcacatactagatgctgtctacggcttgtgaaaaacacaaggaaacggccacctgagagtactaaagtggccaggcccacggggtgtgctgcaagcacacagcaggcatctgcctagcccggcccctctgcagagccatagggcctgccatgccagtgacactgggctttggactgccaaatggggcaaagacaataggagagaaaggctgagctgatttctcagtgggactgagacggagatctagggaggctgatgctgcagacaagtgcaagggccctctgtggtcagtttcagctggccagttctgctctctggaaacttcagtgttcaatatttaaatgtgtggttttgtttgtttgtttgtttgagatggggtctcgccttgtcacccaggctggagtgcagtggtgtgatcatagctcactgtagcctcaaactcctgggctcaagcagtcctcccacttcaccctcctgtgctaggattgcaggtgtgagctcccatagctggtcttatacaaaaaaaagtgtttaatgttttcatgtcaaagttaaaacaaagtgcttgtacatggttttttcaaacagtacacatagattgtgtatacagtgcagaaagggaaagctgtcatcccttctactggtggcccctgaggttttattccctagggggataaccgagtgtgtcgacagttgtgctgtgtcctgctgacatttttcctttttccttttttttttttttctttttttttttgagacggagtttcgctcttgttgcccaggctggagtgcaatggcgcaatctcggctcactgcaacctccacctcctgggttcaagcaattctcctgcctcagcctctggagtagctgggattacaggcacctgccaccacacccagctaattttttgtatttttagtagagatggggtttccccatattggccaggctggtctcgaactcctgacctcaggtgatcctcctgtctcggcctcccaaaagtactgggattacaggtgtgagccaccgcgcccggccctgctgacatttttctgtgtccatgtgcacctaggtgagcacacagagctgattttgtctggggaaaatgggatcctgctatacacaccattttgcagccttttgaaaaattcattaatgtatctcagacatcctccgtgacagtcacagtgcctaccattgtatatgtcatcatttagtaatttcccacttactgatgacattttaaaatttttcattaaagaagagctgggctcaggcgttcacacctgccatcccagcactttgggaggccaagacaggatgatcacttgagttcaaaagtttaagaccaacatggacaacataaggggaccctctctacaaaatttttcttttttttgacggagtctcactctgtcgcccagggtggagtgcagtggtgcgatcttagctcattgcaagctccacctcccgggttcacgccattctcctgcctcagcctccggagtagctgggactacaggcgcccgccaccatgccatgctaattttttttatatttttggtagagacggggtttcaccatgttagcgaggatggtctcaatctcctgacctcgtgatccacccgcctcggcctcccaaagtgctaagattacaagcgtgagccaccgtgcccagccaaaaaaatgtttttttaattgtcccagctactcaggaggctgaggcaggaggatcccttgagcccaggagttggaggctgcagtggctatgattgcaccactgcactccagcctgggtagcagtggaagaccccatttctaaaataataataataaaaaattccttttttatactttaatattcacttatcataaaataaatgttttagttaaaatgtcataaagctagaaatgaactctcttaggaccccatccttcaaagacaacctgtgctttcttaattgcattgtaaatgttttaataaagtaattttttttttcattttgctagctagctaggtaaaacattttcatggtttaggacttaaaaggaacaaaagggtatatagtgaaaagttgatctccttcctaccccgaactagtgttaagattcttgaatgtcctttcaggtatgttcaggcagacgcatatatttacacacatacaatggagccagctgtatacactgtttagtaccctagtgttcctccctggctccccagcaacgtattttgaagatctttccatttcacaagtatggctgcctcattcctgttgatggctgatagtatcctctgcagagataccgccgtggatttaaccagtcttcagttgataggtatttgggttgttcccctttttattattataaattgttcctcagtaaacatttgtatatatgtcattttgcacatgtatgggtctatctagaaaaacttacagaagtgtaattgctgtgtctagggggataattttgatagctgtagctcagctgttctacagcccactgcccttgctatctccagtagctcccgtgggaagtggccttccccaaaccctcagcagtgcaactcaggtgtttggatctctgtcagtttcacagcagaaaaatagaatctccttgttttaatttgcgtttcccttatgagaagggtttagcattatttccagtacctaagctattggaatttcctttcctgtgagctgtatgtttatagcctttgcctgttttcctaatggctgttgtttttcttactgatttaaggacttctttagatattgaaggagggtatcctttatatgtgatatgagttattaacagtccagtacatacattttaacattaagttcagtacacttaatgaagaatcacagaatttgttttttcttgcactgaacacctacagtgtgtagcactgataaatgcttcatcccccccaagagtagagccactgtgtaaggctgcacttgttatgtactgcagaagccaggggtgccatcagtagacctcattgtgagcaggcccgtgtcccaaattgcatgggagccccttgtccactaattaaagattgacaagtgaaaggcagcttgcttacccgatgtagcacttggcagctctcagaggcagccttggtggtttcactgcttcatagttcagtgcccccagggtgagtgcagcatcagggatggacctgcccacgtgaaaccagagaggctggtctttggcagtggctgtgaattgttgccaccagccgtgtgtagacaaaagtcaagttggagtaagtggggagaggtctgtataatgcaatgcaagtttttatgacttgaattagttaaatctgcagcccaaaatttcatgaaaataaatatttaaaacattttattaaaaattaaattgacaaagtcatattagaaattagtatttcaattttcccaactctaagtatactggaataaattgccttaaagtgaaagagtgagagtgtatttagtaagtcttggttaagcctttttggtttacattcagaaacaagaaaagaatgactgatgtaaaatgtcatgacctgcaagttaggtcgtttccaattctgctttcttcaacattgagttgttggccaggtgcggtggctcatgcctgtaatcccagcactttgggaggccgaggtgggcggatcacttgaggtcaggagttcaagaccagcctggccaacgtggtgaaaccctctctctactaaaaaatacaaaaattagccgggtgtggtggcagcacctgtaatcccagcttctcggggggctgaagcagaattgcttgaacccaggaggtggaggttgcagtgagacaataccgtgccactgcactttagcctgggcaacagagtgagactccatctcaaaataaataaataaataaataaacaaaattgagttaagtgacagatgattgaaaatacttttttttttttttttgagacagggtcttgctctgtcacccaggctggagtgctgtagcacaatcttggctcactgcaacctccatcttctacgcttaagtgatcctcccacctcagcctcccgagtagctgggactacaggcatgcactaccagacccagctaatttttgtatttttagtagagatggggttttgccatgttgcccaggcttgaaaatactttttgataatagctcactatttgatttttgggatgtaactctgaagacaatcaaagaactgaatgacattgtagaacataattcattcccatttacatatatctgtggacaagatttctcatatatgtaaaaattaagaggaatagaattgatcccaagccttggccctttctggcagtatttaatattcacccttggataaatgaattaataggaaaaaaatagatatagataggtagatagataacatttaatactttgtaatcacaggaaattaaaaagaatcaacttcaactgattggaattatttctgatttttaatatattctatcaatacatttaacagaagaagagttttttaaagtgattatattgtttccagaaattaaaattatatcatatgcaactatttgacttatgaaaaataatagatgttaactttaaaataaatgagaggtatctagtatctagttttttcaaatgttcattagccaagtgtagtggcatgtgcctgtagtccctgctactcaagaggttgaagtgggagaatcacttaagcccaggagttcaaagctgcagtcagctagggtggtgccagtgtacgccaccctgggtgacagagcgagaccttgtctctaaataaataaatacagatgttcacagcaatgtatgaaagccattgcattatatgaaactcgtagtgcccagaaaaccaaaaacaaaaattagttcctcccactcctacgtgcatctgttcatatggacatacaaacctgtgtaatttttacagctgggaaaaaaatgcttctgctagtgaaataatccattttaaaatgagataaaatgaaaaataggattttaaatttaagagccaatctttcagattcaattttttttaggtaaagtaagatatacataagcctgtctggcaaaaatgcaccattatggggctggcccggtggctcacacctgtaatcccagcactttgggaggccgaagtgggtggatcacgaagtcaggagattgagaccatcctggctaacatggtgaaaccccatctctactaaaaaatacaaaaaattagccaggcgtggtggtgggtgcctgtagtcacagctacttgggaggctgaggcaggagaatggtgtgaacccgggaggcggagcttgcagtgagccgagatcgcaccactgcacctccagcctgggtggcagagcaagactccgtctcaaaaaaaaaaagcaccattatgcagaaaacagactaggtctctttcttgttacttgaactctgcataaaatacagaagtctttcagacatattaagctccttttctcaactggcctggaaacaatttgagggcaggaattacttcctgtgcttagtatttaattataggggcagaataaataattggttctgcaaacattttgcaacagtaattctggatgatgaatgaggggctccattaacatgaaaaagtgtcaagttttaaaaataaaatacttgggccgggcgccgtggctcacgcctgtaatcccagcactttgggaggccgaggcgggcggatcacaaggtcaggagttcgagactatcctggctaacacggtgaaaccccgtctctactaaaaatacaaaaatattagccaggagtggtggcaggcgcctgtagtcccggctacacgggaggctgaggcaggagaatggcgtgaacccaggaggcggagcttgcaatgagccgagattgcgccactgcactccagcctgggcgacagagtgagactgcgtctccaaaaaaaagaaagaaagaaaagaaaatacttatacatagtacagtataagattcagaaagcccaaaggagagaactttttttttttttttgagctgtagtcccattctgacgcccaagctggagtgcagtggcaccatctcagcacactagaacctccacctcccaggtcccaggttcaagcaattctcctgcctcagcctcccaagtagctgggactacaggctccccaccaccacgcccggctgatttttgtattttcagtagagatggggtttcctcatgttgcccaggctggtctctaactcctgacttcaagtgatccacccgcctcggcctcccaaagtgctgggattacaggcatgagccacggcgcccggccagtaacttatttttttaatgtataccttttgttccctttgaattctaccatgtgcaagaattacctctttaacatggaacaaccaggtcaaaatgtatatacatctttaaaattgaccagtagctactttgacttgcctaaaaacgtaccagtgcatctgctcagctgcaccgttggtgggtgcctgtttccccggcccctccctttggctaacagcacatcatggaatcacttcacaccctccttgtcggtgaccaagcatggtgatggcgcagccctttcctgtttaaacggcacgggactctctttgttgcaggccagacgggtgcagggaacaactgggcgaaagggcactacacggagggcgcggagctggtggacgcagtgctggacgtggtgcggaaggagtgcgagcactgcgactgcctgcagggcttccagctcacgcactcgctgggcggcggcacgggctcaggcatgggcacgctgctcatcagcaagatccgtgaggagttcccggaccgcatcatgaacaccttcagcgtcatgccctcgcccaaggtgtcggacacggtggtggagccctacaatgccacactgtcggtgcaccagctggtggagaatacagacgagacctactgcatcgacaacgaggcgctctatgacatctgcttccgcactctgaagctgacaacgcccacctacggggacctcaaccacctggtgtccgccaccatgagtggggtcaccacctcgctgcgcttcccgggccagctcaatgctgacctgcgcaagctggcggtgaacatggtgcccttcccgcgcctgcacttcttcatgcctggcttcgcgccgctcaccagccgcggcagccagcagtaccgggccctgaccgtgcccgagctcacccagcagatgttcgacgccaggaacatgatggccgcctgcgatccgcgccatggccgctacctgaccgtggccaccgtgttccgcgggcccatgtccatgaaggaggtggacgagcagatgctggccatccagagtaagaacagcagctacttcgtggagtggattcccaacaacgtgaaggtggccgtgtgcgacatcccgccccgcggcctgaagatggcctccaccttcatcggcaacagcacggccatccaggagctgttcaagcgcatctccgagcagttctcagccatgttccggcgcaaggccttcctgcactggttcacgggtgagggcatggatgaaatggagttcaccgaggcggagagcaacatgaacgacctggtatccgagtaccagcagtaccaggatgccaccgccaatgacggggaggaagcttttgaggatgaggaagaggagatcgatggatagtcggaatagagccgccccaactcagatcctacaacacgcaagttccttcttgaaccctggtgcctcctaccctatggccctgaatggtgcactggtttaattgtgttggtgtcggcccctcacaaatgcagccaagtcatgtaattagtcatctggaacaaagactaaaaacagcagagaattgcgggttctacccagtcagaagatcacaccatggagactttctactagaggacttgaaagagaactgaggggccacaaaataaacttcaccttccattaagtgttcaagcatgtctgcaaattaggagggagttagaaacagtctttttcatcctttgtgatgaagcctgaaattgtgccgtgttgccttatatgaatatgcagtatgggactttgaaataatgattcataataaaatactaaacgtgtgtcttc

SEQ ID NO: 37166 - DNA, 3443 bp, Homo sapiens
agtgtacacgtcggttgcctaacaaccggcagcggactcctttggctatggtgagtgctgccgctctgtcgcgccccacgcccagcggctgagcccttcccaggccccagctcggccacgccgcctctcctgcgcctttctcggctttagcgcaccagtctttcctttgagctctttcccgggagagtagggtacagacgctaaccaacctactgggcctgcgcttcgctgctgcctcctcttcacccacaacaggcccacacccgcccctcgggctccccttgcattccctgatcccctcggtgaacctccctgggcaaaaaagactcgaatccctcacaggcccctgactctctcagaccttggccccctggcctcctcattctgccaaaatttccacacacagctgggaaaaggtgtatcgtgttctgttacaatgttttttacaatttaaatacaggggcattcaggggatgctttagcttcttggagaaggcacgaaggtgccagatggattgagttttattactcggtactgacacaatatacatcttaacaacttactaatatttggccaaatctagaagtaattgggaagtcggagtacttactgggaaggggagtactgggagtgggcatcgtaagactgttttcagaaccaggatccccacgttcgggaagagctgattatctctagttattcacagtcatcttcttgactggctctcttttgggatgattttcagtaagaggtgtccttactgaacaagtgatctccctgcttctagaaacaacagtaaagaaaagggaggggtagaagttcatggaaagattcattgttcttgccagtaaaccctgttatctttctttttaagcaaagctttggaattggttatataaatgactttaaaaatacatatgggtgtctgtaactatgttatgtaaatatggactgtatgatatattattgtgcttgtgtattgcataacatataaaggcctccaactttaagaaggcaaacatggcatcaagttctcagcgaaaaagaatgagccctaagcctgagcttactgaagagcaaaagcaggagatccgggaagcttttgatcttttcgatgcggatggaactggcaccatagatgttaaagaactgaaggcaagctctgtgcattcctgccgtactgcccttcctttcctctgcctcttccttgtcatctccctatcacctctctaccccttttgccctcttctccctgcagtaagtaacaggggaggttgtactgtgctgttttcctgtctttacttactttgagtattattcaataaaattgattgcaaatatcaattagatcaatgtcatagtgttccccaatcatattaacatgaccacatcagatgctggcttaatgctctcaacactgttatttttgctcctgctactttagatgtgcttattgagacgatcctgttttctttataggtggcaatgagggccctgggctttgaacccaagaaagaagaaattaagaaaatgataagtgaaattgataaggaagggacaggaaaaatgaactttggtgactttttaactgtgatgacccagaaaatggtaagtagctaagacaattatcatggtatggagccccagtcatctgcagaggtccatggcgtcttcctgttaaaacagtcatgtgaccacagagcagtccaggtagcaactgcatcaggaggcctgccctcccatcatgttactttgggctcccaaaacaagcccttgtgcttctttctcaagacttccaagcagatacctcttcccacagaattccaaatcagttaggaaatagatatgggatagggagagatatagcgataggtagcaaacgtcaccttggatggagtgcctggcttgcctggtgtttctttgaggccaaaatgggcttcctgacacttgccgcaagtctagactcgagttacattgttaaaaaggaaagggtgacctgaccaggcagtggcagggctacaggacagtagtaaccaaccgtggtgtccccctactcatgtgttttatgttctacttgttaagtctgagaaagatactaaagaagaaatcctgaaagctttcaagctctttgatgatgatgaaactgggaagatttcgttcaaaaatctgaaacgcgtggccaaggagttgggtgagaacctgactgatgaggagctgcaggtttgtaatgcatcacactggaacttaaaattcccacctttgagccctctgtgacttttccattacattttccctagtgtgagcacctctttgaagaaaagccagtgtactttgtccctctgcagacaacttaattctcctttaatagtcagacaaacctatgaaccctgcttccagaaaaatgcacatatgcacaattttgcttactattttaggttccaggaatccctctagtcaaggcaatcttcaaggtccctcccaggtgatatgtttgacaaagtatgagttggttttcaaataacttttcagaaaccaagctattatcaggagtagcatactggcattgggtggactacaatgatctattcacatagatacaaattatctattcacatagattaaaagtctattgcttgccaggcacagtggatcatgcatataatcccagtactttgggaggctgaggcaggaggatctcttgtggccaggaatttgagaccagtgtgggcagcatagagaccccatctctaaaaaaaaaaaagtctattacttagtcaccttttggcattagtttataaattaacctgaatctttactgtcatataggaaatgattgatgaagctgatcgagatggagatggagaggtcagtgagcaagagttcctgcgcatcatgaaaaagaccagcctctattaagatcagtgtcttctttttctactgcaagcacatgtaactagatttagtgcctgccatggtgtgaaatctggcttttgagaacacaaacttttcccccacggacctccctttatcactttaatagtgaccttgagcctattttagccgtttggaagtgttctttgatattacagttctttgtaaaatgacctgcgaattaccctaattctcaaaagcaaaacaagagcacacaagcgtgaagaaaaggatcttaaagctttgagcacctgccattttgccttgcatcgtttccctcgtcatgcatttccacatatccacaaacacagaacgactttagacaagcacatgttacacctgtgttgccacaagcagtcattcttgacggctccagtttttatttgacacttgagtttagttttctcttttataaacccagtgaactcctgcactggcatttggatgtgtgttaatgctatttgttttgtcttaaaagtaaaacctttctcagtttgaacttgtattctct

SEQ ID NO: 37167 - DNA, 25538 bp, Homo sapiens
agaaggcggagcctacctctcatcaggaccagtctgactgcacctgcatccttagctcagcgcatccccggagcatcttaagagctgagcgcagctgacaactaggggccggaccgtcgcaggaggcgtccgctggataccttcccccttccctgacctagagctctacagctgctgcctcggtactgaccgagggttcccagagctgtctcaccattgcaaaaacgttatagcaacagcctctgattacgacatggctgagatcaccaatatccgacctagctttggtaagtagactcgggaaaactaagcttgaggtggtcagaatggttgcaaggccaagggggcccagcggcagggcagagaatgcagcccagaccagagccttcaaaatgccagccccactaaaatcgggcctgtggtggtgggtagtgggtagtgggcagttgacagtgcatgaacttgagctatgggctgcagggactggcagggcctgagccacaccgagggtggggaagtccaggatgctaaaaccttgtatggtgcactgtcagcactgctggaggtgagaaacagcaagcgtgcggaggatgtgaacccctccttctgggggaggagaggtggggtaggccaagccctcccccttggggcacacagggcggtgccccttcctccccctcccattcctaagggctgcgggggagggaagtgacaagggggatggggcatcaagatggcagcttggagactgtgggccgtgtggctggcagccaggggaggcggcggcctctggggaaagaggggtgcggggtggggagcaaaaaggaagccactccttaagccggtcagctggatgctggggctaggaggaaacgtgagccctgcaagctccattccgcatcgtaatggtggggtccctccgatgctaccaaatggcgcttggcgctgctgggctgggggatgacgtgatgtctatttctgggcctcctggcagcgccgacgctctccttccggggcctttgttccctgtttccctgggccgccttttcaaaaagggggactgaccagcgttgatgctggcgggggcgcgatccaggccggagggggaggggcgaaagaggcccagcccgggggaggccgctttgtgtaccgcagaaagcattacgtcatttcagagcggctggtccccgacccagccctgtgggctccaagattagttttacactctctggagcagaaagtggagtggaaaatagggaagaaggtggcaaagacaagcttgagaaggaagttttttcctctttggggactcctgcagtatatgctaaaggagcaaacttcctgtgttatgctttcctgatcaaataaataaaatataattgccctgcttctccttgattcagtttagatgggggaagccagtgagagttgctgccaaagaaccttcttattccttcagggattctatccctcagacaatccagtaggtttgagcatcgggactccagtttttagggtggagacacaatccagctaggaaatggcttttctcattcctgaataagaggtacagtgaaatgagcagaatccagtgtgctctatcccctcagaataaggaagaagaaatcaaatcagatgtgttcagataactgatcttcacactcattaactacttgttctcacttattccacaaggctaaatcttgatggtattttttcttccacttcaccttccgcatctttattctttgagttctaagtttccaaaacaaaagtccctttcatgatcacatgagcaatccatgatttcttcctgttctttttcttcttattcccttccaacagattcctttctctaactgcagttccagaatccttgaaaaaaggagatggtgtggaacataatatagtgatttctcttagagggactattattgggaaagggaaaataaattatatcagcctgttacatactacattttatttaatcctaacaaataccctcgagtgtatgtattattatatatacttgccagacaaggaaaccaaagctcagaaataaaataacttggctaaagccaaacaaatgactaaaggtagcactagtttgtttttgtttttgtttttgagacggagtttcgatcttgttgcccaggttggagtgcaatggcgtgatcttggcccaccacaacctctgcctcctgggttcaagcgattatcctgcctcagcctcccaagtagctgggattacagacaagtgccaccacacccagctaattttgtatttttagtagagatggggtttctccatgttggtcaggctggtcttgaactcccgacctcaggtgatctgcctaccttggcctcccaaagtcctgggattacaggtgtgagccactgcacctggccaatgctaggatttaaaccaatgtctggctgaagccaaaatttattctcattccattgtattatatttgtctacttgactgcgaaaagctatgtttaggaaagggggtgtcaataaaagcagttctggtcagaagctgaaggagctggccaatagcccagatgtgtcttgcaggtctttaaaccattacagaggatctcctacatagagaactaccacttccaactttttcacatctcatagagtacttcatttcaaatgccacagcacttgggtgatacaccaagccaacactcaattatccatgaccatgaaggacaaaaggagcgagaagcacaggtcactgcaatttatagctactttaaaacactcacttcagccattagtttcaacttccatttcccaccaagctttggactaaagcaagacagagagctctaggttttaatatctttgatgattctagctcattgtcttggtttcagggagagaggcaagagttaacaaatactaaaatgaagaaagaacagcaaaaataggaaacaaggccagggggaacaactagataattcaaagatgcgttcatctgtttctcttcttttccttctctatcctcctggaatatgagaattcttcatcttctctcttttctaccctatctccattttctaacaataaaagttgatgcattgtaaatatgtaagcagcagtgggttgccccccgctcctccaccgcactgctgcagggaataaatctatgatagagccaaaagaattgcccaggtgtctcctaatctaagccttcagatctctctttatgatcattccaaaaaatatgcctgtcttggtagtttgctgtgttcctcttctcatagagacagtgttcagtttcactaatgagtagcaaacaatttgcaggaaagcacctgattgatgaatggagagccacttccttaggctgtgcccattcttaatggcaactgaatccaattagttgttcaaccaaatatttactgaactcctattagaagcaagagactcttgagggattcaaagatccataggatattgttcctgcctgccttcaagtagcttactaccaaggctgtctccattttgtgaaaactttccctaaaagctatttcatttaatactttgagactaaacactattattattcggtatggatatagacatggtcaccttgatttattttgttaataatgttttgctccttatctatattattttaaaatgtacccgggtacagtgggtcgtgcttataattccagcgactcaagagactgaggcaagaggatcttgaggccaggaattcaaaaccagactgggcaacatagcaccttgtctctaaaaaaaattttttttaattagccaggcatagtggcatggtcctgtagtcccagctattcaggagtctagggtagtaagattgcttgagcccaggagttcaaggctgcagtgagctgtgattgcaccactgcactccagcctgggccacagagtgagaccacgtctctaaaaaaataataacaataaatatatattttaaataaaatgtaactcttccttggttaggcatggtggcttgcacctgtaatcccagcaatttggtggagactaaagcagaattgcttgagcccaggagttcaagaccacctgggcaatatagtgaagactcatctctaaaaaaaatttaaaaattagctgggcatggtggctcatgcctgtaatcctagcactttggggggccaaggctggcagatcacttgaggtcaggagttcgagaccagcgtggccaatatggtgaaaccccgtctctactaaaaatacaaaaactggccaggtgtagtggcatgtgctggtaatcccagctactcaggaagctgaggcaggagaatcacttgaaccagggaggcagaggttgcagtgagccgagatcgcgccattgcactcaagtctgggcaaagcaagactccatctcaaaaaaaaaaaaaattaaccaggcatgatggcacatgcctgtagtcctagttcctcaggaggctgaggcaagaagatcatttgaactggggaggtcaaagcttcagtaagctgcgatcatgcatgccactgcactccagcctgagtgacatggtgaaattccatctctgcaaaaaatacgaaaattagccaggtgtgatggcatgtgcctgtagtcccagctactcaggaggctgaggcaggaggatcacttgagcccaggtggtggaggttgcagtgggccaagcttgtgccactgcactccagcctaggcaataaaatgagacgctgtctcaaaagaaataaaaaaagtaagctctaccacaatgcctggcagggacatataaatttacacaaaaaatagcaattttattattgtcactgctatacacaatattacatgtatattatgaccagtgcagatgaaattatacctgcctctcatgtaatctggacattatgctcatagtattgtgctcatgatgctcataggctttctagagaagataaacccttcatctaggtttggagggaagaaaaagccatggattggttggagaggataggagaggatacctctaatagaagggaaaacagtaggcattatactaattatagtccaagattgtggttgcctaaattcctaagtcatttttgactcatcaagtgaggttattgactataaataggtttttgagtccaaatagaaatttacatttatccctgatatatgtaatcatcttgactcaatccttttttttttttttttttttgagatggagtctcactctgtcacccagaatggagtgcagtagcacaatctcagctcactgcagcctccgcctccgaggttcaagctattctcctgcctcagcctcccaggtagctgggattacaggcacctgccaccatgccaggctaagttttgaatttttagtagagacagggtttcaccatgttggccaggctggtctcgaactcctgacctcaggtgatctgcctacctcagcctcccaaagtgctgggattacaggcatgagccaccgcaccaggcctcaatcctctctttctaatctgtggaggctgttttgaattcactgactcttttgttcactgaacgcttactacatgccgcatagttctaggacgtggaactatagcagtgaacaaaacagacaaagttgctgttttattaagcttgtctagtgatcaaagaaagataataaatatatgtcaggataataagctccatgaagaaaattaaggaagggtgatggggacattatcttacttggggcagacaggaaatatttccctcatccagtgaggttcggggctcacgataagtgaagcagtgagctgcacagatgcctgatacaagaatgctttaggccgggcgcggtggctcatgcctgtaatcccagcactttgggaggccgaggcaattggatcacttgcggttaggagttcgagaccagcctgaccaacgtggagaaaccctgtctctactaaaaatacaaaaattagccggacatggtggcgcatgcctgtaatcccagctactcgggaggctgaggcaggagaattgcttgaactctggaggcggaggttgcggtgagccgtgatcgtgccattgtactttagcctgggcaacaagagcaaaactctgtctcaaaaaaaaaaaaaaagaatattccagaaagaatcggggaaatgctggaattatgtctatttccttttcttttttttcctcgctctgttgcccaggctggagtgcagtggcacgattttaactcactgcaacctccacctcctgggctcaagtgatcctcttaccttggcctcccaaatagctgggactacaggcatgtgccaccatgccctgctaatttttgtaatttttttgtgtagagatggggttttgccatgttgcccaggctacatttatttccttagttctccctcccttccaagtggtcccctaaaaagtaaagtggaaaaaactataggcctaatctggacctttaaagcctaaacccaatttagcctcaatgaacttgagggagcgaagaaacttgagggtccaatttttgtgggaaaagataagactagggtaagggaaacaaaaaaaaaatctatttctctttctcttttttttttcttttttttttttttgagatggggtctcggtcttttgcccaggctggagtgcagtggcacgatctcagctcactataacctccacctcccggcttcaagtgattctcctgcctcagcctcctgagtagctgggattacaggtgtgtgtcaccacacctggctaatttttgtattttattttagcagagacagggtttcgccatgttggccaggctggttttgaactcctgacctcaggtaatctgcctgcctcagcctcccaaagtgctgggataacaggcgtgagccgccacacccggcctatttctgtttagttatttgttcatccaacacatagtgcctgctatgtgttttaagtgctgagggtacagccgtgaacaaaacagacataaatttttgtcctcatgagacttatattctagtgaagataaataataaattgtaaaataatatgcgtgtgggtgtttattcttacatatttgtgtatgtattttatatatttttttcttacatgtgtaggggtgtgtgtatcagagagcgagaatgacggcatgttgaaaaaaattaagcaaggctaggaagagtgggtggtgaggatggagaagattgcacttttaaataggtgagtcaggaaaggcctaagaaggtgacatttgagcagagatctgacattttccactaatagggaagaaaacccctatttcttccagtgaaggatttattaaggtaataataatgaaaagagaaagtctctatttcttcctatttagaataatatatgtatacataaatacatatatatacacacacacatatatacatatatacacacacatatacatatatacacatacacacacacacacacacacacacatatatatatatacatacatacacacacctatttttttgcctacaatggatatattcatcctggaggaatacctttttttttttgagacgaagtcttgctccatcacccaggctggaatgcagtggcacgatctcagctcactgcaacctctgcctcccaggttcaagcgattctcctgcatcagcctcccaagtagctgggattataggcacatgccaccacgcccagctaattttttatatttttagtagagacggggtttcaccatgttggtcagtctggtcttgaactcctgacctcaaatgatccacctgcctcagcctcccaaagtgccgggattacaggtgtgagccactgcacccagccttgtattttatatacctgggagctaaaattttggaacatattttaaaagtacataaacccagaattcttccttttggcacccatccatttttactaccctgaacaccctaccaagaccatctaaactcatctccacacccttccaccctagcctgacagcgagtcagtcagtgcaggccctgttctggatgctatggaatatcctgaaaccaaacatcttgtgtaacagttgaagtgaacaggtgctcatgtaaaaaggtgatcttagaacacgtacagagcagctttatgtgaagcacaaatcagtatgagcaaaccaagtctataagtgctgagagaaggtctaggaaagaacatagagtcaagtggggtgcttcagagaaggctttctatagaaggctgggaggaaaagccgtggagtggttggagaggttgggagagggtgcctctaatagaagggaaaaattctgaagcccagatgagcacattttgctttagaggctagattgaagattagcttggctccagcagtggcaatgagcaggggagatctagacaggaggtgaagtccacccgccctgacacatctctgatctccgccttcagatgtgtcaccggtggtggccggcctcatcggggcctctgtgctggtggtgtgtgtctcggtgaccgtctttgtctggtcatgctgccaccagcaggcagagaagaagcagaagaacccaccatacaagtttattcacatgctcaaaggcatcagcatatacccagagaccctcagcaacaagaagaaaatcatcaaagtgcggagagacaaagatggtcctgggagggaaggtggacgtaggaacctgttggtggacgcagcagaggctggcctgctaagccgagacaaagatcccagggggcctagctctggatcttgtatagaccaattacccatcaaaatggactatggggaagaactaaggagccctattacaagcctgacccctggggagagcaaaaccacctctccatcatctccagaggaggatgtcatgctaggatccctcaccttctcagtggactataacttcccgaaaaaagccctggtggtgacaatccaggaggcccatgggctgccagtgatggatgaccagacccagggatctgacccctacatcaaaatgaccatccttcctgacaaacggcatcgggtgaagaccagagtgctgcggaagaccctggaccctgtgtttgacgagaccttcaccttctatggcatcccctacagccagctgcaggacctggtgctgcacttccttgtcctcagctttgaccgcttctctcgggatgatgtcattggcgaggtcatggtgccactggcaggggtggaccccagcacaggcaaggtacaactgaccagggacatcatcaaaaggaatatccaggtgagtaggaagtgtgtgttggggagcaatggtaggttgggggagaaaatatctcaggggataaatggaagtgggaggggagtgggttgggtggcaaagaagggctgtagagaggaagctcttggatgtcaaggataagcagtggtcagagtaagacagagggcctggcagatgaggtctcctctaagaagcaacttcctggtgagagaaggttcaatagctttcaccatttcacttagtggttggcatcctgatgctgtccagcttacttggaacaggctggcctaccatttgtagatccttcattatatcagggatatgggagctaatttcctctccaaaatgatgtgatcttcctccagtgaatttatttttcacagctgagaagctatgacaataattcagtaatttttccctcagcttccctttcccaaccctaacctaggggtgtaaatgataccatgtacatgtcttttttttttttttttttttttttgagacagagtttcactcttgtcgcccaggctggagtgcaatggcgcaatctcagctcattgcaacccccaccgcccaggttcaagctattctcctgcctcagcctcccgagtagctgggattgcaagcacccatcaccacgcctggctaattttttgtatttttagtagaaacggggattcaccatgttagcctggctagtcttgaacttctatcctcaggtgatccacctgcctcggactccaaaagtactgggattacaggcatgagccactgcacccagccgtcatgcacatgtcttcttatgaccattttacaatgcaattcaatgaattgcttcacccttctaggcccaaacctttgccatagacacttcccctctctccatttctcctgtcctccctctttgtattagaagagggacgagggccctccatcctgccttctctctccctcttcccactggaccgacattggctcttgagttgtaatttcaggagcacagtaagtgtagccccacccaaccccattagttcatttatttcttccacaactggggaggcagtgaaatgctgcagttaaacacttgggctccagaattggactgcacgactttactctccagcttaccacttgccagccgtgtgacacgggtgagttactcgacccctctaagcctctattttgtcatttgtaaaatggagctgataatattgtcttccttacagagaatcaaatgagataatatgcctggcatatgattgcccttgaagaggtttcactttattgaaggagaaagacaaatattttttgtaattactgtatagtgagtatggtaggtgctatgaaagaagttgttgaaattttaaacttagagtttcatgtctttttcagggtataacataagtggttaaaatagcaaggactttgaagtcagacctgagtttaaatccaaattccaccagctaaatgaccttgggcaagctgcttcactttcgctaagtctcagtttcttatgggaatagagtaggatgatgattttatatagctactaggacacagtgagccttcaataaattgtgaccgttactattattgttattcctattattagtcaagtttgatacctgggtgatgcatgtggtttgtaaatatttatattttgttttgacacagtgaaggaagacaagggaggaattggtgaaggaggttaggaaagaatttcgaggccactagaaacaactgcacatctcccagaaagagctctgcctgtgggcagatcatacttatttcttgataccttttttacctgcaagtcctcactggactcagtgggtagacaggaggctcaggactggatagaagaggctcctaagttagcaggtgcagagtgtgcagtgagtacccaggaacaaggtttgcctgctgaagaagggtactgtgccaagtctgggtgggggacagcagggagcacactttgtgtgtgtgtattcttgccttctctgctctgtagtaggcacctgtccccctgcagccagcccggtcctgcctttcattgcctgaaggaactgctactgccacctggcacactcagatccatgtcacaggggccagggaagtccaagaatcttgaagaatattagacacatttgtgattgtgatttagggtagaggtggccctcaggacatctggccccaagaagggtttattgaggttatgttcatccacctaatacaagggctccttggctagaaaatcactctgaaagaggttctgctaattataggaaaacttggtgaacgtcagagcataaacaagacactgccacaacatcttgtggttctcaatgccaggatacaatgagacatcccagagtccagccctgaaggggttttcgcatcctctgagactggaatcagaaggtgtgaatagaaatggaagcagtggcctgtttcatccccttctctcccctcccctgtcccatcttttttcctcagggctctgccgacccattctgctgtttccgtattcccttcacagcagctcccatcctctactccttcccttgtctacctctccttgaaggaggagcctttccaatacacccttccctgtgactccaaccttggtaaagtcaccaaccagctggactcctccagacagctatacacttgcagcccaaggctgggagtagaacatggctctgtgccaagctgcagctgggaagagactggcaatgaaagggactgatttgggctgggaacaaaacagcctcaaatcaagggcactggacacagcacagacaatggcatttgctaagctgccaggggctcttggcaagagccacatttctttccactttattaactcccttgaggagggataagccagggctaggatcctgagcaacacatgccctggagaaggcccgagataggttacccagagcctgtgcagccccaccctagagccttccagcctcccaggcttcctaaacccattttcccaaccagtgcccgtaggcaggactatgttccatctgagccatggctgtcatctccctagtcactcatccactaggttccctagaagtgcaggctgcaaatgtctatcccaaatcctccctaccatagcaaagtaggatctctccttggtgaacgtcagctagagctgccctggaccatgccacactggctgtaaagggctttttcctggtctggattacatagaccaggaaaaagctactgcactctagcctggatgacagaaggagaccctgtctcaaaataaaaaataaaaaataaaaaataaaaaaataaaagaaaatatggccaggcacagtggctcacccctgtaatactagcactttggaaggccaaggcgggaagcccaggagtttgaggttgcagtgagctattaccacaaactgcactccagactgggcaacagatcatgtatgtgtattgcagggaggaaaagggggatgggattgaatgttaaggttttgttttcccatggttgtgatttaggctagaggtggccctcaggacatctggcctcaagaagggtttattgagcttatgatggtccacctaatacaagggctccttggctagaaaatcactctgaaagaggttctgctaattataggaaaacagactatcccttgcctaagtattatttcttctgagtgtattctttaggaccactgttcctgttcctctgttccactgaaggagcaaggagattgccctcagagagccgagccccgcagctctgtcaggcatgagaaaatcctttctcccccttgtccttctgcttgcctgccccccaacagggcctttgcctcactaggccaaggggctgggaaacagagcttgctcacagccttcaatggctctttcaaaagaaagagccattgacatagctacttggaatgggaattgggtagaaagagaaagggagggagcttgagggaatgacattaaattgccttcaatgcagaatggagtggcattcaggtggtgttgtggctacagacttgggcatcacaaagcggcgctgagtggggatgggcatgctgcccgtgtgagatggcacaaggtgaaggagggatcagatggaggacagttgcctgaggagtgattttaagggagaaaaaaatgaaaagggtaaccagaagttgtcaactttcccaaaaaactaggaaagaggcatggggattttgattaggaagattttcctagaatggatgatttaggatacagaattttaaataagtaatcgggaaacctaagctataatcttgtcattcgtgttattcttgcaaataaaactgtgcttttaaaatcagatgtcggctaggcgcggtgtctcaggcctgtaatcccagccctttgggaggccgaggcaggcggatcacaaggtcaaaagattgagaccatcctggccaacatggtgaaaccccgtttctactaaaaatacaaaaattagctgggcgtggtggcacgtgcctgtagtcccagctactcaggaggctgaggcaggagaattgcttgaacccgggagacagaggttgcagtgagccaagatcacgccactgcactccagcctggcgacagagcaagactccgtctcaaaaaaaagaaataatgaaacgttgcttttcccccacctatccttcctctgtatataaagttagaatcatatttaaagactgcatatttagtatttagatactcagtattgaaggatggccccagaaatggatatatcaaacctagctaacattttattattattcatggaaacagacgggagcagtagccaaaacaatgcaaaagtcctttctagatcagtgccgtctaatgatgatagaaatgttctatatttgcaccatgcagtgtggtagctactagctacatgtcgctattgagcacttgaaatgtggctagtgtaactgaggaactataattttaattttatttaatttaaattaaaatgtaaataggcacgtgtagctagtggctactgtattggatagctcagttctgaatgttttggaatccattcaattttcttttccatatgggattacttttcatttgatgtggctaatagtaaaaatgagtttatattcactgattacattctgatttctggcaaaaggaaaaagcccagaagtatactggttggcaagagcaaccagactgtaattcaaaactggctgagggccaggcatggtggctcacgcctataattccagcacttaaggaggctgaggtgggcggatggcttccactcaggagatcaagaccagcctggccaacgtggcggaaaccccagacatggtgattcacgccggtaatcccagctactcaggaggctgagacaccagaatcgcttgaacccaggaggtgggggttaccgtgagctgagatcgtgccactgcactccaacctgggtgacagagcaagaccctgtctcgaggggaaaaacaaacaaaacaaacaaaaacacattggctgagggaccaagcatggtggctcacacctgtattcccagcactttgggaggctgagacggatagatcacttgagcccaggagtttgagaccagcctgggcaacatagcaaaaccccatctttaccaagaatacaaaaattagctgagcctggtagcacatgcctgtagtcccatctactcaggatgctgagttgggaggatcacttgagccctggatgtcaaggctgcagtgaatgcacaccactgcactccagcctgggcaagagagtgagaccctatctcaaaaataaaaataaggccgggcgcggtggctgacgcctgtaatcccagcactttgggaggccgaggcaggcggatcacgaggtcaggagatagagaccatcctggctaacacggtgaaaccccgtctctactaaaaatacaaaaaattagccgggcatggtggcaggcgcctgtagtcccagctactcaggaggctgagccaggagaatggcctgaacccgggaggcagaggttgcagtgagccgagatcgcgccactgcactccagcctgggtgacagagcaagactccgtctcaaaaaaataaaaataaaaataataaaaataaaataaaactggctgaggatactttccatggatacgattaagagctgacaataggccgggcatggtgactcacgcctgtaatccccgcactttgggaggctgaggcaggcagatcatgaggtcaggagtttgagactagcctggccaatgtagcgaaaccccgtctttactaaaaatacaaaaattacccgggcatggtgacatgtgcctgtagtcccagctactcgggaggctgaggcaggagaattgcttgaacccaggaggtggaggttgcagtaagccatcgcaccactgcactccagcctgtgtgacagagcgagacttcatctcaaaaaaaaaaaaaaaaaagctgacaatacatatgttatgggtaaggacaaaatgtggggcttctctctagcagagaaaaaacatgaaaatatttttaaagttgatccccttttgtatttcaatttcaaaagctaaggagtgggtttaaaccttggttagattttttttttttctgagacagtctcactctgtcgcccaggctggagtgcagtggcacaatttcagctcactgcaaactccacctcctgggttcaagcgattctcctgcctcagcctcctgagtagctgggattacaggtgtgcaccatcatgccccactaattttttgtatttttagtagacggggttttaccgtgttggccaggctggttttgaactcctgacctcaagtgatccgccctcctcggcctccaaagtgttagcattacaggcgtgagccaccatacccagcctagttagttattttttatgccctgtgagagacatttccatatgctcctaggacgaaacatagactcaataaatttttaaaatcatgtgaaatatcacagtttcattcctggagatgacttaaggcctacaatcaaagcacaaactattaggcttatttcttgttttttattgatgagttaattggcatatttgctgccgctgttctttcctgcaccagacatacctgagtagatagtgaactagcctgggagcttcttaagggtaggattcctcagtatccatcttttcagccctagcttctagcagagagtgcctggcacttaataagtgcctaacaagtcatttttgtgggtgtgtggtgtatataaggttggtgatgagcatagtctatttttgctcaatttaagaattcctggagtagatgacatttctttggggctttgaagaatacaaggaataagggtgattgtgggggtatgattttgtcccaaatttaacttattatgttctacattcctcaaaactcacctccctttttttttttttttttttttttcttttgagacggagtctcgctccgtctcccaggctggagtgcagtggcgcgatctcggctcaatgcaagctccgcctcccaggttcacgccattctcctgcctcagcctccccagtagctgggaccacaggcgcccgccaccacgcccggctaatttttttgtatttttagtagagatggggtttcaccgtgttagccaggatggtcccgatctcctgacctcgtgatccgtccgcctcggcctcccaaagtgctgtgattacaggcgtgagccactgcacccggccaaaactcacctccttttgttttctttatcccagcctcatccccactttctaaagctaaaaacacaagaaatagtccaccctttcctccctcttccctacgcttcacagccaattaactgcccaagcctaaaaacccctgacaattcttcctgagacatattttacctccatgtccatctcctctgccacagccctagttccagtcccaatcatttcttctgtagcacgttgctacagaacaacgaagtctgcttttttgagatggagtctcactctgtcgcccaggctggagtgcagtggcgtgatcaaggttcacctcaacctccacctccttggttcaagcgattctcctgcctcagcctcctgagtagctggggttacaggcgcccgccaccacacccggctaatttttctatttctttttttttttttttttcctgagacggagtcttgctctgttgcccaagctggagtgcagtgactacaatctcggctcactgcaagctctgcctcccgggttcacgccattctcctgcctcagcctcctaagtagctgggactacaggcacccgccaccatgcttggctaatttttttgtatttttagtagagacagggtttcaccttgttagccaggatggtctcaatctcctgacctcgtgatccgcccacctcagcctcccaaattgctgggattacaggtgtgagccactgcgcccggcctaatttttctatttctagtagagatgaggtttcaccatgttggccaggctggtctcgaactcctgacctcaggtgatccacctgccttgacctctcaaagtgctgggaatagagtcgtgagccactgcgcccagccacagcagcttctttttgacagggtctcactctgtcaccaaggctgaagtgcagtggctcaaacacagctcactgcagcttcgatctccggggctcaatcagtcctcccaagtagctggctctataggcacacgccactgcgcccagctaattttttttttttttttttgagacagagtctcgctctgttgcccaggccggagtgcagtggcgcaatctcggctcactgcaagctccgcctcccgggttcacgccattctcctgccgcagcctccccagttgctgggactacaggcgccagtcaccacgcccggctaatttttttgtatttttttagtagataccaggtttcaccgtgttagccaggatggtctcgatctcctgaactcgtgatccgcctgcctcggcctcccaaagtgctaggattacaggcatgagccactgctcccggctatagcggcctcttaactgagctttctgatgttggtcttcctcgactttagctcattttccacctttctctgaaataataataattttaataaaatgatgacaactggccaggcatggtggcttacacctgcaatcccagcagtttgggaggccaaggtgggcggattgcttgaccccaggaatttgagatcagcctgggcaacatagtgagaccctgtctttacaaaaaatacaaaatgtagcctggcatgttggtgcacacctgtagtcccagctacctgggatgctgaggtgggaggatctcctgagcccaggaggtggaggttgcagaaagccgagatctcaccactgtccttcagcctgggcaacagagtgagaccctgactcaaaaaaatgacagctttgccactcctatactcaccaacctcctcttgtatgggtgctgctgactctgctctttggtagtgtcccaacagccctttactctagccttgcccacctttccaggttcctgacctacccctcctatcagccacccccacttcaggcatattcacctctcaaccattctctgaacacagcttaccttttcaggcccaactcctttgtaccagccatttctgtcaatctgcctgatatgatcatccctctgcccattgcttcatggttttgtacccccatcaactcagtccaggcatcagctggtaaagccttccctgaatctccatggccgggcgcggtggctcacgcctgtaatcccagcactttgggaggccgagacgggcggatcatgaggtcaggagatcaagaccatcctggctaacatggtgaagccccgtctctactaaaaatacaaaaaaaattagccgggcgtggtggcgggcgcctgtagtcccagctactcaggaggatgaggcaggagaatggcatgaacctgggaggcggaggttgcagtgagccgaggtctcgccactacactccagcctgggtgacagagcgagagactctgtctcaaaaaataaaattaaaaaataaataaataaattaattaattaattaattaaaaaagcctcccctgaatctcccagctctaggtgcccagagcacttagacaggcttctcatttctctgacaagtcccgcacaggtttatttacttctctgactcttctactaagtggtaagctccttgggagcaacaactgagtcccatcagctctggatcctcaaaacctggcatgcagtgcctatgaaaatgttctttaaaatgttcttggaggggccaggcacggtggctcacgcttgtaatcccagcactttgggaggccgaggtagacagatcacttgaggtcaggagttcgagaccagcctggccaacatggtgaaatcctgtctttactaagaatacaaaaattagccgggcatggtggcgggcacctgtaatcccagctactctggaggctgagacaggagaatcacttgaacctgggaggcagaggttgcagtgagccgagatcacgccactgcactccagcctgggcgacaagagcgagcctctgtctcaaaaaaaaagttattggaggactagaggttttttcaagctcaaaatggagcctagcatcacatttaaagatggagaaacaaagatcagggtgctggggaggaagctgacttggctggagaagatacactggagtgcacattggggtgggcagagcaggtgtggatattcaccctgtgaaatgcagggacaggttcagggacttgcccaaggacatgtggtgagtaagtggcaaggttaagattcaaacccagttctcctacctcccactgtacagtcttcagaactttttaaaggataagaaccaaatgagaggatgcacttctatagtgcgcactatgtgctgggcaccattgcagtttacaaattttaacttatttaatccttctgataatgctatgtggtaggtacaacctttcacccacattttataggtgaggaaactgaagtacagagatgttgagtaacttgtccaaggtcacagataagaaatagcaactgggcatggtggcttatgcctgtaatcccagcattttgggaggctgaggcgggaggatcacttgagaccaggaattcaagaccagcctgggctacacagtgagactctgtgtatagaaaaaagaaaaattagccagatgtggtggcacacacctgtagtcctagctactcaggaggctgaggtgggaggattgctagagtccaggagatggaggctgcagtgagccaagatcacgtcactgaattccaatctgggcaacagagtgagaacctgtctcaaaaaaaaagagaaatagtcaggatttgaatccaggctaatctggctccagaggtcatgctcataaatccaaggctatgtgggctctccatgcaaattatttaatatcagaattatggttataatgtttcctttctccctccttgttaaataaaatcataacacctttccaggggatgagcatctttccaaaaaacttatcatccctgcacttgtcctcccccagactcttcccactgctctgcacactttttgtgctctgccctgcaccctctgccaggattctcacctgccattttttcctcacagaagtgcatcagcagaggggagctccaggtgtctctgtcatatcagcctgtggcacagagaatgacagtggtggtcctcaaagccagacacttgccgaagatggatatcaccggtctctcaggtagcagctatttacttcaacctatttcttactgtctgaaccatccccgactccttgcctgtggcccagatagacctccacacttcaagatccttgcctctttcacttttaatctgctcctctttctgtagacattctcttcctgatgagtatctacgtccaatagatttccctggctaggaagattcttcagttgaacaaatggggtctttacatttggcaaggtatcctaaataatattcatgccaggtgctaagagagacttctcaaaaaggctgcaggcatttgtctctgtgccctttaatatacttcttggtatcatgggatttcttcagacctaacctgagaaagttgttctgttctattcctgcttggtttccttggcccctcatccaggcaggcagactcacatatagtcagtgtgtgtttattgtgcaatcactaaagaacacatgggatggccatcaaagatacgaacaacagagccccccctttcccaacatgaaattaccattacataggagaggactgtgtcataggtctgtctccctttttcttatctctttgggggccccagatccttatgtcaaggtgaacgtctactacggcagaaagcgcattgccaagaagaaaacccatgtgaagaagtgcactttgaaccccatcttcaatgaatctttcatctacgacatccccactgacctcctgcctgatatcagcatcgagttcctcgttatcgacttcgatcgcaccaccaagaatgaggtggtggggaggctgatcctgggggcacacagtgtcacagccagtggtgctgaacactggagagaggtctgcgagagcccccgcaagcctgtggccaagtggcacagtctgagcgagtactaatcctgttcttctctcctctaatccccgggggccaagctggggagggatgtggaggggaaaaagatgacagagaagtggactccaaacctcattttagttgtagaagaaaatttcttacaaaacaaattccacaaagaacaccctatatgaccacagctgcagatcagttcttagcaatgatgtttttttttctgctttgcaaggcgctagaatcttttattttactttattttttttgaggtggagtttcgctcttgttgcccgggctggagtgcaatggtgagatctcaactcactgcaacctctgccctccaggttcaagtgattctcctccctcagcctcccaagtagctgggattacaggcacccacgagcatgcccggctaattttttgtattttcagtagagatgggtttcaccatgttggccaggctggtctcgaattccagacctcaggtgatccacccgcctcggcctcccaaagtgctgggattacaggtgcgagccaccgtgcccggcctctggttttgttttgttttttttttttaatgggggacaaaagagagggaaagacccctataaatctatatataacaatgtaaccatatacttgcatgtctaatacaaactgaagaaattagcctaactgccaatatcaagttgcagattttaatccatggaaattgtgttttgtgctgaattgtatttgctgattacctgaaattggcttctttttattgggcttctctggagaatttctcccactccccacctctgcagaagaaaattttgctcttataaaacctcatgttttcatcattcccatcttttctttttattgcctcttatatctctgctctttgacctcaaggtctagaggtctgcagtaagccaagaaacaaaggtggggtggatgaggcaaggtttgcaggagaaagaggaattgagaaatggggtatttttgctatcagctcttctgctatgaagtagtaaaaggcagtctataattaactgacagacctaactgaagcacagagaatacatcagacttatgcatccaagacatcagaacttggattttatcaaacttgatgacttctctaaaaggagctttggaaacttcaaattcagctataggatagtaccaatgaacacatccagctgatcccaaaagctgttttcaggtataaggacaaggagaggagacaagtgacgacagccattcccctttgcagctatctactgtagtgacagccatttcttggttgatgggttggaagtcatcagaggtttgaagaattacactggcctttgtttttctggaaatgccgaccatggagatgctttagagtcttctcaaatagcttagatgttgtaatgaggttagctttgcttcataaaacaggggccctcagaagttctccttaaatttttcaataaaaatttagctcttaaaaaaataacagtgtgactgagtgaatgaagataagttggattctttcagagcattcttttcctcaaaacgagctgcataattcttggaatttatgtcttaccacatggtggagggatggaggaactacaggatgcaattcttcttctaccaatgggcaatagaggttgagagagattcagcatctttctgggattagaattcaagtctctttactcctacagcagctgtgtctccaacgttgagactttgcagatggcacagactccatggataataggtaaacttggggccgggcgcagtggctcacgcctgtaatcccagtattttgggaggccgaggtggaaagatcgcttgagcccaggagttcaagaccagcctgggctacatgacgaaactccatctctatcaaaaatacaaaaaattaactaggtgtggtgctgcacgcctgtggtcccagctattcaggaggctgaggtgggaggatcatttgagcccagaggtagaggctgcagtgagccatgatcatgccactgcactctgggctgggtaacagagtgagatcctgtctcaaaaattaattaattaattaattaaaataaactaggtaaacttggataggcagtagatatttttgcccacctgaggaggaactcagtcaagctgttgcttaacagcttgatccagggcgtgaaaggttagttgagactgaagtgttcacttccatagaagaacatcacttttaaccttgctttggcgaagggagtcggaaagctgagtctctatggacgggggggtgatcttgctttcagtgttccctcagcttttgtggatttaaaaccattctgctccccctaaaccttttgtttgatttcagcccatgttcttgacaatgcagagcaattctgagcagtcacaaagcctactctctgttcttgtccctgccaacccccaccccccataatctgactcacaacttcaccatcagttggggtcataccactagtctctgtcctataccccatgaaatgtaaatactgtatcataagtagaagaaaataatttttgttttctaaaaatgcattttgagatagtttaatgtaaatctgacaggagcattctgaagccccattaggaaaaaatttaaatggttcctcttcatcgccttaatgtctaaagatcagaaatcgctgagcaaacccgcttttgtttccttcccagaaacaatgcaaaacaacaggtggagatagtctggtctttgccctgctgtgtgtgcctctgtagctcctcctgacaaacgtctgggaaaacagcctcaccccactctcctctctcttccccatttccttgtagctttattccttgcatctttgggtctactgagcagtgggtgctgaggtgacaggggaggaaccagttgttctgtagcctaggaactgcctcagtgtctttgccagaaaaaggcaaagaggcggacagtgcagggctcctccctcctacctcaggcctgatccatcgtgcccttgactttgccgtctcaaagtttcttagctgactttggctttcacatttgttctttccagagctaactgataagagtggaggaggaatgccttctcctaagagtcagttgaaagaaagacaagagagtcacatcttagcttttgcacaaggcattcgtggtcaggaataggttagggaatggtcacttctgattttccaacagttgctccttctctgaagagatcttgattcctttgggaagacaagaatttttcttaataacaaaggtccctttatgagttattccttctttcagttcatctcactggagcacagccaagatggacatgtttatggacagtgctctagatgtgaaaacagatagaactggtttgtgggacaggggcagcttgctcaggagagggaataacgcaggtcccttttcttggaaggcttgtactatggccatgacagtgacattgccctcaccatgatccctctccaaagtggttgtctttctttaccttgtgtcttctcttgtaaaaatgaaactcaaaaataaaataaatgtgtcaaattttg

SEQ ID NO: 37168 - DNA, 25538 bp, Homo sapiens; identical to SEQ ID NO: 37167

SEQ ID NO: 37169 - DNA, 183704 bp, Homo sapiens
aaactggggggtttctcttcaaagccagctggtctggctttattctgcaggaatttttttacctgtcagggtttggacaacaaagccctcagcaggtgctgacgggtacaacttcctggagaagcagaaaggcactggtgagtttcaattgccaaaatatattttttaatctctaaaagttaattttgttgtcttgaaagaggcaccactgaggtacctgtgttcacaaagttgatgagaccattggaatcagagccaactcactcaacagtgggtttgccttgtgtgaaagtaaagctgttaccatataacaattttttaggttttttttttaggtttaaaacaagattctatttttaaatattggtctctttcattactgttttcaatatttggaagatgaagagttaattacatttataatattacacgatttaacacacattttagtctcctttttatctaattctgtcataatcttttctgaataaaaagttattttctaataaatctcccaaataaaaaggtgtaatggtacatactattttcaaaaattacatgtactgggttttttaaaatgtgtgcatgctacaagaacatgattagagagaacatgcaattaactttattttaatacatttttaaagcatacattgcatgtataattaaataatttaaaatatattgcatgtttaataattaaataaaagtaaattgtattgtagtaaatattatttaataattaaaagtggcaatattttctcattactttacaaagagcgtcttttgagaaaaatctttgaaattaacaaccaagacggtattaaagcatgtttttacatcactgatttccaaaattcgtatatttatatattttttatttttattttgttaattcaaaagtttaggcaaaaatatttttttcagaataggactttaattaatgcaaaacatgaaaaaatgagaccacatgttaggacatatttttaaaaagtgactctatttcagggattcattcttttaactatgcttcacagcatttctctacaaattgttgtattatagtaaattgaaaacatttatttaagcaagtaagcagctcaaagctagagcctatacgtagtaaacatatgaaaccattttaataaccaaattccatattcacaagcaacatgggctaatgaatttaaaagaaacaacagtatacattgatgaagaatgctataaattattatggataaaatcaattttctgggctgtggggggtagaattggtgcttaagaaagaaaagactcctaccaatataaattactaatactatgaggcaattgttttattctgatgatcccataaataactttaaatctacatccttaacacatgattgtatagtggaaaaaaaataaggtctgacttttttaatgaccactgtacctgaaatgatttttaaatcagtgacgacatggatatgccacaaatgtataactaacatactcttttaaactgttgtaattgctgttgaaaattatgaaacatttgtggtttaaaaaattatcagaaatactccacccaaacaaaatagctaatattttaaaaacataacgttacccacaaacattttaatgaacccctattttaaaacattaaaacccaaatatactttttattataaattgttacatatatatttcaaatgattaaaacatttaaaaatatatgtgtatttattgcgatttcaagctgctactttcatatatattttgtcatgcttcattatgtttcattatattgattcagacacctgagtaactatagtcgctaaatttttagaataacttcattagtctcttaaagaattagtatgtatttcatgcacttgaaaattttacttttatttttctagtctgttaaatactatattcctaaacaatcacaatatttacttttaaagatgatagttactgcaaaactgaacaacatgtgttcttatgtcaacttcagaattgtatttgttaagttttcacatgcattaccattggctataattattacattgtcattaagtataagcaaaccaaaagcttctgccaaactattgtttatgactctgtcaattatttaagtataaatgaagctactggaaataatattaaatatagctcaaatatttcaaaataactaaaatttatcattttagctgtgcctgaattgtagacttaatctaaaatcccattttttaaaattttcattatgagaggctgtaaattcttgtccaccatgcagctatgtttgtcctttctaataaatcttcaacattgtgtcacaaaaaaacctatgccaactccctcaatgtatgggaatggtttattttaataaaatattggagtttaaagtagcattgatttacacctgctctaaatatttaacattaaaacatatgcattttaaacattatttgcaagttatcttcctatcttacagatagcttatttacagtggagaaaaattgttttcctgtttcagaaagacacttggaaaaacatgttatttaaccttatatattaatagggaaaatcttgattctcccagtagttaacttcaattaattatattttaaatatcagcctatttaatttcagtgcaacaaaatttccagctaaaatggtttacttgtaagtatttaaagcaacaaaaatattttggcagctttatatgtatctcctcattgaccagccacctgactgacagctgtcaactgtccatgtgccaaatgtaacccagtaaagataaaaattacatattactcatccctgttgataatacctggtgccagtaggttttcaaataggaataactagactatagataaaaaacaagtaagtggggaatcatttctactgcctaccattcctcctttgtcattaactcatttccctttctttttcttattgatcccttttcccttgctgtccatatctatagagttattttccttaaaggaactttcagaatatgttacaagtctgtgtccatgaaaatactgggcagccaggtaatgatgcccacacatttcttttagtcatattttcttttgagctcataaactatttcggagttatgggaagaaagctttaaagctttcagcttctcattttcaaagaaaatgaaatcaaagaacaaaaatgaaatttaccaaaggtcaccaaggtggtgacctttatgtagatacagacttgggtctgtttcccaacttaatatccagggattttttttctaattagactttaagcatgttgactagtaaactataagtaacaatgatcacatggaaaattaatgtgaattatattcctttgaagaacccttttcagtcaccaaatttaataccttgttagagaaatacacatttttatcacagcatattaaaatgtagttctaaaaaatacaaagactataaatgtactaaaacatctatggtacaaaagttttttatttgtcttaccatttaaatggatttccaaactggaaatatttatgaatgtatatgaaatagcagaaataaaaaaattatcaaaggtaatacatatatttagaagataaatgtagaaatcaaaaatataagttggaatatagggttttttttaagattgggagtaattaaaaatacaaaatatactaacacataagtatatgtatatatcaagtgcataatacattatatagttcatataactgacttaacaactgactagcttatgtgtgtgtatatataactatcttatattaattccaaaattattaattatattagtaaatatggtctatttatataatttgttgataatatttgtgcaatatattgatctggtcaaggtcatgaaaatattaatattcaagccaaatatttgtcttctggatctccagaaaagaaactgtttagttgaaatctaccacattctgaatttataagaatttattttagtcctgggctttggaacagtacttgcttataagaagtattagctttaaaacccagacatgtaaattaataagaaaaagagatggggtaaagcttaaaatattgagaaaaaatatggagggaaattgtggctagggttcccctgcaagggattgatctaaaataatcaacatttttatgactaacaacaccatttagcaactaaattgtatatctaaatttgaaaatatatttgcttattccattacatttagtccaaatcaacattagtcattaatcaacaaaccatttaacaatatgtaataacagtatgcaaatcaattgcaagcaaaatagtaaatagcatccatttctagcaatttgaaagataggcaagtttaatcattgccctgcatcccaaaggggttttagtgaaaataagtgacttgtccggtatctgcttttgaaggatcatagaggcttcctcattagagttaaagagtgttcttcaaagagcaccagagcagaagtaggaagatttgagttagactctctgtttcactgcaaagtcattttgtgactggaaacaagtcacttaacctctgtgaggctaatgaatggatgggcctttttggccattttgtacaaatcataggaaagtaagttttagttatccaatgaaagatatttcctctgtttcatgtgaggaagtctcaaaaggaatctggaatattattggtgggttcctgtctgcaatgactgggccccaccctatccctattgctataagtagcccaccatgtaagcattccaagtaattaaaactgacacactatctagcctgtgaagtcagtggggaaaacaaaatcactttgcaatatactccagagcagcaggccttattttttccacttggggaccctagtaacataatacaaaaagtctcattctcaaaattatgttatgacacgaagctttgaacttttcagtatgcactataaggctgaattgacaaaaaagtactgaatggtcatttaatatttttaattttatagaatgacaggaaaatttttaaacttagaaagatattctccacacacaatgctgtaagccagcatgataatatatttatttatgtcaggaaaatgttggaacaagaaacagtgttaaaaatatctgaatcctagtacaatatgtctgctacatataggtatttaggttatgtatgatgaataaatggaatgaaagaatggataaatacagctggggagttcaatatttttaaggaaaacttgtaaactaaagcaatacttttgcaatagtaataatcatttattattgctatttttatgttcatgaggacagaattaaaacatgattaatgtattttttaaaaaatcttaatacaaaagaggttaaagacctaagatatggatcactctgttgacaaggttggcaaagatgtgcaggccctttatgactgcttggcagatggaggtgattactgaggtcacaaggaacatctgcattgattgaaaatctctttacagagaagccacattcctcaagtgactatgaccagtgccagtcctattttcctggagtctaggctcacagcaggtggcagtcactgaaggatgaaaatgtttgggagtcacttatcaccaatggtagaggtccctggatctgaagcccattttacaggttttgcagaggtatcaggacccaatgaaccgattccatccaagaaaagataatggctatccctcaattaagtaaagatgaagaattgtacagaaatttgagataattaggtttccatattgcttaactggttttctaatttcaacaggcagaatatttgtggcatgtctttttttcttgtttacaattttgaatcaagattcatcttactatcttgaaaggttctcatgactttaaaagttccacaaaatttgtgaacattagtggagagaacaggagtgaataacaaacggagagaaaaaaaaattatggcattagagggacctgtggatcttatgcttcccctcaccttaagagagtagcatgcaaataagtgctatggaagaaccacctgaggagcctgttataatgcagattcctgagattgcagctaagtgggcctgaggtggggcccatgaatctggattttaacatgcacctgggtgattctgaggcactttggttctttgagctagactgttaacatcctcacaaggagccctcttttgtgaagaggatcagttctcctgctctacagtaacaggaaaactaacatttagtgatcccaagtcccaaaagatgaaagggagcatatgcacacaagtatagactttaccttttaaaatgtattgtctgctataattaaacactactgtgttgagtagttcatttattttaattatcttatgtagactggaaaataagtgtcatcaaatactagtgaaaagccagaaaaaaaatcattcttaagtttttcttaagtttaagatgctaaataatacagcttgaaatgtgataaaacggcttgagcgaactcttcaggacagtcattcaaacaatacagacagtgcttattatggaacgtatgagagtgtagagcatacacattcaccaagttttagaatgctcagttaatcatcactgacctgtggagtttaagagcttatagcccactgataatgtgagagaaaccataggctttattctcctgtgggtgagtttattttgcggccgtaggctacacagactagaatctcacggctacgtaaggatgagatgagactgtgtggatgcatgaacataaatccttcacaaatactatataaccaacacaagcacagaccttattcattgtaagttaatcatcattgcaatcatagagtaattacagtgattaataacaaaaaataatcatagaagttattctatgaccatattatctataacatgcatcatcaattgtttagaaataagctcctttagtgaaggtattttattttgaagtgattctgataaatcaaaaaagaataataccctatggttctgaaacagaaaatgtaattttccaacgcaaaggaaaaatcctgttaataaccagttgtgcgtgtgtgtgtgtgtgtgtgtgtagctttactgagttcacaactgatactaaagaatttacaacttgaaaatgaaaagaggaagcagaaaagatgaaggaaggaaggaaagaatgaatgaatgacagatggaaggaagaaaggaagttaaatggaatagttgggaggaaatctgttggctagctatttagcctttgctaaaggggtcaaaaggaataagaaagttgtagaatgtttcttactttagtagtgttcaaaatcttttacttagaatcttatttcttccttttgaatcttgagtgatgatttttaatataaaattgcattccatttgatatggatactctttatttaaagatttaagactacactaagttgggaaatatttgtttatgtaccctgtctttgcacataggaagatgctttatctgtgatttaatagaggagatagaaggcagaatgaaatttgccctctgtccctaaacctctccccaaccgtttcaaattctctctttcatccaacaagtggtacatattctcttcaaagagttcttaaaccctgttcaagacatttctggataaataatcactaattacacctctggtggctttggtggggcagaagggagagcacacagggtaagtctgagtgacaacatagtcactatggtacaagggacacgcagtggctgcctgcctcatattgcaaagagggaatagaaaaagagaccaggggaacaggtaatgcaatgtacaattttttaagtatataaattttcaaggagtatcttaatattttgctgatagagagttcatcttccaatcccaacattttcaaaaacaaaattgcttcctcaagtaagggccaggtttcccatttgcttgcatccaaggcttagatctgtgtggacaaatgaagtggctgctggtgggagggacctgagacatactgaaagtgctccctaaaacaccacctgaccaacacagcagggtatctgtggaagcatggatactcctttggattatgaattcttttcagaaaacttttgaagagaggttcatttaaagtgattgcacaatgataccgtgtcatggattaggcggctgtagtggccggctcctctgatagaacatagttggaaagaattccgcggacataaaggggcggctgagggatgaaaggactttgtaggtcgcatcagtggaaggcccagaggagaaagaagcactcgtgaaagagctattactgattgtaaaaattgctgctgggtgagtggagcatgccaaagtgaaagcagggcctgctgaaggtgagtatagggaagagagtgatgtaaagacaaactttcacaacatcacaactgcgcatatgctacacagataagagccctgttttaagaggagttcactgggatctaataggaagccactaattcaacatatttatgctcagttcccttaaatttaagattatataatgaataaacaatttagaagatgtctgaggtaactaaaaaataaaatcttggagcatcattctgggcaaatgggtatgtcattactttcataagtctgatgaaatccaataagaataccccaaaaaagtttatctaaagacaatattatatagaacactgacaaggataatatagttagcagtccaacatgtaagacttcttgatataatacatattaactgaataaacatacgaccataaatgtttatatttactttatatatcaaatactttacataaaataactgtttggaagcatgaaactgacagaaaagaaaacatcttttaaaatatcattacataactacaacattgagatgttttccaggaatatggggtatttcttgaaagtgaaatggtatataatagctaacatttattgagaattttctatatgcgaggcactaagtggccacagaagtacaatttcatgtgcttctctcggcaaaatcattatcatgggtagttcctgccaccttccccattttacaaaaagggcatttagaaaattaaggtcaaaacaattatttagtgtctaaacgtggattctgctccagagtttcctagttaccctccgctgcccattttatactctttgaaaagaacatttcccatgctgtttatacatgatctataactattaatttagtgaaaatgacttttttaaaaaaataccagaccttttacgagtgttacttgtcaaaactgtctccttaaaggttataaaatcatatcaaaaatactttgaaattcctcttttatatcttcaattagtgtcaatttatgagacaaatatcaaataatctaatgctttatactcaaatcttagttttcatcctgtttactacatttggcttggatttacttttggaaaaaattcatccttaatgataaggatttgccaacaatcaggccagttttaagactgtgtagcaaatccctgaggagatttctaaatagacttgagcaaagacaacattactgaaataaatgaatagtcttctaaagtgtctaccttaaagaggatgacatgcctttagatatgtatttctgaaatattttctggtgggacaaaaatatctattatattatcactataagtgaacaaacgttatgaatacaaggaagcagtatagcatcatagctaagggtagagtattggaaacaaacacattggttttatgtcgtttggcacttaggaactatgtggccctgggcaggtcatgtcagcactcacagctttagtgtgtaaaatcttaaaatggggacaataatagtacatgtctaaaaggttgttctttgaataaaaggaaacaaaagtttataaagcaattaatacagagcctgacaaatagtatgtggccattaaatgttaggtacttcaaatattcatttcaacccacattctaataagatagtattatttttgcatatatactccagatatcattgtattatgactaagaacattactgatttaaaagatttaactacacatttagtataaatgaataaataagtaatagtccgtaggaaatctggccttttgtttgagtctttgactcaatcagtactttggtgaaacaaactggttttaatcactcacttaaatttaaaagttttattgagttttacttttaattctcaccatattacaaaataatttagaaactcctcccagtgaaaattctgtttcttcctaagaaattagaatattgatataattatgtgcctccttgttccacaatttctataaaattacgtattgaaagcatatagatctatgcatgatcttaccttcttgaaaacataacattttctattatattgcttggtttaaaatttaggattataaataaaatattttataaataattttgtaagatccagataagtagaacatagtcatttaaaaaattacctagaaatggcttggtacagtagctcaagcctgtaatcccagcactttgggaggccaaagtgggcggattacctcaggtcaggagttcaagaccaacctggccaacatgttgaaaccccatctctatgggaggcagaggttgcagtgagccaagatcacaccactgcactccagcctgggcaacagagcaagactccataaaaaaaaaaaagaaaagaaagaaaaagaaaaatacctagaaagatagaataatgtacattttgccatgcggtagctcttttccttcttttctaaactcttctgtcttaacttggggtcttcacttaataactagtgttagcgtgaatatcagatataaaatttttattgacattctctaagtctgtttttttctgtaatacatacttaatcataaaatcagtataaatcataaacatctcaggtgggactttattagaaccaaaaatgcaaaatgactatgcttctgtttttcaagaaatggtacagtcccctaacacagctgtagtgttgatcatatgtctaacagaactacttctaggtcctcttgaacagaacgctccattaggcattctgtgggctaccccttcccagcaggcttttgcccaacccagttgccatagacggccatcagacacttggaatgacatcaggagacaatctgagcggactctgacctaaagaattcaagctagggggagactgaagatatcaatgtcatcttggctgacaatagcattccaaaggtcaaccagggtgaaaagaggatagactctgagttttcagtgccttttcagcaaccaagtggctaacaagtataataaagcatccccccaaaaaagaaaaaatatcctagaggcatgatgtcagtgaaagggaaataaggcaacctgtacacttaagtcatggtattttaaaacattttacctcttccaaggtaaatctcatcctgaaccaattcccacctctcggatgacctacttctttctgctgtgataaccccagtataggtgaataaagaacttaatggtatagaagtggaaattctttgcattagattaagaatggctaatttttaccgcagtttgtcacttttccagccctgtgctttatgctgaatagctcatttaatccttaaacaaagttttgaggatagcacattttgttccacattttacaaatgaggaaactgaggcaaagggagatttaaaccatatgcataatcaaacagttaccatgtgatacagccaattggctgttggccacacagcttcttccaagtcagaccagccttctcggttgtcagccatggagaaggtgaggccttcttccatgtctacaagcacctgaagaagtgaaacattttctctaaggatactggattttagggagaatgggaagaatgctgaaccacacgcaaatggtaaattaagaagagcaataaagacaataattcaaataaaaatgtaaatctacacttttaaaataatttattgttattaatttaaaattatttaatattcataagtactcttatttggacacttcggggatccttaactaagtgttaagttaaaaggtaactactataaaagagcagaattaataccaacagttcactcctaattaacaataagatatatagaatacaaacatggcattaaaaacaaaacaaacccaaaagacagaacaaaacaaaacaataaaactaataagaaagcttatgctttgtctaaatctttatgatgtattctgttgccttatatgtttcagatagtgtaatttgtaataatgttttgtttgggccgggtgcagtggttcacgcctgtaatcccagtactttgggtggccgagacaggcagatcacgaggtcaggagatcgagaccatcctggctaacatggtgaaaccccgtctctactaaaaatacaaaaaaagaaaatattagctgggcgtggtggtggacgcctgtagtcccagctactcgggaggctgaggcaggagaatggcatgaacccaggaggtggagctttcagtgagccgagccaagatcgcaccactgcactcaagcctgggcgacagagcgagactgcgtctcaaaaaaaaaaaaaaaaaaaaaaggttggttggttattaacatttctgagccaattccatcctagttatatcataatcaatgtctccgatatctttatcaaatttgagaaagattatgctttgctaaaaattttcactttaggtgacacctttcctccctgaccttaagaatgctttttagctctttaagaggataatcccatttcctcagaatttttaaagtagaatgaagcacagtgttatcccaattagcctcttagaaaaggcattatatgaatctatgacactaccaataatacatttttagtttgggagatagtattattccccatgctcctcattctttgttaaatggaatttcttcctggaggaatacttagcagtattttttcttgtaaaagggtactcttgcctaaaattttcagtcaagttgactttctgtaagatgaatttgcctagaaagatgtccttgtctggcacaaagtatactggaccctgttaggggaccttatcttctttccaaatttatgacataactttgggggcatcacttaacttctctgggcctgatttctcttgcctataaaaaaattaggtgtctgggtgaagtgttccccaaggtctctttcagcaggaagatactgaaagtctgactttaaagcttctcacactagtgccaagtaacagaaactccaagagtgtcctaaaatgtggctggtatcagtcataaagtaatttctttctttctttctttttttaaccagcattcattttgaactctatagcagtattctccagcagaactttatgcagtgatggaaacgtttgacatgtcgctgtccagtaagggagccactagccacatgtggctattgagcacttgaaatatggccagtggaactgagggacagaatttatttttattttatcttattttaattaatttaaatagctaccatcttggtagccgctaaatgtttcaagaacatgataacataaacgtttttacaccttcgatgtaattgagtattccacaatgccagacaggtcaaagaacagcacagatatctgcatttagtgacagcatttttgtaagacatcccagaaccgttcccctgtgttaacaaataaagggggtacaaggggaaaggaagttttctgttttgtctttaaagtgtgtgttttatcctgaataccctacttcttgctttactttgtggctttttcctagccaaaactcgcacacgcgttagcttaatagagctatgagttggcttttgttttttgaaatataattccttagatgctgagagctcagactataaaatccagtttggggcccgtgttctttcctattggtctgtcaggtgaaaaactccggctggccagagtgggacaggggcggcggctagacctgcagagcccctcttgctctcccaggtttgcaaaatggttggagcgcttcgggcagcctgcgtcaccagacgtggaccgtgtgccagcgctttgtgcactgttaaagggtgggttcattttacttggcccctggtattttcgtgggtcgctctgagcccatcccgagctcttttggatcgcatttctccagcccaggatcccaaaaccagaccagcaggacaactaccccggcactgccaccgcccgtttccacagtccacccacagccgttgcgccctcctccattccccagagcccatcacgcaccctctttaccaacaaaccaccggacgcttttcccccagccgtgacttccacaacccccaactaaatacaagtcggcacacccccttccttccccgcgccaaaccagcgtggccgcccactcgtcgcacccaggtccagcaggtccagcaggtccccaggagggcccagagcctgcctcctgctcgcccgtggcgcacgcacgtggcgcactcaccccctaccagcagcctccgagctctagaaacactccaaggaaggaacccccgccccttcagctccgtcggccgggagaaaaggggggggggaaggggggggaagcagagacgggcagagagaagagtatataggtgatgagagcagtgttggaggggaggatcggcaataattggatggcgttgcagctgttgcgcctctgctgaacgcccagccagagcggattcacttttcacacaaatcaaccggagggattgttgctgcctgcaatcaataactcagcggagtgagttgctcaaactagaggcgtccctcgtctgggtctttgagggccgtccggattgagtcccagcgctctgctttccaaacaaagaagtgggcaccaaaacgcaggacgagatttttaatccccacttccaccacaaccccgggtaaagattttttaaaatgaaaaagcacacacatagtaaggtatctagaagaaacagttaaaaggggaagtgtgaaaatccattccttgaattgaaggtttctgtgatatttcaagaaatgggatagaatcaatgttctgatgaacaacatttaacaattttgtaagtaaaggtaaagtcgcattaaatttattcatgcatgtggttatttttgaatcagccacacacttgcaagcaaattactgatcaagccttatttggacatactgattacaggaaaagaaagaaatgtatcataatttgtagtgtcgtttaaaaaaaaaaaaaaaaccttaccatacctttcagatgttatttcatgaagattgcatttctataaggtgaataggccctgggagatgtgtattatgattctcacttaatagactgtaaaatgaagcacaactggaagaaagagaactcaccaaatcacttggtagtgactacaagaccaagtttggactcactcactgtgggcctaagcctaaaaacctaaactcaactaacacccataaagtaaaactggccaaaatttttcatttctctttgactctgaagcaacttaaaaataaacctcagagatgtcaacccaaatatagaggctttataaatgattcttcactatgcaaagtcctcctgctattacaaatgggaaaagagatattgaccatcctggtctgatgtgtctcaaggctggttctctttctgggactagcctcagtctgaagccaaggaaaggttcatttgtgtgcacaaagtcatggaaagccagactaaaacagaaatcagaacacaggagcatttgtctgtgctcagtatagttaaacactgcttggaaaaataaggtattattggtaatagaatttataaaccgtactgaatacacatcactaatcccaaagtattttaaattggcctttaggcaatgcataaaataagccctttcagtaacctcaactgcattgcaaacatttcccgatttgacaaattgtgttagcttcggatataatggatttgacattcttctgtaattctctatcagatataaaactgaaggtacagaaatacagataaacatagaatccttagatatgtgtaaaccttgtcttgaaataacaaatcctttgtatattgcaaattctcaatcacagacattccacatgctgtatattcttcttgggttaatgctgcacctagtgaatttttgaaatttagatatttggcactatttatgttaaagattattatcacaatgcatgacaatttcagttgtcttatattcaaaacactttggtttaaaatcagaatattgttacttcagattagaagttttagaaataaatctatttgaaagtattttcatatcagcattaacaaaatactatatactgttttgcacttccacatttgaaggtgccaaagaagagttgcaaactgtgaagtaacttctatgaagagatgaagtaaagaacggaaggcaaatgattgtggcagtaaagaagtgtatgtggtgagtgctcacatttgtttttatcatttaccacagagttaccataaaggtaaaactgccaaactccttggccttaggtatttacagaatagacgtgtataacaataataaagagttaaatgaccaccatacactttatattataagcaatgacatatcattttgcttaaagatcatgtcatctttcagggcctacttttgcaagtactgtatcttataaaattaatctatttcatgggaagtcctgtgtatcatcaatactataattagacaaagattaaaatatgtaatgctattggaatttgtgtttcactgctttttagatttttctaaaccaccatgttcacttatcatgtttgtgttaaaagtattctggctgaggaacaaatactatacagttgaataatcttaaggggtacattaatctatagcctttcttcatctcagggtgggttgctgtggcaaccgccccagttcactttaaaataatttttaaagctcacttcaagagctacacccagcgtgggccaggcttaaaagcaggcagacccagtgcacagggctttagtggaccgctgctttaatgtagggaagtagtgaagagaggaggttggagtaagatggtatgcagctctgaacagaaattgcaatattagctttccctggagttaaaatcccgaggagcatgctctctgtaacttctatgacactttaattaaatatattgctaaacataattcttttgagggaaaaacaagtgactctatatttacattaacaataaagcatttacaacttaatgtaggagaaatatttggtgattagaaaaaaataaaagctggtacagtagtacatcaatcccagacataattttcttttaaaggaattgtcacctattatttaactggatagaccctaccttccaattggtttaaagggtagaaacattttctgttttccaatgatagaactggaataggttacagaactcatttaacacataagcgaactgaagcctagaaaggacaaatcccttagtaaggcacaaattttgaactagatagagaatccaggtctcctgacacctagtacaagctcctccctacatgagaaaatagtctgatcctaaccaagtatcattagatggcaaggatcaggatgattttaaagaaaaaacaaaaacagaaacagaaaccaaaagtccagaagtatttaaagaatacaaagcacactctggattaactactttgtggattactcatgaataattttaaatctcaggtgattttctaatgtatatttcttcatatctcttctgcttcaactgtaaaggctcatgggaagaaaactaatggtaatattaacttaggtcacacataattaagaagctaaatctgctgaggggaaaatcctgtattttaaaaggccaactgtgatacattccagatccaaattattttcaaattatccagtgtggggttatacttatttttgaatgcttgcagtatcattaataattatgggtttgttataatgggtattattaaataattatttaaaatatgaaaaggtaaaataaaataatttctttttgaaagaacatctaaaactgaagtgtactgtggtaaacagaaataccctctataattcattaaaaacagcagggctgaaattcatgtattggctatgtgtttgctcatgtcaaatagactgttgtaactcactgcattaattttaggtattatggcaataaacttagatggtccttcaaatgctttgctttttcaggaccttcgtgaatcttgaagaaaattaattttatttttaccaccatatatagacatatcttagtattcgaaatatctttgccctttaaatttttggattttcagagaagttgtactttgaatggaaacctgatacagatgttctctgccatattattaaaatgaattcatggtaatggcaaactcaacatttgaaaaaccggcaaacaaaatacattgtaaatactaatctgcaagaaatactactatttcagatggtttttgctttgtgacagtttgtgatgcattcctataataaaagggagggaatggtcttagttttgctgatagtcacaatgatgagctggaacttgaagattgttcagatctagttgtacttgcctataaaataaaccttcccctttcaagtgaagccttgggacagttgcctaaatgttgaggccactcttctgagagaagctactcacatcaaatacctcctacattgaagcaggaggctttttgaaccatactgtcctcatatattaaaatagtcatctggaggcatattgctgaacttaacaggaaatacaactagtcattgggttaaacgtagtgctaaaaggaattttctaaagtgaggaaatctttagttagctagatatttcaatatactattgtctaatctcatatattccatgttctattaattttcccttcttgctttcacaatattttttaaaaaatagtttggtttaaacattttatgtaatctataattctactggcatgcaatcttgtcttttcatgattctatactagttgatgtattttatctttggctttattgggcatggtatatattaacagttggttagggcgggaggtgcccaatctctagtagcctaaatattaaagccttttttttttttttttgtaaggaaaagtgtttatcatgctttaaccttaacataagtatcctcccttatcagtctctatttctgcttcctgtgcagctgaaactcttcaggataagtgaagtcatcagctatcggctagggtagcctaatgcatttgggaagttggtttggtttacatgttaatgacctggatgaagtccagtaaggtgtggaaaagatagagtggggggagggggggaactccgaggaagctgcttcctcggtaaatatttccaaactgattagaaagttcatggccccgcgatgaagtcgagatctcaaatactggtaattattttattatttcgtacattactaacattagagaaacctttcggctcgctttctagcgctccaacctctcagggtgaaaaccgcgacttctgggcgtgcaggaaaagcacgctggaatcgagtgctgcagacatcctggaccgtggtttttacgcgtgagtaacggaggagcgcaccgaccggtggaagagagaagtggctaacgcgtgtccaaaagggggaaaagtcacaagagcaactattagggtcgcgctcctattggtcagaggaaagatcccgactttagaaggactttcctgctggctggctcgcagcgtccccggagagcaagcgagcgcgccgcagcgggagactaggttctctccgagcgtcctccgcagaggcgccgcgagaggagcagggagccgcagctcgccgtgttgtcttcatttcgtgcaataaagaattgtcattaggtttgcgtatggcatgtgctattaccccaccgtaaaactaaaattagcaaaatgtcaggaatggaaagattgattcaccaagatgcaattatcatttaaaagtgcttgattgaggtactgatgttcagtgatttattctgcataccatatacataattaaagtagtgtagtggagtaatttatcaatctagttgagactggaggggtgaggagggagctgctgtatgtttgttttattaaaatgctccgaggtctagtcccgccccccttttgcaagagtgaaactgatgatttctccagctcgcgaggaaagagtcaacggtttgggattgtgggggagagagagacggagagaaaaaggcagcgcgaagcaaaggcaaggacaaaattaaataaagggggaaaaaaggaggcaaaagacatttcatcggacgtgctgcttagaaccccaaccattcgtgctccgtcttccctaccacccccgcctcccctcccagtatccttcaatcccccccgcccccaccacccccagtcttttttacgcgatgtttcaaacgctgtgagctgttctccttttcccattcgtcttctgtcacttccttcctggacgcagttttctggacgagtctggttacttttaatccgaccggccgctgagagccactttctcctcctcctcctcctcctccttctcttcctcctccttcttcctcctcctcctcctcttccgagcggcctcggcgcgcgcgaatgcgcggccccgcgccccccccctcgcgcgcgctcccctcgcgcgcgcgcacacacgcacacatcgtctccagctctctgctcgctctgctcgcagtcacagacacttgagcacacgcgtacacccagacatcttcgggctgctattggattgactttgaaggttctgtgtgggtcgccgtggctgcatgtttgaatcaggtggagaagcacttcaacgctggacgaagtaaagattattgttgttattttttttttctctctctctctctcttaagaaaggaaaatatcccaaggactaatctgatcgggtcttccttcatgtaagtacccctgatatttctcgaggaaatagaaaacccgggtattgtctctaaaatctgcatcaatatattccacggcactgtgtctatctatccctgtgccttttttgaaggctgaagttgaggctcgttgtgcattctttttcgttagattccatgatttccttgtttgttgctaaaagtaactttttagatagtcgtatccgtttgccatcagctattgaaatcactcctgactcgttcctgtcacaccagtgtatttaaagtttcatgaagttagttcacgtcattagcatgtttgatatggtggagcgtgtggagcctggtggattttaatatttcacagcatgttctgtgaccttgaagtagacgccttaagatttagcagttagttcactgtggaaagatgctcccatgagtccccccaaagacactgatttgccctgggttatgcttctgagccactaattcttgggattagtttgacctaaagcatggctgtctgtcagagtatacctttgtgcatttccttccctcaccaaagtgccggcttgacagagggcttcttaattggtgtggacaaaaagtaatatccctgccatagtagtctacacatttcacaattcacgttcgatttcagcatatggattgctgttcaggtcaagtcaaatacatagctgtttaaaagcaagcaaggttaagtcacttaaattgccttctctttggacttggaatgaaagttaccaaactcgatgataaagtttgtcacaaaggaagtatatatagatgtggcacattgtttattttattattaaatattgtggaagtatttaaatttaatgctaatgttaccttccttccctgaacatggctattgctttttaaaggaaattttatatctgaatcacttctgactattctaagtccagtagttatcattctttggggagagcctttttttgtcacattttaggaatgcgtgtcttttgtataaaatactttatatgtaaatgctgacagtagactaagtagaattgggctctctgccagttccttaaccggtcctcagtggagaattgctttgacacaaagtgcgttttactattgtgaatctgaaactaactctaatagtaactgtcttatgaaatgcttggggactgcatataatttctaagtgctataaaggaaactccagccacctcattataccagtccaaaaaaaaaaaaagcgactagcctactttcactggcaccttgcaatggaattgtggttgcagagtaaagatgtttatgtggagtataataactccaatccctagagacttggtaggacatggaaatgtgaccacctgtgaaccccgtttaacctcgtattgcataccaattttagctttaaatagatcaacaatctctaatttgaaactaaaacatcttatttaattttaaaaaatgtcagttttggctagtctttaaaaacattcagcatgtaccaatatggtataagcagtatttttgtttctccatcagtttcaactaaagataatgcagttaaaaagccatattattgtcttccagtgtatgcatgaaattaagttaaaagaagtagttctaaagcaagactcagaacttgataggtaaaatgagatgtccctatctaacatcctatttcaagaggaaagaaatattttaaatcaaatatctcattctatttgtagaaaagtacatttagctatgtattctgctactaactcaattctaaaagttttcatcaaaacagtctttaaacataacatttgcttaaaatttggttctcccgtcaaagagacagtaggtggctgttacctttacttcaaattttactaaattttataaaaacctactatttttattaatataattcacacagcattcgaatgtttgactttttttcagacttcttaggaaaggcagcattttacttcattcattaattgcaccatttacgtcctgattgctgtgcatgtggaatatattgaaagataatattaaagtgtaagttttattaaatgttaatttgttttttatttcaataacaaatgagcaatttataataaaaacagttttccaccttttctgagctattcatattttaaaagtgtgcaatcacagatattaacttttcaagagagaagcacattaatactagataactccatgaaacttagataacaagaggcactttgcctcttttcttctttgtaaacatgttcattttgaaaaatttgggggaaaagatacctgaaattttttccttggccctaacttaacggaatcaataaattccataacactgcaaacgtatctttctaataaatactttatttaaacttcttttataaagaacagcactgaataactccttagcatatcttaacattatcttttaaaactttcttctgtttattgtagtatattttgtggttttatttctcaactctaaagtgtggtataatttgagtctatgaaatctcagaaagtgacaaaaatggggaaatagctgtgcagcaatacttgtgctacataacaacaaagacatagttattaaacagaattctggctttggggacatgattcgaagcaacatagaagaatttaatatgcaattaatggtcacaagatgaactgttaagagattattaataaagttacacttttttttcaaaagcacatcctctgagaaaataccacacaaattaatatctaaaacttatcaaaatacacgtattcattctatactaatgtggtgattgcctagacacgatgaaatgatttaatcactgttgttccatcagtatgctgcatgtggaaagacaggtaattaagatccccgtccttagcactgtaccttaatcttataggcgcgtggactgtcttgcactcagtaaagcttgactgttcaccgagatctgtcacctttaggaaatcaaaccagattacagaggtgattcacaaaaccaggaacaacagagtctatgcacgttacaaaaggcagattacatagttcacatgttattttgataggtcaaagataaaagctgattgttgaggaatggcaagacactcaatttcaaatgattgcttagataagcatactttgaccctgttgcttcatcattatgatccattcaaacaatggaaaattcagttttcaaatgacaggctttcagtagtgaagtaagagaaaacatgtccttttttatgtatgtcttcattgtgtaaattttaagttccatcatttctttatgaacaaacattaaattgtctgcttacatgaagcaggtattgtaaggcttaaatgcattagacattttcagaggcgttataaagagcacaaaacagaatttgccagaaataaaacatacactcatgttattgagtaattcagcagaaaatgcataatagtcaatatccattatgttattctgttaccaaatatattctacataaaaatgtgtaattacatagttatgaatccatatatgtgaaacatatcttcataaaagttcattggtcaaattttatatatatatataatatatatatttcatgaatgttatataaagatcattctttacaacagaatatgatgttttgagagtttatttcagagaataaagttttggtttacataataacattttgaaaatcttaacttcttacacacccaactttacagtaattttttgcttcttctaaaattgaagtccttttttacccaactgatgcctcctagtgtttcacacaataaaacactaatgagtcacccataaatgtaaacattgcattttcattgcctacatcatctgtgatacataaaattaatatttatgtgtttaattttctgtgcactattataataagatagaaaattttagtgaatgagatgtttcatctgagtggatttgtggcacgcacttgcaggttttctttgaccatcacaatatcttactaagttttaacaagtttattaccttcagttgcagttatatattcactctttatattcactcttatttcaagtgagaaacataggtaaataacaaagctttcattttgtaggcctgggaattatacagttgggttcattctgaaatgcctgataaattgcacaaggactatccatttcatttacacactaaaatatcttaaaagagatataattttttttcctgctgtgtctttacacttgaaaatttctttgtaaaagtggaataaagaaagactatttagaaaagataaaatcaaagataaatgcaaaattttctataaatatggagtatatttattagaaaataacaacaaaagaaaaactttccttggaaggaaacatattattctacataaagggaagtcgtgttagaacacaatatccaatgaccagcagcttgccttaatgaggtagaagttagtgggtgccaactttggtgtgagttttctgccattaggatggtaagcgtagacctgtgatatttttgcatgtttgtgatttcaaacagctctctgattctacttcctaagtttctaaatgttttttatccaatatacttatgaaagaaaggggtcattcctgtaatgggtcttaaattgaaaggaggccatcaaaaacttgtaacattcatgggcctcttcctgaggtgtcatacaacatacctgtacacaaaaacattcatgagtttcttctactaacacaaacattctatagcatccaagtgtagacactagattgaacttcattctgtatatgtgtcatttagttctcctgactcaaaatacacagtgtattaacaatatttgactatcacttaagattttctaatttagtcaataatacagtgctattacaattgttggacacatttcaaagaatgtaagggggtgtgttcctttcgttcaaggaagcaaacatgtagaaaggggtggacctttcccacaagagccacatttcttcccttggagaattgaagcaaatatgcagtacgtaagtgaatagcagcatgagaaagaaaataatttgcaatgatctcctatagttagtgagcaaagaaaattgtcagttttttttaaagtagctcttattgacaacctatcttaaactgaatactgaaaaaaagtctatgaaagttttataatttcagtatgttttaacattcatgcgtgaaataactgtaaagtacactgtaataattttggtcttgctcaaatcaagaattttttagtaaccatgttattttacagacaatattgaggcataacaaaataaagggtgctggaagcattcattccttacccctctcttttaagaatacgaagatggcattgatgttcttttgttatttttgtctgtgaaagaaaaataattaaagaatgttctatgacaaagaataccattgtaaaaataagattatagaaaaggttatttaatatactattatctcacatctccttgatactattttaatgtttactgcaaaaaatcatattcctattaaatatggaaattaggtgatacatgttatacaaatttatggtttagttttaggtgatatgagtaacatttatttgtcatcgccataattcatttgctgtacattgtcattttattgtacaagttaaatcttggtatatatttttaaaatacagccaatgtaaacaaagttcaaagtacatgaagagaatcttttgagggcattgaaaaggaaattgacgacattacaagcaataaaaacagtaaacatattacaggcagatttcttcaggaatcattactcttaaataatgcagacattataaagactttattaattcttaatgctgtaaatttgaaatgaatggagcaatgttgttcctcctgcaagtggttgggattcatgtagaatgacagtgcaagtcctcaagcagtgatttaaattaagtacccaaaacttgtttttagaggctggaggaactaactgatctttgaatcagtcccttttgagaacctgctttttccaaatagcatcatgagcgtggtggtctggttttcctcttctatcttgttgtcatagataagatgcacatgaagaattcatataaattgctctcagatactatggattcctagcatattggattaaaaaagaagtggatatggtccttcgatagaatgtgaagtgtttttttaaaaatcagccaagaactatgcctgtctttttttcacacctgtgattctttcagcaagttagaaggatagcaagagaatgtgcatccttccccaaaccccgaagacaggcagctttggcttaaatatgcttatttattttcaaaattagaaaataaacacattaatgtaaatatgttgagacagacaaagaaatttgtctgctacttaataaacacgcgatttatactttttgtcttctaattaattgtcgaccctgaataaggtggtacaactaaggcatattatggaaaactggcattattgcttaatgtaacatgagggattggaatttctttaaagtaattttaagatatgattatttagcagaaatattcactggagcattttacttttagaaattatcgtcacacaaggaagcctttataggaccgactacctaattgcagtcaaagatctcttgaatgaatgaacacacacacacagaagaacacacattttaagaatatagtggtcctatatttttaaaaatttttgccacattttttatatctgaacagaacgtatgtgtctaagcagatgttttaagttatatccttcatgtaggtgagtctgtaaatgtaccatttaacttaaatggctttgtgggaaggtagtttgaggagtttaaaaaggaaaaaaaaaaaaaaaaaaaactccagttactacagtttcagctctttctttttaaaaaacagtaattacactcaggataaagaaagaaaaataaactcttttaattctttgtaacatccacagtttttcaggtagagttctggtatatttttattcctgaatatgcagggcaggtactggcagcagagctacaaaatgaaaacttcctggctgcagaccagatactgtgcacagtgccacatcataaacttcccctcttctgtctcggagtgatttcagccctaactaatgtcctttatttccccctacatagggtaaggaacagagggccttcttcctgggaaataggggaaatacctttgggaaaggaaaagtataatgtttcccttctttaacttgaaaattctgcctcttaaattactaagacattaactgcaaagtggattcagtatgtttcctttttattcccatatagcagtttagaatacataaaacaataggtgtgagatagaaaatgagacctcttccccaccccctacctccagcacacccagacccaatcagatatctgtactttttgtttcgaaaagaaaaatataatggtttcttttcaatgaagcttgtgcattatattccagatatgttagatcattttgtgatgcaaattagcattgaggttttttgtacttatctcgggaaatagcaacgttccaccacaatgtgtggtgctgcaaaaatttttattgataaacacccacactttaaatgattattaggtcaaaatagagagtacagggggagaaaatgtgagcttttagttttcagatttgttttatgcttttcatttgaaaggtacagtgtaagttctgtgtataataccatgcaaaataaattgacttctaaatatctgcactaatattccttgtatctgaaactatagtctaaaagcttgtacttctccttaaaaaataaagtaaaactttgttaagaagcaggctttaattaccagttacattttcaactgttacccatgtgatttttaaaaaatcctattaaaaaataatttctagctgccatggctcctttcaatcagtagaattctcatttgtatgaggtgcaatcagattattgccagcacacctttctaaaactagccttcttctttagaaatgtattaaatgggagccttcaggagaaagtgttaccacttaataaatatttgttctaattttatttttaaactaaattattgatttaacagtatatgaatagtgtataaatgttagcttagttgttaacccactacactaattattaattgcctatatgaaatttaccaaattagaccaacagttaagtgtaatttaattttatttctcttgaaacttaaatagataagaatgataattttaattatgtttaaatatcaagcatttatttttctgtgaatgcaaatgttcccgataaattgttaagaaattaatacaacatagatcttaaaaaatgtataaggcagcttataagaatatgataacaatggcatattcctacacctggcactttttcaagacccattagcaagggaggaaaaagatgttaaactttgttttgtaaatgctaatatatatatgagtcaatactttctgacatttatttgttagaaaattacacacatttaaaaattcaaattaaaactatgcttctatttaggctattgtaagagatttctttattttcttggaaattctctggaacagtagggtcatttgaatcatacccgttggtattgtcagatacattgtaaagtttcaactattgaacatatgtatggaatagaaattttaaaatagaaaattcgctatcttgccatttaagtatgataaaactatacccgattaaaacgttgactctattagaggttcgcctagtaagtaattctctggtcaagaatttgggaaattttaaactctgttaaccattaaaacaattacttctttaaggtaccggattttcatccatatttgaggagccttattaagttgttgggtggtctttttgtaaaggtttatgtggttaaaaaagtagatcttttcacccttctattacagttaacattaatatctttaaaaggtactatataaatccagacctaatttattctggatgatttttcttaactaaatgaaatctaacaaatttgtctatttttaagtgaatcttttttttatttctagtatttattggaagttcacttagactctatataggttagaagttaaagtaaataattttgactatttttttctttcatttcatgtttgaatatttccccctttacataaaccaaaaaaaaaaaaaaaaaaaaaaaaaaaaaatccgtgacgacattgatagatttgcagaaggctgagtaagatactcagtacccattaattgtttccctatgactcttgggttgaaatgaatcggcaatatcccttccaagactgtttgatcttgcttgatttagagtgagcgttatgtgattttttccctccgcttctctcattttatagcttcaaaaaaatcagagaattcttgacttcagtgttttttccttccgttttcattgtttttggattctctcctgtctgagcttccttcttgcttcaaagtatttggtatcgtgaaagcaagtgcacttttaacttgttttgactacacatgggcgacagaattgttttagatgctaacttacctccttacacttgagaaactgatgtggttcatcacagcccaatgccatgtcttgaaacaactgcggacactgatcttgaaatagccagggctataggatcatgtctttgtaaagaacaacagcagctttagagtcactggatggtatattcgttgcaaacatgaacagcttcatgaactcccaggaagtggtacagttattggacaaggtcaaccacattatgccttttaggttgctctatgaagtaagtgttagaccagaactccaacggtgtgagtgtgtgtgtgtgtatgtgtgtacggtgtggggagcatcggtgtgggagagcagagagagagaaaaagcatgaaaggatgaagatacactctcgagagagaagatcgtttaaacaagcataaagagtttggagactccatttccacacttaatatcatttctttgattctacatattatgctattagacaaacatgtccataaacaataaagaataatgattaagaacaacgaccaaaactgggttcaaaagccagcctcccatttactgattagtggttttaggcaggtgttttaatgaccagaaagccccagtaccaggatctgtaaaatgggaattataaaatcacccacctcttaaagttttttaaggatttactaggataatacatataaaaccgtaatgcagatacatagtaaatgatcagtaaatattaaattattatcatagcattgtactatattttagtcattttaagtttctgctaatggtgatttagaaatttttggtgggatggttattaaaattatttttcaataatactttcagtccattaaatttgggtcacattcagagcaagtatctaattcttacacagtcgtgggtcaattctaatgattgctaagttcaatatacttctttctccaaaaaaatcaaaacctttcacagatttgatgttattaaataaatatattatttttagaaccagaaatggaaccaaagaaacaaaatgataccatccatgaattttaaaagtcatttactcaaagttctgaattgcaggtagattattccttagtcttaatgaaagttcagtttggaggaaatgtttcatgtacagttattagatgattttaatggtgaaaccagcctcgccaagagttctaggtgtttttcttagtattatccacttttgtatacattaataaccttttttttatttttcttattagacaactttgattatatgtagaaatggaattaatttatgatgaatgtgtgttcttttagtctttatatttcttcacaagaactcttgcatataataggtactctatagatatttgttgaataaatgaatgaattgtattttcccataaagatgaaatgcattttttatttgaaaagaaaatataaccagcaaatgctacccttattatcctatttttctctagatttgagggcttattcattatgaccacagcttatcaactttgagatgatgaataagtgaacttgtcttaatttgggtatttttatttatgtaagaaaaaaacataaagtatagaaaatgcagaattgtacctgaggattataccttctgataacgcaaacaaatttaggtaaaatgtagatttaaaaatgtgagtattactggtgtcagggaaccccttttgttcagcttttctgttcacatggtttctcaaaaaaaatcatattttggatgtcaggtaatattgatgagacatgcccagtttatacaacctggctagttgcaaccacttgaaattgttatcatgcttttgaataatgcccctttagtgtgcaccttgcatttcagctttcttttctaactctgttttaatgcctggataaagagtgctcagcacaaggaatacttgcagagtggacttccctatggtaaaacagcatggacagctcccaacactgcaatcaaggacgcctctaaaagctttaatttaaaaataataataataataataagtctgcatgaagatgatggagccctctaaggcacatgggcttagagaattattcccatctgcaaccccctccccctacttagtagccctttccagggttatgattactggaaaatggctgttaatcaccagaattttttttgactgcagctgcttcagtcagactactaatctattaaacaacttcatcttcagtttaaaatttgcattgtaactgtatagaataaattttcattgtaatcagagcatccgagaaaacttcttgatatgatttatagaagcacatttgtttttatgtatggacctctctaccgctattgagccaactgtttaaacaatactgtggttgatcagcataaaataaaatattgtagcactcttgagcacaagcaacatttacaatagtcacatttgcagaatatttgaattgtggcatctttggcacttgtcaatacaatacccacataattcaaaaacttaccccagatatttaaaatttgacttgaacccgaaagggtttttataagtttagtgtttttgtaccaggctgtggtagagtggtttggcctctttttctaccctaatgcttattacattgccataatttgaagaaataacccaaaaccggagtcaatatttagtgctgagagaggacaaaacagctctaatttacaaagaactcctttaaaacacatttttatatgtaaaattgacaggctaaaagaggtggttggatgatgttcatcatgttggaaagaatgtttcaattaaagttgaacactttctcttccaggtctttttttctccattttttatttgctgtgccaaggtatccatgtgcgtttttccactgtcatctggctcattcccagcagatgcacacaatctgttctgctgtcactaacagggttcggtttatgaaaagaatgtgtcagaacatgccactatagtcacttttacaggtttttttaaagagtaactgagaatatatgcattgccctagttttattgtgctcagcccttaagagatttctaagaaacttttatattcataaaccaaaagctttcttccaaacatatttttgaccaaatatttactttccattaaaaataaaattttaaaagttcacaaacatctttaattatgaaatgtattatattaaaatttgagtaaatttttataggattgtttaaaataaaccaaagatttttagataaaattattaaatttccaattatgaaatttactgcataatccttcaatacatatcttccctcatactaaaagcaaacctaccttcctactcaagtcaaagcattgtttaaaaaatgtattgtaatagaatacttaggatatggccgtaagtaccagttatttgatctgatatatagtactgatttccctaagtgtttgacaccactaagttaaacccaaagtagttaaactaccaaaactttcttagcccatatagagacgcgtgatacaccatcctttcacaaaataatgtgacattttatttttgtaagcatgcatgttttaaaagcatactagataattagttatgaaattaatttttgttcgttaagatttctctatttctattgactgttcttaataaaaaatcagtttttgttgtcttcataaaaaataatttttctggtactatgtgaattaaaaaaatttgagcaatggaagttgcattcgtttctgaattaataagtgtagtaagttaacagaatttgaaatgtcaagtatgtgtagtaagtagggactgcatatgcagatagataatggacatatttacatgttgtgtacagttcatggtatttaaatatctcccagaattgaaggctttaaaaaggtacttaagtgctagttttagcattttaaaataatttttgacttggagaacaatacaacgttcaggaaaattaaacttttttaaataagttatagttcacatgcactaaaaatgcagattaagaaaatattttaaggaatgacaatttgtacaaatgaagctatatgtgtatatatatatatatatgtgtatatatatatatatatgtatatatatatatatatatatatatgaaaactagttttagatttctgcctaggaaaaaattacaaaatacatttaagacataacgtgattgtgaaactgatatattgtcacatagacaaatccagcaatataaattaagacctttgtgaaacaactttgccattatagcaagataataatttacagttagaactcactggcactgttgtcacatcatatagattaattgctaaattatctttctagagttctatcatgtgcttgttgtagtaagttttcttaattcgtaaagaaaaaggaatccttgttttatatcaaatattataatgtatacgtgcctattgtaagttgattttataatgttttttgacgatgtgaacatagcacatagatttaagatgaatcataaagaacaattctggagttcactttttactgccaacattttaatttatctgtaatcttacacatcagataactcgactttttatctaacctgtaagtaatttcattgctttgttttgggtaattcggaatatttgctcttggcataaaaggccaagaatcataggtggtgaactgataagaatgttctagttgaatcatgtgggttgtcatagcctctctctcttctccttaaagtaccggtggtagaggtgggggagaattgtagtgtgttacaagaaagtagacagcctcactaactaactatgccagtattgggtggggggtgtcacacggacttggagaacaagcagaatcatttattttgctgcaatttgaatatacatgacatcctttcaagacaaaactccagaggcaaacttagttatacttatcctgatttactaatccttaaaatcttctatcactcaaagtgtaaatatcatcccaaatttcactgggggaaaagcttacgcctcttagcagtattcaccgaaactgaatatttgcagttgtgttttgccttgtgaaatgcttgtaaataccagatcttctaaaaaggtaggcttttttatttagtaatgcttcataaagaagtaatcagatatttttcccccagctttattttttaaagttaaaggaagagtagttccgaaacgtgaaattttcctggttctccaggatatgcaccgtggggccatttttatctcaaaaatactttttaaagttttgccagttgtcttgatttccaacacagggggtaccaccctcctttgtggttgggaggtaattctttctttgcgtttgcttagtcataggtctttttggagcaaagacagattatttttgtgacactgtccccaaaatatatattattcacagactaagaaatccatcaaagagtctcgctgcacgcgtaatgataggttggactgcagtgaccagaaggctctccactcagctttctttagggaatttaaagacagttgtatcctttttccatctgcatcgacatatgttgaccagttggttttcaattcttgctggcttggtggttgaaagtaggactgatcttctataaatataattgatactttcaagtatgacttaggaattccacttttactttcttcagcgtcactactcaaaatatctctaataattttaataacttttatgatatgtgtgtaaaagcttatattattaatttgaaagaattactaattataataagacaataaaaaccacagctaacatttttttgagagcataccgtatacttgagcactattctataggcctgaagttttatatgcattaattcatttattcctcaaaacttaatgaggtaggtgcagttactatcccgattatatagatgaggaaactgaggtaaaaatttacaaagtaacttgtccaaagttacccacttaatggcagacctagaatctcaaccccagatagtctcaagtccactctcttcttattaagccaaaatctcacatacatgatcttatctgttagataagaagaaggaaagagtcaattattgagtcttaattttgcctggcatcttagggaaaaatatttagtaaccttggaatgacaatataactaagtttgtgtaaacatgtttgtattgtttttaaaaagaagtgtattaattcttggcctgtgatatatacttccacattgttgatgtgaagtgagaaaaacatatattatcaactgcttgataaatcttttcacaagcaatgtcttactatttgcgaaaatatatttttccagctacgatattagcgttaattgaaatgggaaaatctcgttttatgtcatcactgtctagtgaccactttgctattcatttcttgagctgttttaatttttaaccttcatttgcaagaatcatagtaatttatatggttttaattcaaaaatgtgagatgtataacagagcctataaatgaatattaaatggatttcaggagttattcagtaaatttaattagtgcagatggatattctagagaattcaacttcaagaacacctttaaactttttctttgtagttaaaaaaggaaaacaacaaaactttaaaaccaaagttagatgtgaaataactactgatgagttagaacaaggtcatattatatttgaaaataagaaatattatatcaagtttattcatcaagtgcatagcttttagcttttaactgaatttttctgggttcagtaaaagaccttttgaaaaaggaaaaggatcatttttagaatttttaccatgagaaacaatatgaactttctttattctaataaacagtttccttgttttttcataaaagtattgccgtactgctgactagaagtgaggacagagaggctggccagaggtcaaatgggactcagatatttctgaattaccagatatacaagctttggacttcaaaattaatagctaccatatctttaatgtcatggattccttgccaaatttccacagttcatattagtaactacatttgcttccgctttgtttcactgttgaagagaatgaaatgcttgtttggattaccatgcaagcatgcaaataatctatgctctctgtatttaaaaattcgtctatttgaaatgtgacttgggccgggcgcggtggctcactcctgtaatcccagcactttgggaggccaaggccggcggatcacgaggttaggagattgagaccattctggctaacacggtgaaaccccgtctctactaaaaaatacaaaaaattagccgggcgtggttgcgggcgcctgtagccccagctactcgggaggctgaggcaggagaatggcgtgaacccaggaggcggagcttgcagtgagccgagatagagtcactgcactccagcctgggctacagaccaagactccatctcaaaagaaaaaaaaaaaaaagaaaagaaatgtgacttaaagatttggggattcaatgtgttatttggaattaattgatttcagtgataaacagccttcctgtcacttacgatgcccactggcggggaagttttgtgtgctttatgcaatattaagtcccattggtaacactcagtgttcattcttctctttccagcaaaaccactgaggccagttatatctacttcctaatgtgattttgactaaagttgtttgaattctgtctctttggaatcttctaactgtaaagcacgctctaagactccataaaacaccatatttatattaatatccatttgagttgtaaatatgcaggaaataattattcactgtaaaggcctggattaccctaagactgaggaggaagttatagctgttggctaattctataaaagataattgcataaacttattagtaatattccttgaagaagattgcgatgtagctaatactgcacttcaaaagcctttttaaaaaatttaatcatccaaagactaaaatcaactaagtttctcacaagcagaattcgttagaaaactatgggctgtaactgatctttggtatatgccaagtgacaaggtcataggtataaaacattggatttcctttgaacagttagcttagataagtggttctgaatccttggctgtaaggagaattattttaaaatactgatgttaggtgggcacagtggctcttgcctgtaatcctaactactcgggacactgaggctacagaatcacttgaggtcaggagtttgagaccagcctgggcaacatagtgagatccagtctccaaatttttttttttaaatggccaggcatggtggctcatgcctgtaaccccagcactttcggaggcaggtggatcatctgaggtcaggagttcgaggccagcctggccaacctggagaaaccccgtctgtactaaaaatacaaaaatttgctgtgtgtgctgctgggcacctgtaatcccaactactcaggaggctgaggcagaatcgcttgaacccgggaggcggaggttgcggtgagtgagccgagattgcgccattgcactccggcctaggcgacagagcgaaactccatctcaaaaaaaaaaaaaaaaatttgaaaaaacaagcgtgatggtgtggcatatgcctgttgtcctaactacttgggaaactgaggctggaggatctcttgagccaggacttcaaggctgtgctgagctatagtagtgccactgcactccaatctggtgacagagtaaggcctggtctctaaatatataaatatacatatatataatttgtgtatttatgtatatttataatatgcatatttatatttatgtgtatttataaatatgtaaatacacatattacaaatatacaaatatatacacacatacaccaatgcccaagttccactcccagattcagattaaattggcctgccatccaggtattgcagtttctccgagctgcctgggagctcttaatgtaaagcttgggttgagaaccactagttaaaagaagataaatgtgaatttttatttttaaataacatataataactgtatatattgatagggtacatgtgatatttccacacatgtatacattatagcatgatcaaataaggctaattaacataactatcacctcaaatatttatcatttctttgtgtggagaacattgaatacacagtgaaataccattcagccttaaaaaaaaaaacaaaaaaaaaaacagaaaacatggctgggcatggtggctcaggcctgtaatcccataatcccagcacttcgggaggccaaggctggaagatcacctgaggtcaggagtttgaaaccagcctggccaacatggtgaaacctcgtctctactaaaaatacaaaatagagccaagcgtggtggcacatccctgtaatccctgccactcaggaggctgaggcaggagaatcacttgaacctgggaggcagaggttgcagtgagccgagatggtgctattgcactccaacctgagagacagagcgaggctctctctcaaaaaaaaaaaaaaagaaaaagaaattctgtcatttgcaacatgaatgaacctaaaagacattacgttaagtgaaataagtcaggcacagagagacaaatactgtgtgatctcatttgtacgtgtagtgttaaaagctgaatttacagaagtagagagtagaaaggcagtttccagaaatggaggcgggagtggatggggaaaggggagacaagacataggtcaacaggtacaaaatttctgtgagacaggaggaggaataagttctggtattctgttgcacagtgtgttgactatagttaataataatgtattgtatatttcaaaatagtgaatcttgaacttgggcatacaaatccatgcattcttacagtttcagaaacaaataaacctataaattgaaaactacctttggctctgccaataaaatgtctactgctattgcccaacacttcttggacgtcaactgtataaatttattaacacatcagtcaacttttcactaagtgtttcatgggagtgtttcattagggatacaaaagtgagagatggaaactctgttgttgaggaattcagtctgatgagggagttgaatatgcaaagtgcaattataaatgtaatgtgataaacactatactgcaggcatgttgaaaatgaggtaaacgcttaattgatagaatgttcagctcttttgggagatgactggttaggtcaatcttcagtcaaggatgcctaaggtgagtcttaaatgatgagtcaaatcctggcagtactccagaaaaaagttttgggggctagtctgccctctggaagcatagcagactttcatatgtttttcgtatggcctgccatattctcaactttgctttctcatttagaaaagctgtgcaggccttgcccagaacttcagattctgtggaaattgggggcacctaatgaagccgtgaagatggtatcagaagtaggaagtgccaacctaatcttctttccattctctggtatgccatagaaacctcactgtggcagatctcaaggtaactgggaggacatactcctcctcagcgcccactcctgccctatttcctagacacagctgaaaggaaggatggcctgatccgggtcctcccctgcaacccactgttttgacaagggatatgggacaagttatgaataagagaaaagggccaaacagggagctacccaagaatactttatatagaggagattcaacttacatctcttacaaagtaatttttaaaaaactttaaaggttatttctcgggttttttttttccttcttgttctaaaagaataaaactaaagaaagacaagtacttcagggatgtcataccagtaggaaaacatcttgtatattttaaaagaacttcgggtactctaatagaaggggataaatctgtaaacatagcaaaccatgatcttataagacacgtagaatacgagaaactaagcttgtccctcctatgttgccaaacaaacatacacatgtatctctgtgtgtgtgtgtgtttgtgtgtatgacagaagtcagaaaaggcaagacatgacaggaaaataaaaatactagttccacaaattctatagaaaaagattgttttattatttcgtaggaagccttaccataaaatgaaccacataaagttttatgtaaagagcagggattagataatgatctcagttatataatggaacaaaattccaagtctgtaaaccttttggtcgcagctgctagataacgttaccttcacaaaccaggtacttaatgaaaaaagacctgtttcatgtggagggaggtggaagaactgggttgcactgcttactaataccatttcccagtgactgaggtagagaaataaattagttgtgaaagactgagaactttggtctaatggattgacttttttggaagtcacaaaatgtagtgaatttgatctcaaatagataatacattaacatcatacatgcaattagaaaattatcaccttgagtaaattaagtatacagcattgaatttaattagcatactattagagatttgcaagtcagtaaatatcacaaggtgaaatttatatttttaaatacaactgaaaaccctccaaagagtcaatatgatccagataaaaatgattactttgcaagcccttgaaagttcctaatactggttctgcagaaaaggggcatatttatcaggactgttgtctcagaaaggcaaagctttctgtgattttaacttataaatctattaagtgtcaggttgtccatatgaatttttttttctctcacttcgtgcagtagctgagaaactctctcaggtgaattagctcagaactggatagaccggtaaatttcaagaacataccacatccaagggagataatgcaacaacatacctgtgttgcagtggttatgtttctaagagttttaatatgattcatttcagatctggcttcacattggaatctcctggagagtttttaacaagtaacaatgccagggaacctggtccaacaatcctgatttcatcagtctgggatgggtctgggtatcagtgtttttaaaaagtgtttgaagtgattgaaatgtatagtcagcattaagaactactgttagtggaacattcaaaatctctacaactttgaaacatctttgaacactagggtgaagcaaatgcagaacattggtgttacttccattctagctgtagaattgagaagaaaataaattaatttcttaagttatgacaggaaaattttctatagaatcctgctttttttcatctgtgagaccagccgcatcattccagtttctaaattatcggcatttctaaagatgaagtaacaggggaagtgatgaactttataaatagactccctaaaatatttggcatgaggggtcaagatgtaggcgaagctggaaaaagactttagtttgggtattagccagaggccaacagttgttaaattctctaaatttccttaagaaaggaaagagaatcccttgaagaacattttttttttctccaatgtgtagtcagtgaaacccagagggggaaaaatgtacctttcaagccagaattaggtcatgccaaccacagcaaattggaagctctacttaaactgtagtcttgcaggattgctatgtatcatcttaatgtcatgcatgtggtggggccaacacttccagatcatagctgctaggctctgctgagcggggcagctctgctgggtgaatctgaccaccccattgggctgcatttggcacacagacataacctaagactgtctgaaaggtaagccctggaatatggcattttttaaagtgaaaaaaaaattacaatttctaaaaacaaaatatttcattttgttttatgattttagaggggggaaatgtcaagggaaatagagaatggacaaatccaccattatgaccagcaggcacagcttcctggcaattgagacaaggttgccaaaaacctaccttaccataaaaaaaaaaaaaagcatacaaatagtttcatgcatttattcacctgtccacattagaagtagcaggattgcccccttaccagccttacagaagtggaagaaaattagaaggtacttcattcatttctttggcactttccataattattagaatgtggaacctactgtaaaaatggaacatattgccattatgtaaaagaaactgttgtcctttcctacctgtgaaacatagggtttcacaggcatttccagtcattattagaaggctgaattggccataaaaatgtaacatatttccattacctaaaggaaatttatactctttcctacttagagaaagcatttaataaaatgattagacctgtatggtttaagaaactttatcatgaattgccctatcgaactttatgaagctgtttaaagaaaatattagtatctgctacagtatccaatgtgtttgttctgtttaaaaagaaaataaactaaaatatatttttgttgaacacttctgaattgactcccacaagaaaataaaacctcaaatttgttgacttgttcataaatgagcaaatatttttgcagacttgtagccattagctttacatctgtcatgtctgcaaagagtttttgctcgttgagcgcaacttcccaatgtgtacaattaattagatcaatctaattttcaaattattggcttcttttaggatgaggttgtagcagttatataacattctgtcaggtatgaactaaaataggatactgaaaacattaatgctttcctcttgctatagaacactgtcatcttcagttaattaatacaggaactttcatatgtgaaacggcattctccttgattttccttgcatgctggttctacatttttgataacacaggaaataaaaagcctaatctgtgctacatgaggattctggaaatacttcacaaaggagaaaacacttgagcgggatcttaacagaagagcttgaatgtgccttgtcactgggtgtcttgcttttgagtaaagactctaacataccattatgttcccaggaataccgtcacactgcagcttatgaataatttgcatcccaaaattctgttttaaagttatgttggaaaatccagaatttattttttcatggaaagagttttttaaatgcttgttattttctcacatgaacccacaaatacctagtgtacactcttaataacaattttaaaaatagtaagaagccatatggatgttgtaatacaaataacaattatatagttcaagtttgccataaccagtaatgcttaatcaaagcactctgacgagacaggcagaatttttgtggaaacaatgaaaacaatgtcgagatgtgcaaaatgtaatccaccatacataggcctcagaatggtttgcagtgctccttcaaaatacacgtctcactactaccttcctggggagaactttgaacatgatatttaaataattagaatgtgaagtttgaggattactgcttaaagattcaagtattcttagtttatgttttttttaaaaatagcgttttttattccttaatgcagatgtataataagcatcactctaaatgtttattagttgtctttagctgacatgcagaacacatgagaaagagatttctccaaggagtaactaactgatccaggattaggaaactgacaaggatgtgtgcatgtaagtgagggccagagaaggtctgcacacaatgaggataaggacataggtgggtgggtcccagaatccatacccttatcaaatgcactttgctcccttctttgtcttctagttaactcttactgggctgcctcctcctgacatcccaggtgggctttaagttttgttgcctatggtcaccaactataaatgcagccaaggcccatgattaacttgctaaattaatgagcaaatgaattctgtcaccccctttattccaatctctatggagtcttgcttctttaagggtcccctgaaatgactggaaaagtaccttgaatatattgtaggtgaatattacacatgaattcctatatgagagacaggaaaaaagattggtgaggcttgaatgtagaggttggtcttgaggtgataggcatatgtaggagcgtggagggaagattgaggagatcctgtttttgcaaggaggaaagatgtatgcattgagttgatttgaagtacatattcacaagttggatttcattatcaagaaatgcctcaatttgtcaaaattaaattaataggaagaaaatactttgctggatattcttatgagtctaaaaacaatactgcatgtatttaattcacagagtttttgttgttgctgttttataaatttcattgtttttaaaatcatgctttgagatttttctctgcgtcctctagacttggaccataatttaagcacacattcagctactttacaggaaatctgaagaaaggaagtgtattagtttgttcttacgctgctatgaagaaatagccaagactggataatttataaagaaaagagatttaattaactcacagtttcacatggctggggaggcctcaggaaacttagaattgtggcagaaggcaccccttcacagggtggcaggagagggaataagttttgagcgaaggagtaagccccttataaaaacatcagatctcatgagaactcactatcaggagaacagtacgggggaactacccccatgatttaattatctccacttggtctctcccattacaagtggggattatgggacctataattcgagataagacttgggtggggacacagccaaaccatatcatttctcccctggcccctcccaaatctcatattctcacatttcaaaatgcaattatgcctttccaacagtcccccaaagtcttagctcattctaatattaacccaaaagtcgaaatccaaagtctcatctgagacacggcaagtcccttccacctatcaaaagcatgttagttagttccacctatcaaaatcaaaagcatgttagttacttcctagatacaatgggagtataggcattgggaaaatacacccattcaaactgggagaaattagccaaaacaaaggggctacaggccccaagcaagcccaaaatccagtaggacagtcattaagctttaaatttccaaaatgatcacctttgactctatgtctcacatcaaggtcatgctgatgcaaaaggtgggctcccatggccttggacagctctgcccctgtggctttgcagggtatagccccccagccccccaatcctggctgctttctcaggctggcattgagtgtctgtggcttttccaggtgcatggtgcaagctgtcagtggatctaccattctgggatctggaggatgatggctctcttctcacagctttgctaggcagtgccccagtggaaacacagatgtcagggctctgaccacatatttcccttctgcattgccctagcagctccatgagggttccacccctgaaacaaacttctgcctagacatccaggcatttctacacatcctctgaaatctgggtagagattcccaaacctcacgtcctgacttctgtgtacccataggcccaacaccacgtgtaagccgccaggcttggagcttgaaccctctgaagcaacagcctgagctgttccctcaggctgttttagccacagctgggacacagggcaccaagtcccaagactgcacagagcagcaaggtcttgggcctggcccacaaaacctttttttcctcctaggcctctgggcctgtgataggaagggctgccatgaaggtctctgacatgccctggagacatttttcccattgtcttggtgattaacatttggcttcttgttactgatgcaaatttctgcagctggcttgaatttctcatcaaaaaatgggtttttcttttccatctcattgtcagactgcaaattttctgaacttttatgctgtgtttcccttttaaacataagttccgatttcaaaccacatttttgtgaatgcataaagctcaatgattttaagagcacccaagtcacctcttgaacactttgctgcttagaaacttattccaccaaataacctaaatcatctctctcaagttcaaagttccacagatctctaggtcaggagcaaaatgcctccagtctctttgctaaaacatggcaggagttacctttacaccagttcccaacaagtttctcatctccatctgagaccacctcagcctggatttcattgtccatatcactatcagtattttggtcaaaggcattcaacaagtctctaggaagtttcagattttcccaaatctgtcttcttcagagccctccaaactgttccaacctctgcctgttacccagttccaaagttgctttcacattttcaggcatctttacagcagtgtcccactctctgcagtaccaatttactttattagtctgttctcacaccgctatgaagaaatacctgagactgggtaatttataaagaaaagaagtttaattgactcacagttccacaaggctgtagaagtatcaggaaacttacaatcatggcagaaggcacctcttcacagggcagcaggaaagagaatgagtgccaagtgaatggggaagccacttataaaaccatcagatctcatgagaactcacttactatcaggagaacagtatgggagaaacctcccctatgattcagttatctccacctggtccctcccatgacacgtggagattatgggaacaattcaagatgagatttgggtggggacacagccaaactgtatcagaaagggaataaaaatcatgcaacatgaaaagcattattttattcactggcttttaaattatccaactaactagtttattcttttgtatcagaaaaataatctgtgaacagttaaggaaaaaatatccaaaatcgttaaaagaagtatatcatcttattactgtatgttgtgctattcaaaaaaatgtaatgatgcttttctaaaaatggaagtaatttgttttatagataaaaatattttcaaattatttaagaaaataaacttgaatatggatatatatttaaatgcttcctatatattctatatagcacttagcaaaactctttcaaatcccaacatttaaaaacagctgtttaaaaatgaactataaagctgaggaaaagttccaaagcttctttttaaatttgtgtctcttcttcaggattcttcagcaaggacagcacggggtccagcaccctttctgtgtacctcctgccatgcttgtctcctttattgtgcatagaaccactttgggtagtaaaccacacataagctattctagaatgggtcaagccattcacataaatactaaaattagaatgaatctcagttctcggaagcacaagaccctaaaggctctactgaggtagttgtgattcattgcagtccttttttcatatcacagtagaaaaatatcaacttttgtgacttcagtaaacatgattctcaaggtctgtgtgaaatgatatgtgcacatagcactgtaaaatggaaataatgtacaaatgtacattattctcaacccaagttagattgtaaactccttgagcttggagactgcaccttactcatctttgttttctctatggtctgtatgagtctgttacacataatagatgttccatctttgttgaattaatttgaagcaagtgaatgaagggtaataattatcctaattcaggtgagagagatctaggaaaagtagttgatgaagtatttccaccatgaggcttttcccaatggtgttatctttcccacatctgactttcagagaactttttgagtgtctcttttatggtgtttactaatttctacattgtactaaagttaatttttaaagtatctttccaagtttgataaaatgtaggctctttggtgtgcagaggttaagttttattcacctttctattcaggatatacttcctgattgatttctaatctctcaactaacaaattattttttgcaccacatctgctatactacctgactggctgaaggatgttgatcataactactctataaacccatggcaatagtatctatttattgtatcctaatacatatttcacagagaagaaaactgagatttagaagtctcatagattaaagctttggtctcaccaaaaatatggttcttatatagctgcaaaaagctgctctcaatggtctttaattcattttacatgcaggtaatagataaagaatgcttccacctctttcctaaattataattttacagttcttcctcagattttgcccccatgtaaaaattaggaatgattgtggttcttgtttgtgtcacaagtgaggtcatgaaataacaataatgttgtcactgataaaacaatgttgaaagacacatttatgatttattaggagacatagtacatcttattatccttgtttgaagtttaagctttatccaaagcattcatgtaaattgttttatttgttttgtgatgagcatctgaccatgtggatcgcttattcctgtaaatatctgaagattcaagtacattggaaagggtttatatcttttataaattcattacgtggacatctaataaaagctaaatcatgcctttatattttccattgctgtttaatatcagatgatgatgggaataagaaaatcaaaatgatattcaaatcactaagttttacttttcaccagcagtctttatgatatatttgttttaataatattgttgcctaaaatgattgtcatttttattttgcatagatttcacttttgcaggcagtttacaattatctgtgcccatttaattatagtgactttatactgtttcaacttactaaatgtctaggcattatggagctaacagaacgtttcttcttaatggtcctaatggaagctccctggctaccctgtgtacacagctgtttggtaatcaactcttgtttaaacgtatacaagtccagcctagaagatctcactactcattgcacactcagctagaactacattctttttctttacttttttttaaaaacaaatgaacaaaaaaatccaaaacagatggagtctcaccatcgctcaggctggagtacaatggtgctatcctagctcactgcagccttgaacttctaggctcaagtgatcctcgcacctcagcgtcctgagtagctgggactacaagcacaggccaccatgcccaattaatttttttcagttttacagagacagtgtcttgctatgtttcccaggcttgtcttgaaattgtggattcaagcaatcctctaaccctggtctcccaaagagctgggattaccaacatgagcctctgtgtctggctagaactacattctttttttttttttttgagacagagtcttgccctgtcccccaggctggagcgcagtggcgctatttcagctcactgcaagcgccacctctcaggttccagtgattctcctgcctcagcctcccaagtagctgggattacaagtgtgcaccatcgtgcccagctcatttttgtattttgtattttagtatttgtgtttttagtttctcctaaaaatacaaaaacggtgaaacggggtttcaccatgttggccaggctggtctcaaactcctgacctcaggttatctgccaaccttggcctgccaaagtgttgggattacaggcgtgagccaccgtgcccagctagaactacattcttaagagcagcacatgcaccattttaattatcgcttggaaaaataaaataattaaaataaaaatctttgttaaggaaagttttattgttgtacagtatacttatttcaagtgatggttaatacaaccagaatccagtgttcaaataaatagagagaccactactctgaatggtcttttttgggcactaagtttagagtgcaattctgactaccttttctcatcatgttttatgaattttcttcatctcaacttttaccccaccactggtacttttaggtgtgtgcttttctaacattttttagaagaaatagctttaaaattaactttttaattatatagaaaagatttaaagtatttagttaaaggatgtgttttttaatattataaatcttttctgttactaaccaatgttgaacatacagttcaacatacagttctaaaattcttttaatcgtgttatgatgtctataatgatagcagtaagttattttttgtcactatagtgcttaggaatgtatatgactgccaagtacaattacttttggtcattcgagttttcacttgtcattatggaaatgttgcaaacaaaaatacaaatagtttgataaattgcttatattccagatatataaagtacttattgattgagtctgattgtattgattgcattataaaggttcaagtaataatcatcttggtacattttagtacaattagaatactttaatctctttgagatgctgaaaatacattttataatttccagtacttgcaataaatattacaacctattcacacaaatataaatgcatgaaactattttaattttaaaatataaaataaggagtcgtacatgaccaaatactgaatttttaaaccttaattaagttagccgacttatcatcgagaatgtgaaattattacgaatagtagcgtatagaaccttagcaagcagaagctaaaagctagtagaaaaattagccagatcctagcagataggctgtttatattgagtgggtttagtaagtctgcatccaatacttgtacaggttgattgacatcaaaatggaagacaaagtgaagtcatggcattattcaaaaatgaagcaaagtagccaagttttctactaaaatacaattgacccttgaacaatgtggaggttagggttactgaccccccatgcagttgaagatttgtatataacttttggctctccaaaagcttaactactagtagcctactgttgactggaagccctaccaataacacaaacagtcaattaacacatactttgtgtgttatatgtattatatactgcattctttttttttttttttttttgtgagatggagtggcactctgtcaccaggctggagtgcagttgcgcgatctcggctcactgcaacctccacctcccgggttcaagtgattcttctgcctcagcttcctgagtagctgggaccacaggtgcacgccaccacgcccagctaatttttctatttttagtagagatggggtttcaccacgttggacaggaatatactgcattcttacaagaaagtaggctagggaaaagaaaatgttataaatgttcttaagaaaatcatagaaaagagaaaatattaagttaaagtggatcatcattaaggtcttcatcctcatctttacattgagtaggctgatgaagacgacgaagagaggggttggtcttgctgtctcgggtggtagagatggaagaaaattcatgtgtaagtggactctctcagttctaacctgtgggtgttgttcaagggtcaactgtacatatatattctttcttaaataattatatgtatgtgtgtgtgtgcatatatatgtgtgtgtgtgtatgtgtatatgtgtgtgcgtgtgtgtgtgtcatagagatcaccaaaatcagagtgtgtacacaaatctggaggttacaattactgctccatgttgaagtgaagggcattctgggcatcatagtggccctgaaggtcctcttcaactctgaatcctccataccctcatctactttggcagttcccactcagatgctgcattcttatggcaatcaaaatagccattatttttcattaaaatgttggactctttttagtgtaatagttaaaaagcagatgctggagtcagatcctgtaacttcaaaccctagatctacctcttaccatgggcaaaagaagtcctctttgcctccatttcatctgtaaaatgggcataatactacaaagcatatttctggagattagatgaactaatatatgtaaaatgaatagaatagtgcatgacacaaaacaagaattaacaatcattatcctttttaagcttttacagtcaagaaattttgctttgaggacaaaaaaccaaacactgcatgttctcactcatagggggaagttgaacaataaaagcacatgcacacaggaaggggatcatcacacaccggggcctgttatggggttggggggcggggagggatagccttaggagatatacctaatgttaaatgacgagttaatgggtgcagcacaccaacatggcacatgtatacatatgtaactaacctgcaagttgtgcacatgtaccctaaaacttaaagtataataaacaaacaaaaaaaataaattttgctttgaaggatttttggtttttgccttttgagaggaaggtctaggaaatagattttataattaccacataatcctacattatcctacaagctaccctaaagtcattaaatatgactttacttttgtcatttatctcttcagtgtttttttaaaaaagtattggagtgaaatgttaatggtttcaattcaaattattaaattaaaaatggatctagagtatactggatttgctaatttctggaagtttctgcatttcgaaatattgattaacgatagataatttcttaaggcagcttgcagattcatttgcctgaaacagagaaaacaaaactttaataatggccaatcatgaatgtgattgatacaaagttaaacacttaagacacagattaaatagaataaatatgttcaaacttttattgtagatttttaaattgagtcttagataacattgcatgttagtcaaatatcacactcattctctgtatatatattatgtgcatatgaccttattatttatttatttttaacaaataagttttgcaatctttgcaggacaaagaagagatatttcccatagaattcaacagattagccaaaatcatgtgtgctggctcttagatatgtgaattttaagggttaagcagttggagcatgtggatttatgaatgctttttattttcaaattaaattatttagaaacaagtaaattaaaaatactttaaaatattttaaagtatttggcacaagaatttttttttttttttttttttgagacaaagtctcactctgttgcccaatctggagtgcactggcgcgatctcggctcactgcaacctctgcctcccgggttcaagcgattctcctgcgtcagcctcctgagtagctgggattacaggcaggcgccaccatgcccggcgaatttttgtatttttagtagagacggggtttcaccatgttggtcaggctggtctcgaactcctgaccttgtgatccacctgcctcggcatcccaaagtgctgggattacatgcgttagccaccacgcctggctcacaataatattattttaagaagtattttccaatattgaagaatctttgtgtcatccaagaacacatactacttacttctacatcacccgttaagaactctaaataccttattcattagtatagaaaatcttttaactctttcacagagaagaatgacataggcaaatggaatttgtatccccaggagtgtcaatttttttaccaaaatccaaacttaattttcatcagtgtgcccatttttataatgtgcttaccccagttgcaaatcactagttaacagtgtggagtgagaagttatactactgaagatttcaaaatgtgcctcagcttatctaccttattatgactagaataattataagaattaaataatatgcataaagcacttagcatattgcctattatcattactatgtagagagatagaaatgtgtgaaaatgggagtttttaccttaaggatgtaatttttcatccgtgtaagattacccaatattctataaaataagagatgttacataactagaaagttgtagccattcaaccatttttctggaactagctttattatcctctactaaaatggttttggccactataactttggtctttcaaatacagatcattattaagtttttaaatccagcagattctctccacaatgtctttctgctctttacctttgaggagtttttttaaatggcaaattattctatatcatctttttaaaagttatgacaattaaagatttaaaatctcagctaaaatattatatatggatttttagttacattttatgcccaatcgctagttgtaagcatagttgtaagcgtgctgaatgaagtttatttgcactttgtgtattcccactttttagttatgtactttataagtggaatttatttgactctaacttttgtaatttagataatcattgtttgtgttcaaattcaaatgtgaggaactttgaatgcatttgtgatccaagtcattaccaaaaattgtgtaaatataaatgagataaacaaaatagaaatggtggtctcatatgaaaggtatagattggtgtctgatgttgtatcctaattttatgtaccagattcacatgttaaaattctatctagaggtcctgggattattctctctcccttttttttaacatgtgttttatagtcaagttactaagtgaaaaaaaagaaaagaaaagtggtaatagaggaagttggcacagagaattgtcgctgtactcagctctttttatctttttctaaatatagtcttaaaatattgtccaggtcagctgatgtaagcagggaagtgcttcttcatgtcttctttctttcccagtcatttcaataatgttttggtgaattaaagtatgtaagtgaaacaaagaaatcagtgctgagttctgatagcaaattgaaaattgaaattgctaaatttccagatattataatagattgctaatctcaaaactaggactacattggtattctagggctaaagtgataaatttttaatagagatgtctcctacgagcaagtcttattataacatactagaatatcatttattctttcagggtgtgatttattctatttaaatataagtcctgtaaagaagatgtgttaatctgtttttactctacataaatatgactgctactctctagtcagtagatgtattcaaaagccaatatgtctacactctcacatttcttctgtaaatgatgaataatgttgataaatgaaaattacaaatccgcaatagagcttaactattgaatactaaatcattctgttgctaactccatgttccagtgacatttttgatataaaaagacgtcattcctgcatttaaaaaatattttgtgcttttgcagcaatataagcaaatgtacatttgaaagaaaattcacaatgcagccacaaataattccctttaagattcaaggtgccatttcaaaaatggttcaattttcaaagtagaatatttaaaacctctttcctgccagactatatccattccacgtgtttggtacaattaaaatagaagagttggtggaatgaaactcttccatctatattttggaaaaacatattcactcacctcagtttgtcagtgtacatttagaggctggtcattatgcagtagaaaaaagaagaaggcagctccaactcatgtgactgacatactgaatatggccattaatacaacttgacagtgaccttggcggcattacaggtaatctccctgcagggataaactgtgtttgaatgatatttctaccatgttgagcacaaagagatttctccttggaactttactgcttaattttcttttatgctaacaaagacattacagagtgatttttgtaatgattttctttttccttttgctctctgaaatgacagtttactacatggtattgctgctgtcatttttctgtcattatagggaaatgccatatatttgtagcactttcgtaaagtgttgaagtaggccaggcatggtggctcacgcctgtaattccatcactttgggaggcagaggtgggtggatcatctgaggtcaggacttcaagaccagcctgatcaacatggtgaaaccctatctctaccaaaaatacaaaaattagcctggcgtggtggcgggcacccgtagtcccagctaccaggaggctaaggcaaggagaatcgcatgaacccgggaggtggaggttgcagtgggctgagattgcgccaccgcactccagcctgggcaacagagctagaatgcatctcaaaaaaaaaaaaaaagacttgaagtatatattatttttattataggagtaaatatgtaattgaatgttataccacttttaacaaagttctaataagctgaaagtacatatcaagaagatataggctgaaaattcaatgttaagaaaaatcttttattatgtattttataaaaattatcagcaccaaaattagctgggtgttgtggcgtgcacctgtagtctcagctacttgggaggctgaggcaggagaatcacttgaacccaggaggtggaggttgcagtgagctgtactccagcctggcgacagagcgagactccatctcaaaaaacaaaagttttctgcaccataagttagtgttattaccatttaaaatttatttagattatgtaagataaaaatgtgtatttttatcaccaacttctgagatgttcaccatagaagactcatatgcattattgcttgtttcctactttagataagcttatcacacaggaagggaactgtgatgcgtaagattcaggtaaatgaatggaaaagatcatgacaaatagtgaaagtgtactcttcctcaaaacttctactgctgttgtaatctcagatttagtggtatgtcgatactgaaatgactacaaaaaagaaatttcacataatgaaagtttggcttattaaaaagcacttaagtaggtcgtaatttcttacttacagttgcttctacgtcatatttcaatgcaggaaatgaacagtgactataaaggaagagttttttccataatgtggatccatttaaaaacttttccttcctgaattgtttctggggtcttttggcaatttgaagcagctgttgacaacagcaattataggcaccattgacacgggaggatatgacagttgcagttaagcgttcgttatttgtaatgttcattctggcttcaacttttacatgcagttcaaattaattaacatggaattaaaacaggttcactggtccttgacgttttttagtatcctatctattgtaaagtattaaaaagttgcttacaatcaatgggtaattttaaatgcacaaggtgaactattttcatacacagaactcttaagaatcatttgataagaaaggcatagacatttattagataagacatgttcaataaattgcagaacacggcatttctcaccaattcctctataaatttaacctttagcagcacatttttccaattcattgtcaagttaatctatatagtcagagttcctaattatgtttacattactgacatacaccaaatggaaaattagagatatcttatccctagttataagttgtaagtaaatacttgctggtatactataacactatttaaaattttaaccatgaggaaaagagttgtttttggaatgactttaaatagaagtgcattaagaaatataatttgaatcagagaaaaagttagatttacttagtatttttggtgtactgtgttaaaactacaaatagcagtatattttcccagttttcaaagagtggtaacaaaaaaccaagcagaaacaaaacaaaaacccttctctaatctaataagaaataaacttcgaggtgtatttttagataaaagctctgatcgtggttgtacttgaatttgatatatgtatgtcactgtcaactgatttcggactttgacatataatattttaaaacaacatgataaaaatatttccttaggcctttttgagaacttggactctggagtcagcctcccttatctcaaaacccaattttgttgcttacttgcagtatagagttggacaagttgtgcattttttcaatgccttgatttcctcaacagaaatataatatgaagtataatcatgagattacgaatttgcctgagattaaggtccaattgaaatatagaaataacatgcctggggcatgctcattaaattttaccacttttactaggatgatttaaaattgtttcgcaggggtgcgatggctcatgcctgtaatcccagcactttgggaagcccaggctggtggatcacgaggtcaggagatcaagatcatcatggccaacatggtgaaaccccgtctctactaaaaatacaaaaaaattatccaggcgtggtggtgcgcacctgtagtcccagttactcaggaggctgaggcaggagaatcgcttgaacccaggaggcagaggttgcggtgagccgagattgcaccactgcactccagcctgggtgacagagcagcaagactccgtctcaaaaaaaaaaaaaaaaaaagtttcacaggaacaaacaatcaaacacaaattaagacgttgttgccaattttcaaatttatttcttcagatttttttcttctgtgtttccaacttgaaatagaatctgttaacatgataattttctggattagagaaagtcatagatatttgtttcaatagatcatagctaataaaaattttaattagaaatagaagaaacatatatattacatagttaacacctctcactttgttgtggagaaattgagtcttagaaaaaatgaataaggtataaaacttgaatttcagacacatgaaaaatgtagtttaaatgtaattgtgtaacataaattgtctgcctaataattggtctgcctcatttttgcaatgtctcaatagaattccaaagatagattgatttttttagcttaatttcaacaatttgttggttcacctttgagggttttttttggggggaaccaaatttaaataacacacaaacaatattttacgtgatgtaacatgtctatccatctcacatggataatggagtaagatacccaaatagaaatagaaatgcttttttttttaccatagaattaaaaaaaaaaaaaagcaagcaaaatacacatataactagagagatttttataaagcccttcatccctcccaaaaatgagataggaaaaacgttagggttgacaagataccaccccctaaatatcaggatgttccaaaataactccgtcttttgtagctcccaatcagtagccactgatgatctctgtctgtcataccctccttctccttctagagcaggactgaaggaggggcagtgtgtttctctggggagatggttgtggtcagcatcatcacgtgccctctccagtccagacatttcactgttccagaatagaacccacgcttaatttcaaggattctggaaaagaaaaagttgtttttcttcacaaattattgagatcctaacccagaatgtcatatttttaaagaagattattattatttagattctcataagcacatgaaaaatgtatctaggaagttgacatactggcagacatctagctacacataagaggggttttctcctttatctcacctttttcctactgcgaattttttcaacatacttaatgaaagttaaaattatgacaaggaaactatcacagtatttcccatttctttatttactgtaactttgtggctgttgaatgaattctcaggaaattttttttcactgtataatttctctttttttttttccatattgttgacgtttgtaatggcactgtttctaatccactatcttttattatatgttagagagtcattgattacttgctttcatcctcatataatagaaatatctaaatattacagtcacagattccacagacatgtaatatcagaaaacatgaaagtgagttagctttcttgttttactagattttttttctttcagtaaagctaggaaaatattattaattaattagtttagttttcatcaaacctggtgattggccggattcttaatattgtagcacccaaatacaggtaggaattaaagatctgaagaagccaacaataggaaagatgaattttaatggatcagatttcaaagaacttgtaaatattacaagatatttcttataaaatatactatgtagcatagaggattgcacaaatggtcaaagaacacttcatcagaaatcacaagccttaaaaagaagtatctggttgactaaagaaagatctgtatgaggaatggaaatctgaatgtattatgagaataggagaaatttcaaatagtataaaaataaaagttctaagaaataaggcttaaagttggataaggagaatcaaaattaaaagatgatttttatgaatttgtttaaccaaaagcaacaacaaaagataaaataaaacgtagcccatttttaatgtgctatcaggagtgtgtacgttccaccagggcatgaaattttgtctgttttattccctgacatattacatagaatagtgccttgaacatagtagtgactcagaaaaaaattgttgagtgaaggaataaatgaaatgcttctttgctttatttttcacctttattatgcagcgaaatgaacacatgcttgtagccacatacatgaaatgtaatacaagtatgtgtgacttatggaatccattgatactaagaaacaaaacaaatttcatggaactcctcctggaaaggtttgactaaagcctaagatcatttttttttctttgcttctttttttcttctttttttttttttttttgagacaaagttttattccatcatccaggctgaggtgcagttgtgcaaccacatctcactgcagcctgaaactcctgggctcaaacgatcctctgatctcagcttcctgagtagctggtactccaggcatgcgccaccacacccacttaatttttaaattttttgtagaggcagggtctcaccatgttgcccagactggtctcgaactgggctcaagtgatccatctgcctcagcctcccaaagttcagggagtgcaggtgtgagccacagtgcccggccctaagatcatttcagtagcaggaactattttaacataatggcattacggggccataggctgttagtcttaagaatttttgagtaaagactaggagttaactatcacactgataacatttcttaaatgaaggatgacgctgggaaccacaattagtaactctcttatttgcagacttaaaagtgtacaaggaaatattgccatgaaatccatgtgttatttatctttaaaagttcagggcgtgagtattaagcaacatagcatcatataagaactggtgctatgagaatattttcatctttgttaataaagtgtgaaggaaaaaggataggtataatttcaactttctaaggcttttgattttcttccatatgacatcctcatccataaattgggaaaatatcatctaaaccacacacagattttaatggtagctaaaggaatagtgaattaaataatttagtcattacattttaaatgctaacaaatcctgtataaagagtgcttgaggtctggcccttgaaagataggaattcagcataaccttggtaaactagagaagtggtcagaagtcttgaagccaaggagaaaaaaaaacaaactctctaaatacaaaatgtggaagagttggctagaaacaaatctggcaagggaaaaattacaaaattgaaataagtgaaaaggtaaacatttactttaaaattcatgcagagtgtggataaataaaaatatttatttgataagaatatacaacaaaagcacttttcaaggactatgtatatttttggactccagagatctaggcaaatctgatgtgaaatgatgagctgcaaagatggcgaaaaaataaaaaccagcgtaaggaaagattaaaagaacagacataaagcaatacacaatattgaagtgtatgacatgaggacgtgatcaccaaatgttgttctctgtacaaaggacagaacaagaggagtggacataaagtattctgtgagggattagctataagtaagaatttcctgagagtgagagttgtgaaacatcaaaataggatactgaggaaggttatgttgctccttttccggaaggccttaaaaataggagaggtggaatctttgtgaaataatttgggtacggtattatctgaaggagggaaaaatgatatgaccttgcataactcttgccaatattaatatccggtgtttctactcttaccttagatgaatggaaaatacaaatatgtatttctaaccaaaagaaaagatttttttctcttttttgacatggcaaaatttatcattttcataaagattcattttaaggcagttgaaatttccaagtccattctggaattctccatagtaaatttagtgaaacacaaaatattcatattaactaatttatttcaaagggacttggtagaggttttgttatgcttattgtttttctatttcatacgatacaaaagacaaatactcttatataattttgaaagttagaatcctcaggattgtgaccaaataataatttggtatgtgaactagttacttgatggaaatgtccgcttttttagcatataagagtaatatgcacactctttccttttcagaacacttattactggacccacaaacatacctgagggacacggacataaaaattatcctagaggtgtcttcactttgaaaggcagtatttgccaacagattcgttcttactgaattacaaatctcagagatttcctgtttaccagaagtcctcttggagtgcatgggatatagaagcagccattttgagcattcgctttgcaccatcaactgcctagcatctgaaattgaagtcagtcttacataggtaggtaggtagagatagatagatagagagagagagagagagagagagagagagagataatgtggcgttgttgccttatggagtttttgaatggttctgacctgttctcatcaactactacaataacatatataattatgtaagtgaatatagatgtactatatatgtacaaacataggtacatggtgttctgcctatgaaagtaggaaaaaagtctgacaaatgctgaatatatatatacacacacgattacttcctcatgctgtaggctctgatagagcaaggctacacaatacattgtgaaaaaactgtcatgttaacttctataatgcaccaaaatgtgcagtattttccaacaattataaatatatcgccaattatgtcagctgttcttatacaattagtatattttattaggcgtgtgtcttataaagttgaaagccgtaaaattccttctaaaataatgtacctaaagagcttgaattgcacaattaaactcagagctctaaaacacaaagtattctgaagaagtaggtaactgtataaaattttgaagtggaaacttccctgtaaatagaaggatttgtagtagaccataatttgaggagataaggagaagaaagagaaagagcataacgagaaggaaaaagaggagtggcaaggggaggagggtaaggataatggccagggtcataccagagctggttaggtgtgttttagaaacctactcaaggtactttgaaggaaagcaaaatgactgcttcaagctttggggatgagatatctgtgtaattctcatctgtaattctcagatgagaattctgtgtaattcttaacttcatcataagtgaaaatgactctcctgacccattatcaggaagacaattcttttgggtttctttttccgggaattgtgaagaatatatactgatttatacagtatacatttacctggttttccttgtgaacacattcatttgtagaaagtagaaaaaaaaaaaccaaaaacagctgctgatgatcatccagtaaattataatagtaaagacaaatatctaacttacattctattcccctgctggcacagggaagtaaactcatttttgccatcaagaataagaaaatgtgagatgagttgaagaacactcattttaaaaataatttgtagattccaccaactcctgaacatcacattttctacatagaattttaagttttaagtactcccttgaatattacttagcagcatagagaagtaacagagtatgtgattcgattctctgagtgtgagactggattgatatattgatccaatattggtatattgatatattgatattgattatagctctaacactagctgtgtgaccttgggtaagttacttaaccactctgtcctccagccttcttttctgtaaaatggaaattgtaatagtgccttcctcataggctgttttgaggattagagttaatatatgtaaagcttttaataccttagtattttcctagctattatgtatttattaaacttctaaatgtgattagtggtccaaagtgcataatgaaaccttagtcttaactgtttatattgcttgaggctgaggtgaacatatccttcaatattttaaaatatggaagaaaacaattctatttatccaaacaataacttgtcaatttattgtttctgtaggatgatacttttgtgagaatcattccaaccctcatttttgttttgttttgttttgttttcctcctttattgaatgcataccatttaggaacttgaaaggggtcttagagactgaacccggctccctttttatgtctgaggataatgagacttaaagaagttgactggcccaaagatatgcagctagcgaacccaactgagagtctgactccaaatggagctttctttccactgtgcagtattgctttgcgcttagtgctttgcggtttggaaacaaattgcactctttaatggcaaaataatttattaatacttttacttcaagtgaacagcaattttctgcacctgatcttatgtttgcactttttttataaaactgaaaaaaaaaagttttccattgttttatcatgtcttcagcaatactattgtattttccttgtgccaagcactgagccaagtattggtctgaagtatttcagcactgcagtgtattcattggtcaatgggaagaagcttgttattttctttaaagctagcatttccaagggatatctgaaatatattgggaaatagtccagattatgacattcagcatgtagaagaatatgaaaagtcctataacaaataaatcagttttccaaatatatttgatttgatttcctgacttttttttttttttttttttttgagaaacagcttgttaaaatcttaggaaccagtaatctctggaatccactttggggaatgctaatttaggcactttgggatctctaaggaaaggaaagtcgtgagcttgcctccacccgagagtgctttcttttagagtctaggtttgagagaatcaggctaaaataggatccattttagtaacttctgatctatagtacctgatcttttttacaggggaagcactgtaatactttccgtttagtgttatctgccgaggatgacttgggctatccttgaaaacagcctgggacagaatgtgtagacatgctgagataaggagcctcctgctaggccttcggcctagaaactgtctcagctcactctggcccagggcaacatccctctgcagcgtgcctgtccttgccctgcctggattgtatggaggaaacattttgctcgtctgagaacacctctattcctagctctttgacagtttcactttccatatcccctcagttccaaacatgtggaaaaagagataaagaaaggtgatgaaatgaaaaactggagtggggaatgctacaagtagagaggagaaactcatatttccatgtctggtttgtatgcagtcatgactgggttttggagggtgaagcaaatgtatcccagaggtcatcctactagatagacagggagggaggtgagaatgcaatgtgaaatattggttagcactgagaagaaaatcaaatgcaattttttgttataatatctataccatgatacatttagaaaagaaaaatatagtttttatttttaaaaaactttcagatttatgtttcttttgtagggcatttgattgattgtaaatgaaaatcgataagtgttcatttaggcttcatggtaaattatataacttaccctattttaaaactgataaattatgttcaccaaacaggaaattagaagaaatggtttggaatagagaatcaaatctatttataacttcctccaaaaaagaggagggagaattgaaaatatatacccctaattccttaaggcataggaaattttgacctttccttaaaatactatcatttgtcattaggcatttctgtttcacaaccttaaaaattaaagtgggagcctgttgtcctttaattttctatttattagaatttataatccttccttttttttttttttttttaagatggagtttctctcttgttgcccaggctggagtgcaatggtgcaacctcagctcattgcaacctctgcttcccaggttaaagtgattctcctgtctcagcctcccgagcagctggaattacaggcacccaccaccacacctggctaactttttgtatttttagtagagacgggatttcaccatgtaggctaggctggtctcgaactcctgaactcaggtgatccacatgcctcggcctctcaaagtgctgggattacaggcatgagccactgcgccaggcctgtatttttttcttaaaaacgctttcatttaaaatactagataattcaatttgtctattcattccaagttggaaattaatctgttgggcttgaggctacacagcttaatctataggtggggatgtccaaagatacatgaatatttccaatactgtgagacactgggattttcaaatactgctgacatcttaatcaaagctctgctgattacttgggagttgggtcctttgagagatgaaataaatcaacctagcccactgacaagttacattagtacggttgtaagattgtttttttctcaaattttaaaaagtgtgatttttatataattctatattttacacttgcagaaattttgcattgtatttatcagattcttcatggtgttatccatagttagcattgtgaaatgaaaagaggtgtttcaaccagtggccattgccatcatgaaatactcacatttcaagggaagagggatgcttttggactcaattgatgtcaatttagaaacattttgcattatgctatattcctagagcttcaaagtatttacaatttttataaaattatataatatcagtgaaggaagcaagtttacacaattagtgtatgaaattgagttgtatccatctgaatttttacaaatgagtgtggttttgtcttttatttgagcctcacaacctcataatagaatgtgtatgttgttactattcccactctatagagaaagagactggggtttagaaaactatgacttggccaggcttgtaccaccagtgacaggcacagtgacggagtattcatcctccaaataatgtctgactccattgtggattagggctttcctcaaacgtcatctcctcaaataacccctccctataaatcagcccaatagatagccacctctgcccttctccacttcatcaccccttggtccattccactgcgatattttctctatagcacttctgtatttaaaatcatcatattggtgcacttgtgtgttgccctttttccccttagaacgtaagcttcatgaagactgagaccttctgttttgttttcagtggtgtccatggcacgtagcatcatgcttgacaacttcatgtctctgtgactgattgaattttgtcattgatatctgtgatattaagcatcatgattttggctcatggtataccccattacagtgacttagccagggtttgattcccatgtactccaacctgaaatctacaatcagaatacaccaagtatgttacatgtaattggtctgctccaaagctgtggcaggtagcgtggactgcattctgttagaggacctgaactccatgtgtgtgccttaatctcatttctgacatttaactgtcaccctgcctgcccaccaccctgagagaagttctgaagtattcgaacagtgtgttacacagccccagcatgttttacagtgagccagggcagtcatggagaggtctcttgttctggagttttgcacagataaagggaggatatagttttgagaggaatgctataactacaaagtgcatcctgaaggccatttagctcacaatgaaggtctgtgttttaaaatagcactataacaaagtaactacagagttttggcaagggcttcaactatttatagaactaagtaaggaatagtaaatagtgccacagtacccagttctcccttgccataaccccaaacttataagaagcactataattatatttttctacttaaaaaaaatcgtagtagccattatcagtttaaccatacggaagctcaggctgagatttcttttttaaatgcatagttttgattttcagcagctgcactgggtctttaatcatatattatctttatgaagcctttttctaacatatgttaattggctgttttctgtgacaaattatgagctcttactttgatgaggttcaattgcaatcatgttggagtcgagtacgtagagtttccacccctgctggctcctcaaaccactacaaacatccgcacgtcactacagtgctgagtaatggcaggatttgggctggctgatttctctacagatttttttttccacaggatattttcagcttctttgtactaaatctgttgcagggtttgccctttttagcagaagcatgctctaaaattaacatcaaatcttattggagattactataatacatgagaaatatttcataattcaacatccagtgtctgtactgctttgctaaaattttagtacatttattacacatttttaaaagtcagtcagttgtaaggctggtaagtattttctatatcatcagcattttgtaacaaatattttgaattttcctcttgagagggatacagttattaagtgaatagatgatcaggtatatatttaattatcataaagaaaatgcacataatgtttttcctggcattaccaaatttatcactatgttaaaaattccattgtattttcatttttctttgcagttaacatctgttggttgagtcataagaacaattacatgtcccatcaaggctaatgtcctataagatgcatagcatgtatttcaattctctaacagtttttaatgtatgattaggatgaacagatatgttctaatccatctgctctgagaactgtgacagcctgcatcaagtaccagcagatgatcagtgatagccataattagcatatatatataaatacagtgtatttgtttatattcacaagaaagtagggtaattgattaaagccttcagaacctgtgtcagacaccagtcatagtgggattaatttaactgtttctgctttgacatcaaaatattctaggtaaactgctgcagttgttcaaaatctaaatctatggatcaaatcttcatacaggtattagactttagaatcagatgagccagatgtgaataggagctactcctcctcatgaggctgtttttaatcagtcatttccctggagtagcacacaatcaatgagctctaaatcctgaggctacctgcgcttgtaggaaggcctgggaacatcattacagaacttacaattgggcatatgtgaaaaaattagagcagaaattaagggtaagaaaggttaacttcagaagtcttactttggtactgcttttttagagggaggtaaagagataatttcaaatgttaaaaaaaaaatagaatattaagcccaacttctaaatgcagagaatttctattaaaagatcattataagcaagccaaataaaagttattattgatttatgttagccagaactgtttaaacacgtgtattatttcgagaatgtacatgtgggtccatttcaggatgagtaaataaatgtaaagattctttttcgctagtacctctgcagctgtatagaatggcttcagaagtcctatgtgatactttggtgtgcagtcaattgacacactgtgtctggagctaatgtacataaggaaatttagttccacttgataagacacatgcttaactggctttaagaaaataaaccaagaacaatgtgtgaatgaaacagagaacttggcacttgactgtatggaagcccatgagccatgtggtttaattggggccagttgggatcatttaatgattgctgtcagaagatcagatttaattctccttataagaagaccacagtgggatagagttaaacaaattgtcatcagaggtttcagatgaacaaagccttaattaggttgattaggatgctgtaaaagagatgaagagaaatagaaaaattgatgaatcactgagttccatgttgagccacatataatagcaatatcatatatattttgagagatagtattatagcattttgaacatcacatatttgagcatgtaaagtttctgtgtaaaccttctaaatgtgaaggtttagagataaaaataaatgacattccacttaaataacagatgatttatctagcattttctctttaatgtacaacaaaaacattggcagggggacaatggtatttcttcccatttcaaggtcatctttaaatgttaagtaaattggaaaataaataatgaaagaagcaaattattttcaaggacataattttcaatcatttaacataatatttgaatgcagagtaaaataaagcttttactgagaacgtccttttaggcattcacaccacgatcttaataatattgtgattatttactggtgataatactcaagacaactcaggtgtcttaaaatgtactcttattgttttatttacacatttcgacagactaaaatgtgtttttccatgtgctgtgcacacatgtgcacacatgcacaaatgtatcagtaagactgaaatatgtgttcaacacttataggcatatgagaaaaatatttttagagtatttccattttaatcgtgaaatatgatatattaaagatgaagaatataacgaacataatttttttctaacagggtcatgagatgcctgggaatttagatgtttttatcataatagcatgaaaatctataatagcaacatctccaacttctagcctagcttgctttacagactattttgtttgactgaggttgatgttgtatagtgcttaacttgctttgttcaataacagcaacaaaaatccagctgcatgtgcttactgagaggttagagctggggaacagaacacaatctgatgttaaattgtagctcttgctttgtcataagacagtgcaggctttacctttgtggtgagccctaccacatcactcagaggcctttgaaagaaaacatggtggctgcactgttgtgaaaaattagaaaaacaaagacatgatagaaccctgaattaattacctaatatgatgtggaaagactaaaagctgtggtagggttggatagcacaaggttcttcacatatttagaccatttggagtttattttggcatgggaatagagaatgctattttagctgcagtgtgaaaaaagtgtccaagacaaaatagaccatggataactatgacagggagactgtgcttccctcacagttattaaattgtttataatgcaatacaattgtataaaggtatgtgtctcctaaattctggaactgtgtaaataaaatgatgtatgtcagggataatggcaggttaggcccacttattaaattaattgcaggggttaagaaaacgagttcctttttagccttattatatttctgacatacatttcatctctttttgtccttggggaaagatattaaagtaggactagaagcattaatgtagagttttcagcagccgtggtcatggggaaaattgatgtatttccctagttatttccacttttgcagcctgaagctcttccgtagctgatatgtaagagaaacttcttaatttttttaacactgtaaatttattcttcatttggtgattattgttacaggataaatgaggcattatctgtcagaattgctaatcattagctttggaaagtgagatcttcatggtaaatgtaaggactacactattcacttgatagcattactatatgataggactttcactttatgccttcaaacggaagcaatcatacgagcagcaggccatgttcccagtactactgtgtacccaggattcacatatagtaccacatgttatgatcataaccatcctacaaatgaagatttttttcccagttatgggtagggcaaggaaacaacagttccaagggattaaataatcagtctggagtcacacagcgtccaagtaccaagctagaattctaaccctgttttttctgaccccaaaatccatttaacttccaattctcagtatcaattattctaattccacataggagatgctatgtaaatatggcgaagtattaagtgaggttatcaatctgcttctgtgtaagcaaaaatagtaaaatatttttagtagtagtcagtaaaagtagaagctgaagaaaagaaaatacgtcagttgagagatacacatcttaactgattgtcagtcaacgaatagtcattagctctttctatatgtttgacactagggtatatattgtggataaaacggtgaaacaaacaaataaaacagatgttgaggaagacaagcaaacatacagtttcaattgctgcgagtgctgcaaaggagaaggactcagtgcttagatcttatgagagggaaattcgatgtcatcaggagggcgtggagtacttcctgaggaggtgaaactgaagctgagacagaagggaggagaagtcaaggaggtacaaaaggaaaggaggaacatccaggcagaaagaattgcctagtacacaaaggcctagtggcaggaaggagcatggcagatgtgaggaaatggaaaagatggtcaacattatttgtatatgtggtactatgttactgagacttgaagatggtttgaaattcatattgatactaaattggaataaattaggaaaataaattggcatatggcatgatggtatttatctagtggaaaagaatagctgttcttttattacccttagaagagtgagtcttgggtatgtgatttggaaataaactcagaatgcactcatagctaaggtaatggtatatttataaaatacatggtaagcttagagagaaatggagcaactttcaaggccaaagaaatcctcctcaactcaagacatcacgcagtcgagcatcaataggagtagtaatttggttataccttttgaagttcagaatagctcctaatggaaaaaaagtaaaagttctgcctgttccttttaaccaaaatataattgcatgcttcatacattttatcaaacaaatcacaaaatagaaacctaaatgtaactagatgtaacatattgagcaaagttttccacttaaaaagataatgaatcatttaattatttgatttagcaatactaggtttgcagcaactgggcttatgatcatttttgccccttacgatgtatccagcttgtatttatttaacagtattatttagtgttgtgtgatagagtgtgctcagttttcagctttgagtttttacaaaacattatttgaggatactagtgttagtgaaaatgtaagtcaatcaaaaagatctgctaatatgaatcaaagaaaaccggaatttttttttgaaaattgacatcacatatttcaatgttttaccattattcataggctgtttttatttaagtgactgcattgtacttattgcagaaaaatacatgctttgcaaagataagtttagcagaagagaattaatttcttcccacatcttttaatgtggcatggcagtttcactctaagatcaaaacacataactgaaggttatgtttaacttctaaatcaaagtgttgtgggaagatgattgaaatctgatgatgactcagatacgcttgatatgtggttttcttcctacagaaaccttatgtagaatgccatttccatgttagaaagaacctaatagtgaggagattaaatagtttcactatagatgcagagtttgtgttattcactttggttcctagtttgaatttttttaaagaacctcgagaaactcaataaccataagaatcttttccccctcagtatatcttttttttttttttaatgtgggagcaaacaaatgattagcatattttaccagcatgcattgattttttttttgccggttttcataattcttttttttaaccaaaagttttaatgtatctattttggttctttgcttgcatatttttcatttgcctcaaagggtaaattccaattatatgactgcattaactgtgtacgatgacttttgtaaggcctggtaaacaataactgagatatatctgctatttcaatgaagtcaatgtgtttgttttcttattttcatttcttaaagcaatcataataaaacactaacctagagctgacatgaatttttctcaggtgttttaaagatggaaattaaaaatcacgctcccggtctgaattgtcctcattgtcccttatctgaacctctccaaggcctctgtgtgtggggtgtgcagcacagcacactcagacggttctgctcagagaaggaagtggagagttttggttcccattttacacttctggaacagtttagggaaggaagcacctttacaccttttattgttcgtggttgctgacatcatatccttccctgaccagtctgtgtgcgtgtttcctgccattctgtcaaaattcttctgtgctactgggagagatttgtaggagggaaggagggaggaagagggcaagaaagagtgagggagggaggagggaaatggaggggggaggtatgtgtcactcaagggaacttgtttgtaaatgagatagcccagtgggagaatgatctttagcatctgtccagaagaaattcttctcgacttgggtctcaaaccactttgccttcatctgcctgcttatgccaaactcaaaatgagcagaagcctgccataatgaagttcccctttttagtaagcagcctcattttagttttcttttatctgggttggcattttttctttagaaaaaaaaaatgcagaagactgtaattctatagagtgtaactatagtagagcagttcttcatctttttttttttaaattagtgattatttatatgtagctctgtcattttctaagaatgcttctttcctgtggaaaaaaagtagtggcaaggctgttggaattattttaagcttatggttgattgtacgtaatgaaagttctcagcataacttgaaattttactacatgtaggctagctgttatattcctttttcatatacacacaaaacagttttacagattactaaagttaaataatctctttcttcgcctctctaggcctcctacaaattgatacttgaaactgaccttttaatatagtttttgcataaaaattaggttagagaaaatgttgtgctaagaaaacaatgcgtgagctattgttgaccttcctaattctttaaatttttagtgacagccttgaaatgtggtgacccataatcaaatgttctaaaccacgtttcatgatagactttacttcatgaccagttacttagtgtcatcatcaccacatattactctgcacgtgtacttcatactaaattttggattttagaaatgttctgaaggcaatacctcaagaaatatttatacagaaaacaaaagtttagttctattgaaatttaaacttgcttctctctacattgctttgcatatttcaaaaaagaaaatatattcaatggcatttttatcaaccacttatatatacatagatacatacacacattctctttggcaaaatttttttccagcatgttttaagaaatttttttttaagtccttgctctgctctttttaaaaatggtctcattcaaagttgtgaaatatggggtgatgatatggaggaactctcctaagtttggttcatcaggaactctctctgtctttctgagacttttctccaaggatgttttgctgcttgtttggttatttgtattttgaaatcaggatctgtagatgttcttgtctcttctgccttatcaccacactctaatctgctcaccctgaccttccaccttgaagtgaataagcgcttaggcaggcatagtcctgtaagccgatagtgccaccggcctcagctaaatgaaaggaaaggaaattgtcctatatgcatttgctgtggattcatggattggctttctgtgatagagaaagcttgtttgtatctttggggtcttaaacgtgcatgggaaataccattctaacacactgcttgcttctaaggtaagactataggaaacacaggaaagttgccccattgagtgacatttaagacgttttctaaaaatagatggacagtgtctagcaacatcaaatatatgatgcaattatgctttgtgggtttttcatattttaatgtgatttcaatatgttataactatttttatatgtatttgtcaaatgtgtgttatttctataactctttagaattttgaaccacctccaacatttaaaattacagctggagcaatagtttttgatgagcactgtgtggtcataatgttactcaacatacatattatgagaggcagaactgagctgcagtttagtagagaggcgtgaggcaaaagagaatggatagtcttagtatttaagcagcacttaatccaccagaagtaattatatcataatagcttctgcaattaaataatcaccaaaaactaaaaaaaaaaaaaatacccaaggtgataaagaatttggaaattaaattaaagaaatcagaagacagctaatggtcagaccgaatgtgtaacagccttcctgttccaagaactttgaattggagccaaacaatctattaaatagccaggacattggcttagcattacataatacatgtgggaatttatcaggtccgttgtcagacaccagctaaaataaacagggaaattctgagcagtgtgtaaagttgttgcattcattgacctaaaacgaagtagaataattggagctgttgcttgaaaaacccattgtggaatgctttcttgttaactttcacatttcagagcaattaacttccgttgtgttcaaatattttcagatgtaatttaaaaccaagtaaagtatgtacttttaatattctgggtttcttgggcttatctcatgttattgatgatcatttctctaattttaattcctgacccagagatctccagtatgtaatgtgaagcttctgcaattttgtatcttactccacaaagacatgatatgtctgtttctaaatatttaaatttaaaggaaggatggcttgttataaaaaatatggttataaattgaagaataatcttaattttgcaccatttattttgtgtcaatgcttatcttttttgattcttgttatctaagatgtagtttaagggctttcaaaaagaaaagatctcactgctgatagatgcttgtaatctaagattaaatattccatattatttttaaggtgttctcacagcaataatttttttaaagtaagattaaaggatttagatttaaattagttgacatttacatatatcaaatagcactttcataatcgtccatcctatttgcataacgagggacgttatcacctctgctgtcaaaacaggagattgttttcccttcagaaatgaattagctgccctacttagcatacacaggtacataaaggttcattaactctctgatttaggtaatttttcataacgggtgaaattgtcacctaatttcattaaaaagattaggaaactttttacaaaaaaaaatacatttcaagtgttagtctttaaaaaagcatagtttgcatcatttaaatgacttgttaaattacttatgagatcattttaattgttaaaaaataaaactacttgatctgctcctgtctgtgatataccatatatttttaacaaaaaagttatttttattcattttattgctttagctccatatagtttatttccttgataaaattagaatatgatagttcttatgaaactgacttgctgttagagtggtatttaatttttcttttttgttcagcaggaacgaatgcaggaatttgggaactgagctgtgcaagtgctgaagaaggagatttgtttggaggaaacaggaaagagaaagaaaaggaaggaaaaaatacataatttcagggacgagagagagaagaaaaacggggactatggggagaaaaaagattcagattacgaggattatggatgaacgtaacagacaggtgagtggagtaaactttttttgtatcattatttattaattatattttctccacatatgttaagggtacagaaaatatcttgaatctgtaaatatctattaagagaagtttgggttaattaaatgtgaccagttaaagtgctgatagtctcttatatataaaggagaaaaaaatcactttatctgtcagaaacatagtttacacatttgtcattattcactttttacttcaacacaaatttgaaatgggaagtgtagttgtgtgacatgaatagcttgataattaagagttaatcagcataacattgctacattgcacgcatcatcaaacaaagatattcttatattcatgggaactagaccttttgtggtcattcacttaaaggtttataatataggataaatatcctgtatgaaaatggctttcattttattcatagtaaatgagattttgaaacacatccaaacattttaacattgtgctgacaacaacaacaaagaaaacacccacacaagatattaataacttaaaacatataggcaaggactatcggttaattcataccattttaaatctgaatttgataaacatagaggcagatggtgttataatttttttctagaatgccaatgataatgtctgtgtgatacaattaatctgttgtgaagactttacacattcaaatgctcagtttggcattaaagacttgtatatcatgaatgcctgcaatttgactctatttttcttcacactaggggagagtggatttagttaggctatgtaaggacagctgggtagtttgtataacgttaaatatcaaataatggtcctgggagaaattatagtactgctgggtcccaaccatctcatatggatcatggaacctgcagagaagacgtttctggactgtggaagagaagagtgttttgcctacttttcggttacactgaagaaggctacacagtagccctggggacaaccaccagactgtaatttccccacaaatgtagacactcatgtcctctattgtcctgttttgtcttcttggacatacaaataggactagaactgattgattcatttttttaaatgtaatgttgtttcatgtgtaaactataatgaataggaattaattatttcttgcatcaaagtcagtacgccattaaaaagtagagaaacttttaggttttcaagtttatactcctctaaattattatatattttcaggtacacacaacttgaactatttttggctgcatgtttagctagagggtgaataatactaagatttatggtggattcctttagtgttttcatgcacatcgtttcttgctgtggatcaagccaaagagcaatcattgtgtcaatagaaaaccgctattttttaattggcctatagcttgaaattgaaattaagactgaaatattgaatgtcatgtaacactgtttggaccttgttatttggaccagaacctattttgagtatagtcaaaaacatatgaattagcatttgcactttattaccaataccagataatttttaggtttatgatattcattatatcttcttttgcttgcaaagttagaagaaaatttttgcaggttgaattcatgagcttttattatgctttattagaaaaaacagggatacaagattttttaatttctatttttaattatgggtacataatagttgtatataatatggaatacatgtgatgttttgatacaggtatacaatgtgcagtgatcaaaatcagggtaattgaggtatacctacctcaagcatttatcatttctttgtattaggaacattccaattctactcttttaattactttcaaatatatgataaattcttgttaactgtagtcaccctatgtactaccaaattctagatcttattcattttacctatttttgtatccattaaacatccccactttatcccctccccactccatgcccagctacccttcccagcctatagtaaccatcagtctactctctatctcagtgagttcaatttttaaaaaaaaaaagtttagctcccacacgagtgagaacatgcaaaatgtgtccttctgtgcctggcttatttcacttaacataatgtcctccagttagtttcactcatgttgtaacaaatgacaggatttctagggatacaataattttaaagccgggagtggtagttcatgcttgtaatcccaacactttgagatgcagatcactggagcccaggagttcaagaccagcctgggcaacataaggagatgcaatctcttattttaaaaagttaaaaaaaaattaactgggtgtggtagtggcatgcacctgtgttcccaaccacttggggaccactaggacccgagatgtcaaaactgcagtgagccgtgatcatgttactactacacttcaacctgggcaacagagtgagaccctgtctcaaaaaaacaaaaaacaaacaaacaaagaatcttaatgtcgcacttttgagctaataattgaatatcttttctttttttatatatagttgcagctacagtggctgttaccctcatccaggttagaagtcataataactttagaagaagaaaacttatttaaattcagcttagtttgacttatcatttttttaaattctgaagacagatttcttgattttattctttagaatttagggtatatttattcttttctccagtctttagatacagtaggcctgtaagttcaatacttttaaacagaattagtaaacttgaaatccaccatgttttaatatatatttcagtgattattttagaggctgttgacaatttcaaacatcttacatataaatgcttgtcttgtgcacctctcacctactatgagagcagttgtaagagtcatttgggaaagagcctaaattatgtaggtcacttctaataaacaaaaccagcaaatccgaaacagcatatcatactgtgtagaggcacccgtaacctgggctttctttcaactgtgtattcacatgttgcaaagaaaaatgctttgccctctttgaagctgccccactgtagactgtccagtagaacctcatgcaatggctcactgtcatcttttcttaaaagttgtcaaagactgctctgccattgcacttgtttatttagctatacacagaataagttatgttttttccagaaaaagaaatactgacttcaagtgtgaaatgaaatattacagcactgatgttataagttgtatatcattaagaaataaaactgttgtgaaatagaatggctgtttaaattgaattttacctttactttagctgtctttcataatggaagtagggaacagctcaaattcagaaacatcaatacatgaaatagtttaggtgagaataaaaattgacagctcaaattcagaaacatcaatacgtaaaatagtttaggtgagaataaaaattgacagcttttttatttaaaaaaattttttggcatttccaagtttacaaaaactatttctttcttagtttcaagcttagacaacatggatttcttaagcaagtatgtaaaaataacattatgaattgttaatttatcttacagaaattttcagacaacctaataaaagtagttaccaattatgtgccaagaactatatatatatatataattacaaataatttttattaataagtcccattttatggctgaataattcatttatctgtgaaatcaacaaatattactagactgcagtgtacctaacaccaagtattcagtggtgaacaagaatctcatccagcttatcctctgctttaggggttcagcgagctttcctgtaaaggaccacatagcaaatatttttagccttgtgagccatatagtttttgtctcaactactcagctctgccctagtagtctgaaagccgtatgcagtatgtaaatgaacctgtgtggctgtgctccaataaagctttactgacaaaaacagggcgtttggatttcacttgtaggctacagtttatggacccctgattgagttaaacagacatgaaatataaaaatatataacaaaaatttcacttatatgtgctatgaaagaataataggaggtactttatttacatcagggttggagaaaggcctgaggaagtgctaaaagatgagctaaaagatgattcagagttaggcaggtgacagcattccagaagcagtatttgcaaagttccttaagagaggaaagagcttgactgaggagctgaaggaagatcagtgggacttaagcctggtgtatgactgtagagaaatgagagaaaagattggatgttagacaggacccagatatcgcaaagctttgaaggtcctgttaagttctaaataactggctcaagattgtacagttaaaactgggaagtgaccaagatctgagcccggatctctcatattcaacacgaaacaaattatgctttttaaaattatgtcatgatgcatctagtgtaatataataactaagagcatggttttgtgtcattacttttcccaattatactgcatccagtataatcaaatggctaagaggcatagtttttagagacacacaaacttcgttcttgtcccagttctgccacttactagctatgtgaccctctagcaagttacttagaccctctgagcttcagcagtaccctcatcactagagtgaggatgaaaaaaagttagtacctttctcattaggtctttaagacaattaaatgaagcaataaatgtaaagcacccaccaaataataagtgctcaataaatttacctattagctattcctattaagactcaggctctttgaaccattagctattatagttaatgtgatttctatcaaaacaactcttgtactgtgtagcacaataaagaatgttacctaaaccttcatttcatgagggttttattttaaaagggtattgaggagatggatggaaaagtggaacaggtagagcaggagcacaaaggagccttcagaagccaacaaggggctagagaatgataccagagcaggagtgagctgatgcagagaggatagtttgtggacaagaaggaaagatcacacaggacgtttgcagaggatttatgacaaggatggggagaagtcgtttcctaaatgttatgcttgtgggacctgttttcaaatatatgttactgaccaaattatttttaactactcctcaccatttttatcactaccagcttctagcttatgctaacactacagtttcagtctctccgtcggcattttttttttacccttgaaatacctccatcagttaggcagtcttaccctctttcacatggtaccaatttttaatcatgctcctgaaacagatttttttctgtgacacttttattgtattttacagtaacatatatatgcaaaggtttaaaaagttcaacaacaaactggtttttatgaacagatggttttgggggtgcttgtttcatttcttttgtgtttaaaattttttaaattaacaaataattgtacgtattcatagggtgcacagtgatgttttaatatgtataatgtatagtgatcaaatcagggtagttagcatatccatcatctcaaacatttatcatttctttgtcttggaaacctccaatatcctccttctagctatttcaaactgtaagatatattaactgtagtcatcctttggtgggatagaacacttgaatgcatttgtcttatttagctgtaattttgggtcctttaacagtttttaaatgaatattgtccttatatgactctttctacaaacaatatatttagaaatctgttatattaggaagaaagatatataaaaattaggcatgcttagcctaaacctatttacttgtatgtttgtatttgaaaatttcagctttcctactttgaaaggataggagaggtaagcccaaatttatttgtgcaacttgttataaaaagacatttaaatatttgtcagataacacagttagggcttaaaatagtaagttaagaaagaaatatatttaaatgccttaagttttcttttctttcatcagatctggcacactaatagtttttgccagcaaacaaaacttcatgtaattatcagtgcaataactggagcacaaactaaagacaatttgcaacattctgttaatagaacaggagaatccccttatgactaaaagaattcagagttcatagctgttacattttctaactttccctcttcttatgtccccatctcagtctcttcatatgaattataaattatataagatgaactaggaaaaaagctggaaaaatgtgttcagtgtagatgcagcttctgacagtttctacatactgatgtgttttcaaactaaatctggtctattcgacactaaactgaaaaataaaaagagatgtatagattccctcaagtgactctttaaaaagaaaaaattttactccttactttttcctggttttcatcaagttaattacagttctaaatttgggagttacatcttaataacctaatagaaaatttgttgaaagagagatacattcactctttaaatgtgagtaactggataattgagaaatacaaattaattgcttcaaaaaaataatttttcggtgaattccaaaccataagttggagaatagatggaagatgcagtctccactgctaaatgcactttttttggccacctccacaaacagaatttccagacttgtgagtttttctttaaatactgtagaagaattatacttgttaatcaagaagtatctggaatctctttcagacctagtgaaaaaaagctcaatcagtgaaaaattattgattttcctatcttttaatccaaaataagcctgcaaatacctcataataatgatgatgatgattgttttttcttagtatcatttcttaacagatgcctgcctccccaacacttgtattaaaaattatactaaacttatttcatataaataaaataagggtgtgtcatagtaatattttaggacatcatacccatcagaattgaattatagggtctattgccacatattggggatgccttcttaaaagctcctcatgcatataagttaaatcattcttttattaatcttaaaattaccaagggaaaagtttttattcaaagatttggaattgctggtgattgaagagttgaaaaagaaaaccagaagggaaaatgacctaaataatacttgtaagagtttccaaattaaaaaaaaaaaaaaaaaaaaaaaaagcagtaggcagaatgctcagatgtatgtttaacagctgtggcctcaggccattcatttccattttatcccttagcaatttgaaaagaattcacaaataatctccccaccatgtagtaggatcacagcaacagtgtgccacacatattactatttatcctgttcggtgcatgatattttatatttatgtcagctagatctactcctttactgccagaaagatattgctccaactcccgtcaatctcattcattcactttcctttggtaggaaatctgagagaggccaacattttcataaggaaaagaataattgtcacttctagaattctgtcactcttctttgaacttgagggcctcaagggtttttattgtttccagttctaatttgtatatctcatataatttctacttaaaactgtaatttaaaaagaatctgatgcttttatttattgtatctcattttgtgaagaaagttgatactgaatggcccctttcacctctgggaatgcatgcacacaccactctgtctgctacaagtcacctttagctttgcaaatgcacaaactgtgtgacattgtattactgagaaaccaacactaaaaatattaacattataaatagactacatacaccgagaagtttcttccaaactgtagattaaaagacatgatgctaattgtttcaaaagccatgtcctctgcagtctgcacttctttaacatttagttcaaaatgaaactacttcaaaaattattagggtatttttaaagtttgcatcccaatgtattcttgttgaaggtagtttggaaacttattttttctgaggataatggctttggcaaaaattttaaaaaattaagtaaatgacatcattaaggaaaaaaattaaaaattgataatatgtaatgtgtatttgtgtttcttttgaaatatgttggaccattaataagaattagagaaccagtctaaatgtttggaaatttgacttttaattttaaattggaacagtttaactaaagaaatcactaacatttaaataacatttcaacaaatgtaactgtttggaaactataagggagacagccttctgtcttgcaaggattgatttggaaggccctgggggagaaaatattggagttaggaggtaaaacctaggctattgtggaaaggaagaagttacactcttcctgttatgacaggaaaatgtagacaaatgtgcttcctgagcatttgctcagcagggaatgaagtatcctttgacctttcccttaggtacatttggctttgttgaactagtaaacatgtttttgcccccaaaatattaatctggtttatttgattcttctcagattcaaattatatctcttatgtagatgagatacagagaaacaaaggtatttattttatgactgcatctacagattggatttagaatgaaaattagccctttaacaaaccaggcagacttgagcagcccatataaaaaatgtgaagcctgctgtgttagtcttctcttttcaaaaggcaaaacattcctaggccttaaaatgggccacagtaaaatctcttatatcctgatcaagttaacaattttcggtcatccttcttccttttcctcatgcagacaaatgcatcagaattcagctgtcacaaattttaaaactcaaacttttatgagtttgttaataaacactcgtttcattaatgtgcattcgattatttaatttagatctaactgtgatttattattttccctccaatgcataagatttggagttttattttgggatttgggatgttgacttagggtgaggggttggtagagttctaaattccacactctaagccccttattttaatccttttatcatgttcagaattttaggaactactgcttgaaaatcctttggaaatactactgtatttcagcgaaacggaggctcaatttgcttgaggctaacgaggacaatagtcccctttgcggcagaacacactgctgtctcatcctcgcaagttatgctggagggttacaagcacgtggtagcagtctgcttaaaagagtccctcgctgctctttaaagagcctttcatttacgatggcaggccccgtcattgtataaaggaacgcttgtctagaacacaagtctgcagaggcactgcttcctcccaccgagagtaatcatcgggcctaaagctcgcgagcctttctaatgacagactgaattaaacaaaataaaactgaagaagaatactttagaacatttgtgccattacttactgtcaggaacaagggaggtggagaaagagcatttaggagggcatttccctttttcccaattaaagattgtcgttgcagactcttgactccagccctaaccctttaaacacataggaagacctgtggctcctggattacagagtgtattgtatctgtgaactgtccatctgtcactcattagtcattctgtttcctcaactgggaggaaactgagagattatctaggtggggggatgaggtggagtagccgacctgaaatattttcacataatgagggttatatttatcatgactcttatttggagggaaaaaaaatgatcaaacctcaaacctttgaaaatagaattagctgggtatacgaatcccaaacacatcctaaaacaaagaaactactatttatgagttaaagaatggtgaaaataaaaaaataaaaaattatccattcattgagcactgtaaggttcaattaagattaggctaaaaatattgtgtttggtggaaagaagtatttgggacccatagatcagatttttgttgcttcccttagtgatatgtctgaggcaatttgcagttgggcctcaattattattatagatgtgagtagctgctgtttctaaaggtccttttctttcagaactctttcctgcaaggtgcaagaacagttaccacagttaaaatggcaggaaagttcttctgaggtgactttatgaatggggctgggcctgggagggtgagggagggggcaggcgtgtggagtggagaaagattatgaaatgccctttccatttcacagtagtcaaactaatttccctaccctgtaggaaatgatacaggactccttctctgtttttagaacttgttatttacattgcctgtgtaaatcagagggccacctttttttattctagctgtaagcagacctgtatttactaccaaccaaaattcttcccattttctgaaattaaaataaacatccataaatatagaactagtttgtgcccactagtgcatgcatgtggttctcagtggctgtagtgggaatggccggagcgtctgagggcagagttggctgcagagtctatacaaaagtagctttgatttactgtcagaacctagaaaccaactggctctcaatttagtgttcttagtattattttttgactttaacctagaaagcagtccttacgttaattaaaatgttatgcattactgtgcttgcacttatcagaatttctgatggttcttaatgtaacattacaaatgacagtgcctgcatactgctcaataaacagttgactgggtccatattgagctgaacttcagcccctaaaatccatagttatctaaaagagggaaggaacactaactaacagaaagaaagatgcactttgtgtgaagagggttggttttctagtccatccaggaacaagtctggggaccttggataaggctattcatgtctttgtttacggtattcatctgaaaaatagggatgataaactgtgctaaagaataagttcaaagagatactgtcgaatgtagggagataattaattataaaatcgttgaacttcttagaaaaaattatcaaataagcaacactgttatctaaaaaataatataagaaatctgatatgcttcacttgcaccaaccaacccacacacaaaatttgaccaagtccagttttttctcctgattaattttaccaaatgtaagtttctactgtaagttaaaatgacaaaaaaataaaataaaacaagtatgtgaaatttccctctctcagtagcaaacttcttgttaacatagtctgagcatccatagaaatttattttcagctattcattttggattacaaaaaacactataattcctctgtccatatatctattcattctatcaacatttatttatttagccaagtattattattggttgtcaggttacaagaatgagcaaaagatggcccaggtactcgagaaaaactaggatatagctgagagagacactctaatctagacctaagtaaataatggtaacacaagctgacaggtcctaggagaccagtcttttacagtatgtttcaaggagcgactaagcctggtgcatcagagaagatactacttgctttgtaaagtgtttcacagttaacaagttatttacactggtattatatcccttacttgacctctcacaaaactctatatgatgcctgttattatctccactttccaggtgaggaaactggggttccggtaagttaagcaattttacgcaagggcacacagctcataaaaggcagagctgggacttggttttcaatttttatgtttttctttctacattgtactgccccagtcatgatgcatgtatcctgtttctttaaaatgtctttaataatgtgaatttgctgttttatcaatctggataattatttttctgtgcattttcagtacatcatttaatgttgtctactcaaattctttacagtcttttgtgtctcgtctagctacaaaaaaagttattttatttcttgaaatatggaaattagaggcgataatgtatgggtgggattgagtaactaaaacataggagattctgtagggtgcatgcttggtgaaccatattgccatttgctcttaactcaaagccctatgatacttaggcatagattaagaacatctaaaaattagaataaatattttaaaggtctctagtccaacttcctgcttaattcaggagccccttctacaccttccttgatatgcagctctatgtgaacatattcagaaatgagctgcttcctgcttggtgggaagttctcatcactagattttcccttgttttgaatctctttctaattttcaacaatgcttactaattttgcctcttcgcatggacatatgcttcagaccttagaaaatgtttagcatttcacttttaattctatttttttctgagttatacattccagattctttcaatggttcctcatgccagattgttctcagaccctacatcagtctgtttaccatcctgtagatgctctaattttgtcagtgctttcttaaaatgtcaccctcagaactgaatatgctaccaaagatggttctgacaaacaaaaagatcagtaggataattaattaccactatagaacgctaaaactttagatcctttcccaaaattccttaattatccccaacctgaacttttgtaattgttttttaaaaatatgaatgtggactttaaaattaccttcatttgattcatcttgattgtgacccagctttctaaaggctgtagaaggcgctatggatatagactcttatcacctactgggtttgctcaagcacccagatttacgttgcatgcagatctgataagcctgccttcctatatacccatctaaaccaatgacaaaaatgtctcctgggatgggaaaagtactgaattctatggcactttactagagactttttgataaacttaacattgatcaattaagtcggcctcattaattatagttcatcagccatatttaaatcagctaaattactaccatccagtctcaaattgtgcatgaggatttcatcacttttccaaatgcttattctttgaaaatctgaactcatcagaaagttcagtacatttttgctgaacaaactcagtcatcctgaacccatggatcctccccattctttctgtatcctgtgattgtaaaattaaatttttatcttcagacttttttatctttcatcttttttatccaggcaagggataaaaaagaaaaaaacttttctctgaattttttgaagtatatttttcttgaagtctacagcatatttacatatatatttttctccagacatcatttaccttctttattataaattccaagatagtgtaattactttatcttaagatttgtgtcactaataagctaaacattgtagtaaaataaaggtatatgtgtccaaaatctctatttttgagagattaaattatttaaaaggcaagtaaaaaagcatctactctaacataaaattataccgaaacattcagacttcaaaatggagtatttccattccataatccattcgttcagcaaaggttcattgagtggccactggtcagagtctgtgagaggcctgagggatggtctttggggaattcaaatctggcagaagggaaaactcatatacaaccaactttgtaatactggagtaagtctcataataaagatttgtaaaaagtgctggaggactacaatgagaaaggaatgagttttatctgaatgtgacaaggaaagcatcaaagaaagaagttggcatttaaactaacccttacagcgtgatgggtgcatccagtggccaggtggaaaaggagagatgggagtaataccacaatcagctttcaccaagtcaagattagaaataaccagtaaggtagatttcatttcgtactcatcttgactgaatttacatctactattatttttctagctcagtccagagaaaaagttagtctgaaaaaaaaactgaattcacccaactctaaataaaaatacgaattcagattattagatatgactgaaaatataactctgttggccaagtcatgcattttgttccaaataaagaaaattccttttaaacgttatggaattaaatgacttttttttgtccagccacaaggaactgatatgaacaagggagatattattttatgtaatggaagccacagtacctagcacaaatgcctgacatagagaatattcaataaatattgcttagcataatgtttgacatgcggaaaatgctccataaaacttggccaaattatttttatattttttgtgaatagactttcttaaatttttagtaactgatttgtatggtgctatatttaatgaatgtttcttttctcaatttcaacttctaatttctgtttttccttcgcacctaataggttctagagccattatcaacataagatgtatggtatctgtccttactctaggatttaaaagtcagggccactataaaacttaacataccatcatcacatttggggctatttaaagattcaaaaatataaaggaaaaacataaaataaaaaacatacagagtagttctgctttctatgctatatcacacattaagtctctttaatttgataacatgttgacttatgtaaatactggaaaagagagactctttgcctaactactgtaaaaacctctttctgcctcacctaaggttccaaacatgttatttaaaaagaaatatggacttgtccccattacaaactattatcaagttaagaaaaatgtaaccatcacaaggcattatttaagtataaaagcgcagaattgaaatctttgttattgagtggcatattttaaatgaagagttatattccagatctctttagaaagcctaatgcttaaaaataattttatctaactatgaacaatgagaaaaagcattataaaatacattttgagaatgctatgaagaatatgaacataatgcagaattaaatttagagcaattaagagtagattttgaagatattttcttacgtgctttaatacagtcatcatttcagtttgcagttttaaattgcagaagaagctatatgcactgacttctttgatgggtattattaaataagtattcattatccagcagcctatttggttacacaaaaattgaggagcactaaaagtaaacacaaatagtgacattaatgatatttctgtactgaaatgtactttgattatgagtgttgtaacgtgcaaaattctgaggtctgagtacaacagaaaccatactgtattgagacattccacatatagcttgtggtcatgaagtctgattaaaagtggttttagatatatgaaagtagtctaggtcagtgccttctgtattgaacgtattctgtagcctatttcactaagtaaaatgccaatatgcaggtacattttcatatcaaaattggatctaaaagaaatattaaaagacatttagtgcagctctgtgtaattaatgattatgtttctttattcattccaaaaagatggttttcagcccatccttaatatcaattatgactcatctgcataaaacagaataaaagtttctaaagtagtatgataatcagatatgaaaataaaacactagctatattttttcagaagtactttagaaagacaatcaataaagatgaaatagaaggtgaaaaacactgacaattacaagaaagaagaattatccaagttgaaatgtaaataacgtaactgagtaaatattgactagttgatatgggctagtaaatatctaaatgccttattttccaaacgatggtcactacagctttatctttctatcagtcataataacatcttcaaatagccataactggtagactcttcaagtcaccaagacaagtatattttgctagttcttcttttttggttaagtcaactaagaaatttgggggaactaatatttattgagcacctactctaagcattatactcaatactatacacacattattggatacaatcctcacaacagccttaagagtaggtataaatctctgttttacaaatgtgaaaaatcaaactcaaagaactttatttaaagtgaggcgaggcacggtggcttatgcctgtaatcctagcactttgaaaggcttaagcgggaggatcgcttgagctcagaagtttgagaacagcctgggtaacatagggaaacctcgtttctagtaaaaataaatacaaacaaagataaagccagaacatgttggtgcacgcctgtagtaccagctactccggaggttgaggcgggaggatggtttgaccctggaaagtggaggctgcagttagctattctagtaccgctacactccagcctaggagacggggagaccctgtctcaaaaaacaaacaaacaaaagagaagttgttaagtgaatttcgcatgactagcaaattcggcattcaaattcagagttctctaaatacaaaccctatgttctttgctttctaccatactaccttcaatgtcatatgataaaatagtgtaattattattaagtaaggaatatatgtattgttaaaacattttgcatatgagttgttaaaaaaatttcatgggaaaatttatcacatatatacatacatcaattgtatctttctgaagatttcacatagtagcttcccctatcaatttttataccatggatttttaccatgtgcccacacatgtctactggtctaagcactggggataaagtagtgagcaaaataaaaacggcatatacccttgtggagcatgcgctgtagtggaagagaggttaaacagatcacacaggaaaatataaacagttttgtattttttattttgcatattttatatacaaaatatattttgcatatttttgtatatatttggtatatttttgtgtatattttgtatatttgaaaatataaaatgtgattgtaacatgaaggaaaaataaaaggtgataagtaaaacaataattaacaaaatgtggaggaatgaggagactgggaggtcaggctttctgtctgctagtccacagtccttgtcaacataaatctatttagttgtgggggagggtggggagtgggagaaggtggcaggccaggattcagagttctctctgaggtttctagtttggatgactgagtttatggtgagatggggattccaaaaggggctgcagattctagactgaagataatgaggttgaactttggaaggtttgagaatccaggatgtttagacaggtgtggaactggaggacatgcattgggtgtctggagacaaagagaaagatgaagggtaggaatatgcaattaggaattacacacaaatctgtgataaaatgagctggcctctctgcaaggtgggttggatttgaaggtatgaaaaaagtttaaatgattcattctgaaaacagtagcttaattaagtaaattagcttttcccagaatatgtgcctcaaaaacctagttctgaagagtgatagtaagtgctcctcaaaataaataaatatgcaaagaaacaaacgatatgtcagcaataggttcgaaaagcaagttaaacaaagtttaaaaggtttcatagcctttcatataccaatgtgcctctttttccaaacatattaggccactgaacttttttcttaaggagtattttataggaacagtactctacagaatgaatacctgttgggaaacaggtattcattctgtagatgggaaacactggaccatataaaggtttataagagactccgtctccaaaaaaaaaaaaaaaaaaaaaaaaaaagaatgttcacgccttttcagtagccagactggagcaacaagctgaagttcaattaaaagagagttgaaattgggaagagtgaaatgtatttttgcatttggtaggattggcaggtaggaagttttcaaagccagggagagggagctgttgtaggcagctcatcaggaaaaagacagtaggaagagtgaggctttgcagtttgagttaaattgaggaaggaatgattccaggcagggagatcatcgaggacaggaagctgctaggctgtccaaaattgaagtgataaggacatcagtgatagagttgcctgggaaatagtgtgaacctgagaaatattttgaggaaaggaattatgggtcttggtaatagattagattaaaagaagaaaatggtggcattaacaatacagtttctgacctgagagaagaagaaagatacacagaagaatgaaaccaaaaccctaagcatatgatggctaacggacttcccagtgccctgttgggtttctagaaaacagaatacaacatcgtctgagatcacagtcatatcccttcaagtgttttcaattaaatgacatgagactagacaattttaagacttgtttgaacacagatctaaaatgctaagttcctaatgtcatgtccactcttcaaatagtcaaaaacaagctccaaactaattattaattgggaaatatgctaaccatgctgaaattaatttttttttaaatcttaacttgctcaaagaaacatgaccagttccctggtcaccttcattaaaataccctacattaaatcttgcatttagagtctcacattcagcagcaagctagaaatcacacattttcaaatgataagcagaaattaatattagatttatttgctttctttctgaatgtgttagtgcccagggctctgacaactacacaccattgttttgtgaaggaaaagaaaaaagaaaagaaaaaaaccacacatgcatgaatattttttaaaaaatcttggctgctttcttttttctaggtgacatttacaaagaggaaatttgggttgatgaagaaggcttatgagctgagcgtgctgtgtgactgtgagattgcgctgatcatcttcaacagcaccaacaagctgttccagtatgccagcaccgacatggacaaagtgcttctcaagtacacggagtacaacgagccgcatgagagccggacaaactcagacatcgtggaggtgagagagcatgcgtggtgagccccaagcctccgcaagcaggggagtttggacctccccctgccacacacacatacacacatcatgttctttttcttaagatgttcatagtcccatagatagacccaggattattatctatcgcaactcttactccaccttttctctccccttcaaaagttagagtgatgtgatgatagagaccatgtaagatctggtctttgctagaaatcaagtaccagtgtcaaactatttgcttcatctttggcaagtggtcattgtccacagctgtgtatcaggacaccatggttgggaactcttgccagggaatagctcatccatattttagacacttctgatcatttattttaggtatataatagtttcccggcatcatcaaagaaaaaacgtatttaaaaatgaactcaccccaaccttacactttcagtttttcgatttatgtctcttctttgtaactcattattctgaatgctttcttgctggaagagtaaaggcaattattctcctagaaatgttttttcctaaaaattatatcattatatatatcaatgaaaactgttaatatacatggaatcagaaatcagatgaaaatgaatttctaaatgttagctcagtgtttaatcaatgtcagatttaaaaaattgttttattgtgcccaaaataaataagcatgatgctgaaagtcaaaaatgttttagatgtgttagcataagtaacataccatacagttttggctggaacattttttttcccattttattttattttattttatttttattatacattaagttttagggtacatgtgcacattgtgcaggttagttacattggctggaacattttaaaccttttcagcatcgatcctatttaaatactttgtagtacccttcatgagcaatgattaagactacaaaacaaaggaagaggtataataaggatggttcccatctgcctattttcttaatctatttgtctactctggcttccctagattgtgcctgctttctcagaatgaaaagaaaattaataagtgtttcaaaagtatgtactcaagagccagtttgccagagtacacgtcattcttgccattgcttagactggttccacattgtaaaaaaatgtagtgctaatcctgatcaaatgaatatgcctcccacatccatctcccttttacctgttacaattgtctaagactaattctcatttctttgtttttatttgaaagtttttcaaaagtattgagctgattattatattttatttttgccttaacgaggccaaggaaataatttcagagaaacaaaagtgaatgataaatagacctagggtgatatgtgcttaaaatactatgcattattttagtttttcattgataatttgaattgtgtgcttgccttgatcttgaaatttaggatcactgataaaatttacctatgcatttcagatagttttttatttgcatataaatatgaaagtacaaaaatatgaaggtgaacactgcttgtgtgtgtgcactaatacttatgtaaaataaattcagaaaacaaaacaactatttactaaaaactccatctcattactaaaaccattataacaaaagtcagggtaacaaaagaatttgagttggaatttatcattacactggaactgctagtccttaatgtcatgtgaaatgctgtagatccataatgagccaattggaaaatatgttgacttctaaaatttgctttcttaaaggagtttaaaacctagaacattcatcttctgagggtttttcttaggaatatattatatgacttgaaggcaacttaaaacttcatatattggccaggtgtggtggctcacacctataatgccaacactttgggaggcctaggtgggcagattgcctgagctcaggagtttgagagcagcctgggtaacatggcaaaactccgtctctgcaaaaaaaatacaaaaattagccaggcatggtggcacacatgtgtggtcccagctacctggggggctgaagggggaagatggcttgagcctgagaggtcaaggcctcagtgagcctagattgtgcctctgcactccagcctgagtgacagagcaagaccctgtctgtttaacaacaacaacaacaaaaaaacccacttcatatattgtatgaaaacttcatattttttgataggtggatatttgaaagtcagacttctttaaatgccacaaaaacagcactgggttaagagtcattgtttttcatttgaatccttgtcttgcacttttgtgcagtgtggtgagttgggtacctctctgggctgacgttttctcatctcaaaaatgaaggcattggatttgaaagtgcttttgcaagattataatttttaaaaaagcaatacttgtaaaacaggagtaaagaaccagttccattttcttgttaacatcaatagattaaatctctgaatctctcaaaaagacacttcgaggcttttgggccaaatctagagattggatggctcaattatttggatgaacataacatgtaagtctaacacattgtgggtccgtcctgttcaactccctgaattatgcattcttcacatatttggcttttccacattttagtaataacagagatcatggaaaaagaagtaagatgggaccgctaagcttgataaaatttacatcatcttcacatggaatatttttcaaagtgctgcatcactgaaattaggatacttgagacacttggtgaagagggaatctggattggaagttgcatttataaaaagttccccaagtaggccaggcacggtgactcacacctgtaatcccagtactttgggaggccaaggcaggcgcatcatgaggtcaggagatcaagatcatcggggctaacatggtgaaaccccgtctctactaaaaatccaaaaaattagccgagcgtggtggagggggcctgtagtcccagttactcgagaggcaggagaatggcctgaacacgggagggagagcttgcagcaagccgagatcgcgccactgcactctggcgcaggcgacagggtgagactccgtctcaaaaaaaaaaaaaaaagttcccaagtaattcttagacacactaaatttgaaaacctctgcagcactagtacataaattgtgctggaggcaaagacctatgatacatcagggatttgaattcgttcttagaatggatctaccataaagtcaaaagttaagattgtttactgctcctgggtaaaattttaaatcctatttattttaatttaatggaatacatttaactgaataagtttaatgaggagcataatatgtttcatgaagggtcattagttttatatttcccatttggaccattacccctcttccttaaccctctaaaaacagtttactcacaagaagaaaaggtatcgggagagatagaaataatataatttccagcctttacacagaaatacaaatttctgggccataccagagtagtgctacagggtcataggaaattgtgcagtgcgtgggtgttgaaaaagattccttcttttagcaaaaaagctctgcgtaattatcatgtctttgcttgataattagcactactccaacaatggcacaaagactcacaaaggcttaacagacagactgagatcagtttttttatgattatattataatgcagcttgaatatctgtttagatacaatatataaatatgccagatttagtaaatgtgttaaatttttaatccattggttaaaaaaacaaaaacagttattgtattaaaagcacttcctttgaaggaagtccattttacttaactctgtgacaagtatactgggatatttacccaaaacgctagcttgtcagactgttgaaattcagttcggatggcattaaggaactgcccccttcactgcttgttcactagctccactcctcgttctcttagctgtctaagacagcaaaccctaccagtttatgttgggctctgttcctggaagaagatgtggttgttgagtacttcaggatgatctgaagatgcagatcccacaggacatgcttacagcccattgcttcatttagcaatgatttagcaagctccactcatgctcagcactgtggaagagactctgaaacagcaggagacaggcattcttgttaaggatgtaaaacatatatgcaaaaaatcagcttgggaacaattggacggcaaaggaacaataacctcattaatgcagtataagctgctgaaatgaaggtgtaggctaaacaattcaacagaactcattcagccaggtcatgtgtttttccagagcattccaagtgatccttggagtgacaggactcccagacaggttacctccatatccagcacgttttgtaaccacaaaatccttatgggagtatcacttagcacccagccaggaaggaatctctcatcccctcagtgaactcagtgattctaatgagctactcattcagtctgggcccacagtccagtgattaagtgtggaaggggaataaaacacaaggccctttgctgctctctaggaaattcagagatggatgtaactcctgcagaagaaacctttgattcacaactgtctcagtagaggattattggtttttctttttagaggaagaacatgtgtgtctctctctctgtgtgtgtgtgtgtgtgtgtgtgtgtgtgtgtgtgtgtgtgtgagagagagagagagagagagaaggaaagggacatagggagatggagagaagatgagagatgagagattatatttacctgatattttattattttggaaattttatttgctgtcacctgaatcctgacttctgttttgatttagagacatctaagaacagttgctgcagcaaaatgttttctgcacagtaataattaaggcctaaattgggatgggaaaagccttaaaatagtttataacttgtatagcttcacaatggtgatgaaagttatcaacgagctaagtgctcttacatagtttagtgaaaatactaaatacaatttttgttgaaaagcaaatgcagcaaatagcgaaattggacttctttacaaactcagtatcacaaaatttggaaatggatgtaaatgtgaaaatatgtctactttacttgaccattcattatatctaattagcttctaattttatacttataaaaatatagatgtaaagccactgtagccagactgcctctctagattcctcctctctgggcagagcatctctgaaagaaaggaagcagccccagtcaggggcttatagataaaactcccatctccctgggacagagcacctaggggaaggggcagctgtgggcgcagcttcagcagacttaaatgttctggcctgctggctctaaagagagcagcggatctcccagcacagtacttgagctctgctgagggacagactgcttcctcaagtgggtccctgaccccccgtgcctcctgactaggagacacttcccagcaggggtcgacagacacctcatacgagagagctccggctggcaactggtgggtgccactctgggacgaagcttccagaggaaggaacaggcagcaatctttgctgttctccagcctctgctggtgttaacccaggcaaatggtctgaagtagacctccagcaaactccagcagacctgcagcagaggtgcctgactgttaaaaggaaaactaacaaacagaaaggaatagcatcaacatcaacaaaaaggatgtctgcaccaaaaccccatccaaaggtcaccagcatcaaagaccaaaggtagataaatccatgaagatgaggaaaaaccagtgcaaaaaggctgaaaattccaaaaaccagaatgcctcttctcctccaaaggatcacaactcctctccagcaagggaacataactggatggagaatgagtttgacaaattgacagaaataggcttcagaaggtgggtaataacaaactcctccgagctaaaggagcatgttctaactcaatgcaaggaagctaagaaacttgaaaaaaggttaagggaattgctaactagaataaccagtttagagaagaacataaatgacctgatagaactgaaaaacacagcacaagaactttgttaagcatacacgagtatcaatacccaaatcgatcaagcggaagaaaggatataagagattgaaaatcaaatttaatgaaataaagcatgaagacaagattagagaaaaaagaatgaaaaggaatgaacaaagcctccaagaaatatggggctatgtggaaagacaaaacctacatttgattggtgtacctaaaagtgatggggagaatggaaccaagttggaaaacacttcaggatattatccaggagaacttccccaacctagcaagacaggccaacattcaaattcagtaaatacagagaacaccacaagatactcctcaaaaagagcaaccccaagacacaatcagattcaccaaggttggaatgaaggaaaaaatattaagggcagccagagagaaaggtcgagctacccacaaagggaagcccatcagtctaacagcagatctctctacagaaaccctacaagccagaagagaatgggggccaatattcaacattcttaaagaaaagaattttcaacccagaatttcatatccagccaaactaagcttcataagtgaaggagaaataaaatcctttacagacaagcgaatactgagagattttgtcaccactaggcctgccttacaagggctcctaaaggaagcactaaatatggaaaggaaaaactggtaacagccactgcaaaaacatatcaaattgtaaagaccattgacactatgaagaaactgcatcaactaacgggcaaaataaccagctggcatgataatgacaggatcaacttcacacataacaatattaaccttaaatgtaaatgggctaaatgccccaattaaaagacacagactggcaaattggatagagtcaagacccatctgtgtgctgtattcaggagacccatgtcgcgtacaaagacacacataggctcaaaataaagggatggatgaatatttaccaagcaaatggaaagcaaaaaaaaaaaaaaaaaaaaaaaaaaaggcaagggttgcaatcctagtctgtgataaaacagactttaaaccaacaaagataaaaaaagactcaagaagggcattacataatggtaaagggatcaatgcaacaagaagagctaactatcttaaatatataggcacccaatacaggagcacccagattcataaagcaagtccttaaagacctaaaaagagacttagattcccacacaataatagtcggagactttaacaccccactgtcaatattagacagaacagcgagacagaaaattaacaaggatattcagggcttgaactcagctctggaccaagctgacttaatagacatctacagaactctctaccccagatcaacgttggacttcagcattcttctcagcaccatatcacacttatcctaaaactgacataattggaagtaaaacactcttcagcaaatgcaaaagaatgcaaatcataacaaacagtctctcagaccacaatgcaatcaaattagaactcaggattaaaaaactcactcaaaaccacacaactacagggaacctcaagaacctgctcctgaatgactactgggtaaataatgaaattaaggcagaaataagtaagttctttgaaaccaatgagaacaaagacatagtgtaccagaatctcagagacacaactaaagcagtgtttagaggaggtgaatttatagcactgaatgcctacaggacaaagtgagaaagatctaaaattgacaccctaacatcacaattaaaagaactagagaagcaagaacaaacaaaagctggcagaagacaagaaataactaagagccgaactgaaggagatagagacacgaaaaacccttcaaaaaatcagtgaatctaggagctgattttttgaaaagattaacaaaatagactgctagccagacttaataaaaaagaagagagagaagaatcagatgcagtaaaaaatgataaagaagatattaccactgatcacacagaaatacaaactaccattaaagaatactataaacacctctatgcaaataaactagaaaatctaaaagaaatgaataaattcctggacacacacaccctcccaagacaaaaccaggaagaagtcaaatactgaatagaccaataacaagtgctgaaattgaggcagtaattaataggctaccaaccaaaagaagtccaggaccagatggattcatagctgaattctaccagaggtacaaagaggagctggtaccattccttctgaaactattccaaataataaaaaaagagggactcctccctaacccattttatgaggccagcatcatcctgttgccaaaaccaggcagagacacaacaaaaaaagaaaatttcagaccaatatccctgatgaacatcgatgcaaaaatcctcaataaaatactggcaaaccgaatccagcagcacatcaaaagcttatccaccatgatcaagtcagcttcatccctgggatgcaaggctggatcaacatgcaccaatcaaaaaatgtaatccatcacataaacagaaacaatgacaaaaaccacaccattatctcaatagatgcagaaaagggcgtcgataaaattcaacactccttcctgctaaaaactcgcaataaactaggtattgatggaatgtatctcaaaataataagagctatttatgacaaacccacagccaatatcatactgagtgggcaaaagctggaagcattccctttgaaaactgcacaagacagggaggccctctctcaccactcctattcaacatagtattggaagttctggccagggcaatcaggcaagagaaagaaataaagggtatttaaataggaaaagaagaagtcaacttgcctctgtttgcaggtgacatgattgcatatttagaaaaccccattgtctcaccccaaaatctccttaagctgataagcaaattcagcaaagtctcaggatacaaaatgaatgtgcaaaaatcacaagcattcctatacaccaataacagataaacagagaaatcatgagtgaactcccattcataattgctacaaagataataaaatacctaggattacaacttacaagagatgggaaggacctcttcaaggagaactgcacaccactgcccaaagaaataagagaggacacaaacaaacggaaaaacactccatgctcacggataggaagaatctatatcgtgaaaatggccatactgcccaaagtaatttatagattcagtgctatccccatcaagctaccattgactttcttcatagaattagaaaaaaactactttaaatttcatatggaaccaaaaaagagcccgtatagccaagacaatgctaagcaaaaagaccaaagctgaaggcatcacgctacctgacttcaaactataccacaaggctaaagcaaccaaaacagcataatactggtaccaaaacagttatacagaccaatggaacagaacagaggcctcagaaataatgccacacatctacaactatcttatctttgacaaacctgacaaaaacaagtaatggagaaacgattctctatttaataaatggtgttgggaaaactggctagccatatgtaaaaagctgaaactggaccccttccttacaccttatacaaaaaaataactgtagatggattaaagacttaaacgtaaggcctaaaaccataaaaaccctggaagaaaacctaggcaataccattcaggccataggcatgggcaaagacttcatgactaaaacaccaaaagcaatggcaacaaaagccaaaattgacaaatgggacctaattaaactaaagagcttctgcacagcagaagaaacgatcatcagagtgaacaggcaacccaaagaatggaagaaaatttgtgcaatctatccctctgacaaagggctaatatccagaatctataaggagcttaaacagatttacaggaaaaaaacaaccccatcaaaaagtgggcaaaggatatgaacagacacctctcaaaagaagacgttcatgcaaccaacaagcatatgaaaaaaagctaatcatcactggtcattagagaaatgcaaatcaaaagcacaatgagataacatctcacaccagttagaatggtgatcattaaaaagtcaggaaacaacagatgctggaaagggtgtggagaaataggaacacttttacactgttggtgggactgtaaactagttcaaccattgtggaagacagtgtggcgattcctcagggatctagaaccagaaataccatttgacccagccataccatttctgggtatatacccaaaggagtataaatcatgatgctataaagacacatgcacatgtatgtttattgcggcactattcacaatagcaaagacttggaaccaacccaaatgtccatcaatgatagactggataaagaaaatgtggcacatatacgccatggaatactatgcagccataaaaaaggatgagttcatgtcctttgcagggacctgggtgaagctggaaaccatcattctcagcaaactaacacaggaacagaaaaccaaacaccacatgtgctcactcataagtgggagttgaacaatgagaacacatggactcagggaggggaatatcacacagcagggcctgtcgtggggtggggggctaggggagggatagcattaggagaaatacctaatgtagatgacggttttatgggcgcagcaaaccaccatggcacgtgtatacttatgtaacaagtctgcatgttctgcacacgtatcccagaacttaaagtaaataaatatatatgtacaaaattatttttatgtgctatatagatacatattatacaaggatacttttcttaagagaaaaaaacagattcacttacctaatcatttgcagattttccttctttcagtcattgattgaacaaaaatttgttgaattcctgctctgtgttatatgctatgaaatgcctggagatacagatataaccaaggtccctcaaggactctcagtccttaagttggctcacaaggccatgcatgatctgatccatgtatttctcttactcttcagcctcactttttgcaatttccctgccattaacctgcccttacaacccccatcctatactcaagccacatcgtacatacgtacattcctcaacctctccaagctctgttttgtcttaaaattccttactggatctctacttggctgttacttatccttcactcaagtcaggtcccaattacactttggaaagtcatccttgaagcccccataacttaggttaggtgcttcccctgtattacagtcatcatgtgttctatctttcccatcagagcactgttgaagttgttatccaattgcctgtcccacactagattctaaactcccaaagggcaagggactgtacacgttttgctcaccatcatattcccagtgcttaacatgaggtctagagaaagttacctcctcagaatatatttatagaataaacaaacaggaaagacagacatataatcaagtgattatcatgtggcataacgttgcacatttaaagtatgaaaaaatgtttttacagttccaatgaaacaattcattaaattttgatagagtttatcaaagcacaatttaaaaacactcaagtaatctaggtccatactctccaatatagtagccaataggctcatgagactatttacatttaaatgaattaaaattaaataaaatgtccaattcagttcctcagttgcattagtcatgtttcaagcattcagtagtcatgtgtggctagtggctactgaattaaacagggaagatatacaacagaatgcattgatcatcacagaaagctctatgagacagcactggtctagactgaaatatgaagagggagatatttaaacaaattgtgttttcaaattaataccaaaattaattcttcaatataaaatttgaggagtcacttcggaagtgagtaactgtgtaccttgtgattttggaattcagagcataaatgttcacttcgagagactctgatctggaactaaacactcaccataaaactaaaagcacactttacccctaacctataaccacagagtcaatcagtaaacttatgatctggtcagaaagcacttgcaagttgtccaggctgacagggaacattaactgtgtgagctgggtgaagtatactgtatttttttttaacttgaagcttgtgaatggaaagatgatagttctgtcttattactatttttaatttacttgaagcaacattggaccagtatttacctatataattagtaaattaatttctccagaaaagtatttttcattataaaaaaatttagagaaatagtattcttgagatacattacaaatccttcttagatttactataaaacataattgatatagatcttactgctagtgactaagtaagtctaccctcccctctgttaagccaagcatataattgcttttcaatacatggtattgaaaaattaacaaagtattagtattttccataaagatttaaaccttctatgttgtggcttctgagggaaaaggggaaaaagattttgttatttaaaaagttttttattttcctgaattttaatataattttgtttatatatctttaaaagacttttattagtacctgtaaataatatttttacttgttccccaaagtcttaaagaagaaatgagtctaaaattttttaaatgtattcatatttctcataactataccacaatgatttgtatagatcaaatttgaagagccatttcttttttaaaaataatcttcttgcttaatttacatgttttataaacacgaagagctgcttcacatctcatttattaagaaaataatcattgttgaacaaatagtaatgtgaggcaataaaactgagcttcctctagtctctgttattacacagctctaatagtttgcaagcattagtatgaacacagtgagcagataattacttaataatagtagaagcagaaaagacagggttcaaaatatagacttttatcagtaatataatttctttatcaatattaatcattaccattttgtcatcattattattttacatgaaccttcctgaactagagcaaaacaaagatctcatgtgatctctcttcacctgactcccaccatacctggaaatgaaaagagaaaaatatatagcctggatgataattgtcaatttttaatgatatttacaaatttcatggcatatggaacttggtggtaagcagcatatttgaaccaaatgttacattctagccattgatatcatctaagtaaaactaacattggctctaaaaggtgccgaataagaatcaaagtgtagaatattcttacttcctcaggaaaagttactgaatatatagtcatgaaatattcaaaagtaaagttctaagaatgattctgaggcttgcctagaagcagaattctaagatgatggctcttttcattaaggagtgtttattttaatttcttcaccccactgttggttttggggggtttgtttttgttttgtctaattacaaatccctctcctttccctgaagggcatgacgaagctttgttcatctctgtacctccagctgccagctcaatgcctagcatattgtggacattcaatatatatcaacttactgatgatcattagcataaataaaatttttaaatatacaattttttctttggtgagatccgatgtgttctaataataaaagtgagaatctttcaagtcagctagagtgagtaaatgttgttttgcatcaaaaataaataaataattaaattacaaggcacaggaaaccaagtaaaagtattgcttgtggtgctggtggaaaggaaaggacttccagaccaaggtacagtattttgattactggagaagagagaagaaacctgttagtgctttggccagtattgggtcaaatgaaatgcctgtggcccagtgtgaatcaccagagtatcttgctaaaatgctgattctaactcagtgggtatagggcagggcccaggatccctttatttctgaccaggtgatgctgatgctgctggagtagaaaggatctagatttccttttccaaacatgtatttccttcttcatggaatttgaaagtgtgtctgtagactatttcctctttgtaattttatggagggttagaatcatgctataaaacaggttcttacaactgaaattctgtgaaactaattcttgaaaggaagtgtcttaggtttttctggaagtgtgatacattcataaaaggcacatcactacccagtgaggtgggactctggcacatttcactccttagtgtgtgcccatcactttgtactggctgcctggagcacacagttaaggaagatgctgagtccaagtccagacattcaggaagtgtgatgtgattggttaggggcatgtgccttgggtgcagagagatagtagtacccataactttttcattattttcttggtcaaaataatcaataggacattctgggaaaagacttaatcaaagtcagtcattaaaaggactgtaattaggtaaatgctgcatatgtgtacaacagattaagtaaatagattatattattggaaatataccccattttatagctatttggcatattatccagtcatgtctcaatggtgtttagtgtattctgcactactctgaaatttaaccacctggaagaagttatgaataagaaaaaaaattctctgtcaattatttctaaaggtcatagagttaatgactagctggaaggttaattagattctgaaaacctcttcatatcaattaaatctcttatctttatgttttagtaaataaactgaataactatttagagctactgttctagggtaagaaacgttgtaaacagtaaaactacacaatgggtgtttgggttttttcctcacattaaaaaaaaaaatagttatagcaggcatggtggctcacacctgtaatcccagcactttgggaggctgagacaggaggattacttgagcctaggagttcaagaccagcctgggcaacatacagagactccaactctacaaaaataaaaataaattagctggatgtggtggtgcatacctgtactcctagctacgcaggagactgaggtcagagaatcacctgagcatgagaggttgaggctccagtgagctgtgatcatgccactgtaccccagcctgagtgacagagcaagactctatctcaaaaaaaaaaaaagtattacaaaaaagtagatatatgaattaataatagtaacttattttaataatagtaacttattttataatttctgaattactttatttttcaaaaataaaagtgtgcatattactatttaatcataaacaagttccatcactatgatgtcaaggaggaaaccatttcatagaaaaatagaccaaagttaccctatgcatgagctactactaatctaaagccaacttcactctcagttatttcaataggacataagtttattgattgactctgtggttagttccagaaacccaacccctttgaaagttactgtacacatttgtaaataaatggtatatttagcacctatactatgacaattataaactcatttgtgtcatgtaaattttctttggataatataaccagacttcagatgaaaagacatagatctgcattaatctgtaaggtagcctagccacatgtggctatacaaatataaatataatttaaattacataaaattaaaagttcagcttttcagtctcactatccacatttcaagcaagatgtgactagtggctcccaaatataattgtccattatgaaagaaaccctctgttggacagtaaatgacgaaactggtgcatctagtgttctctttcattcaaataactggcatgggctggccgaggtggctcatgcctgtaatcccagcactttgggaggccgaggcaggcggatcatttgaagtcaggagttcaagaccagcctggcctacatggtgaaacctcatctctactaaaaatacaaaaaaaaaaaaaattagccaggcgtgatggcacacgcttgtaatcccagctactcgggaggatgaagcaggagaattgcttgagcccgggaggcggaggttgcagtaaactgagattgtgccactgcactccagcactccagcctgggtgacagagcgagacacagtctctaaataaataaataaataaataaataaataaacaaacaaacaaactggcatgatggttaatagatacagcccaataaaggatatgtaaactggagaggttgcacctggctacttcaccttccattcctgcagcaggcatttatgacatgcccactgtgcgtcagtcaggacctgagccagggcagagaaatccaaccaggaaagttgaatcactcagttggcatttactccaaggaacagaatatttgttaaagtctatgtgattttgtggagaaagacgagaaaatggagggatcactgaagctggaattgccctgaggaagaagagaaaatggaaaaggcacaggaaaaatgagtagtaagaacgtagaaataagctaggtcccttgtgaacttttccaacaggaaagaaaagatcatgcgtgcacacggtttcttctgatttttcttaattagtatgtgcggaattttatcttcatccagactccatgattggttttccttaactgtagttgttctgaattaatttcatgtgggggaaaaataaagctacaaagtgatttttctaaagaatattgttgaagcattgttatgagagttcatctttcaaattttacttctaggatataggactttaaaagctccacaaatttgaaggaaagatggagattaaaaattcagttccagttacagcaacatcacacactctcattctctaacggagggcgagttatgtaaccttgctgggctttaggttcctcatgagttaatgctgtctaccctgagctccttacggggctgtcatgaggattgcaggttataacagctgtcagagcccattgtcaacccttaagttttaaaaaattagttttattttcaaagtcaagagaaaaagttcagagaagaaaaaatgctaaccaaaagaaagacaaaaattcttaatttacgactgcatagtttatgctaataagtgtattatttataagtaaatattgaatgattatataaataactgtagcattttacataaattaagaagatctaacaaaggtcaacgaattgattttttttttcttttccacaagtatttattaagtgtatgtgcaaagtatggtgttcacggccctccagggccagtagcagtccatggtggacagaatatacacagtatttgttctctcattcagtagatattgatggacatgaagatcatttgctaagcattctgccagttactggtgatgcatctgtgattatgatacccaattatctgaaccataataagatatagacaaagtacagtgggctaacagaggagaaggaaagcagttacaactgtgagcacctgaaaaatcttactgtagatttcagatgaaggcatggccttgaataagtagaataatttgatatgctaagccaatctgagaaccatttttcccatttaaactaaaagtgagactaataaatgtagtgatatatggacattaaatgcatatatgtatatatatacacacatatatgtagtatgtatatgtagcagcctttattttttgttttctgttagcactggattttttaatgtatggtttttctataaacagatggttataatttctagagaaattccatagaacacaaatgttagaaaaatgcagtgaatttcattgcctttaagcttaataaaaggttcaaccttaaagttgcatcccacatcgttagtttaactttacagatgagatttttttttcccctctctaaattctaaaacatgatacatctggctgagaggctggaaaattgttacatgcctgtgcaacattcttacaacctaatcagttcttcaacttttctcgcagtttaatcattggagaatgttctttgtttttgtagtcactgtttcacatagtaacagcttgttgtattttggtctgtttgccagagggtaggtttatttttaaaaccctgaactctgaatttttctttatttttccaagattgaaagcagctgaaatgcctggagttacaggttgaaggctgcttcacaatatgtggaggaagcttctttccctcctccctttgtgtgtgtgtgctttttttttaatttttccctaacaaatgtcttctaactggtagttgtctaaaaatagaaaactgcttaactaaaaatagcctggctctcagtcgtgccaaggaaaatggagaggaataggcgtggaatagaaggctgagtaatccagttctattcattcagagaaacctttgagaatgcgggcgatgataaagtgccctcaaaaaaccacaggcccgactctctcttcagacttctaggtgccaataaacattttagccccaggatacttttttttttttcctcataggttgtaaacattttctgaaagacaaggctttgtttcagggaacctgacaaactgccataaataactaactttcctaaggtcttaaaaattcatatttgtaagatgtattttaaaagagaatcttaaatgaaagtattgtaaaataatgtacgtcgtgtaataattaacagaggaaactctgttataataaaaaccacttactgcttgcaattaaactcaaaactttaaggagtttcacagcaagaaaattattcctgtgactcattgtaccttaagagagcagctgactcattttagtttagctccctgagacatgaaattctcttgttcagtctgtatccccttaacatgccaacatttagtctctttcttaaaattattattttcactcaagcagatttttacttttaatctttaaaatgatgtagaaactactttgaaaaatagcatttctggagtaggatggcttttagtttcaacaaatggaattctgagtaagtcataaaaaaatacgtgtgtgtgtgtgtgtgtgtgtgtgtgtgtgtgtgtgtgtatgccagttttgcaatgggaatgctttttttttctattttgttttgcttaagtaatctgtaaaccaggtcaaacatagcaacagggtgtggaaatgtcagcacagttcatagggttatacgagtctgagcattgttatgttcagttcctgtaatgctgctggtgataagactcttgagacaaaagacgataattgatggaaagaggcttaaatcattgctagaagaatcaaggtccttgtatctgtgtacatcgactcttctggtctccttccgtcttgtaaagcattttgtcgtcttgcatgttggccccctactgctctttgtaatggatgcagaccacaagtgattcctttatgcagcatacagggtgtaattgtgtctgtgtggtgtattagtaattaccaagctgaattcccatattgtatctttactgcaggcatggaaaaataggacatacaaccctgcgaaaccattttcaacctagatagtgagccacttagagctgtattccagggacaaagccttttacatgaatactttttaaacaaaattttcattgttgagtcatttgtaccatgcaggataaattcagtttgggaaattattacctttgatattatattattcatttctgactcttcagcaaagtctgtaatatggaaaatattggttctttttaactgctgaaataaaaaatatttttagatgtaatagtgatatgagctatggtaactatgctaggctatcatacagaaagagtactacgtgaattactacatataatagattctgtaacatttataaacatgaaataatatagttattttagtagcattttatcttaaacagttatatgttatacataatttatcaatattggctcaagcattgttaaacttcagaaaaagctgacaaaaaattttgttacagtaaacagatataaattattaatttctttgctataaaatttgcatccatcctttatgtattatgtagctgatattgatttgactacctccaaatcattgtggatttgaaatgtctacagtattatctgtaatagaaagccaaaataatgcaagcagcttggcttaaacaaaagaaagtatgcttattctatgcatcaaatgcttataatgacagttaagaaatattaaatagaagtgcaaagaaattaatacagcaatttcattatcgattttcaatgcagttagacttatattgcaaattattcattaaagcattcaagatttttgttatatttttaccttcatttctgaaagtggccttccagtatgtatatcttaaaaatttgcttccacttttatatgtagattttgttttattcaagcaataattattaaattcttaggatatacagaactttatattgatgccaggagaaatacaagtttggaagacattgtctgtgacctcacaaaacttacagtccaattaaggtagaaaatacatgtgggaatcaactggacaaaacaacgtaatgagaactatggggtatttagagggaggcaacatagcacagtgttgaggagcatcagttctggagatagactgcctgagttctatatgtccttgggcaaattacttagactgtctgttttattttttattttattttattttttttgagatggagtttcactcttgttgcccaggctggagtgcaatggcgtgatctcagctcaccgcaacctccacctcccgggttcaagcaattcttcctcagcctcccgagtagctaggattacaggcatgtgccaccacgcccagctaaattttttttgtatttttagtagagacagggtttctccatgttggtcaggctggtcttgaactctcgacttcaggtgatccgccagcctcggcctcccaaagtgctgggattacaggcgtgaaccactgcacccggccaactctctgtttcttaatcccatcgtctgtaaatagaggttaataatactatcttctgcttagctgttatgagaattaaatggataaacatttataaaatgcttagaacagggtctgacacttggtaaggtttacaataatgataacgacgaccatgatggcagtgccgctcctgataccatgtcatcaagcaataagtggtagaaagaagtttaaaaggtcaggacaggcagccatgattggtagtcctttttaggctcaaacaagtcaaattcagaaagatggatatcaattgatgaaaaacgtgggcaaactttcaaaaaaccaagtatgcaaagagtcacaagaaaaaagaaacaagggcatgaaaagtattagcttgatatgaagagaatattcacataaataaaaagatataagaaagatggcaatgaaaatgggaagaagagacagggaaatcaagcactctaaatatttgatgtggaattaaatgtgatacaattggcatcagaaagacactccgtggtctcgagcagtaaattagcataatgacaattcttgagagaggttccgctggaaaagacagaaacagttgtgaaaagtggaagtgccaaaatattttacgttttgtaagtatgtatatgtgtgtgtgctaaaaagcctgaaagctttcaccaaacttatatttttatttcataggacaagttgcttcagaaatattcatataattttagtttgcactaataaggtgcacatgcatttctgtgactgaggactatttatcacatacagtgtattaaaaaagcaaattatagaggcctcaggaggttttttgttgcgtttgttgttttcgttttgcttgtttttattttttttttttttgagatgatttcatgcccattgcccaggcttcaatgcagtggcacagccttggcttactgcaacctccaactcctgggctcaagtgattctcctgcctcagcctcccaagtggctgggaccacaggcacataccaccacacccaacgaatttttgtattttttgtagagacaggattttgccatgttgcccaggctgttcgaattcctgggctcaagtgatcctcccacctcagcctctcaagtgcttggattacaggagtgagccactgtgcctggcctaggaggtttattttaaactatataagcttctttacagtaaattgaaacataaatcaaaatcttataaatttagaagttcctaatgaagtagtgcactttttaatttttagacagagtctcgctaggttgcctgggctcttctcaaactcctgggatcaaaagatcctccttcctcagaacatgtgcagttttttgttttgttttgttttgtttttgacagagtctcactctgttgcccaggctggagtacaatggcacgatctcggctcactgcaacctccacctcctgggctcaagcaattctcctgcctcagtctcccgagtagctgggactacaggcatgtgccaccacacctggctaatttttgtatttttagtagatacggggtttcaccatgttggccaggctgggtcttgaactcctgacctcaagtggtccgcttgcctcggcttcccaaagtgctgagattacaggtgtgagccaccacacccagccaggacatgtgcacttttaatgatcacctaaacaggtcaggattctgaatacaatactgccaaatatgaaaactctccccttacactttcacatccatataataaaagccctgccctttcataaaaaagacagtgtggtgctggaggagggacagacacacattttagcgtcagacaaacctggtttctgccactttcataaactctgtgatcttgggcaacattctgaatttccaccaagcttcagcttctgaagcagtaaaaaagggataataaaactcacttttggtcttcctgtaagaattaacttatgtacatatatagccattagcacatgatgctcatacaactggtatttattttcctgctgttcctttttgcatatgtaaatttaggcaaaaattttaaactttcacttgtatatacacacgcatactttggacactgaaatcttcagtgtatttggtgcttacatttaaataaaatgtcacattttataaattatcatataatgtatgtatatttcttgtgtaataacgtgatgaaattcttcagaaataaggtcctcactacacagatttttaaactagggaaagggtagaaaaaggaaaaaaactaggagtcaaaagtaattctattaagtccagtcaaaatagagttaaaagaaaaaaaaagtggaactctgccaaatagaggggcttgcccaagttctcttagtgaactctggtagatagcattaggatataatttatttcctggtgtcccctttgaactactttgtatccaagaagaggagttagacaatgagagagaaagtgaaagaacgagagagatgtagggagaaagagaagggggtaggttgattgagatttcaagacaatggaagtaattagcaaggataacacaagtgtccctatgctgccagtttctcttctgacacaaaaataaataattgatttcattgaagtattagtcagtcaacaatgcttagtgtgatgatattgttaacagtgaaatatatatgttgtgcattgcttctagggtgaaacttaagtatctttgccctggctcccgcagtattttcatggcagtgaggatacatactcttggaaatgagccaggaacactctaatgtattacacatgtggcttaataccaggtgaacaggtattttaaatattctaatcacatacccacaatgtatatcgctactgggaaaaggatatcatttttaaccactggtgtttgttctgagccatacctttttcacactctgaagattttcaagacgaactgtgatttggggagggatggccatctcagtcaactttaactgataggaggtacaacaaatttatagttctgaactctgcacctggagtctggctaccgaaatcaaaccacttgctgaccagcataaaaataaataggaaaatatttcagtgttttccacaattgcgtttgtacaaatacaagagattttatttatattaaagaaaactgtagtttttcgttttttcttttttctttttcttttttttttcgagatggattctcactctatcatccaggctagagtgcaatgatgcaatgtcagctcactgcaacctccacctcttaagttcaaacgattctcctgcctcagcctcccaagtagctgggattacaggctcctgccaccatgcccagctaatttttttgtatttttagtagagagggggtttcaccatcttggccaggctggtctcaaactcctgacctcaagtgacccacccgccttggcctcccaaagtgctgggattataggcgtgagacatgagacactgtgcctggcctgcaaattcttatattatgattaggggaagaaatttgttttccattagaaaccaccattaagtttgcaagcattgtaacataaaaaaaaaaaaaacctcactttgctgaggcctaaatttctatattgaaatattactttctgggggaaaaagataaaatctacccaaaagtacatctaacgagaaataattctgaagattctttcagatgttctgcttcatgctgtacacacacacacacacacacacacacaaacctacacaaacctacatatattcacatatacatgcagttaatgtgagactggcagtttccagcacaaaatacatagcttccatttcactgtgcacaagttcctgtgtcagatcaacaaaactttcattgatttctatctatctgcttggcttcgacaataatgtaatgcaatcggggagggagagtttctaacttctcccagccacctgccttaacctcatgcttcattcatctcggtatagactggattcctttgacaattagtcgatagtgtacattacctcatggaagcagactttgaactatgttttgcttccttttaatggtactgtttcccctcatcttttaacagtgatcttttaaaaagaagtgtgattctgttcagaatgatggtgatggctgtttgagacattttaaaactattaggtggttaatatgtggttaatattatttattcaacagaaaatggactttaagcgcatgtgaaaagcaaagcatcataattgtaaacttcttttaaaagttatacaactttatttagtttcaattttccaaaagtccagtttcccatctgagagacatgggtattggcccggctgtgggaaacctccagagaaaacaggggagctccgctactgcggaagcagagtcagtgactgtgggtggcattttctccgctgagtcaggtcctgccagccctaccccaggcttctaccaacagtgcagattttctggcaagatgcaaaacccaagtgtttgtggttcttgaagctcttctgcagtttctccttttccttggtactttgggaaattttcactttagaagatcacatcttactgtgtcttccttgtaactgttgaaaaaattgggaagtttaagtcatttactttatttttcctctcatctggcctataaagtaacttggtgttatgtgcatgtttttcaacaaacaggaaagggaagagattatatacccatgattttgaaaataatttttatacagcatacaagatttctcgatgatccctcgctttgcccagggagaaacaatagtttctccataaaagcatacatttttctcttttccccaatctattccctcaacccaagagaaaatgtagtcttgtagttaccagcctttgcatcccccatctgctcaagcaaattgaagagaagaggcaagtggttggcttctgcatctgaagaatataggtgccaaaataataaagtggacctttttgttagtcacagagacttgaggttcttgctagtattactctaatcattgtaataaacctgtgcttcattttatgcagataggtacagtctgtatattattgggaaggacttccttcctaggcttaggaatgttaggagttgaaacatttagcagccgggcgtggtggctcacgcttgtaatcccagcactttgagaggctgaggcgggtggatcacaaggtcaagagatcgagaccatcctggctaacacggtgaaaccccgtctctactaaaaatacaaaaacaaaattagccgggcgtggtggcgggcatctgtagtcccagctactcaggaggctgaggtgggagaatggcgtgaacctgggaggcggagcttgcagtgagccaagattgtgccacagcactccagcctgggtgacaaagggagactccatctcaaaaaaaaaaaaaaaaaaaaaaagaaaagaaaaatttagcaccctttcttttccttggggcttcaacaacctacacttcattttaactagatagatagtacctacatattggtgaagggccttcccatctattctagatagtacctacatattggtgaagggccttcccatctattcagttgatattatagcaaaatagtaggaaaaacattttagataatattttttatcagaaaatgaattccgttacaaacacatccctttatgaaaaaataagatttgtcagtcatttcaccaatttcagctgagagtaagtgttcaaaggatacacagatacacaggcatggtttaggcaatccttattgttaaacaaccttgcagacgcagaataatttgatagctaagagagaaaattctggagctcattcatgggttcatagacttggttccaccactcactaactttgtaaacttcagcaagttcttgggccactgtgtgcctctttttttcatctgtagattggcagtcattgtggaagagtagcttgtgaggattaaaaaaagacccatgcaaagccacgggctcagtccctggcacatgtacatgcttggtaaatggtaggtgttattgctgaggaatggattcaattaaaatattaagaaaattaatattttgatagtgatggaagactggtttaatttcctcttcatgccatagaagaggaaatgttgtttttataattacctaatgaagaatctggaagaaatgattttgcaaatgatacccttaagctcatcactgaactaacaaaataactgagatttcataagttatggaaattgaaatacctaatttaaaaagtcaagtttgcagtacatttccatggataatgcctgaagttattgaagccatcatgactacaaaatcaggcagccaggaggccaggtctacagagtctgttcagagaaggctgtctggggccacaggacagagtgcgccgtggggctggcagcatgcacttggccttgttgagttagacaacaggtgccgagccactgccaggtgtggatatcaggatgaacaaaattgctgatggcctgtcataaagctttatgttagatcataaagtgctgagcccatatgatgagagatgagttcacatagcaagggatcacttgaagtgttcacttgattttcccctccctgtctttcacacgatcttcaaattctctctttttcactcattttcattccttccctctctccctccctccctttctttcctctcccccttccagtatttttctatctatttataacctctgtctctcattcttggtattcttatttttaaacattttctaagtagaatgacggttactggaggccggaaggggttgaggttaccagaggctggaagaggttgatgagggcgggaatgaggagttgttgatcaaagggtacagatagacagagggaataggttttgagagctactgcacagcagggtggctatggtcaataataatgtatttatatttcaaaataactaagagaataaatttcaaatgtctcaccataaaaaataagagaggtgatagatatgttaattagttagatttaatcatgccacattgtatacacataacaaaatggcacattataccatataaatatatacaagtattgtttgtcaatttaaaataatattactaataatttttttaattatggggaaaagttcatcataacagttaacaaattgattaatgaaatttatcttaacaattttatgaacaccaaagcatcatcaaaataaaagtagaagaggcatttgatgaaattcagtttctattaataaaaattcttaatggactaggaatagaaatttccttaagtttatgaaatatatcaacaaaaagggttcatagtaagtgtataatggtgaaacatttggctcattccttttaaagttataaatgagataaatatgctcccatctctgctttaagtcatactgagggcctagtcaatggaacaaaatgagataaaaaaataaaatgtatataaatcacacacacaaaaatactctctatacccttccatttttcagttctcagtgtcactctagcttttatagcatcatgtgaaatccaaggtgacaatgcacacctaagaatattatcatctgcataatatatgcagtcatgggaaatgagattttgtgaagtaataattggtccatgattctggactgtcgattcatatatggatagcattcagagaataaggaaaataaattgagatgaatttgattttaattattaatttaatttggaaacataaattttgaaaaaaattaacctgataataaagtaacttagtctatataggccttgattagcatgcagtatcagtaatagtacactttgcaaaatatttcttatgaattatattttatttgtaagtatttaacctagaaagaaggatctatttgccataatgcaatgtatgttaggaattttcagattgtatttattcatgactcgtgtcctctccgagcaattacactcaattcataattgcctacactagtgaaaaaggatccttcacattaataccataaaacagcaggaactgcaatgtgagtccaggcacagcaacccccaataacaaatgagccaggaaactagcaggcaagtcccagtggaaagttgagcagaggaccctaactctgaaatgctactggcacttttgatgtcggtcctagaaatactctgattatttttctggtactagctggaaataattatattgttaggtaagcaaataaaggccctctaattagcaaacttgaaatttacattaaattatgaaattcccagggcccagtactctgccaggtactaaggataccccgacacaaggcacagacctgccctcaaggagcgcagccttgtgtggaacagaggcaggcacacagtggcattgcagcatgcagaactacgacaggactgcaggaaagacgagtttaaataaagaaagccactggaatgatgtcagtgtgtttgcagcagaagccttgagaaactgcctcagaattttgaagcacatttatttttaagcacctgaagctcttatcaaacagtcctatcaaactttctttcatcagacacctacccaagtcaactgaacgtaaaatccaccacttattataaattcacatattaggtgagtggtaatgagataacagctacagaggataaatggattcaattctctccatctctacaagtaatctataatgtgacaggagagataaaaggtagaaacttactttgggaggccgaggcgggcagatcacgaggtcaggagatcgagaccatgctggctaacacggtgaaaccccgtctctactaaaaatacaaaaaattaacctggcgtggtggcgggcgcctgtagtcccagctactcgggaagctgaggcgggagaatggcctgaacctggaaggcggagcttgcagtgagccgagatcgccccactgcactccagcctgggcgacagagcgagaaaaaaaaaaaaaagaggtagaaacttatttgcagaaaagaaacaattatttgcattttaagtttactgctgtgagttttggagatttagtctgtgagactttcttaatgcatgatgtagttgttggtagatagaggtttgttctctgaccatttgacaacatcctgaaactctaacaacttctacctccaggtcaactgttgaacctgcaaggagccttttccccagatctctgacttccagtcggcctttctgcctcttgttcactagagagtacatcctggtttcctgtccttatgctaagtctgatgaaaccccaggatgtctgtctgctggcttaactggccctggatcagcaactgtcccctgaccagcaaccatctacccattatacctttcactgcctctgttaagcagaaggtttgccagtatatgaaccaatacagtgaaaacactaatattgcattagccaagtcccaggagagattttacatggaaagggagaagtaatatacaagtaagactagagaccaagactgctcaccttttacagacctggcaaacctgactaaaacgcgagagaggtttggttttcaagggggaacatttggattcctagccactagcttttgcttagtctgcctgagcctctccattgtatatcatcaggctgtccttaccattagtcccctgtaggacacctatccagaaaagttaaccaatttgtagcaacattctactgtcagatatcctactagttgccaaggatggaaagtcgtcaggagacttcctgtctgcaagaatcttataatctagaaaatgatataaaagcagaaaacagatagcaacaatatgaaataactgttcattatatagttctaaggaagaataaaagagacattaattctattaactctctcttccacgtgattttttccttttataatttaagtttatgtacgaggatgggggatggtggggttgaggggcagatgttgctaagggtagaatcagtgtatatgtacagtatgtatacaaacctaataagtgccctctatgtgtttttagatttcattgtaattccattttaaataagaacttctgttgctacagccttgaattccattattctttcatcgacaataacaacatttattgagtgtcatccatgtgctgggaacattcaagatgctgtggatacagaggtgaaaaagacaaagattctgctctcatagaacttcgttctaacacactgaaactcttctctccccaggcagccacaggcggctgtgacttacgtattgtgttcccacaatcccagtgacgctctgcactcctgatacttcacttttctctaatcagaacaatatgggtattgagcagtatgtgttaacagttgtcaatggcagtctctgggatggcatatcacaagctcaggcaaaaccctcaattagcatctaagtgtgtttgttcttcacagggcatattaactggggagatagactataagagaccctccctgctcattgctgtcagatcactatagaataaccaaaaccaaagtgaaaattttcaagagtgaatgacttatagccactccttgaagagcaggctggtttattaggaagagggagaaatcaattttaaaaagatttgaatgtcacgtattatgtgggaagaagttgaggataccataaatgaaatctgtgttcacaatccagaattggtccttgaaaaatctctctgcctgctatttaagaaattgaagaatagaaataacttgcagtatttttggtgctgtcccaaattgaaaactgttattggtgatgttggtcctgtgacttaagacatgacaaccacaacatagagaatgttccccatcaggacaagggccagcccaggagaaaagtgggccagggtcaagcccattagatgtctttacctctcttaagcctggctgtcaactgaacgtaaattccaccactttaggttgggagacaaggaattaaaggaaacagctcaatctttatcttgggagttcctgactgtctcagaaatgaggaatttgatatcttaagttctcaggtatgattaaaatagtcatgacataagtcaatcagttgccaacctcaagactttattttgcaatgccttatggaaagttctgtgtatactctgcttttctgataagctggtaataaactggagatcccaactgacagatattctgtaaagtacatcaagggtaatgccttgtttcggaggggagacgtagaaatagagaagagaatgcacaaaggtgtctattgcagtaagttttgttctcaacatgtttgtgtcttcctggcagtaacagagcagcagcagccacagatggcttggaagcccatcatgccccagactctgagcaggtctaaacacagagaaatcccaccatttgtgaaccagttacaatagtctgtgtcacctcctccattccctcagctcccacagggatgtcctgtgccgcaatcttgaagtcattccagatattgctttaacctaccagaacttgtactccttacattttgaggtaataatcttattaaaacaaataaatagtactgtcactctacaagaccacccaactcatttgaattagtgtctgtcactgttagaaagtatgactgtcaagtttgtttgcttattcatttatccagtgaaccataactgagaatcttggttgagtccacacatattacccaagccctgtgttagggaccagagatgcccatttttcacagaactcactacctggtggtgaagcagacatgttaaaaaataaattacagtataacataccacatataaaaaagaggtcaaggactgtacaggtacagaaaagggagttcctgagtgccttctacaagcgttaggaaaaagcttcaccaagtaagtgagggcattaggtaatagggtgtcctaggacaattaaggtttgtgtaactgagaggaggagtaaataaggatattctaggaaggatggaatggcgtatatcaaagcagtgtttctaaaggattgagctgacttgccaaatgacatgaaatttcccccttggccaaaacccagcgatatagtttggctgtatcctgacccaaatctcaccttgaattgttacagtccccacatgtcatgggagggacccagtgggaagtaattaaatcttggggatggatcattcccatgctggtctcatgatagtgaataagtcttatgagatgtgatggttttataaatgggggttcccccgcacaagctctcttgcctgccgccatgtaggacatgcctttgcttctcctctgccttctgccatgattctgaggcctccccagccatgtgaaactgtgaagccattaaacctatttttctttataaattactcagtcttggtatgtctttattagcagtgtgagaacaagctaatacacacagtaggctggagaaaagaggaaatgagcctagaggcaggtggagggttttcaaggagaacagccatccaattagatgtgcattttaattagaccctgccagaagtatgaaggaagattgactggaaggtgggagtccaaaaacaaacagacaaaacacagaagaccaaatagaaagaataacgataggtgagtcaagaaattacggaatcaagggtgatttctgagttttcagcttgaacaagtacattgtgacatttgctaggaagggaaagatgggagagaaatggatgaaggggtaggctggaatccagaaaataaatgggaaaagaaatgatatagtagaagagatcgtgggaaatcctgtagaaatgaggaaatgtggtgactcaaaagatagctcagaagtgactggtgaatgcaaagatgtaggatataagctactcgcatttcaaatgactaatcacgcatagactcaaattgaataaaaaggcatttacaactaggaaataaaaataatgatttgacttattttgatgacccaggataacatctacatcttttgttaaaataagtcattaatggtttatgaaagatgctccaacatgttatttgtaaagcatcagtgcctcaagatacagcctttttgtccctgtaaccaacccatttgcaagtaaaatgccatagtctaaaatgtttagtatgtgaagttacaattattatacattttatactttcaaaaaacctgttctctgatcttatattaatttactcctttcctctctcaacctttgtttaatttatagttctgtcttgtcttttccttcctcatttaagaaatcactaacattgcccattcttcaaaacaacctacaacttgattctttgcattccagcctttcttttcttaacttgcattataaagattattaggataggctggacacagtggcccatgcccataatcctagcactttaggaggcttaggtgggtggattacatgaggtcaagagttcaagaccagcctggacaacattgtgagaccccatctctaccaaaaactacaaaaattagccagacttgatggcacacacctgtaattccagctacttgggagactgaagtgggaagatcacttgaacccaggaggcagaggttgcagtgagctgagatcatgccgctgcactccagcctgggtgacagagcaagactctgtctaacaacaacaacaactatagctatagatatagatatataggattaactgcatatcctatcatgcatttcaattattatatattaaatgttctctctttagtatttcacttcacatctctgctggattgaggatctcagggagtgttttacagctaacgtgtgccagacttccccatctcagtcccattctaggccaactcatgatgcatgccctgtccgggttccaatagaggtttggcggaagaatccttacaaacaccaaatccttgatctgtcctgaggaagcctgaatcatctgattggccccagaatcaccctgattttccatgaattccctcaggcaaatgttggcccagaataagaccaatgtaaaagcccaggagaatagtggagcagtagactagcatccaagaatgggggaaaatgatgaactttgcccaagaatttgaaagcatgcttaattcagatttatagtatctgactcacattcacaaatttccctgtgctctttcctacaaaggttttgtttttcctttgctaacctttaccttctgcctaaaatatcactcccttttttctctttccatgctgaaaattctgtgccctctttcagctacacttttgatcactgagattatatgcttatgactttctggcattaaaagatttcactgactgctcagtttttctgagggtgtctatttagactagtacccctaaattttaagcgttcaataatgtaaaatttgtgagttataatgtttcatacatagtacaaatcacacctacattgcactgctttctaacttaaaaactgtacatttcaaaaagtagtaaatttgggagttattaagagggaataaaaacattgagttttaacgtagtgtgaaatggtagtaataaatggaaaaaaaagagattgcagttgcaaaatactgcactgagactaatcttcctccctctaacatttgaacattcttttctgttctgttcatctattcatttcagtttgtcatgaatgctgcaaatatctagtaagttccgaccacttgccaggccttgtgctaagttctggtgatacgagatgacaaataaactattcctaacctctagtagctcatagtagcaggaagaaaaacacatacataaacaaatcatctttatcaaatgtccagaaaaatcatcttagcatccagaggaccactggcagcacctgacatatagtagcagttagtaaatatgtatcaaggggtctggaccctactacagcctttgcctccagccagccagacagccttggtcaagtcaagaaacctccacatacattaacattgaagtggaaatgtgtgttccattcattcatctagcatttattgagcaactacagtaggtcagactgctctctggtgaaactccaaagtgaataaagcaaagtgctttgttaaggacctctcaatctagcagaggggaaaaagcacataaaggatcaataatgtatgattaagactatagtgggaaaatgtgtagaataaaatgagtgcctgaatgaaggagaaactgattcagcctgagcgatcagaaagtctaaagagaggagacaatgtgtcagctgctctttgaaggaggaacagatattggtgggctcattcctgaaggagagcccagcttgagaagggatgcagaaggaaaggcatgcagcgtttgcaccattattcctcacccactgtgggcatgaggaagggccggatgatgcttggcggtctcatccagactagagtatcaataattagcaccatttgaatgtttatgtcaaataatttgtggcccttaagacagagttggtggatgtttccttgtgttcaatacatgaaaaggctttcaaatctttaattagtgtgtcttttatttccattatttgaagatgaaaatgattcagtcaaaaaaatttcagctccaatattaagattatcttttgaggaagcatataaaaataaaaacaatgacaatatccaaccccatccaccccttccccagtagaagttgatatctggctagaatgagcattaataaataacctagagaaatacagtattgtacagttttatattttcaactttttattaaaatttttaccacaagtgaataatttttgttaaaatctaactttttgtactctgtattggatatgatttgcttgcctaattaaagtctacctgctgattatactagatttaatatattaatgtgtcttcatttctagaataagaacaaagaaaagggactatggtactacagggagagatagtatagacaatgcttacagttttattaaaacctgtggagaaatttcttggcatctaatcttccctcagcctaaggcaaaaaccatacaatgttataagtcaggtcagagctttttagttttaaatttggctgctttcctaacacataagcgtacaaaacagtatctggcacatggtaggttttcaataattgtttgccgaataaattttaaatgaagtaaggcactgggcacagtcctcaaagcacctctctgtagatactaaagggtcaggaaacagcagcagcgtgagtaccagcacaccaatatggaaacactttcaggaaatattcttagaaactcaatttataggcagtattcatttcaactgcacttcctattcctacatgaatttactactttctaaagattattcagcttgttaagagtagatacttatcttcataaagctgtgaacgacaagcaaaaaaatgattcaggatcagaggaaaggaaactaccttttctaagttgatgcttttttttcttggtttttgtgtgaacatgacattgatgcaactaatagtaataattcctgcatgtgttcttgacacatcaaccctctgaagtaaagatcacactacctatgcaacaaagtgtgattacttggatttttaacaaaggttaataggagtaatttgggggtttctccaggtttctctgcatgtagaatgggcaggcacaggaaaaggatgatgatgaaaatatacattcttgaggactgagactgcagacatgtaaagaaattgagtggttgaaagcttttagtctgtgatggtggttctctgaaaaaaagctgaattttacttaaatagcattaatataaaaatacagcttcatataatcgaaaaaggtcaataatttacttatttctttttactaacgagataatttttgaaagaataaaaggaaaaaattttttaaataacaaaatagtatttaagaagggaaaaatcagttttaatcactgcataagaaaaggattttctagttgataacgtaatgcctaaaacaagaaatgagagctccatgtagcattctttttcatttatattcctttcagtaacgaaatagaatctgttcccctaatgaaattctatttcattagaatttttgaagcacctgtcacctatcatcatcagtttgtacgtatttcaagtttttccgatgagcaaatggaataatgcagggtccatatgtccacatgtctgggaggaaagattccacgtggtttttggattacctgtctggactctttctcccatttattgcttggaatatgtcaccttctgtcaatctaattactcctctaggaaacggctgttctcagctcacagtatgacaatcgctgtcttgtgaaaatatcccagaagcctctgtagttgatggatctacctcaacagtgtcactctgacgtggaaagctgacttcagtatacaggcttgctcaagatttacttgagttctctgaggaaagagtttcttcagatacgtaaggagagaagctggtggttttaggagatctcttgccttatcttgacatacatgaataaatcttttcaaaacgtagtcagtcagctgagagacagtatatacatttaggacttccagcccctgtaaaagaatgacaattgaagtacctacattacctgaccagtgacacttgtaaaagatcagagaagctttcaaaggccaacagcagagattttgattttgctagaaaagggcccgaaggaataatgcttatttatccatttagtcagccctttcgttcatatcgactattcattactgtgataaagacagacttggctgaatctaacagaaattcttttgttatcattaaacagctgtagatttttaatataataaagataaaactgctcttatagttccacattcacactatgatattcaagtttgtgccatcacttccattttcagagctttataattccaccataatcatttgttcttggcagaaatgtgttatacaagcactcagctgaggataatatttttgaacatttttttcaatgttctttctggttatgtgattatgggaatttggaactcaatattaatttgctcttcagctttgtgtttgtatatctcaaaatgctcttttttaaataacacaatttaacttgaatcattacttagattcgggtgatattcatagcaagataatgcagtcagatacaagaagaatgtattgggagaaaatgagccacatttttccttctcatcactgccatttcctttgtgactccatgccacctgccttgtttgtttaatagtttatataattcttcaggtacaaagtgagccactgacctaattggtttttttcattcataaactgatgtgttttattgaccaatatgcattccaactcttgactaaaatttgacatctaagaaaatcaatattttagctctattttcatacttgaaattttccctcagcctaattttttaaaatttctacttctttttttttttttttttttttttgagatggagtctcactctgttgcccaggctgaagtgcagtggtgtgatctcggctcactgcaatctctggctcccgggttcaagtgattttcctgtgtcagcctcccaagtagctgcaattacaggcgtgcgccaccatgcctggcttattttttgtatttttggtagagacaggtttcaccatgctggccaggcttggctcaaactcctgacctcgtgatcggcctgcctcggcctcccaaagtgctgggattacaggcgagagccaccacgcctggacaatttctacttcatttatttcagcgtccagtgtcctaactatagttacatatgagtgagagagatctagtctgcactcatcacttcacacgggtgggaaaacgggcaggggaaagtcaggccccacactgtctccaggcaggaggcaaatactcgttgactgaccttggaccatcatgcttggccatatgggtttgagacctggcataggtttacctaatctcttcatggaagacttgtgagagataatgggttaatatttgtggagatctttcaacaaagtgtaattgatgtttgaatttttataaaccaaacacaatatctaccccctgaaagctttgtgagaatatttagcacacatgtatgtgccagatggattgtaatgacagttgataggcctctcctcacccttgcattctgttgtcagaaatctgcatatcaaaacaactataatttttacaataagatttattggttaaaagatttgggtgcacactgaaaaatctactgcctggataagactataaattaacattatggaaggctttaaattaaaggtttatataagaaaattattggcagggtgccatggctcatgcctgtaatcccagcattttgggaagctgaggcaggagcatcccttgagtctaggagttcaagagcagcctggacaacataatgagaccctgattctacaaaaataatttttaaccaggtgtggtggcacacacctgtagtaccaactgcccaggaggctgagttggaaggattgtctgggcctacaatgtggaggctgcagtaagctatgaccacgccacactgcattccagcctgggcaacagagcaagactctgactcaaaaaaaaaaaaaagaaagaaagaatatttttaacatgtcttatagataacttttgaaaaatatcaaataatattttcttgatctgacatatttttctctatacaaatgaattctaatgaaaaatatgtggaatataatgcaaaaacaatcagaaagtattcttaaaagctcaaagatatgcagagatcaaagcagaaacacatcataatacaatagttatcagccagaagaatgtttttgtggttgagataataagaaaagagtatgaagcacaggaagttaagttagtaaataaaattattattctaatgtattgtgatgttctttatagtattactgtagaaagtctctaaaagtacttgttatgagtgaaaaatgatgcctgtagatccaagataaggggacaggtggccccaccaattataaattccccaagattgtaaatgtatattttatcatgctgtgtcaaaatattcattttaatattcaaacattttaccacataataagctgtaaccatatgtttatttgttatattataccactataacattaataaatatttacagagccactgtgtatcccagatatattagaaatcatagctttcttgattttttattttaagtgaaaatattcagtgcctcagaaactaattttaaataatgttacatttgttacacattgataagagccaaggagtttagatttttaagactgacacccccctttttaactcatgttgttttatttattttccccaattgcatgaattaaagatggggtgttatctcagctttgaattccttagcttgatgtcacagcttttgctttatttgtatgtgaattctgtctttaataaagatgagctctgctgaactttccattaatgagagacacttaggtatgcatctctttataacggatcttggtggtaccaggaaaattcagaaatgttgctagtctattaataattaacatgacaaactatgattaatcagaagttttatgatctctaaaaacataacattatctctgtaaatcgaattgtatacaattaagttgacaaccgttagtaaaaaaaaataataataataaagcaggccaggttgtggtggctcagcctgtaatcccagcactttgggaggctgaggcaggcagatcacatgaggcaaggaatttgagaccaacctggccaacatggagaaacccattccctactaaatatacagaaattagctgggcatggtgatgtacccagccactcaggaggctgaggcaggagaatcacttgaacccagaaggcagaggttgtagtgagccaagatcactccactatactccagcctgggcgacagagcaaaatcctgtctcaaatttaaaaaaccaagtaaaactcaagactcctaacttatactttttctgttacaatgttacattagtatttattcttctgtgacagctgagactagaccagacccacatccaggagacaggaggttcaagatgaggcactgactttttactttcatgtgtcagtctcagggtgattcctactcagctgaaaaactaggaggaacccttgctagtttggtagttattgacttggttacctgttttcagtgttcttcgtcttccttactcagctcagctgttttcacttttctttccacctgtgtttaggaagagaccttctcagtattataaattttgataagattttcacatatatagaaccctaacaaacaaaagtagttctccatataagcacagcgtctgagcattcttcaccgatgcttggtggggatattagctgtgttctcttacaccctttagctgtcaagtacatcagaagtggaggctgtggggacaggacaccactaatgccaaccattagtttaaattcacacttggatctgtttccaacatttctgcttttgtcatcatcacaggttcggaaatcattgtgtaatgtcctgatttctgatttttctgtgggaagagagtgttgcaatttgccaccttaattgtattctgctgtaattgtctctcactagatatttgaagcacgtaagaattctgtatcatgaaacttgagtccttataccctctgttcattgactgaatttagttgcaagaggaatctttcgcttttatttttttaaactgctgatgagcactcgattgaaatgactcagctttcatctgtggtttctcttccctaatagaataaagcatatgtaataacctgaaatactggacagcttgaacttctttaatgcccctgaatgtctcttacagcctttgtctaggtttgaactttccaaattatgtatttcagacgttgagaaagaagggccttaatggctgtgacagcccagaccccgatgcggacgattccgtaggtcacagccctgagtctgaggacaagtacaggaaaattaacgaagatattgatctaatgatcagcaggcaaagattgtgtgtaagtactcagaacacccttcattttttttactcttgatatttctctgaacctggcaggcattgaacaagaaagaaaacaaaggctgtgaaagccccgatcccgactcctcttatgcactcaccccacgcactgaagaaaaatacaaaaaaattaatgaagaatttgataatatgatcaagagtcataaaattcctgtaagtaccaaaggtagatggctggtctgctgataactgctgcagtaacataccttaaccctctcagtgatggctttctctaagactcttcggaaagtcaaacagataaatagccatctcatcccacgggcagctcatttagaaagcaaaccctaaaggatgctgagattatgtaatctaacagagttgccatcgaaaagttcattctgaggtagaacagttcacagcaggaagagaaagatttatgagacacaccgtaaatttacacaatcttttaaacacacagtccatgcaaatcacaatacatgagtaaaacactggaacctccttccaagcaagtttgagaattgctataaaatacatagattatacattgtttgctaagagcagatactcaagtgggtcagcaattctttcatgtaaactgacaatcatcacctaaataaaagctgatttctgaataaaacttcagcccctctccctatacatgaaattcaacaacagcactgaagggttaaagctaatgctcgctgcagggaacagactgcatgaaacctaatggtaagatttcaacatgtttgtgtgctggggtgattttaaagctttatcagaatattatccgctttgccaccaacattttccatgctttaacatttggctaatttttgttttaaccaaatgaaaaaaattctaacagtcaatcatatgccttgccagatatttaagagaaataactgcatgtattattttgttgtccacatatataggaggaaagtacatactttttattagattctgtcatcaatcaaataatgttaattttgtggctgaaaggggtgaaacccaaggctcacataccttctaaataactaatgttagtgtctgaaccttaattgtatacaagctcctcagtaggcaatcagttccttttgaaaaaagttcattttttgtaagttagcaaaacagcctaaacctgagaaatgagagagactgaagtgaaaatatgttttggtgattacaagtgcagatatgtggggacaaagttcgaggccaaattcacaactgcactcacaagataaattaatactttaccatagtagctgcacactcaaacctgaattgaattaaattgaacactttaaaacttatttacaaaatgtgtgcatattaaaatttctatccttataaatacctatctgcttcttttgttaaatgaaatgtcagcagtagaacttttgttgaatcagaattattaatacactgtatcatgaaggaaagctaagtgctataaattcttaagggtttcataaaactattatatgcacacattcatagtgggcactttatgaaatggagtatttagtattatatgtagccatgcatacttgttatgtccagaattattaaataataaaatatccattggtattttattttgcctagaagaaaaaaagaagcggctcatttgggccaatttttatttttatttatctatttttatttttgagacggagtttcactcttgttgcccaggctggagtgcaatggcacgatctccactcaccgcaacctctgcttcccgggttcaagcaattctcctgcctcagcctcccgaatagctaggattacaagcatgtgccaccactcccggctaattttgtatttttagtagagatggaatttctccatgttggtcaggctggtctcaaactcctgaccttaggtgatccacccgcctgggcctcccaaggtgctgggattacaggcgtgagccactgcgccacgccatttgggccaatttttagttcttatgatctgagtttatcttgctatataatacattggtgtggagcagctgtgcattaaggtttgtaagtgtaggatgttaaggcggagtaccttaggtgtgtcagatagtaagaatcccctgcacagttggaataaagacagatgtatgcagtactgctgatcactcaatggaagcgatcatataggtggagttttaacccctaaagttctggaagaatgcacattggatcttgtttctcatactttagggagagagacatgtaatacacacctgtattccctcacaggatttcagcctgttacgtaaagagttcaagatcaagatacgtgatttcttaaggggtgcagtggtgtgtggtaggggctgaaaaaccacattagagtttacgggcagagctgtgagaaggagccacccagctccgagctatgccacagagtctccatctctttagtaagtgcttcagtcttcacgatgaaaagcccagtttttgcacatcgctctgagttgctggaagtcaattttgttgaaagtttccacagctgctaaaacatttacagcagggcaaggacactctgccctttgtatgtagagagtgtctccacctctttaaaaacattacaagactgtttttctatttcgaagacccagtttgaagagtttcccttttaaaacagaaaatttaatattgcagtcacctgttagtatattgtaatttatgcccatattcctcaattacataaaataattcatgggtgatttggaactgtgtcgagcagcatttcctcatgctgggttcgccatggttcatgctgggcttcacagcaagagaaaacacctccgtctgaggaaccagcagaagttaggaaaggggctgaatgaatgagaggcgggtgcaagttggttgagagtaaaagggaagggaggaagtggaaagaaacagtatgtattttcttcaaaataatgggctgtgaagagagagaaataatgttgtatgtaggatcaagggaggagttaaaatgaaagcgcttgagattatttacatgcagaggagaagtgcttggaggaaggaaaagattgaacatacaggtacaatggagatagaatggcaaagcctctcaaggaagggaaggaggatgggacctaaacaagaaggtgttacagatggagccaggtgtagctaaggtggtagctgggtagaattacgctgagtaggtgaccatataatgacctctattttattttatttttattttttattttttgagacggggtctcaccccgtgcctcaggatggagtgcaacggcgtgatcctggctcccctcaacctccgcctcccatgttcaagtgattctcctgccttagcctcccaagtagctgggactacaggtgcctgccaccaggtctggctagtttttgtatttttagtagagatggagtttcaccatgttggccaggctgttctggaactcctgacctcaagtgatccgcccgtctcggcctcccaaagtgctggtatcacaggtgtgagcctccatgcctggctattttgttttttaatgtatttagtttagcttctgtagttaattagggaagggggaagcaggtgattgaaaaaggaccgagaagttagacatcatgaggaataggagttggagagggaatgaacaagtccatgatagacttgtcaggcagccttgagggaatttagataaccagcattggtactcacaagtcatcagagttgtatgattttttttttcctctactacagcccagcagctggtaatggttaatcaaaatttaaaggtgtcattagtggcaaaaaaagggtggggggaagattcagttcaatcactcacattaaataaaagagggcccattaactaaaaatattttactttaactattttatttgatttttttattggacttttccttgtggtaagtttgggaaaatagtgggttttggatgagagttcagatacttttctgattatgactcactacagtaaccgtgatcactttgttcagggatagaaactaaaagttttttagctgtcatgtctgtgtccttcaaagctgggaccggcttcatgggccctcgacttggccctgttctcatagggctgcacttggttaaatactctgctgtcattgtcttgaagttcttaatacttttttaaaaagggcccccacattttcattttgcactgggccctgcaaattacatagccagttctgctgacagcatttcatttaatcaccccaaattctctctttcttcctatcttgagtgtttgtaaaagttggagcctggccctgaagtctttgcaagtttggtgtttttaactactttttggctttcattttttagacaaaaaaaaaaaattgtttaaatgtagatgctttcaagtttcctaattttgaaaagtcaaggagaaaaagaataatgccaatttcttagaaatatttatatgtgattatagcatttgcattccctaaaatgtttagagcagcttcatctcttcatagatacaaccatttcatgccttagataagaaaatcaaggtcaagggagattaaatgacctgcctggttagatggcaatttattacataacctggactgtaactgagattcctgatagaaaggctagtgtttattctgattctctaaaatatcttctcagtgtgctcatttttaagcttataatttgctttcaaaattattatagatagttcctttaactcagaaacagaaaatctaataccgtatgttctcacttagaagtgggagctaaacaatgggtacacatggacataaagatggaaataatagacactggggactccaaaaggggggaaggtagcagggcggggtgaagtttgaaaaattagctcttaggtacaatgttcactatttgggtaatgggtacactagaaatccagtccccaccagtatgcaatatatccatgtaacaaacatgcacatgtatctaaaataaaattaaattttaaaaaattattataggtagttcttgatacaggtaaagcaaaagattaatagaatacaaatgatcttggtatattttatgaattttgaaattttcaactatactctgataccataattatatttgactgcttagccaatcacaaagtagttttataataatcattatcatccagttgtttctgatccagaattctagaagctgaagaattaattcttggggataatagtcagaggaaggaaggagtagaatgactttcactgacctgcttgtttggatggttctgaactcattacataattattaataatcctctttattttggatgtgcatataatcacccaagggtgaggggatatgggctttgctctctaatgagacacaaccaacattctatagcatattcagggaagatatagttttatagcagatccttagatacctattaacagttaaacatttataagtagtaacagtgaattcaaattaaaacatttgtagcccagagatggctttaaatacaaactctaagcaaatatggaaaaggggagtctttaagatttattttttcctaaaacctgagacactccagtgtagatactcacccacatttcatgagaacccatttagtttattatttacatggtccaaagataataaactgctaatatctagcccttattcacttaacagaatgatttctgactacagtattttatttctatccaaaaacttatactgtgttgcatagtgtttggtagcaaaagcaacagactcagtcactagttagatgactttgggtcacttacttaacttaccaatttgaaaaggaaagaattatatctatggtcaagggatgtttaaaaggttaaatcatatcatgtatgtcaactatacagcacagtgcctgctcaataagtaatatacagtaaatagaagctttacttttgtgtcagtagagtgtcttcctaaaaattctcctttgaagaaaaatattaagttcgtataataagaagtagagtaggctctgcattgcctcacagcaaaagggcactatttaaccaacatcataaatgattttataaccaaggagaaagaagagcaggagaaagagatcaggatatgggcaaggggcaggacaaattgcaggattaaatagggtggtcagcgtgggcttccaagagaaggccagattttgagcagagacttgaaggaggtgatgcagttcgtcatggaaatgaggcagggaggcagaaggtgttaggcgatgagataacggaggttggcaaaagctagagcttaatagggcctgtggacccttggaagaaaaaaattctcatcttgagtttttattctaagatgagagccctcacagggttttgagcagaggagtgttggcatgacttaagcttttaaagggtcaatctaatttctggtttgaaaatataaaggatggcaaggaccggagcaggtaaatctgttaggacgtgactgcagttatctaggcaagagatggcactgcttgagccagtgtaatagtcacaccctccagtcattttgatacccaaagatagtccaacagatttccaaaatgctccctaaggagacagtcccacccctgtagagtaccagtgttctagatctagagagttactattatggcccaaggttgcagcaggaaacagatggcaaactctaaagggtaattgaagacagtttgttaaaaggactgtttacagatgggtagagttaaggaaaacctgagagaataatgaagtacattagggcttgcaacctagaagctgttcctatctctagatctgaaagagtaagtggaggggaaaagtaccagatcacagcaagatctatgtgtataggagagaacaactcaaaaagagatggggtcttcgctagagaaacgcagcctcagccagcctgtggcccagcaaggatgatgccactataaaaaaataccctgactttgctcccctcctgctctctgtgctgttgctggtgcctcccccactgaccagtgggaagccagagggcaggagagcctggttgatgcagtctggagggtcagctcctgggcacacagtacagtgaaggggctagagggtgggtctggatggagcaagtggagaatatacctagtagaatcactttactttgttttcttgggtatgctagagcaatccttatttggccttttaatgaagaaatacaatattttattcatgctatagacttcgactttacagcatatgctgattttttgttgttaaaagggggctggacatgtaaggctaaattcattatttgatgtcttatcaaacatttatattccattatgtcatgatgtctatccaaaaattatttcccctgtttactgtagataaatcctaataaagactgaccatattacttatatcacttgaacatttttatttccctctaaaacaatgacagattgggccagatgtggtagctcacacctataatcccagtactttgggaggccgaggtgggcggatcacctgcgctcaggagttcaagaccagcctgggcaacatggcaaaaccccatctctactaaaaatacaaaaaaatagctgggcgtggtggcacatgccaaccactgcttgggaggcagaggcagcagaatcacttgaaccagataggcagaggttgcagtgagcagagatggcaccactgcactccagcctaagcaacagagtgagactgtgtctaaaaataataatataataataaaagtaaatatgaaataaaatacaaatgaaaaatcaaagatgtgtgaaagaaaagagttttgaatgtaaagcatttgctgttgtcaagattgacatgtccagaacatggaagaaaagaaaaatgggaaattaataataagggagcataaacataaacaaagaaaagtattgtgatcatcaccaagataaacagagaaatattacacagaaagatgtatgatgcaggccagccaaccaaacagtaacagaaagtggatgtcagcactaagggcaaacaatagtaaaaacaaaatgggaccaaaaaaaacaaccaactgagcctcaagcacatatgcatttaaatttgcacaataacttattgagaacccccaagggaatgccttaatgccttctataaatcctattccatatatatgtccattttatattaagaatgccatatgttttgataccatatgagttctctggcattatattcaaagagtatttttactcgtaatgcttaaaaaaaagtagctacaattatgttcctatgttcatctagttagtacagcagaaacataaacatgattttgcttaaattgacaaaataattactcaaaaatcaatcattgaaacctggattaatctaattagacatccacacagcttcagttcactaaatatttgccaactttcacaattgagatacaggtcttgccatttgtcagtggcggtacacaccaaaatatgaagcatagtgttttctgaattgccacttcaaaatgtgaattattgaatgatacatgctctgttgaatcttgtatgttaaaatgcctattatctttagagttacttttaaaacatagactttaaaaaatgataattaaggtatatgtgctatgcacatgcttggagatgattttctatcattaaacttctacataaatatgcttcaataagcaattaaatcaaaggcttcggtttgcattttaatcctttttctctgtgaagtcatcacaatcaggcacctttgatcttgcagtcatttctggcaccagattcagatatcacaaatgaacaattactacttaatagaatggaatccaaagacaatggagtctaatgaaatggggctttgttttaaacaaaagtgaaacattttttaatggttgcaaagaaggagttctaagcacatttaagaaatcaatttatgatctgaacgtcttgagagctcttcttaatggtcttctagacacaaagtagtttggaatgtagaatttttcttggaaaaataagggctgtctgtcttgaagagcttctgttattaattcttttcttttacctttgttttgttttctgttcctgcaggctgttccacctcccaacttcgagatgccagtctccatcccagtgtccagccacaacagtttggtgtacagcaaccctgtcagctcactgggaaaccccaacctattgccactggctcacccttctctgcagaggaatagtatgtctcctggtgtaacacatcgacctccaagtgcaggtaacacaggtatgtcctcataaggatgtaatgctaacaaatagttggaaggaaccattttcggcaaagccaacactgctttatctacgagatgttttctggttttccacttactctccttcatggcttaccatccacccccgagctaggtctcctgcatgatagagcctaaattctttagtatgtttttcgaaatctttcataatctgccgtttatctttttcattctgtcacctatctcctcctgtggctatattttaaccacatactctcaaacaggatgtcagatatcctttctccacacttttacttctgctcgtcctccctgcctaaaatgccattttccctcttcctcctggccaagctaccacttctgtgaaaccttcccctgtgttctgtgatagtatttatcccatttagttatttattatttgggtcaatttttttttatttatacagtaacttatcccacaaaggacttaggcagaaaggaaatatgataagatagcatcatttgtaagacatgtgaaataaaaacaaagctgaatcagaaatgaagttaattaaacacatgtacacctgccacaaatttgtctctgcacttttacttgctgttgttcaattcacagtgtccaagagaaaaataaattatttctcagaaaaagttcatccattcttagtacttagaacaatcaaaatacattatgatgaattgtatttaatatatgtctattttgatactggatttaaagaacatttaagggaagaatgttctcttgatttgctaaactaacagtaggaaccaagtcaatgcgtattgaatataacaaaattattcctttatgtttccagaagcagcatcaaaaataattgtatttctaagtcacatacagcaaaccattatatatttgcatttcatatttttaaaagtactctataggaaatttttaatgtatcctacatacacatagctgtatgaaaatagtttattcatggaggaattttcctgtagaatacttatatatctgccttacaattaaaaccaaacatgtattactatttttgttacagaagctttatatagaaaatacagttaaattcatccaaataaaaaattttaatcttgagtctgggaaatgtatacaaaggacttcattgagccattctcttgacttttgaatatatttgaaaattttcgtatgaattttcagtaaccacatgtattcctttcagatcatactagaatgcagttcactttcctatttgataaactcatgctcatttttttgaatttgatacggtatttccaaaatattatctgattggaaataataaacatttgcttaaactgtaacgaaggccagatgcagtgggtcacgcctgtaatctcaacactttaggaggctgaggtgggaggattgcttgagcccaggaattcaagaccagcctgggcaacatagagaaaccccatctctacaaacattttttttttaaattaactaggtacagtggcttgtgtatgtggtcccggctactcgagaggctggggtgggaggaccacttgagcctgggaggttgaggctgcagtgagccatattactgccactatactccagcctgggcaacagagcaagctctgtctcaaaaaaaaaaaaaaatcgtgtatatatatgtatatatataaacaaacattttcttttaattccaaaacctgaaccaactaataattacagagtatcacttagaggcaattagaaaatctagatgatattctcactattattcttttggctgaatgttgtttttttcaaaactaaaagtaatttttttttttttgagacggagtctcgctgtgttgcccaggctggagtgcagtggcaccatctcggctcactgcaagctctgcctcccaggttcacgccattctcctgcctcagcctcccgagtagctgggaccacaggcacccgccaccacgcccggctaattttttgtatttttagtagagacagggtttcaccgtgttagccaggatggtctctatctcctgacctcgtgatccgcccacctgggcctcccaaagtgctgggattacaggcatgagccaccgcgccaggcccaaaactaaaagtaatttttatgttcaataccttattgaaacatcttgactctcataaataaacattgccaaattttaacatactgtctaaagttagcaatgaataagcatatgtttcttaatctgtggccggtgaaaaatttgttatattgtgtcagtcaataagattttagtagtaaatgtgggtagattcatgaaacgatcaaatttctggacaattaacattgcacaaaattaatggcataaaacatatttacaaagaactaaacatcaaatgtgaggtcatctgagcatatagtagaccttactctttctttcactttctataaaacatctgcttagggaaaacctagacttagaaataataaaaatgcagagaccaaagactggatttttttaaatgtaactttcttagaaaaaagattctgcaaaatgtcagtgattgaatgtatttttaacgtttgagcacagcatggcacaataaaacaaatgtcagccatctgacttgggttgtactttacaagtttatgactattgcaagaggacaaaatactgaggttgctgaaggtaaagtgttttgttctgtgggcctttagcctttctcgttttgatcttcctctttaatccataggtggtctgatgggtggagacctcacgtctggtgcaggcaccagtgcaggtaagcccagactccatactgcagtatgtatcattgttctgagttcttctactaggtgatttgcaggacaaagtcttttgaacaaataaagttaagagatctgtgagaggcatggaaaaatgacaccaagaatttttaaagcacttttctgaagcaggagtggttaaatagtaacttagaagaaaactatttattaactagaaccttccttaataaagcttcaactggtcagcagagaattaagggctctgatccaatcaacttaatcctggataccatccttggacacaagagtacctttagcaaaccatactttttgtgttctctgttaatcatttcacattaaatatgaatcattttccagccaaagaagtattgaacttctatgcatttctaaagaagagtacataaagaaaaggaggggttaagattttaattattcaacaatactgttaataaaataaaatcacattggcattaaaatgagctcttagacaacatgaatataatgcatccccaaaagaccctaaaatatatttcagctaagaacttcttacactgtgaccaataattgtctcagtcacatttctccaggtttccgtgttaatttgtaatattgagattattgagatatcgatgtcattttcaatgcagaggcaagatagcacaatactttcaaatgccaactgcagttcactattggcataacaagtaaccatggtaatttctgcagctggaacatgctatacatttaaaatagtaggaggcaggcatgaatgacacaaggttatgtttgaaatgtcaaaaaaaatcaagtttattgaaatagacatggatagcctaattaaaatattttgccagggtcaagtagaatagcctgctaattataagaaagaagataaagaaaattggtttacaaatacatttttataaatatatctatttgagggtagagtttctctgttctgatgctggctcttcactaattcactgaataatgaagaaaaagtattagacctacacagtgattagcaaacaagatgaataacactagcttcctattttatatatcttttgaaaattaggtcgagccaaattagtgtgtaaactcacgtagtattttgctggacatggaaatgaaattttttccctcaaaaaatactttgtggtttgtagcctcaaaatgagagaaccagatcaaatccagaccaatgtttcttggatccaagtctctaccaaacactatgattagaaagaatggtgaggactgagaattgggtggtcacaaagaccaagatataatataagaaaaatggtttagatgttatgatgttttacccaatatctcactgcaccgatttgcttgccattatggaaacagctagtagtggttctgaaagtcattaaaagtagtaaaaaagggccgggcgcggtggctcacgcctgtaatcccagcactttgggaggccgaggcgggcggatcacgaggtcaggagatcgagaccatcccggctaaaacggtgaaaccccgtctctactaaaaatacaaaaaaattagccgggcgtagtggcgggcgcctgtagtcccagctacttgggaggctgaggcaggagaatggcgtgaacccgggaggcagagcttgcagtgagccgagatcccgccactgcactccagcctgggcgacagagcgagactccgtctcaaaaaaaaaaaaaaaaaaaaaaaaaaaaaaaaagtagtaaaaaaaaaaaaaatgtggaggaaaacatggcctactcagctttgatggaagtggcttgttactgcttaatagctagaatgctttggaatcctatattgaaaataaaaagtgtttggttgttcaattattctgtcattgtcaattcccagacagttggctaagtttaatgatcctctagggatagagaagactctcaatcctgtaggcataaaagtttgacacacgtaggatatagtaacattgaactaacaaaatcttatgcacttagcaaattcatcctcttacctcaggacctctaccataggtatgagaatcttctaattcagaaatagaagaaaaccaaaagaaagatactgaattactccaccctggtgataataaatattatatcttgattgcatattatagctacgagcatgtagttttcacagtttctatatagctgtgaaagtgttacccatattttaaaaatagaggaagaagccctttctaactctggtcccaaggaacacctgttgcagatgccacttagtctcaagcttagctgtcatgtcctactcataaactcagccatcttccccttctttctcatgccaaccagtatcatatgtcaggctgaatatatccgtgctgatgtcagagaatcacataacaccagaggaaaacaaggccagccagaatgttgctacattttcagagaagaaaaccaaagcaaaaaggccaaaatatagcttccaaattttgcatattgtcattgaaattcaaggtttcagataaagtttgaaactcttgaggccaagtggcgagactgcaattacgttactttttagcagctgcagtttttttctaaatcaagtcatctcactttgttaaaaaaaaaaaaaaagtgagagggagggagagtctcatgaggcaaggaagtaaattgaacatttattttgtgcctataaatactaaaagaccaaaaaggtaagcatgctttttttcagctcagttttatcataaagtgtagcatctttcccatccagtgcctgagccatccttttctcatcataccatcatccagtaagtttctagaacatcctaattcatctccctgctttatattgcatcctgcttcagtctccccaggactgcttgttctttcttaaaaccttaagctaactgtaggtcatcattcacatgccaaaaatccagccatggcttctctttgaaaattaacagtgaatatcttatccctaggcccattcctactctccagccttaaccttcttcccttctgccactgctatcaagaacccggccctccagctctactaacagtagacatctaaactgctcttactgtgcactctacaaaaagcatcattctcataatagtcgtttaaattaagtgttcacattatgccctttctacagattaggaaactgaggcacagggaaattaagtaattgcacaaggaagagcccaggtagtcaggtcccatactgtgtgtttgtatgtgtgtgttttgagacagtgtcttgctctgtcacccaggttggagtgcagtggcacgatctaggctcactgcagcctcaatctcctggtctcaagcagtccacctccctcagcctactgagtagctgggaccacaggcatgcaccaccatgcctggctaattttttaatttttttccttatagagatggggtcttgctatggttttcaggctggtcttgaactcctggattcaagcaatcctctctccttggcttcccaaagtgctaggattacaggcgtgagcctctgcacccggcctcagtgtgtgctcttaattgctacactgtgccgccacttggcaatgtcacggccgcttactcttacctatgcaatcctagcatgcctttccttcttctgcttcatgctattgagcactctttgtcatcccacagaattcagttcagccatttgagaaaagcctttcctgactctaacagacaagttatgcacctctttcctgtgcttacatagtagcctgtaccaacattacatttctcattgcattatgattgcaacatctgggcacatctctctaggacgctcagctctgtggaggcaaactctttctcattcagtttgtatgcccagtttaacacctaagcgttagcacacagcagatacttggtaaatgtttgttagctgagtaagggaaaaatagatcttctagccatgaagttttaatagtgttgatgtaaaccagaaggaacatttcaaataaattatgtaattttcaataaaaaaagatatacccttgatctgtaactcacaaaaataatgtattcttctgaaacagtatacaacgaatgtttaattaaccatttgattaaatggctgagtaccctgggccaataaagcaaagtttcattaactcctctaatattcttaacggaaaacctgaagagctgacatatagtagtaaatgaaatgtgggttggtatctcagaccatcacaaatcacctcttaatacaacttcttatcatcacttaacttgaaatactttcaaagatgaagacaaagggtaataaagaagtagcaggatggagttgtactcttggtataagagaaatatacagcaagtcattataatacattagttagtaacagtgacttttctaaggtttcagttgatggttattcatccactacttaattctttcctcttaacaacctaaatgaaaagtcactgcttttaaaataacattttgtcataactctataaaacttttttttttgagacggagtcttgttctgtcacccaggctggagtgcagtggtgtgatctcaggtcactgcaacctccgcctcctgggttcaagcaactctcctgcctcagcctcctgagtagctgggactacaggtgcacgctgccatgcccagctaatattctgtattttagtagagatggggtttcacccgttgtccaggctggtcacaaactcctgagctcaggcaatccgcccacctcggcctcccaaagtgctgggattacaggcgtgagccaccatgcctgaccacattaaagcttttaacatgctaatctgagtggttattgatgatggtaagatcaagttcggttgtttgtagtcattagatttaatggaaataaccattagcagagcaatgccttgtgttggattattcactatcccgttagtatcctttgttttcactttgataatacgattgccttttattgagtagaaaggaccagtatgctcaaggagttattgattcatagttgagatcaaaaaaagagaaaaaagaaatgaaaaacctttaggaattcctttgaacatttaagataattttacaatctacatagctatttgacagtaaggcaaaggagatttatgtatattggttaataattttaattggcatttattgtaaattagatataattttataaaaaagaaactaacatctgttttcttattttgaatgttaattgttgactattttatgcatttggttatcaagcattgtcacttctggaatgcttaatttatgtcagctaaatacatggagagttgatggtggcagtgtactgccgtggataaatattgagcagtgaataagagatctggtttccagactctggaaagactccatctagcaagaccttaggtcatgactcagcacctttgaacttagtacttactcagattggagataagaaacaaatatttttacaatccatttacacgcaatgttttatgataatataatcataaaattttgcttatgtttttgtaattcatctagcattgaaaaagaaaaaacttagcatattacaaaatagaactaagtggaaagaggaaaggtcagacaatgcttaatttttctgtaccagcaccattgttttgcaagtatttgttttcaagaatacttatcaaaaatttcttggctgactttcttattggccagaaagacttctctgcaattcttacttagtgacttaaaatatcagtgaagtggttaaaaatttagtttaaaaagttggctttaacaagtttgcattttttgttgcccaggaaaacataacttaagattgcaatattcaagaaagggagaaagatacttaattaccctcaaataagaaaactaattgttagtataaagatataatttttatattatttttaaaatattattaagcagcaaatgaaaaaaatctaggttaatagttgggttctgttttgaaagtattgttccattagtttgaattgttctgaattaaaaattctgaattcattggcagttttaccttgggagttcacccaaaacataagtaaataactaacggcattgctttattattattatttatgaaattaagtaacaatgatatttttaacccaaaccaagtttatcaagattaaagaaaaaaaaaaacctagtcctcaaattagatagctacagcatgtggtatgcagctactgccaagaaaatcagtgttcactttccatatacaaaaccaagcaaattatagataaaccattaccttgataccattctctaggggctcatgttgaagtgggaaaggcaggtcaaagacaagacaaatgaaaaatgttacaggttaagtcaggatgttgtaaaatatgccttcgacccctttggtttgacttcattcttaaggagtttgatttccagaggaaaaaaagaaaattttaggttataacttcctagagagtgttttagcagattttagagccctttgtttatcctgatttctgacttcacaaattgtatcctttttattctctatccttctatatctacagtaaagtactgtgaagattggtttctttactcatatcccattgatttaacctaatagtgtgaaggataagaaaaccttggttgtttttaatattaaattcaagccgttaatatttccccctgaaatactagttttattcagaatttgtctttttttctcaaagcagtcttttctctttatacacctattaggttcctcttccctatctttggcatcatgataagattttatttggagataacacagaaaggaaagcttttttcataatcatcagtgatgtgacattgtgcatcagtagagagcagatgctgaaggggggatttggttaaaaaccccctcttttggaaatcagttttttacttaccagggactttctcactcggtgcttcaaggctgtcagccaagagtataatctgctgtttttagacaaacctttgccaatcacttaaattttgcagttacacttacatagtatgtttcagttgaatttcaatccaaagaatatttagtcatgatacagtatcatatttgaaagatcattagctatgttaaacttaagtattataccaagaaccttggataaacagtttaaatttataaccaactgatacgtccaaaaggtgctaagtgttcactgtgtttatttattattgctccatttcaattgttttaactgaactcaaatttaagtttatctattttactagacattatgccttctttttacaatttcttgaccttagagtccacccaccacctccagttattataaagaaccgattatgttgtatttaaagtataaggaggaaaaagccctgctatactaatatagaacattataatatagtagtaagagaaaactaaatctatggccagtttacatattcaaacattataacattaatttacataacaatcaagaaaactgaatctttagttggctctaatattaagcaactcagtgaaaaccgtaaaaccatggaccaaaatttttgcccaaggagtagtttgggaaaagattccagaggcagatattcaaaaaaataaaacaaccaaggaaagtatgtgatatacaaattattttagggatggcactattgcccttgaaaagtctgttaaactcctctttttccggattgttgtaaaaattaaatgagataactgatgcaaggggtctagcacagtttctgccccagagtaagtgcttgttaataaatgtgagctatggttataatcatctacattcttgattttctagcctttctggttataatgtttagcttaatgcagttccagtagtatttatgaaatgtgtggtgaagggagcacaccagtaggcttcacagagatgtccagcacggggctcctatcctcaagggtggaagtaaagcggatgtattaataaatctgaagcagaatgtgagagcagtacagtacagtgcaacacatttcactttgaacgttatgaacttctgatgtgttcgcagcagttgtgtaaatgttaaaaccacaagtaattattctttctcttctgtcatgctctctctaatttatactgtctcaatatttttgtttataaaaatgactgaaagaatgagcgattgtgtcaataatgaagacaccccctcatttttagcaaagagacagccccaaaatctcaagaagtgaacaattaaatgagtcataaatctatcattcatagttaaatggaattttttaaagatagtgtggttcaatagcatttttatggtgcaattaaaaactatcccttcagtaaatcagtacccaaaggagaatgatatttgggttttttttttttttgtactggagacatcagattgtcaatttcttccttatttgcaaatacaaggatgcatgctaaatctcagacatctggcttttgtaatgtagtggtagcaacctgcattttggattcaaatcaaagcctcttccttgctgacagggtgatctcagtcaagtaacggaagcttcttaagcctcagtttcctcatctgtcaaaagctgggatggtgatgcctaaatccgcatgacagttaggacaaatgagaaaatgttcgccaacacaaacctacttgatggactctcaatctttggaaaaacaacttagtaataagtaaaatttctttacctctccctcacaatccagagcttacacagtatgtgctgtacgttaaaagctcattgtctcattgacagactgttaatttcacacacacacacacacacacacacacacacacacacgcaaaatcgctgaacaaaacacagcccaagaaacgtcaaggacaaataggctagatatgaaattcctgaagctctggtccagcatcaggtgacatggtcaaagagaagagacagctctctttttagaacgtctgatgcccctgaactggtatggccaagaatagttcttggctttggtatagtcttggggtatttctctaagaatataccacaaaatgcactgaggtttcagagaagtttcttcatagtttaacattatgcattattatataatttccctaagaaacccccagaaaaagtggagcctttattttgtgtgtaagaatccctaattaggagtctttagcaagataagaatcagaaatctgatttgccccctttctacattaagcatattgaaattttcatcatacccagatttctgacccctgaatgttttgtggttgccttttctcttagagctattcaatgtaaaatatctttttttctcaaaaaaataaaaataaaaacaaaactgattttgatacacaacagctgaataactcacagttcctagcatatgtaacaaggtttcaggcattcaggctaggactgcagtctagaagatcatatttttccactaatttttttttcaactgtcacttccagtagagtaggggattgtatgagcaagtttatgatacacaatttaaagtaattttctataaaaagatgtatgttcatttgaggcacaaaacaatatcctgatattggaaactaacttttaatcttaaaactttaaaaactaaaatataaaattaattgatgatagtgagcattattatgtatgtgacatttcctgtctaacaacccagtatgctgtaactgttttcaaaattgctttattttttttttaaagtgagtaaaacattttgttgaagtaaaagcagcaaattgatacttcagaggtccagctgtgtgttcagcttaatgttttcctgtgtcaatttgcttcaaatccctcaaaatcagatactattaacaaattactaaacaaaattatttttatacatttatatattagaagttatttcccgggtaacaactaatcgcagatactaaaaaatactggacatttcactgtaacattgggtgtttctgatagaagctggtctcttaaattgacagtaagtaagtaagcatcattaccatttaagtatattacaggggagaagattattgactaaaatattacaaaatctacttttaaaagcatatttaatcatccactcaaaatagcacactaaaagttaaacagctactctggtgttcagtgtagctaaactcagtatttcctacttgtaaatatttatttatccagaaagagaccagaaatatggtttgaacatcaccattctgtgcctctttatgagaattcagtgtcttctgaaccagaactactatttactatgcccaagttgaccttacaacatgtccctcaaacttgcacatcacctctggcttaggacaaccttgactgtcctgtccctagttgtgtcctctcttcatttgtatccccataatttgcaaatgagactcgacatagaaaggctttcactatctcagagcatgactggttctgaaggagcagtgtagtgttgtacttcagggcatggactctggacatactgcttgggttcaaatcatagcttcaccagttgatagctgtttgacattgagcaaattcctggacctctcttttcttcggttttctcatttctcatttttcatagggatactattagtatcccacagggttgttcttgtgaagattaaaagtgctttatatccatgtacaatatctagcacttacatagcagttacaagtgcctggtactcttctgagcagttaatgtgtatgcttaatgttgtgttgttggtaaataatactatacactgtgttagcgattgctaatattgttggatggtaagattgtcaatgactgcctcagatgagtacctgagagcctctcattcagattactttcatgcttctctcacactagggaaatacttctattgagaaaactaaggctctgtagggttgagagaactcttaacagaaacattttgagtagaacctagattactctgccttatcttttttttgtccccaactcctggatgcctgtaaacctttctctctgcgctgcctcattcagacatcatttctcatgtattctagagcaaggcgttctaactagcttctctaacagcagtccaacccccttttgtctctcctttccactgccatcattgttcctttcctaacacaaatttaataaagctaacaactaagaagctatcttaggcactcattttctagagtataaaatttggtaaaagcttagtataaagcctacagtgtaaagttaacataatcttagaggttcatgttagccaagccttctttttcaacttcggaaaactttctgctcttcaagatccattgtttcatcttcagaggaatgcccctccttctaaactctgagatctctctgtcctgcattccttctctccgcaaagcctctctctgaaccatctgataaattcctgttcactcttaatagccaccctgccaccattcttttccctaggataccatgcagcttatcttttggtgaaaagttctgtatgagtaaattagtattgagatttaccttgatataacgacaacctgtggcaacaaatactcgtcagtgtggaagaaaatatcagagacttcaacttttcattttcattagggaaaatgtctgacttgtttaattctaccacttgcagttagctaaggtaatgtgctgtgaaatgattaacaggtgcaacaggtagaaaagacgctttaattaactctctataaacaaatttagtaggtgggcacttacatgatttcctggctttcatatatatggtagataagcagtttgtctcaatagtgtacttggtcatcaatttgcaatcattatctaaaatataaaattttctcaagtagcataaagagaagagacccttgatgtttcaatttaacaagttactcattacattttcagttctcacctcattgtccctcaataacttaccttttagtgcctttcctgaataattcttaatttttctagcatattctatatatctatttgtgaagcacctgaaacatataaagaactagtactctgtgtattatcgctgccactaattgcagcagaggggagtgaattcagtgtgggctgaagttgtctgaaaggcatcatgaaagagttggaactttagttgatccttaaaagataaatttgaattaaacaggagagccaatactgccagttattgaactgctagagcaaagatttgcatatattccgaggaccataaggcaggctgtgaccattggaaattaggtttcatagatagagtgtgtcaactgtagacagttctgagagccaggcagggcactgactcaactgtgttaagcactcatgtatgaaaaaggaacatgatggaagtagcagttcagaaagacttccttgagtgggttggttagcatcacacaaatgcacaaaagtttgcatacagctttaaggaactcctctgaaggcctgaaactcctcttaaggcctggtgaagaacccctcaagtagagaccagaggcccagatggagagttgctgaaatattttttttttttttttttttttttttttgagacggagtctcgctctgtcgcccaggtcggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggccgagttgctgaaatatttattcaaatggtgatggaagccaaagctaagatggtggcagtggaagtagagacaggcatttctgaagaaaaatgaataagatttggtatctcattggatatggagatggaaggaggagaggggataatagaagatgacagtttggtagattaaaaaatggttatgccaatggcagaattagccatggtccatagtgactaattctgtttatgcttattagtcttatatgcttgtattcataattcaaagtcctagaaaagaaaaagaaacaagtgaagaaaactcaaaatgcctaaacatccaaataaaagaaagtttcagaactttgagctcaaagagagctacatgttcaagtgagctctgtgagacaaggcaaaatgccttcctcataatatcttaagccaggaatatgttctttgaatttacgacttcttaaaataggagtcaataaaaaaaatgcagcaagtgtttgcaagttaactggggagaaaaatgtttttctcctaacaccacattcaagttctatgtattgacactaatatgagtatatacaaacttgtaaccagaagaggtagattctctaatcctttatgtaagttaactcatatatgcttaaatttgttatttttatgtaaaacaatatttttaatcaaatgaaactataaaacaaactgactctaaagttggtctgtacttcattttcttataatctataatcaggaaatccattcactcctgctttataatttttgtgcctttaagtggtcagaggaatgtgacatctgcatacagtcacgtctaaattgataattgtccaggcagagggtaattttaaaacatagcatgaaaaaaggttgaatccatatattagaaggttgttgagaggtggtgtttcccacctcccggacccctgaatttaaatgcgaccattctctttggtgaatttatcttaaggtgggacaacaggctcaacacaggccgcagcattctgagtgaggaggaggctgcggtttcccagccggtttaaatgcaggctcttcttagcagtaaaccacacgcatgtattcatcattgattttcaaatcataggtttctatatcactggtttaggatccacagtcttgcattcctgaatctatattatgtccaaagaataacaatttggtggctggaaacagaaatggttattatacggctccaaaatgctagctggcacaatatgctaaaaacagcagaaattcactagcaaaaagcagaatttatttgttcttaaaaataacttgatgctctaaaaatatgaatttaagaagtgtcatcatggttcaaaatattttacatttcagtatgtaaacaccttaaaatatgtgactaatcttctaaaatggcgtaatttccaaataacaggaaatattccaagagaaaaatagaaggcttttaaaatcaatttttttagttttgaggtatttactgaatgaaaagctacaatgtatatttacttttttttcccctactgctgccctgaatcactgtttaaaatgtgggcaaaaagacataggctttgttggaatttctcagagagtttactgtagaaaatgctaaaaaaaaaaaaaaaaaaaaaaaaaaaaaaaaacaaacttttctcaaggcctccgtgaagcatttccattttcgcacactggcccagtgcttgtcatatcacaggacaacacatttcacgaagcggttttacttccttttagcaaaataactcctccatgcaaaccagtatcggcatctaccgagctggggttttagtttcttctgatctattcaagcttcattgcactgcttaacagacttttttctcccccttcttttgaaattacccagctaattttccatttgattgtttatataaaccagatctcacacaggcttaatagataagtgacatatgtcttcagtgtgtccatctgaccttcagctgacagcaaagtatagagcagaattgaccttgatgttcttattctctttttatcccgtagaatctattaattcaaactaagttcataacatattcacaataatgattcaggatgacatattaaatataaaactcctctaagcactccattttgtcaagctttttttttttaagtgaacatactctcttttgtttgtttttttcttctagtgagaggaagtaaatgcattgttttatgtaacagcttttgccatggaatactgttcgaatttactgtaaagaaaatttgggggtttgtcatatttatctagctttagagaatttggctaatattccagaagttttcttatagaagggaattgatattcagattcaaccaacatttcttaagtgagtcctgtcacttaacacacgttttgggggtgtccagtttgctttatttttgtttttttgccccaggaactgggataattttattcataatccaattgacagacttaatcttgtagttatttgttatatattcagcctgtttattcatgcataaaatgagacaggtaaatgaatgggatatgaagaacaaatctgctttatacagtgtgcctcaaatatattttgcttctaaagatgttcccataaatatctcctgaaatatacctttgctctgccttcccagttcctcatggcctctatctcaggccatcaaagtagtctccagactggtccacactagcaggccttactaattcctgagtataccaatgccagtagatctttctgaccacttagaggtctgtgtcatacctctactctgaaactttcatttccaccatataaacccaaggacttttagcctggaatttgagatctccacagcccaacccctgcatccctccagagcctctgacacccctctcttttcacgggtccccttctaaacaggttcctctcagtgccccttaccatgctctttaaactcctacctcagccctttcctactgcccagtcacaagcctaacatatcttcctatggcctttctttaaggccctcatcaattcctgcctcttctgtgaatcttttattggatcacctcttctctcccgggaactcaataacacttaatctggattactctgcaggcacctcaccctacgctgccttgtattggtctttatgttttccatgagtatgtattggattaccacaaagagatttcagagcttttcaagcctggggccttgtctttgcatcctcactgggtagcacacaatctcactcatgcaggggtaatagatacttgtgttttgtaatgatggcaataacaatgaggtttaactgtctcctttagaaagcttcagaaaacaactgtctagtttctagcaaggattgttgaatcaggtagctgagttctcttattctcccttcagaggcagtggaggaaatcagcagatgtctttctgagtccactgtcatgccagctctgctggcatttgtaatcaactcctccctagctctcttggtcatattttgaaatatgaaaaacgcagaccttgggatacccacttttctgttagtaggatactgaacatcagagacctaagaaaaccctttcagtcttccagttcaatggctattcctgtgccttggtgaatcagcactttagcggaggcatcatcacttcatttcagctccagggaaggagtcttgctttctgaagttctgtgtgaggaggaaagcaagggttgtacactgaacttagtaaggagggcaaagcagatggaagaaaaaccatagagagaattcactcagagaaaagcggaactgaacagcaaaatgtgtaagcggcttcccctcctcctgcctgtcctagaaattacagtcttgctggtatgccctttcttcatttaaggacacacagacacacaaaataaaacccaaaccagtgaactgaaagagtgagtcacgccagccaggcctccgccaagctagtcaattaaagtgcaagaccagttctgtgcttttcttagaccctgaactactgtctgactttcttcctgaatatttttgataggaaaaaaagtatatgctgacttctgagcaagttgatgtatattggctctcttctcataaaaagtttttaatcttccttcagaggactattgaatacttaattgggttacttgtcccatggaggtcaaatcagtcatcctatggttttgcaatgtacgtcttaccattaagcttttgtttttattctcatgttgtgtattcttcggaaacgtatttgacctagatttcttcctaaatgctttattgttttttgttaacagggaacgggtatggcaatccccgaaactcaccaggtctgctggtctcacctggtaacttgaacaagaatatgcaagcaaaatctcctcccccaatgaatttaggaatgaataaccgtaaaccagatctccgagttcttattccaccaggcagcaagaatacgatgccatcagtggtaatacaaaactacattttaaataaatattgataatgttttgtatatgttttgctgtttttatatttgtctaacttgatgaattacttaacattctcccagaaaattaacataacagtgccattgacagagccttgcttgtatttagctattatttctggtaactggtttgcatttcccttttccgtgtaaaaaaaatatatatatatatctggtgaacttcactaggctgatgttctaggataagaaaaacattttcttttaaggctttcaatttatagttggaaaaaaatcagacactaccatcggtcaatctctacgtcccataagcagagtaataataggtaatgaggtactttataacatagtatttttacaatatttatgtcctcaacacgctgacaatgagaaagtactttccacaatttctaaatgaactttctcctgttaattagcaaatcctttcttagatgtattgcaatgattatatctaatacatcgcatgcctacacactgcctcaattcatctttccatacatttacttcatgaaaatagctatctctcaaaagcaaattaaaatcctaggcattttaggaacaaaggttatattttacatcaaaaaagaattgtagcacctctaaggaagataaataaataagaaattttaaatagaggttatatccccagaccctgtcatttttctttcttctgggtctgcatgcctaagatgaagataatgttatgggaccaaattcaacaacaaagagacttacatcagtgttctacaaattagctttgcttaagagcaagaacgtttaaaaccaagattcggtagacaaatttagatcattctgcaaacacatttatttcttttttctttctctgctctgtggcaagcttcagggtaaaacagtcctgtgagctgattagtttattatggcacagtgcagattaattttgaatatcaaccaaaaacatcacataatatgcaacattcccttcagaaaaaaactgggtctaataaatataacctcctacagggctacagccaagcagtgtgggccgtgcatggcaggccatctctatcaacagatttattccaggtcccttaaaactgatgctgtcccagggaatctgtgatgggtcagttaggtccctctctggcagccaggtgtgtagctccccttcctccagcaagtgaggtttcaaagcacagtctttttttttccttcaaaatgaagtgatgaaataatgaacattgagacactgacctgggctgaaaaccgggtagattgtcttcacatttgagacaaacagctcattaagggaaacaaagaatgtctttgtaaggagttatctttggagtctgggttttaaaactgtttaaactgttgtgtctatcggaagatgcttttccttttgttgaaaagattttgcccaattataaatatttacggacactaattaataaaactccttccgcatgctctcagtctgaggatgtcgacctgcttttggtaagtggtgagagcgcttccctcaaatggcatgtgcaaagctacttttaggtagaggtggtagctttgataaaattggaagatattggaagttaccacagtatgtcaacattgattatgtttaaataccattaatttctggcatcactcacaggtgaaaagaatgtcaggtttttttttttgtttcaatattttttctgttttcaatattttaggacaatttatagtaaaattcaaacaaaaatattctttcattacataaaactaaaatatttcttcttctgggaattaaagtctcatgattttaagtttatgtggtggatcttttatctctttactgtaatgagttaaatattcgcattagctgctttgccatctagtttgagggaagtttagaagaatctgaacaaagtggtcacagcaccacctgctggtcaaaatataacatgagcccctactcatttgctctctgctgtatgtagaactgaacataaaaactaccatggttgattttaatttttttttaatttgcatttgaatgaaaactgaaacaatggaagtacagtatacatatttcatcagttttcaacatagtctgtttttacccataataaagctatggtacttgttactagttcagttgcctaggagatactgatgtaatgggttactatggcaacagctggtctcttgaaggattgtaaatgatagggttggcagagttcatagagacacatgttaaatgattaatttcatgagatttgtaccaagttatctctttatgtggaaaactaatactgaaatctaatatttttaacttttaaaaaaattcatcagtaatgtctttttatttattttaaaagaatcaaaggataaataactcccagtcggctcagtcattggctaccccagtggtttccgtagcaactcctactttaccaggacaaggaatgggaggatatccatcagccatttcaacaacatatggtaccggtgagtagctttgtcatgtgcaattagtacactaaatactttttattgaaaatcaagatgaaaaagttatcttttactctattaggaagctttatttagggcctgcgccgtccacagcactgcagcattacccattcttcactaagacaaagtgaatatccacatttttctttcttaactgactgaaagttttatttatgcaacctgagttcaaaatagaaacacactttcaagaaaattgagctgtttctttgatgtaataaaaagctcactttctcaggattgtttaacatttctacatcatcaaatatgtacatacctttatactagattgtagttctaataaactagaattgcggactatgctacttcagagcattcgtggaatacttatttttggtttatagtatattccttttaaattagaattatcgctgatgctttatctcccctcccctcaaaattaaaaatatctataataacgataatcctaatagaatattttggaaattgaaaatgtttattctatttaccatttgataatttctaaatttaatattttcccttgttgttttattctttaatctagagtactctctgagtagtgcagacctgtcatctctgtctgggtttaacaccgccagcgctcttcaccttggttcagtaactggctggcaacagcaacacctacataacatgccaccatctgccctcagtcagttggggtaagcaatattattttttataatataattttagaatgtattttgaaaaacaaatgacagtctctaaatatgtgcttcaatatcccattaacgggtataaaactctactttattgaaatccaagtgtaattttcagatcaatacttttcaagtagcttaaatcttatatacctgttttttaagaggacagcgagctctgtaataatgaggtaaattctttccttattgttttaggctacatttgtttccacttctatcagtgatataatttttatttagttttcacacagttcatttgggacataagaaggcatttatagtataagcttagatatttgagaatttttcttttttcacataaaccatatggtttatgctaatgttaacctaatacacataggaacaactagtcaattgatacacaggcttcatgtatttataatgtactcatagtatagttgtatacttatagatattttaagaaatatatgtatataatactaactagtacatataatactaattacctaaatttggatataaaaataatttttgttttatgtagtcagaggatgtatctttctgcccccttgtggtagttttcagatatgtctttatcatagaaatgactcttgtcatttatctatggaaacgttcaaacctttaaaaagctctgaattcacaattcacactatttcatataaaacaaatcatttttttaaaaaagcttaaaacgttaactgaaagcctgactgtaaatttaataagtccaaaattgcaattaatcttcaaaagaaaataccaggaggatataaaatatttaaagataacaagcttttatattttaaaaatattctgtctgcctagcccacttttacttttctgcttagccatttgttatcgttaatcacttagctgtattagttaactagttatatatccatatgtctaaggagacagtgagaataaaacactgattagtataaaagtcactgatttataccacaactttgtgtctcttatgtttgctggtgccctctctccccccacccactagctttcacatgatagtgatttagcatatattagtgatctgattatgaaatattcacccgtacactgtttgcttatgttcatcctacccgctaatcactgtcattgaaaatctaacctttcatttaaatagtaagataaattcacgtgatactgttggtcagctttcttgaaagatagttaactttgaagatacattacatattgatcagcgcagagttttatctttttaggacacttaaattttctctggaatgttaactattcaagtagacattaactgtgggaacttcttcaggtaattatcaccaagcacataattccatccaggcaactaaaaaatatgtacatgtatacatattttgtacaaagtatcaactgctatggcttagcagggaatccactgaacatgattcttgtcaaaaataaacataactgcttatttcccatttttttcacaaaattcatccattatagggctagatttccctaaaagttatcaatgtcaaaagccatattattttctctgaatgtggcttttttttgttttcaatagtacctgataatttatatttttacatataaacacatatttatttacatattttagctgtactacaattttaaaactcttttctattacaaggaagaatctaattctctgctgcctctaatagaggtttcagaaaatgagaaaggagggacagccttagacagaaaggaactgaattacaacagccaaaggttaagcattttgttcagctcccggttcctttcaacacttaatttcgttgtgcttaatttgactcttagttttctctgtgagttttaattgcacttaatcacttcccttacccctcaaatcaatggaatgacccttccagtccttccactgttggcccttctctctctctgcttcacacacactcttttctccctctcacaatcacacacagagtagctttttgaaaggaggttccttcacatggactacctcatattcacacgattaaatgttaaactgtttttttaaaaaatcccaagctgcaatacttatgtaaagtaattcacatgagcatccttaattctttacagtgtaaatcaatttaaaaagaattgatacattttccaggccaaagttgtcgcagagatttgtgttgcgggctcacattcttttggctagagacaatgttcatagcagagtggaatatatttcagctccaccaaagtagatattcccagcagcccaagatggttaccacaattctttctcaaaattgcaaaaccataaacagagttcttcatattttgtccatggaaaaaaagttcattttgtcctttggagctttaagtcttcaaagctatacttttaaaacctagtatctgattttatctaaccaagctaagtaagcaacacaaatttatttgctatagggagagagatggctgacagaggaacttgccatcaagagttaatgaaagtcctttgaatactaatatttgatttagtgtaacactaagttttagtgtttttctaaaccaccacctataaaaagggcagcctgttttctggaagcatttccatacgtcaactttgttgatgtgggtgttcagtacatactgagagagataactctgagtagagatgacttataaaaggttaggttaaatatagtttgatagtctaatttccaggcggaggcagtaaaaattttgaataaaactatccagtcatgtttgatttctgaacaattatgggaaagggtaggagttttcccaattcaaaagcatctgtaatagatgaaaatttgcatagaggacttgatatgggtaacttgcatatctggcttctatctccccacccacctctttatcacccacccacacatatgcagtatttcacaattatcagggtctataattattcgtgtctatattttgttctcaagtagaccaacatgcttatatctgaacctagcatatatgcagttaagttattttaatgctacttttttcttttcaagaaaatacttctttgttaacagagactagccattctattttatatcctatgtcacagtataatgaagctgaatctaagatatcacttgcattttactactgtggatttagtccccagaactactcaaaatgcttcatgtatgttttcagtgtcaaatgaaattccaccaaaagataaatttaagctagtctgtttgtaggaagggataaccaataattgttacatctttcatggggaagatacacagctaaacctatacaggccagttaacataggaagatgatgcaaagaggtgaataatgcagcttccaaaaactgtattaaagaaacagaattttggttatattatttttcccttaccttgtctagattaactgcttagactgtccaactcaccaattttttcttctaattttctatgtcaccctccctgtgaagacataatctgtatgtcaaagagcaagcaaaagtatttattgacatatcactttttattttcagactcctaattcatattcattattaaatagttgtgtgattcatagcagaagcatttaattaaattttagtgaaatggtctttcttagagccaggaaaattctttattccagaaatcaaaagacgatttcctcaaacatcagaatgaatcactaagtaactttgaaccaagataaaatagtctaccattatgaatccttttgaaatacaggtgttccctctccccattttaacaaggcttatttaattaaaacttttggaaaattagtaaactgatagactataaattaataagctacaaataaatagctccaaatataaacaggtgtttgaaaattatatacagtcagtgtagtttcttgatataaatgctaacactgctttgattatataagatcataaaagctagagaaagagacgcttattaaggaaacaaataattctcctttatattattctctacattagctcatctatttattaataggagaaggaaagtaattctttgccagtaggtggtgcttttgtacaaaacatcactcaaagataaactcgtttctgactaattttatatcactatacatcttgagtttgtattgcatctcccaaaaagccagccccaagttacttcactttttttctgaaatatatactttttctctcagtggtcataatgacattgttagtgccaactaattctctccactggaaagcagcataattacatacattagtaagtaggcttgctttcctttgtttaaaatgggtgtgtctgtatggataattcttcacttggattcttcctcagtaaaagagagtaccatgctcttttgacaatatagtcaagtaatcctgactctagctctggaagtcagtgtaattagtgtaagaagagtaaaagcatcttaaaattgatgcgagcaatgccactatggtttatcctgatcaaagtcattgtgattgctaatctacacttaagggcttaatacttttttcctctagaattccaagtttctaaattttcccagattttggaaaaaggaaaaattattctctctgggaatatatgaggattaaggattataaacacagtaaaatcacactacatccttcttggcaacaagctttccttaggcaacaccagattcatcaactaatgccaatgataaataagaggagtggtagcctaagaaccgcacgcatcagggagtgactaacattaataaaattgaggtcattgtggaacacaaagtattttcatctcatgtaactgcaaaaggatgaagaaagtcaaattatcagttttaatggagtagaaagtcttaagtgtttgaaaaccaacgtttaaactttctgcagataattttcaatttccctccccctttccattttttccacctccaaagctttttaccagatacagttattgtgcagcatttgagttctagtcatttaaaatttaactcccttcactttctctgaagactatgtgattccatctgtatgtgcttattaattggaggcaaatatttatattgataataagcttttaaaaataatattcaaacacaagcattagtaaatcaaggaagtctaattccagagctaaacactgtatctaaatgcttagaaatttaatttttagaactagtctagggatagagtccatgaacacagaaaatgctttttccattgtgtcttaaacctttctgaaatggtaacctatatgtttagggagcctctcggagactagagatataattcatgaggcctggaccagttaaatgctgtaattactaccgggcaaatcaacaaaggcatcctaaatcgccctgagaaggcgatgcccttatgtgcttccaagcacgttttcttcactctgggcatgctctggtgtctatgcgagtctttaagctgatgtttgatttaattgtgagttcctggggcctccaggcctccttcatctgtaactgggtttcctttcctcctacagagcttgcactagcactcatttatctcagagttcaaatctctccctgccttctactcaaagcctcaacatcaagtcagaacctgtttctcctcctagagaccgtaccaccaccccttcgagatacccacaacacacgcgccacgaggcggggagatctcctgttgacagcttgagcagctgtagcagttcgtacgacgggagcgaccgagaggatcaccggaacgaattccactcccccattggactcaccagaccttcgccggacgaaagggaaagtccctcagtcaagcgcatgcgactttctgaaggatgggcaacatgatcagattattacttactagtttttttttttttcttgcagtgtgtgtgtgtgctataccttaatggggaaggggggtcgatatgcattatatgtgccgtgtgtggaaaaaaaaaaagtcaggtactctgttttgtaaaagtacttttaaattgcctcagtgatacagtataaagataaacagaaatgctgagataagcttagcacttgagttgtacaacagaacacttgtacaaaatagattttaaggctaacttcttttcactgttgtgctcctttgcaaaatgtatgttacaatagatagtgtcatgttgcaggttcaacgttatttacatgtaaatagacaaaaggaaacatttgccaaaagcggcagatctttactgaaagagagagcagctgttatgcaacatatagaaaaatgtatagatgcttggacagacccggtaatgggtggccattggtaaatgttaggaacacaccaggtcacctgacatcccaagaatgctcacaaacctgcaggcatatcattggcgtatggcactcattaaaaaggatcagagaccattaaaagaggaccatacctattaaaaaaaaatgtggagttggagggctaacatatttaattaaataaataaataaatctgggtctgcatctcttattaaataaaaatataaaaatatgtacattacattttgcttattttcatataaaaggtaagacagagtttgcaaagcatttgtggctttttgtagtttacttaagccaaaatgtgtttttttccccttgatagcttcgctaatattttaaacagtcctgtaaaaaaccaaaaaggactttttgtatagaaagcactaccctaagccatgaagaactccatgctttgctaaccaagataactgttttctctttgtagaagttttgtttttgaaatgtgtatttctaattatataaaatattaagaatcttttaaaaaaatctgtgaaattaacatgcttgtgtatagctttctaatatatataatattatggtaatagcagaagttttgttatcttaatagcgggaggggggtatatttgtgcagttgcacatttgagtaactattttctttctgttttcttttactctgcttacattttataagtttaaggtcagctgtcaaaaggataacctgtggggttagaacatatcacattgcaacaccctaaattgtttttaatacattagcaatctattgggtcaactgacatccattgtatatactagtttctttcatgctatttttattttgttttttgcatttttatcaaatgcagggcccctttctgatctcaccatttcaccatgcatcttggaattcagtaagtgcatatcctaacttgcccatattctaaatcatctggttggttttcagcctagaatttgatacgctttttagaaatatgcccagaatagaaaagctatgttggggcacatgtcctgcaaatatggccctagaaacaagtgatatggaatttacttggtgaataagttataaattcccacagaagaaaaatgtgaaagactgggtgctagacaagaaggaagcaggtaaagggatagttgctttgtcatccgtttttaattattttaactgacccttgacaatcttgtcagcaatataggactgttgaacaatcccggtgtgtcaggacccccaaatgtcacttctgcataaagcatgtatgtcatctattttttcttcaataaagagatttaatagccatttcaagaaatcccataaagaacctctctatgtccctttttttaatttaaaaaaaatgactcttgtctaatattcgtctataagggattaattttcagaccctttaataagtgagtgccataagaaagtcaatatatattgtttaaaagatatttcagtctaggaaagattttccttctcttggaatgtgaagatctgtcgattcatctccaatcatatgcattgacatacacagcaaagaagatataggcagtaatatcaacactgctatatcatgtgtaggacatttcttatccattttttctcttttacttgcatagttgctatgtgtttctcattgtaaaaggctgccgctgggtggcagaagccaagagaccttattaactaggctatatttttcttaacttgatctgaaatccacaattagaccacaatgcacctttggttgtatccataaaggatgctagcctgccttgtactaatgttttatatatt

SEQ ID NO: 37170 - DNA, 183704 bp, Homo sapiens; identical to SEQ ID NO: 37169

SEQ ID NO: 37171 - DNA, 52072 bp, Homo sapiens
cgcaggcggcggcggcggcggcggcgggtccctgagctggaagccggtaggactgctggccgcgcgtgagcccgaggagcgggggccgcgcccggaagggctcatgggagggtgccggggctggccccgagcgctggggacgcggcgggagggaccgggtccgccgtgccccggggaggctgctgctgcccggcggcgggaggcatgcagcctccgagcggagtaggcctgcccggtggctcgggggcccggggagaggccgccaggccctcggccggcagccgggagggctaacgggtccctgggctggggcaccccctccccgcccccacacgccctctctcgtcccagtttgggctgctcgggacccgcctccacctttttttggacgctcggctgcagctgttgggcttcctctgctccctgaagccctccaccctctgtgacccgcggcgtttctctggctgctggcccggagcatcttctgtcggcggaggcgcagctccggactacccccaccccttcccgagcacaccttcccacatctgccccccgcttctacacgcagtcgcctgctgccctccccgctggctctttttgccgggctcgcctcctttcaggagccacagtcagaggagccgcttcctgtccgagggtccaggtgctgcaggaccctggctcccaggcccagctcccctagagccggcctcgcgctgcacgggctggaccggacaggggtgcgcggggcgtgtgtgcgcggcggagctccgagcccagcgacggggacagcacctattccgagcccctcggaggcgagccagggctgcccggctgctgatgggtgctgctttctcttccccacattgagcgagagcttcggctccttttattaataaaatctgtttggctctcagaagacttaaattttgtggattttgcccctcccccgccacccgcaccaccccacccccgcccttccccgcaacctggatttttcttccctttttaaaaactctaaaagcttcatcaagtcctcttggttcgactcctttggtggaggaggaagcgcagaacaccacaacatgtccattatttcccccatatgtgatttacttaagagtcgtctttagcatttcttgtcactttgtcctattctttgtccaatttaggtagcttcatttttactggcagagctccccgtgctttcttttgtttttaaaggctttgtgtgttgcagccatgcagactctgcagttttctgtattttgttcggcagtgagtcctgcattctgatacagtgactatcgctgtgacctgtgtgctgggatagtaactgcggggcacagagtctggagcgaagcgaagccttctcagcgacttgctatttagcagagggactttgaaatattttgtgatgaaagaaaaaccgttttcttaaactgttatttgatgtgttaaaaataccttatcctgtgggaatttcccattcgtttgcttgtggggagccggaggaatcataagaactcacgagcaagagagaatcgagcctaagtgctttctggaagagtcagaattgtggctcttcagacttccggaaacgtgcttaatgtccagagatgtgaggggcatacctacctaaaaaatgattgacaggcgtatgtctgtatccctccacttctcgcttttctagtgggggaaaaccctgttaatacttggtgtgtagttgggatctttcagtgattaggcctcaagagttttgacctcggagtaaaaagattttaagggaacagtttggagagaagtaagtcgggccaggccgagcatgggaaatgtatttctaggagagagggcaagtccagagggtggtttgaagccagcagaagactagagagagacctgttcttttccgcagggccctaggccagctgtggattggagggttatgggtgatgaggggctgcaggagtgatgcggagtccttgtctcagttgagactggtggtcttctggaggagggtgggagggattccctgatgtagactcaggtgttaggagaaaaatgaagtcccatcagacctactcttggtaaaggttcgagcgcctttgtatgttactctagagtgaggcgaggaatatgaaaccaggacgtttcataacgtcctaaaactgcctactccattcgctggttattaagtttagctcagaaaacttctattaacatatttctattttatttttgttaccccttcatttcggcaactatcatttcgaagactttcaatgatagggcagctgactgagagggaagaaaggatttttcacgtttggaggtttcatggaaatagcatagcccaggcagagagagtttgtgagctcaagagggacagaggtgggctcacctgtaagcttcatcttttcttttcttgcctgaaccagttgcacagtccttttaaattttcagtcattcagacctcttgggtgatgttactagggagaagagaagcaggatttaaaaaacctgtgatcttgaaaatagaagaggattggggagactcattactaacatacttccctctcccacagttaggccataaagtgcagtgtaggatactactcacatgcacccaaatgacccatcaaaagtctagaagtggagccataggaagatgaactgtagaatctgttggagagtgaaagcatcatatacataatatataagaatgcctactatacgcagccatacaaacggaatccataactgaatgagcaaagctgtattccagtgaaactttatctacaaaagcaggcagctgccgcttgcgggtgcctgccttagagtgccacccctcacacacatgcctttcctttggtatattccttcatttggctgtgtccaataccttttggactggtcaataatattaatggttaacgtcctggatgtttgcttttttgaccattttccctttaaagtctcttttccaacttgcttttaaatgttttttcagcaattttgacctactctttccagcatggcttcttttctttttcttttttttttcaatttttctattgagacggcgtctcgctcttttcgcccaggctagagtgcaatggcatgatctcaggtgactgcaaacttccgcctcccaggttcaagtaattctcctgcctcaacctcccaagtagctggcattacaggtgtgtgccaccacacccggctaattttgtattttcagtagagactgggtttcaccaagttggccaggctggtcttgaacttccacccacctcagcctcccaaagtgctgggatataggcttgagccgccgcatccggcttcctttgtttctgaagtagagctgtaaaatataaaagcacagtggcttcgaatggagaaaatagttgatgggatcccaaattattaatggagtctgtggaaaattaaggggggccttaaagccttatgcctgaaatcttggaggtgaaacgagaaggaggtcttgggaatggccttgctgccttgagtaggtagggtggtgaaattttccccacagcaaaacatgtttttgtgcttcctgggagcaaggcaattgtcagtgagggcctagagtctaaaaggatctttgaggtcatccggtctaaccccttaatttacgagttaacaaaggacaaggagcttatgagtcaagaacgaggaattgggaagttaggggacctgatgaatcagaaatatggtaatgatgatgggatggtaaagcgtctcaagctgaattcacccacaaagggtgaaggagaatgcccgagtcataagctgatttaaggctgggcacggtggctcacacctgtaatcccagcactttgggaggcggaggtgagaggatcaccttgagtccaggagttcaagaccagcttgagcaacattatagtaagaccctgtctcttaaaaaaaaaaaaaaaggaaaaacctgatttatgtatggcttagcaaacttgcttcactttctctatctcattcagggaggcccagggcactaacgatatcaattgtatgcctccacagcataaaataaaaatcatgtatgtttgagaagcgaaaaccgttagattagtttatattctaggcacttgcatactaagttgactgttctgagaataagttagcaaaatccatctgaagaccttatttgaaaaccttgtttctacatcgctacccagcccttatgaaaatgacgcatctcattttaggagggagagtgagaaagataggaagaatgcagaaatcacctataatttcacaatctagaagtgcctctgttggtgtttttgcttctgtttgtttttctattcagaaatatatacatatgcattttaaacatgttatactgcatatatggctttgaatctgtatttttccagctaacattgtgaacatgttttcattttatttaaaaccattgaaaagcttcctaatggtatcatagtcatatcagtgacagtcacactttgtttaaccttgctcctagtcttggacatttaatttatatattttatacagatgataaagaataatgaggtgattgcatctttacatacaaatcttgctcacctaaaatatattcctagaaagtgaaattgctgaatcagagataagaaaattttgaaggtttttttcttacaaatggcaaattacttttcagtttacctttctactaacacaagagtacctgccacattgtagcagccagcatagttcagagttgtactgtactttaatcactattttaatgttttagtatgagcattttggaagttaaatcttttttctcactcatgattctttaagaataatttctcggatagaattacagggaaagaggatagacacagtttcagtgtttttattactgccaaattgtgctccagaaaggtgtgccaatttgcaatcccagcagccaagtgtgggaatgtttaccctggatcctgcttagcaccagatattataattttacaatactttgatgatttattagtggaaaatatcacagtatcttgtttgaaatgtgtatttctttgatcgctaggaaggttaaacatataaacatgtttatcacttgaaccctttttttgtgtaacttcttatttatgtccgttgaccactgttgattgctttcttttaattctgtcatattgagcaggcttccccatttttaatcaaatttaagctttttttttttccttctgaatacatagaatcatttgattcttatatagtcaaacctgttgaacatttctggattttacttttgcttggattcctggaaaagtggctgtacttgagatgagattacatgtatattttccttttcttgttacggttcatttattataattaactcttgaatccacctggaacttatttttggatttggtttgtcatgcagtaatctgactttattttttttcccaaatagatgtgtcacattatttattgaaaaatgtaatgaggtgttctttaaaaagattgcaacaaggtaatatttttaattacaaaagtaatacataatgattgtaaaatgaattaagacaaaatgaatcctctaagtaaacaaatggtagataagcaagaagcagtatacagggctgtaggtcatacggacctggatttgtaacttggttgctgtattgccttgaacaagtttcctatccttggtgatacaccactgcttcatcggtgaagtggaaatgacagtactcccatgtggctgatgaaatgtatgtgtgaagtgtgttatctagagtactgtgcctagcacactgtaaatataaatcagtagcaattatgaaaaagccctctcctccccatcttccaagggtatgtggtgcattgaagtgcggactttctgcgttagctaagggatagtgctgtttgtcttccttagctgtctatgttgattgagctgccatcaatctgaatctccattactatcaattcttcattagaccaatagttttggagttagggttgtgtgctctgcattaaaatcacctgggaactttgtcaaactgcaggagttttcccccacacctaggaattctgatttagttaatgtagcacggtcccggtttgttatttgaaaaaattcttaagtggtgaatctgatttttacacataattaaactgactggtaaaacaatacgatttggatttgtgggacattagcgaactggtgggaagggaagcagataaggcaatggcataattttcaaattgaggacttatcctgggagttgagacttctgggcccaggtttgttgccaagtaaacagataacttggagtaatcaatagcctcattttccttgttaatatctatatattcagcagcggaaggaatgctcaccacttattgatgagttccttttgtattttgtgatttgtctgctagtggcatttgtggaacaccttgggatttagaaacctactcttaagcccaaagaataaattgttttccctttcaaacagccctgtaataagggcggctcaaactctggttctctggttgcatcataatcttcactcttcagtcagtaggtcaaggcacaaccagtttttcacacttcgttttgctttttaattgctgaggatgttctgtttcccttttttcatccaggctaggttacacagtaagaaaccactgtggtcgttggattgtgaaaaacatagggccttggtctcctgtaacttgggaagtgtctacatgtagttcttagagcttactctttatctacaattagtttccctgggaagtgccttttttttttttttttttttaaacagaagacaaatcagtgatagtgttgggaaatgtgttttagtgcttattaacatacttcctgacttcacgaactaggtactgtcttgccttgacaggctgtttgtcatgcctgtagttaggaaatcaggaaatgatgtttttttgggttgttagtacttaaaaacaaaacaatcctctgaaatactgctttcagtgacctcactgaaatggtttcctgtggagaactctctttacctaattggaagggctcctggtgatggcagcaatgacagcagcatgcagacagctctgtagaacccgcacctgggttgtcatggagttctgccacttgatgggcctattttgacctaaatgaaaaagagaaaatagtactacaagcacagatatacaggtgggccataggcacagtggcaaacatcttttgttctgagtctgctattctctttagcaggtaaatactttgaatatagtgttggttttgggttttagaggaatattatgtgtgtcaattgtaattattattcatggttacagcggagtagcagtgatatggagaatgtaaaaatgatacacatgataggcatgtgtgtgtgtgcctgctcgcactcttacttgaattaatatagacagtgtaacataataaaggcattaaaggtatgagctttacagccagcttgctttggtttgaattcaagttttaccacataacatgggtgacccatggctcattagcctctgtgctttggtttcctcgtgtacagaacaggaataacagtaaacccacttcacgggattgctgtgaggattaagtgagtgtgttgaggaatatatggtaataggtttaacccggcatacagtaagcattcaatacctgttagctattatcataattatttaagatattagaggccgttgaaggtttcattgggaacatctggaaagcgtctagcctctctctctgtttctcactctgttctcccttcataccttccacgtggaaggcataacagccagatggagcagtgactcccttcttccctgtcgcgcctcctgtctctcctgtctctccgggtgagtgttttagtgtagtttaactttttttctttcttttggagtagtctgataattttctgcatataaaaaaatttacagttttattaaaagatgcaaaagaagacctaaatagagacatatcccagatccgcaatgggaagtttcaatatcagtgttttagttttacaaggagaaaagtcgagtctgtaggatggttgttatatcaacaaactcttgaaagcaaggccgtgagtaatgttcctgcagataatcgcagtttgctattgtgataagggatgtgagaggaggagggccctggtacgtggaggtggaggggcgagaaggtgaaggggaacaccagcacgtgcacagttctggattggaactctgagccccgacttctcagcccaccgctcagactctcgaatggagtgattacattacagctttccagggctactgcttggttcagccctccaatgaggagctagcagatggcgacttctgctttgcatttgtcagcaaaaatgtctgattagggaaaagagtaaaaggtagaatgctggccacaatctgaatgataaatctctgtatacaactattttaattttttttcccctgggagaagacactgtcatgatcctgttctagtcatagaagatgtgcttgctgccattgaacgtctgaggtgtagatgtctgtgttgctgaccactggaaaaaggattatcaggagggaggtgaagatgggaaaagtaaatttgagagtcagccaatcagggggctaagcgaagctcattggcaagctctgggaggtgaaggcagaaaagaggttgaggacaagcctgcaggaacagctacatttggggagtggtgaaaaggggtcagagaaagagaagcaggagaggacatgggcaggaagtgtaaaatgcagactgacttaatatgaggtgcacagcatgggtgagaacgcaagacactttgataggagaaatgaaggtgtaagtggggagaatttttatgcttctggataggattaccctaatattgtgttaagtatttttatgtctatattcatgagagattttttttttgtagttttctttctttctttttttttttttttttgaggcaaggtcttgctctgtcacccaggtgtgatctcacctcccacctcagcctctagtagctgggaccatgcctggctaatttaaatttttttttttttggtagagatggggtctcactgtgttgccagggctggtctcaagtcatcctctcccctcagccttctggagtggtgtgattacaggcatgagccgcagcgcctggcttgtggtattctttattttggtactgtctttgtctggctttagtcagggcaatgctaggtttataaaatgaactgggaagtgttccttcctctggaagagacagtgtagagtaggtgtttatttttctttaaatgttcagtagaattcttcagtgaaccatctggggctggagatttcttttttgggattttcaaaagtatgaagtcagtttacttaatagttataaaactaattcagattattccctattggatgagttgtggtactttgtgttttccaaggagttggtctatttcactgaagtgtatagagttgtttgtagcctgcagggactgtggtgatagcccctgtttcattcctgctattggaaatttgtgtcttttcccttttttctttgtcattcttgtaggtttttcaaaccagtgacaaacctctttgttttcttgatttttctcttctgcttttctgttttcgatttcgttgatttctgctctttaggtttgttttgttttttttctgggttcttgaaggaggagcataggttattgattcgagacttttcttcaatgcaagaatttatgcataaattttcctcttagcactgttttagccatgttcccatttttttttcttccatctataatatcttacttaatttgtgcaataaccctggcggtaggtagagattttcagactcactttacaaaggaggaaatgagctcagggagattatgtaacattcccaaattctcaaggctgagctgcatcctgagccgggtagtctagctgcaggtccatatggccatccagctgcctcctggctctgaagttctctctctgtagtttataatgtattcaatacaatatattatttgttaatggattcattaacattatgttgagagccatggggaacactttcagtatgaggtaggaggactgggtcccagcaaagcagaaagggaggatgagtcagggaagtagatggaacactaaaaaagcacagcttcatggaagtccaggggagaattgagagtttgtaggatgaggaagtgatcagtgataggattcatttatttaacaaatatttatagagtgtttacagtgtgctggacactgggctgggtgctggccacgcagcagtgatccaaacacaaagggttcctcccctcgaggattaggctttggtggggaagggagggaattaataaattacaagatattaggaagtaaatcagtgggtcggtgccagagagcatcggggggtaagaaaggcaactttaaatggtaatgccaggaaagttgaggcctgaaggatgagaaagagtctgccaggcagaagcctggggaagaacatttcagacaaaacaggcataaagttttgagagcgagaagcttggcacagtcgaggaggtaagaggaggccagtgtggctgaagctgagagagcaaggggaagagcgatggtaactgagatgggtctggggagcccggcagtacagtgggcagccttgaaaatattgagaggggaggcgtggcctgactcatgtttcacgatggtcctggttgctgtgtatggagtgcattgtaggggcaggaatggaggccagctggcaagttaagcatgaaatgctgtggcaggtgactgagaatgaattagacatgtacattgtatatggaataaaaaaaatctgaagggctccttatcattgtttcagtgacatttatttctagaggctgatatgtttattgtcattttccagagaatgacagaagagattctgagggtatcctttttcttttgtgcttgaaataatttaattagctgtttaggaaggaatgctcatgctattggacatggatgatgcttttgcctggctccagtaaaagagatgggaatttagtggggatgcattcttttgaatcattgttgaattattggtttctgtgagaacatttgtttctgccctcagctctgcttatatgtaagttggtagcactagaaatattagactaactatagtcagtctccaaatgactttttaataacctctgtttagactctgtatgtagtatcttttagaatttttggtatgaaaaatttcaaacttagacaaaagagagcctgatataataagcccccatgggtacccatcattcagtgtcaacagcagtcagctcacggccgatcttgggttcatttctacccgcaaacattccccgccaccctcatcctgtttattttgaagcaaattccaggtatatcatttcatctgtaaatatctcagtatatactttcaacaagtaaggacttttccatattttagtgtttggttttattcccccttagagcacataaataggtaacgtctgtctggacggtttgcctgccagagtccccgtgtatacctcttgtcccagtgtatttattaatagtctccctttccacttcaaagagtctctgtttggacagtaaattatttggtgacctcatgtacataagagaaatcttttcataggggacagtaaataggttctttaatagcactttcagtattgagtatttttctaatagtatgtcactgttctatttttgttttttgtttttttttttaaatcaggagagcaagccctggaggttcactctttcaagaagtcgtgtgctgaggtgtaatgctacacaagtcagaggaaggaagggtcctgaaacacatggtgaggaaggaatgagtcagctggattgctgtgattacgccttcttttctttttcttccattctgttgtttctttgttacaatttggtcataagtgcaaagaagattcttttgaaagcaagagatttaaacatttgaatcacaaggataatgtaaatttgagtatttggtcagctgctaattatccaagtttagattatccaaatacttaaaccttttagtaatattatcatcaactttaggtctgatgtcttgtcaggtgttctttgtaatggacaaagtgactcacaccatcatttccctcctctcattctttgctgttagctgattctaatatcctcttttctttctttcttttttttttttttttttttgagatggtatttcactcttgttgcctgggctggagtgcaatggtgcgatctcggctcactgcaacctccacctcccgggttcaggcgattctcctgcctcagcctcctgagtagctgggattacagttgcgtgccaccacacccagctaattttgtatttttagtagagatggggttttgccatgttggccaggctggtctcaaactcctgacctcaggagatccgctcgcctcggcctctcaaagtgctgggattacaggtgtgagccaccatgcccagcctaatatccccttgtctttagaaattgttattataatttattgacagattaaaatttaatgtccaatgttacgatgaaataaaatgttacttgaaaaaatgttagaatgtttaaaggaatctttattctgaaacataattaaaattatgtttataaaaatggtaaaaaggagagaagactattacacctttaatagttaaacatctttgacagaggtagaagctagagaaagtggttgtgcctctgtgaagtcctactcattttatgctacgtgtacccttgtttgtttatatcttatctcttagggtaagggaagttccatgaggtcaaggattatacaccctagattctcccacagttatacttagcatgtcttagccctgttaagagtatggtgaatattttttggaagaattaaaaaaagaaaccgggaatattccctggcatagaatattatgatttgtttctagctgtgttgaatttgagggaaagcaagtggcaagcctctgcagccagtggcagtgaagcttggtgagagagcagggctgggagtgttgctgagggactgagtcgctacaagcgtcctcccatccactgcactttgtatcacagcaacgtggtgcattgccgtctccgtgcacctatctccattttagaagattaggaaaccaaggtctgatagcaaatctgtcagcaaagaaggagaacgaatgcctctcatttctaagtatagtgttctttctaaaagagcaagttactatttatattttaagaaagagcacatgatgtctgctaatggaagataaatgagaagcaaactgggaaatacattttgtctcaggattactgcatctactactggataaagatcaaaagagttctcttcaaccctttcaactctacatttaacaaattgagcttttcagagtctttttttgtaaagtatttccaaagaagacttataggttaggaataaacataaactacccaggttggctaggaaggtatttctgttcatctaaagatgatgcccaggtgtggaacaggataagaaaagaccatggacatctttgtcccatgaatttagttggtcatcgtgttacagggctataatgccgctctagatccagttaaataagaagtggggaggggttgtaaactgcagctttttggggcacttatccatttattaccccaagtaaaagacctataccaaacagcaaacaacatctctgcattgtcattataatgttctttgagacacagccagtgttccagccattgttccatctaagatttaagcattttctagaaatgtatggtggcaggggtgttgaacataacttcttcaagactgacatggttctctttcttttgcaggcctgattgttggcaaaggcatcataagaagctggcatttatttctgttctaacctattactgtataactgtgaatagacactatgcatatttgttggtcagcaaaaccaagaaacaagagctatggcatttgaaaaagtctgtctgattccagggtgtttttcctgggtttcatcatcaggtacctcctccctttcatctcagcaagaatgtggcaccttttatcgtttgataaagattaaggacatgttctttggtcaacagccagaacttaaaatctgctggaatagggtcagagaccatttcagctgcagctgaggaaaatgaaatgttcattttatttggtgccttgtctggggagcacactaactcttctggaaacgtgtcagtgaaacagagatcgttttgtggaatagcaacccatggttatggcgagtgacccgacgtgatctggggggcaggctgcagaggactcatgacaggctataccatgctgcggaatgggggcgcggggaacggaggtcagacctgcatgctgcgctggtccaaccgcatccgcctcacgtggctcagcttcacgctctttgtcatcctggtcttcttcccgctcatcgcccactattacctcaccactctggatgaggctgatgaggcaggcaagcggatttttggtccccgggtggggaacgagctgtgcgaggtgaagcacgtgctggatctgtgccgcatccgggagtcggtgagtgaagagctcctgcagctggaggccaagcgccaagagctgaacagcgagatcgccaagctgaatctgaagatcgaagcctgtaagaagagcattgagaacgccaagcaggacctgctccagctcaagaatgtcatcagccagaccgagcattcctacaaggagctcatggcccagaaccagcccaagctgtccctgcccatccgactgctcccagagaaggacgatgccggcctccctcccccgaaggccactcggggctgccggctacacaactgctttgattattctcgttgccctctcacctctggcttcccggtctacgtctatgacagtgaccagtttgtctttggcagctacctggatcccttggtcaagcaggcttttcaggcgacagcacgagctaacgtttatgttacagaaaatgcagacatcgcctgcctttacgtgatactagtgggagagatgcaggagccggtggtgctgcggcctgctgagctggagaagcagttgtattccctgccacactggcggacggatggacacaaccatgtcatcatcaatctgtcacgtaagtcagatacacagaaccttctctataacgtcagtactggccgtgccatggtggcccagtccaccttctacactgtccagtacagacctggctttgacttggtcgtatcaccgctggtccatgccatgtctgagcccaacttcatggaaatcccaccacaggtgccggtgaagcggaaatatctcttcaccttccagggcgagaagattgagtctctgaggtctagccttcaggaggcccgctccttcgaagaggaaatggagggcgaccctcccgccgactacgatgaccggatcattgccaccctgaaggcggtgcaggacagcaagctggatcaggtcctggtggaattcacctgcaaaaaccagcccaaacccagcctgccgactgagtgggcactgtgtggagagcgggaggaccgcttggaattgctgaagctctccaccttcgccctcatcattacccccggggaccctcgcttggttatttcctctgggtgtgcaacacggctcttcgaagccctggaagtcggtgccgtcccggtggtgctgggggagcaggtccagcttccctaccaggacatgctgcagtggaacgaggcggccctggtggtgccaaagcctcgtgttaccgaggttcatttcctgctcagaagcctctccgatagtgacctcctggctatgaggcggcaaggccgctttctctgggagacttacttctccactgctgacagtatttttaataccgtgctggctatgattaggactcgcatccagatcccagccgctcccatccgggaagaggcggcagctgagatcccccaccgttcaggcaaggcggctggaactgaccccaacatggctgacaacggggacctggacctggggccagtggagacggagccgccctacgcctcacccagatacctccgcaatttcactctgactgtcactgacttttaccgcagctggaactgtgctccagggcctttccatcttttcccccacactccctttgaccctgtgttgccctcagaggccaaattcttgggctcagggactggctttcggcctattggtggtggagctgggggttctggcaaggaatttcaggcagcgcttggaggcaatgttccccgagagcagttcacggtggtgatgttgacttatgagcgggaggaagtgcttatgaactctttagagaggctgaatggcctcccttacctgaacaaggtcgtggtggtgtggaattctcccaagctgccatcagaggaccttctgtggcctgacattggcgtccccatcatggtaatagagaaacgaacagttcgttttggtgcatgaaatagtatttcactcttaatcccttttccaacttccttcactttagcaatcgtaacttctagcagaggagaatacatgcatactcatgaaaaacctgtatagattcctttcttcctgaagggtttgcttgctgctttttcaagccttggcagttctgtggctgttactcacttcctaaatcgaggatccccaaaactgaaactgattttatattcaatatacaaaaccttgtcggttatcccgtagacttccatgtcataacaagatgatgatgataatgataagctaccatttaggaagcacttagcctctaggcactataataagcattttgtgacatattatcgctgtttcttcagcttattcgtatgggagctgaagcttaggttaatgaatttgcccaagatcatggtgagtaatggagaagctgagctttagtatgtctgattccagaagcggcagctttagtcacctcccaaagggtttaggaaggcctgtgtcattttccaggtattcatagaagtcttttggaagactggagttggggtttgatattttggagttggagaaccaactccaattgaaccttccagggtgtcttgtaggttctttctcattctttactccatctcatggttaagtgctgtattttacaggaaaaataatagctaaatatgcaggacagggctttagttctgaggagtttaccatcttcagaattaaacttggcattctaggagagagatggcgaccatctctcttaaatgtgcagccttagagcaggtcttaagcagactgccacctatttaacctgctgcatatgtagttacttcctggcagaaggtagcaaaaagtctgatgggccacacgttgctagaagtctcggtttttaaaaaatgtacttcactgggaggccaattcatttgaattatttttctaagcagcagcatggtgtaataagtatgagatttggagtgatacagacctgggattaagtagtcatttcgtgatctttgataattagcttttttgatctcagcattaaagaggaaactacgataagacaactaaggattctagaaaggtgctcacttatttgattccttcttatcccttaatgttaaaggagatggaagccagtatgtttgtcttgcctatgctctgggcagctttaactgacttcactcataaaggcttcttgtatcctctctacatcatttctgtttgtgtcatagttgttactgcctacttccttctgtgcaaagtgcctctttgctttaaattttttcttactgctgctaatctttttttaaatttaattgaatttataattagaagctattcaaagactgtagggttataaatcctttttatcccagtgtattttgtatattaagttttgtaaatagggaatttttttaatagacttctcaaagttcactttttttctttctgttacaactttatgtcattgaaattaagaaagcatttgctctgtgaaagatagatgctcctcaaatagtagaataatagagcagccattgttttccatttttcctgagttttctttgattttgatagggatgtagagaagctggtgccataccagttaagttgactgaaattcatcaagaacttaccagaatgaatctttttttaaaaactctgatgggaaataagtagtcctgactattgggcagcccatcgcaataatacctaattggaaaatgccagaaactttacagataggctattctaaacagctttctcatattagcaatacaagttttttttctggtccttttaaaaaagaggaaatagcttcagatggagaatttcactccatcctgtaaatattgtggttgtgctttctatctaggagaggcgggtgttctggggaacagttgaagttgctgacatctcggatgtacccagctatcagagctagaaagagactggtagctctctctgctatagaaaaagggcactactgtgatacacctcagagtgggtttttcttctagatgtagacgtagccaattcaatacgctaaggttaatttttataaatttagcaccagggttgttcccaggcatcagtgaatctacccaggaacctccgtgccatttcagaaagtgctgggcaatacgggctcctcttatgtttaggttcccactaagcaacaggcataagtgctgggtgtttgtgggctgtgaagtgtattgagccccagctattttaagtggagaaggattgtcttaggggtgccccataggacttatatgttaaaattcctcattcttttaaataattatttgcataaaaagatctagcttagagtgaaggtgatctttattgccaccacccttgaacactcctgattgaaatgctctgtgtaaagagaacttcagcacaaatgggatggtggcggggcaaggagacaggacttgcagagagatgggagaagtgccaccagttgaagtgggtctcccgttgaatggggtaggactaccaaacagaggggcgatggtgagtgtctgctctctcccttgctcttgtatattttgtaaacacatggatcaggtcccttagctcctggagcataacaacaaagatatctaatgaaagccaactagagagtattattatgccaagggatttgaggtctagccttttgaaaaactctccactatgttggggaccaccactttcatggcacctgaaagatgttccactgtttccaggcctccgttgtttctgaggatatatcagtggttttcaaatttttgtttccttatatgtaaggtgtggttttctctggctacttttgaaattttttctttgtatttggttttcagcagtttgactgtggtatgccttagcatggttttctttgatttttattctggaaagtgttgatatttttgttttagtaggtggttagctgtattgactcagactgaaagccctgtctcgtgaatggccactctcatgttgagttcttttatatgtagctggtctgcttacagcctgcaccaagcatgcatggcttaggggtgggccagagacagagcagtttctacgcagaacttggagctccctctctctggctttctcctgtctggaattttctccattctttctacaggctgtggttaccttacacatttcctttacaggccagaaagaccatgggttttgtatgagagttttagctgtctttcttggtaccaactctggcctactctcagggtgaaagcaacagtaattctccctgtgtcagtaattccctccctctgaattttagcacccctccataattggttgtcttttgttcactctctagtgccttctggaaattctttttttggtatttttgtgcagaggttatagttgtcatctgagggaggactgggtctggcaggggcttactgaactcttctggaggcagaaatgccaagtaatcccttcttgatagatagtcccattaaaaattttggtttgagttactactttattctgaccagtttacacatcttccttactctgctttatactctggaaaatagtaagtagggtggctgttttagagtctgtccttttggagttgtaacatgtgggctgttaggaaagggacatctttcatttactaacagtgtagtctagctcactcaaggcatcacttcccttcacactgtatactcactgactgctgagacagtctcttggcagcccgtccctgagtcttaggttttcattctcttcttcataaagggtatggctaattgacgcagggtgccttggaagggggcttttagaaggggtgacatttgagcagaagcctgaatgaagcgagagaggaggccatgtaaattctggagggatgtatggggaatggcaagcaccagaagcgatgcccagtgcatccgggtggcgcgtttgaaggaggttggagaaggcagtgggaccagcaggtgcaggacagtgcaggtcgtggttaggaagtctgggttttatcctgtctgccttaggatgcccttggagggtgttgagcagaggaggcacatgatttttatggaactatggggaaaagagcagaagcaaaaagacttgcagtagcctaggcgaggagcggtggtagagagaaccagttcagagatcagcatagcacacatccttgcagactgcaaggtctctgtggaagtgatgaggtcagaatgcaccattttttttccaaatgaaaatgatagtgccgggcgcagtggctcacgcctgtaatcccagcactttgggagactgaggtgggtggactgcttgagcctaggggtttgagaccagcctgggcaacatagggagaccccatctctacaaaaaaatagaaaaaattagccaggcatcatgcatgtctgtaatccaggctcttgggaagccgaggtgaggggattgcttgagcctggtaagtcaaggctgcagtgagctgtgattgtgccaccgcgctccagcctgggtgatagagggagaccctgtctctaaaaaaaaaaaaaaaaaaaaaagagagatacaagattattatttttcaatgcccttttccctctgtcccagcccttgatattcaaattgaacagggagagttctttttttgggtaatataaatatcattccaggggagttattttcatcctctccccagtagtctattagggaaaagggaagactggaagagaagctgcatccgtagtgcactcttggcgtcaggaactttctggctggggactccgcctctcaggctaagaggcttggcttctggctagacctcaggcaagagagtggagatcattctcagggcttactccttaaagtgttggtaagctgtatttttttatttctgcccactctacttttaaaaatatcccttgaacgaatgagacgataatttcctaaaattgtgatagctaggtgaagccagcaggaaaaaccttgtccagcttctccaggtccaagactgtgcaaggtctggtgcacttcactaggagctggcacatctgggtggttcgtctttctctttgacaacattttacttaataacttggtggctatagctgtgggtttctgtttgcgaatgggctgtatggctgcaaaggaaaattatataaaacaaggctaccccgaaccaaaaatgaatactaagaaatacagaagttgaaagcaattgctggaaagtcatgttgcataatttactaattgcagcaaattgattcttgaggtaatgtcttcccctcttagtgtatgtgtactctttttactaattcaaagtaaggaatctgagactgtaagaattctgttgcttcaggtcacttgactaactgatacctgtattagaatgagggctcaggactgtttttttttttttttttttgagacagagtctcacgctgttgcccaggctggagcacagtggtgtgatcttggctcagtgcagtctccacctcccaggtttaagtgattcttgtacctcagcctcttttgtagctgggactacaggcgcataccaccacgcctggctaatttttgtatttttagtagagtcaggattttgccatggtggccaggctggtctcgaactcctgaccttaggtgatctgcccatttctgcctcccaaagtactgggattacaggtgtgagccaccaccagcaccaggtcttaggacttctgacaatagatatgtattttttttctttttttttttccacgtgtaaatttcttggagaagcacaaacttgtttttttaaataaagatatgtataaaatatagaaaatgtataaaaattaaaatacatacagaatatgaaatatacatgtaaaatgtatgaaaattaaaatagagactgctaatatcatgttataataattgttaacagtttttgggcattttctgtgtgctaggcactgtggatggtctttatctgcattctctcatttgttgacctgctaacctaggctttcttacctgcacttgcactgggatcattggcaactttttctcttataagttaaaacagacttgtctcatctaaaacatgtacaattttgtttgtactgtatgacatccctgtgtaaagttataaatggaaaaccaatgcactgttaccttcttattctcttttcttcctttgcgttttcttgctttctgccccatcacttgacgtttattgaatgaatcccttaaataatgtagtccttggctgggtgtggtggctcacgcctgtaatcccagcactttgggaggccgagatgggtggatcgcgaggtcaggagtttgagaccagcctggccaagatggtgaaaccctgtctctgctttaaaaaaaaaaaaagaagaagaaaaaaagaaaaaaaaatacaaaaattagccaggtgcagtggcggacgcctgtaatcccagctactcaggaggctgaggcaggagaatcgtttgaacccaggaggcagaggttgcagtgagccgagatcgtgccactgcactctagtctgggtgacagggcaagactccatctcaataataataatgatgatgatgatgtagtcctctttctatcatcttctctctgtcgctcacctccctcccatcgctcacctccctccccactcacttcaagctctgttacctaggtcctcctgagctgggtgggcatgactgtgtgcctcttcctggatctcattttcctcattcctgagttctctgatggttcctcttttaagttggaggaaggggatgatggagaactaaggtcagttgctgtttcctttcttgcctgtgtgatggcttgatgttaagtttcattctcagatatggatttgctatagggatgtattatgtacgtatatatgttttgttggaggatggagattgtcgggcttggctgggccggatgtaatctgaaaaggggcatttcaagtgtatttaaatggccaaatttcataggtggcaggttccaggccacgattgctgtcccttttcctttgtgataggagaaggtcaagggtcccgtgaatgatattgtgcagaagagctagcgaggcaccgtcagggagccctgtgtgtgagacaggccaagcaaagagtgggcattgctcctggcttgatggaggtggatgggttttttgctatagaaaactacactaaatactaagaggtttcctaattcctctctatcattctttaagattattaaagatattgaatgtttacctataattttgatctagaaacttctcaagtctttatttcatattctgtaaatagaatggcagggctaaattatgttctattttctgcccattcattcatttataaaacatttgttgaacatctgctatattgccaggcactgtggtctattcattttggttaatgtcataccagtaattaaagcaatcacttgaaagtgagtcttcctgtttgcaagttactaagatgtaatcataaggcatctaatagcaatatgctgtagtaacatgaagaaatagccagtattgtggggttgagggaagagtgttggtttgatttgaaacaaaacaacatcaacaaaaatgagaacctttcctaaatatgacacagtccctctggttgacttgtttcttttatgttcgatctgtcttttctcagattcttagaggccgtgctgatctgtgagtctgcatttagaagtgtttttttttttttttttccgagatggagtctcgctctctcacccaggctgtggtgcagtggcacaatctcggctcactgcagcctctgcctcccgggctcaagcaattctcctgcctcagcctcctgagtagctgggattacaggcgcacaccaccacgcccggctaatttttgtatttttagtaaaaactgggtttcactatgttggccaggatggtctggatctcttgaccttgtgatccgcccgcctcggcctcctaaagtgctgggattacaggcgtgagccactgcgcccggcctgcatttagaaatgtttgagcctttctgttcttctgattttggtgccagaatggataatagttggtttgctgagcttttgtttagccattaagcactgcagctttgaagcaaaactgttagaagaaaacttttactcttccacccatttagttttagttggcgtttgcaaagtttgtgagggcagaaatctttttgcggctatagggaaaaggggaacatcttaggtaatgaactatagttagtcttccaagtgctgttttggtttactgtcttcctgcaggttgactctaaatcagggtgtttcagcagtggcacagtgacattttgggtcagataattctctgttgtgggggctgtcttgtgcactataggatctggcagcatccctggcttctgcccactagatactagacgcaagtagcgcacccttttctccagttgtgacaaccaaaaatcccttcagacattgccacatgtagcccgaggcaaaattgttcctggttgagaaccactgctctgaattcttaaagctgacttactgactgcagttagttttgtcagctaactgacaaaactgtagtgcttggtgttgtgtttctgtgaatctttaacagcttttcttttctttttttttttttttttttttgagacggaatcactgttgcccagcgtggagtgcagtggtgcaatcttggctcactgtaacctccacttcctgggttcaagcgattctcctgcctcagcctcctgagtaactgggattacaggtgccctcccccatgcctggctagatttttaaaaaattatttttagtagagatggggttttgccatattagccaggctggtcttgaactcctgacctcaggtgatccacccgccttggcctcccaaagtgctgggattacaggtgtgagccaccatgcctggcccttttattctgattgctgttctgattgttaaaatgcagtttgctatacctgaacagctgttgtcatccagcccagagcagttgtgctcagagggtgagcagagatggcaggcgccctgtgttcctggagtccttagtagttgttctcttgttgcttcttgatatctaagtaatggactttaataaacttactaaaaaaaactagtgtgaaatctaggccaaaacactttgatatttgacctccagctgcatgaccccacctaagtcttctaaagcacaagtaggttctcttgatttggttgtttgtaaattagataattttggatatgatctagatatcaaatcattgtagtttttcttgtttttcgttttcaggtgcagagttaggttgtttataggattgtcaagtttggctgataagtaacttcagattttgcaaacagtgtggtgctatgttgatttagcagagagggtgctggcattcacacgtctagtaagaggaagagttggaatttgaacccaagcttttctgattggccccaaagccatgctttctccctctgtaccagtgcttctccccatttaatgtgcacaggaatcccccaggggcatgttaaaatgcagattctgactcagtgggcttggggtgtgcctgcactcctacaggctccggtggtgtgtgctgctggtcttcgcctcacactttgaactctgaagctccttgctatattcctggtttactaattgtgctgtagataatccacctgaaggttaacccacaaaactgataatctacaagccaatattcaagaactgaagtggtttttcttcattttaagctgtgtgagggggagctttgtttggctgaattggcagaatcagttctgtactgagtgaatgctaggtgtgttaggtaaagtgaatgttcgaggggagtttgttgagggagtttgtgaacagctaccatatgccgtcatttccaaggcggaccttattttacattttgtcatctctgaaattgagatgtgtcttacaatggatggcctcttaccattgctgagcttgccattcaagtccggccccttcttgccaccctcccgccctttggcgagtggaaccgacagctgctaaggtgagcacttggcatctgctctccttgctgctctctcgtctgacctaggcctcactcggtccttcgttttgtcattgtggactctgagcttaggataccctgggctgtacacttgggaatttttatgctggtcagacatgctgcagggcaaggtggatttctcggtctgttgcttggcttggacatctgttaactgtggtggcgaatctgttacagatccttctttgtcttgagttgggcaggacctcctctggggctgaggtgaagtcttaaagaaagctctggccaagagtgttgactcttgcctgtaatcctgtcactttttttggaaggctgagggagggggaatgcttgagaccaggagtttgaggccagtcaaggctacatagccagaacgtgtctctacaagttttttttgaaattacccaagtgtggtggtgcatgcctgtaggtcccagctacttggggagctgagacaagaggatcaatcacttgagctaatgagctctaggctgcagtgagctatgatagcaccattgcactccagcctaggtgacaactcaagactccatctcttaaaagaaaaaaaaatttaagttctgtaatcaagtaaacaagggatcatcaatttcacatgccttcttaattggcaacattgttttttcttgatggtacacagattaataatgcattttcaggccaggtgtggtgactcatgcctgtaatcccagcactttgagaggctgaggcaggcagatgccatgagatcaggagttcgagaccagcctaggcaatatggtgaaaccctgtctctacaaagataaaaaaattagctgggcatggtggtatctgcttgtagttccagctacttgggaggctgaggcaggaggatcacttgagcctggcaggtggaagttgtagtgagccgagatcacaccactgcattccagtctgggccacagtgagactctatctcaaaaaaaaaaaaaaaaaaaaatgtctgggtgcagtggctcgtgcctgtagtcccagcactttgggaggccaaggtgggcggatcatgaggtcaggatttcaagaccagcctggccaagatggtgaaaccccgtctctactaaaaatgcaaaaaaatagccaggcgtggtggtaggcgcctgtaatcccagctacttgggaggctgaggcaggagaatcacttgaactcagagggcagaggctgcagtgagccaagattgcgcgactgcactccagcctgggtgacagagtgagactccatctcaaaaaaaaaaaaaaaaaaaaaaaaaaaagcattttctatggtggctttggtttgaagaagtttataaagttaacaaaagtttatcaggaaaaggactgggtttggaatcaaagtatgagttaggaccgggcgtggtggctcatgcctgtaatccttgcactttcggagccgagataggaggatctcttgagctcaggagttcgagacgcctggggggaacatagtgatgagacttcgagaactcgctttttttttttttttaaagttatgaattagagttttggctcttgcaacttgccagttgtatgacatcactctgggcctcagtttctgcatgtgtaaagtgacagacgctatagtctccaaagcccttctagctctgaattaattggattttaagtgtgctagaatgaattaattgaagtatgagggctctgcattaagaatatagaataaatgattctcctggcaaggagggtgtggcaagaggcatctgaactggacctccagggggaggatggaagagaaggtatttgaagttgaagagacatgctagtaggtcacagagctccttggaaaccattcataaatttaagtcctcggatgcagttaattcatgccaggtagaggttgttctcagtacaagtaaaatagtctgttggaagtaaggtgatttttcgtggcattctaaaaagattattcttcatgagatgctctttgtttttggggtttgagaacaaaataatggttcccctttggttggactaattagacaaagacactctaagaataaaatgagccatccaagtactggctgtggtcatcatttatatgagtattaggtggcaaggtgaataacacagctactcacccacactgtaggtaaactatacttaactgagatatggttaaataaaaattgtttcattatgtagttgtactatttgaagcaccagtttctgttttatgaaggaaatactgctttgcatgtatgttgaatcacttagatgtgttttgaattgggatttgctgaagacgcagaagctgttgtacttgagtacatgataccttgaaaagaaggaaaaagtttgtgtacgagtagtcagcattgtaggtaggaatttcaaaggtgaagtaactaatctcgaccagatgggctgtgctcttttttgggatttatatcccaaaaaggcgttagaattgggagtcagaagtgacagactcatgaggtttctgagttgggttttaaaattaacaagcatgctgggaattccatagccattggaatctcagatccactctgccaccttgtgttctcttgggagagttgtttttaatttccctacatcgtgtttattgcgtgtataaaataatcttcagcttttgcttgattcacaagaaaattagctaactaatgaatgaagcttaaaaggtaaatctatatacatttattgaagtataaggcagcttttattcctgaaaggcatatgctagattttacaagcgcggagatcaggcaaaattattcagtaaatccagccatggtctccttggacctaaatacagattttgtttggcctttcataacacagccttaatttttaatgtttttccttcctcatcacaggtggtccgtactgagaagaacagtttgaacaaccgattcttaccctggaatgaaattgagacagaggccatcctgtccattgatgacgatgctcacctccgccatgacgaaatcatgtttgggttccggtgagagactaatttccaatcaaaactttaggttgcaagtgacagaaaacctggattaggctgcaaaatgaattttttggctgatggtaactgagaaccccttgcagatagtcagggctgatgtaggacgtggctggatgcaggctcgtagatggcgttggaggagtccatctctcttcatctgtaggctccgctctgtgttcccacaggcctttcctctgtggccaggaaggtggaattctttgattggctagaccctggttacctgcctgttcctggtgctgcaggtgtatcatccttaaatccaaaccacatgggcagagagtagaggcaacgggtagggtagttctctaaaggaaataggagggttttgtttttagaggaatgggaaggcaaaagtgacatgttgctgtgtgttggagcaatggaacagtgccaggatcctggacccaaaaagatttgggggaaggagggtgtcagaagcaatgatttaaaaggaaaaagaaggggaggaggaaaaggaggtggtggtaatgatgatgatgatgatgatggtaaacatatgttgaacccgtactgtgtgccagggactagcctaggactttgtcttatctcattcatccttctaaaatttgatgacataaattgtagctgtctccatttcatgtaggagtaaattgagatagaagagaacagaaccacgtagaagctagaaagtggcagcagagctctgggttcaaatgcaggtttgtcacactcccaacctgcacccggccttcaactctcctgccttcttgagtcttaggaattgctgaaggatcccacttgagggtcactgcagggaagaggatggagtagatgaaggctactccaggtatctcagggactgggatgttggtttagggacagtttgttacctgttaatggtgaggtaagtacaaaaattgagggtaagcattcagaaacttgtaaagcaatttgacatttactatgaaatccaagtatatgattatttttcttgcagttcttttttttacaacatttcttcaatataattcataccccataaaattcactcatttaagtgtacaattcagtggttttagtatattcagagttgtgcaaacatcaccatggttaattttagaaatcttcatcaccactgaaagaaaccctgtacctattaacagccactcccaatttttctccaaacccctcagtcctaggtagccactcaatctttgcatctctatagatttgcctattctggacatcttctataaatagaactgtacaacgatgcatggccttttgtgactctcttctttcacggaacatgatgttttcaaggttcatccatcttgtagcaggtaccagttcttttttattttgagatggagtctcactctgttgcgcaggctggagtgcagtggcttgatctcagctcattgcaacctctgcctcccaggttcaagcgattctttcatgtcagcctcccgagtagctgggattacaggtatggaccaccaccatgccaagctaattttattttttgtattttagtagagatggggtttcaccatgttgcccaggctgatcttgaactcctgagctcaggcaacctgcccgcctcggcctcccagagtgctgggattacaggcatgagccacggtgcccagcccaggtaccagttcttcattcattttctgttgatggatatttgggtcatttctatttcttggctattatgaataatgctgtgaaccttcatgcgcaagtttttgtatgaacatgtcattcctcttgagtggatacctaagagtaatgtgggtggatcatgatagctgctttaacattttgagccggtcaggctgtttttcacggtggcagccccatattgcattctcaccagcagtgtatgaaggttctagcttctccacatcttcgtcaatgcttgttattttccattttcaaaatttatagccgtcctagtcattgtaaagtgataactaattttatatataaatgtgtgtgtgtgtgtatgtgtgtatatatacacacacacacagatggggtctcacattgttgctgaggctggagtgcagtggtgcaatcttagcatgtggtaaccttgaactcctgggctcaagtgatcctcctgagtagcggggactacaggctcacattaccacacctggctaatctttacatttttttttttttttttgtacagatgggttctcactttattgttcaagctggtctgaaactcctggcctcgagcaagcctcccaagtgctgggattacaggcatgagccacagcacccggccatacagttgtgatttgcatttctctcaatgatgttgagcttcttttcatgcgcttattgatcagttagcctttgtatatcttctttggagaaacggcttttcacattctttgcccatttttgtttggattgtcgtctttttttttttttttctgacacagagtctcgctctgttacccaggctggagtgcagtggtgtgatcttggctcactgcaagctccacctcccgagttcacgccattctcctgcctcagcctcccaagtagctgggactacaggcgcctgccaccatgcctggctaatgtttgtatttttagtagagacagggtttcaccatgttggtcaggctggtctcgaactcctgacctcaggtgatctgcccgcctcggcctcccaaagtgctgggattacaggcatgagccaccgcaccaggccaggattgtctttttattatcacgttataagagttctttatatattctagatgcaagtccattatcagtgattggagttgcacaattttctcccattccatgggttattttcttgctttcttgatggtattatttgaagcacagggttcgtgttttgaagttcagtggatctattttctttggttgcttgtgctttggatgtcatatttaagaaaccaggcagttcatttttgttgtattttaccaaagtattaatctataataattttggggaaaaattagttcttccccacatcatttgaaaaccactggaggccgggtgtagtggcttacacctgtaatcccagcattttgggaggccaaggcaggtggatcacctgaggtcaggagtttgagaccagcctggccaacatggtgaaaccctgcctttactaaaaatataaaaattagcggggcgtgttggcgtgcgcctgtaatcccagctactcaggaggctgagacaggagaattgcttgaacccaggaggtggaggttgcagtgagccaagatcatgccacttctagcctgggcaacagagctaaaacaaaacaaaacaaaacaaaacaaaaaaaacactggagtagatttctttggcgatctttttcaaattaagtgtggatccaggatagagagagttctttctctgtgcttccattctgttcactgaaggcctaacctgacctacctggctctggagctgcctttggcttaggcttgtaagagcagatgctcagataaaaggagcagaggctttattgctcatctgtcttaaatccatctgtaaagaatgatttgacacatttctgaaaaattagaacatctgttcttattctcccccacccagcctctcacatttcctttgacctcttgcttagtgtattattgaaccaagtctattgacagctgtgattaaaaaaaaaatcctggtaaaccgaggtgtattttttttacacgataatagtagctgactctctccacttgtttttatgaaaggaaaaaagccatgcagtaactccaggcatgatctttgctgctgcaggtggtagtggtgggggtgggcggtagggagtgtgtttatgctgcagcgtgatgcagtttggagcgtgccgaaggactggcgtggtgagcatagtcgtggagtgttaacaggagaactgccaacccttagatccaagaatgattttgataaggagcccagctttaaggagtttgaagcctattaacatagctggcattaacatagcttccaagcccctgatttagggacttcttaccttgcccgtgctattttccagcagatttgcaggtggtgagagaataatgggaagccttttaatgtgtctcttaactgtcattcatgtttgagatttagcctctggtaatggagctggtgaattatcattgctgtctatacatcctaaccttttcctaccctgacccttttctcatgcatttgggcatcctttgatctaaaacctttctcttattaatctccccaatttgcttatttcaccttaatgggaatgaaacagacctaagttcaaaggaaagggtaagtctaagaattctttcttctggcaaagatagatcttgactcacttcaacttaggtagccaagaaagaggcagatacaatcaatcataagggacagaaaaggtataccaagagacttgagagcatgtgtccatacagaaaggaatacacaaatggccagagcagcgttattcgtaacagaagtgcaaacaactcagagggataaatactgtggttccattatgtgaggcccctaggtagtcattcatagagacggagagtagaataggggctgccgggctgtgggaaggtgggagtggggattagtgtttaatggggacagagtttccgtttgggaagatgaaagagttctggagatggatggcagggatggttgcacgacactgtgaatgtccgtaatgccactgaaccatacatttaaaaatgattaagatggtatattttatgtttgttttgccacaatttaaaaaaaatcagttgtctaaaaaaacccacctagaaggctgttacattgtgatagaagttgtgatttctcctcttttggattagattagatgcttctagacttattaggagaggaactctgttgaaataaaatcttctgtgtcttaggaactgaagttccatgtaagtgatgagggagtttgcaggcagtttaaatctctggcagcctttctgcaggcctgtcaggtcctgtggagcttaaacgctttcagttctccaatttatcctgtgaaactggggaccaattttatttgttctaatttacctataaatttggagatgatatagaagtttctactgaaacatactgaagtctccatttatttcttccatttaatgaaacctttcagttgtatggttctgtaggccacttctcatcatacatgtttctccgtcagccctgctcaaatttggaattaggagtggtgcagttcagtagtcttctgtggttaaaccagtgctctctaaacctttttattatgttccttctctgtaaaagaaaagtgtgcaatatatgtaaattacatacatgtccttctgaactaatatgtcatgcttattaaaaacaaagcctttcttagaaaatgcttgttcattcattcatttttagagccagatcttgctctgttgctcaggccaagggaggtggtgcaatcatagctaactgcagccttgaactcctagaatcaggcagtccttccacctcagcctcccaagtagctggtagtacaggtgtgctccaccatacccagctaattacaaacaaaaatttttttttgtagagacaggatcttgctatgttgcccaggctggtctccagctccttgcttcaagcaatcctcctgtgttggcctcccaagtgctgaggttacaggcatgagccatcccaccaagccctttcttggaaattaaataagctaaaaaaagaattgaaattgatatcatctttctgctgcttagtagattattgtatataccccattctggagccctccttagtagatattgtacataccccattctggagatcccctttccaaacttagggcttattctttctggaagggctggaggatgctgactgctagagggacaatgtgcaggtgcttattaaggaagctgaatatgataccttatttgcttttatcctgtttggcttgttgttgattttgttttattttgaaaggatacgagaagtaaaagcctaagggccagagcttgtaaggtggaggcaataactgtgaacacttctgatgaccctagagctctgtattcaggtctgtgtatgcacttgtgtttttcaagggtgtggagagaagctcgggaccgcatcgtgggcttccctggccgttaccacgcatgggacatcccccatcagtcctggctctacaactccaactactcctgtgagctgtccatggtgctgacaggtgctgccttctttcacaaggtaagaaaaagctggtaataatggcatcgacttggtgagagtttcacctttgtgtggtagcggaatgctgccctcagcttagctctcctaacgcttcttacatgtttcttttgtgctagaagtcagttttttctatttttacagacaatgatcaagatgcttagagcaactctgggataaaaagtcaagatgagagggctgcctgtacagttgcacataggccatttggaaaccactttatctttctgggcgttggctctccgtttgtaaaactgagggcactgggctaaagacacctcaaataccttccagttttaacactgccaccctagatatggcccagccatcagaaggtgacctgggcacttttctgacttagatataccatgcctgtcccgggccccacgatgagcctctgtgtggctctgccagttctttgtgatgctttagtgcttattactttcactgtgcctcctaatctgattttcactgaatatctgaagcttaggaccctgcagtctttcctcctctactgttctgtattctgtttttttctcctggcccatcttccctctctacctcttccatcctgtaaagtggcccctgaccacaagtggctgctgatcacctggtgcatgactggtcagaatggagacgtgctgttcagtgtaaagtgcacaacagctttcaaaaacttgtaacaaagggtgtcagatagctcagtaattgtttgtgttgattgcatcttgaaatgcagttagtttggattactgggttaaatacagttattgatttttactgtctctttttactttttaacgatgtagcttctagaaagtttacagtgctgtatgtggtttgccttctgtgtccgtgagtgccgctctctacctccctcctgaagtgttcccgggccctgaggagtccctgttctaagattaccctggcattacccccactgcccaccacacagagcacctcttctgtgccctgagtcttctctgaggacagtgctcccattagccttttcctgtagactttgaggcactcatttccccacatctgtgctttggcacagggcaggtgtagggaacattttcattgcttaccaatgacacttccctcccagctgtcacataaagtctcatttgcagctcctgtcgtctgtcttgctgccatcaaccagccttttcatcgtgccctgacagtcaccaaagacggtggcacctgcctccttctctttgtctgcatccatgccctccatggttctggtgcctccactgtcctcacggaagaccctcccaccactctctctgcatgaatggtgaagtgtcccggggtctagcctctgttgctcttcttattttccctaggcgttctgtctcacacacaaggttttgaggcttttcttagcatctgcaggctggtaatttcctcatctgtattccagccttggcctttcttgctgaggtctgcgtttgtatatttcattgtttccagcatatctcccgtttgtccctcagacacttcaggtaaacttttcccaggaaagctcaccgtctctccctagctccttgaagtcttttctcccttacatatctcccatctcagatggtggcatcttgccagtcacctcaaatagaacaataaaattcatttttatagggacttttttaattttttaagacagggtctcactgtcgcccaggttggagtgtaatggtggggtctcagctcattttagcctccacctcttgggcccaggtgaccctcctgcctctgtctcctgggtagctgggactacaggcacgcatcaccacacctggctaattttttttggtaatttttatagagatgcagtttcgccatgttgcttaggctggtctcgaactcctggactcaagcgatctgcccgccttagcctcccaaagtgttgggattacagatgtgaggaaccgtgcctgacatatagggacgtttgaaccagcctaagcagtcgttaaactttcagctgttctttttcttttaaaaacttaatgtgtgaagttgatacactcatcccattcttgcacttcacctcaggacttcctttccttcggtgggccttgtttggactgaggattgcaagtagagtcagaggattagggtgtcagcaactggccaagattttcacacttgctcagctaagaaggagccactgatcttagcagcgtctactcataccttgaggatgtacttatcttctgaattgccttcccagattcagactgttctttaaaaccatgaatggtcaggtacctctactttcaagaaatcatttacttaatgaaatttagtatttttcctgtgtgaaaatctataaagaagattacagactagcagcgcccaaacctcagttggcttacagagagatttttgggccctctagtgttgtcctatgcactgacaacttctaaaaatcacaagatttcacaaaaagacctgagctgcaatacaaatgaagatcaggtcctctgaggtcctgtctggggcgtcatggcggctgctcctgtagttgaggcccatgatggggccttcatgcgcttacctgcctgtggctcctcgtttttcttacacctatttctttttttatttttatgagactgagttttgctgtgtggcccaggctggagtgcagtggcaccatctcggctccctgcaacctccacctcctaggtttaggcaattctcctgcctcagcctcccgagtagctgggattacaggagcatgccaccacacctggctaatttttgtatttttagtagagatgggttttcaccatgttggtcaggctggtcttgaactcctgacctcatgatccgcccgctttggcctcccaaagtgttgggattacaggcgtgagccacagcacccggcctacacccatttctttacactcatttgtcttacttgcttggtccacgaaagcagttagattggtcctctctgatcaacagctgtcaagtttttttctttttttttaaaatcataagtgcctgtcaataacactttttagacctgtacctaatatatatgtatatttacttataaattttatgcatgtgtctattactgatagatattttttagaggttgaaataacgatgaaacaaaactttaaaataatgtgatcactcaattcttaaattttagtgaaagcagtaggattgaatatgttttattatttttgaaaatcttgattggatactgtgtgttatagcaagtcaggtctgtttctaaattaaacttttttttttctcttctttttgagatggagtcttctcgcttctttctccaggctggagtacagtagtgcaatcttggctcactgcagtctctgcctcctgggttcaagcaattcttctgcctcagcctccccagtagctgggattcaccctgttggccaggctggtctcgaactcctgacctcaagtgatccacccgccttggcctcccaaagtgctgggattataggcgtgagccactgcgcctggtcaacataaatcatttttgacagcaaaaccacatactgatggaaatacctctgaacagttattctgataatgctttcatcagttttttttaaattattattaaaaggcagttcttattgttaaaatgtcatttctttcaagacgtgttatgttaatatattctcatcagcatacgaaggacagtcactggccatttaaagggtcaataaatttgaattaccttttttaaaaagtgtatttattttattttatttattcttactctttttttttgagacggaatctcactgtcacccaggctggattgcagtggcacaaccatggctcagtgcagcctagaactcccaggctcaagtgatcttctcacctcagcctcctgagtagcaggcagtacaggcacatgccactacatctggccaattttttatttttttgtagctatggggtcttctccctgtgttgcccaggctggccttgaacttctgggctcaagcatttcaccgaccttggcctcccaaacaaagtgttgggattacaggcatgagccaccatgcccagcctggatcacctttttgttaaaaaaaaaattacaattcatttttttaagttcaccaactcttaagtactttgctataagataattagcacatttattctgtgttacaaaaaaattttatcattatttcactcaacatattatattgtaggtaatgcaatatgttcatcagttaatcagtttaactgggcacctcacctattcatttgttcattacagcaaattgcaacatatagcagttaacatgtgccctgtcttgtagtatttgctgatttctatggtataaatactcttaccttggctgatttgaagttatcaacatgagtcactgaacacggatttgggaagagatacacagttgtacaccattacatagtaatttcaacatcaacagtagatataggtaacctcaagttaatagtaaaatattaactaggaagtaatgagtttaaggtgtttattgcatggatttttaatataattttaatttatttaatttgaagtttatgtaattacatctttaataatggctatgtttaacaacaagctgacaacattctgaaaatgtagaaagcgccattcatgagcaggtgtgagtggctccaacacacccctctgtgggccttgtaggacagtctgagaactttgccttttactctgagtgagatgggaagtgttggaggctttggagcgaaggggtgatatgttcagttggtttgagtgttaacacaatcacctgctgcgctgggactagcacatggggaagagaatatggcagcagggagaatatttaggagctgatgtggagaatccaggcaagagacgaaggtggttggcagcagggagtagccagggccgatggcgagtactgaccagactcaagaatctgtacaggaggcagtgagggatcgtgtgtttcatggttctgtgatttattgaggtctgagaaaataaccaggcttttttctctcacttatctttttttttttttttggccattgttagagataaaatagtgttcaattgaaccagcatctgacctagtttgacaaatctttgtattgatttcaaaatcactgcggtaccagggagatgatatgacattctgttactaaagggggtgatgatggcagtttgaatgggataattcctcactgcagaagatccacacgacaggatgtctcgaatcccctgccccagtccctaagtgccagtaatacctcctagttactgccacacccaaacagcccctccatccatgcatattttggctgaaagccaacaacctgtgtcttgtaacagagcatgtggttctttttcttcccctgacagtattatgcctacctgtattcttatgtgatgccccaggccatccgggacatggtggatgaatacatcaactgtgaggacattgccatgaacttccttgtctcccacatcactcggaagccccccatcaaggtgaggtcccaccactggtggggctgtggatgcgtgcatgtttacttcacttgttttgcagtagtgcagcacgtaactgcactgtacctcagagtcctcatttgtacaatagggatgatactacctacctcatcaaaggattgtctgtgagcttaaatgagttgttactacaggggcccttcattcctaagggcaatggatagaaatcagaaggtttggaacttgggtgggaaagatgttgcatcattatttttattaatgtcttactggaataaagcattttcttcagttatgaaacaggctataattcataagagtatttgtagtaactgatttgtcaccagtagaaatcactgatatcttcatatcacaatacctttattgcaatatctgcaaaaagtattgtttgtatttgttactgctttgaattcacggcagttactccctttcccctagatgttgtgatttaatacattaagaaaagagcatgtatgtcactgtgttttactgtaactcgtttcctttgtcatcctgtgtattgtagtttatatacctaaaaacattactttgaggagtctacagtcttgaccagattgccaagccagaggcacaggcgatgtccatcaaacaaaaaacttaagaatttctgagttaatatatgtaaagctctaagaatagtgcctggcacataagtactatataaattatttgctcacaaccaaaaataccctcagaattctagaagttctgagggtattgttgtgtttttttcttggaggtattaacacatacactcagtgcacagaaagcctggttccacccacttcctgtcatctttgtgggctctgtcagcaagttagagcatgctggtaagggttaggatagctcagtcctcacagaagcagatgttattagaaccaataatgctatagaatctgtcactccaaatgaatatttgtgactgtgcttcgtctgtgtttgtctgtttcataattgaagaaaatgctaaattccagtaagagatttatacctgatgtccttagaagggtcaacaaactaatgaggtcttattttcattattatcaaaaaggcatattatttaattttatgaaataggtttaccttcatgggtgacattgccatgagtaaatagttgtgttcgactgggtgcggtggctcatgcctgtaatcccagcacttttggaggctgaggcaggcggatcacttgaggtcaggagttcgtgagcagcctggccaacatggtgaaaccccgactctactaaaaaatatacaaattaggctgggcgcagtggcttacgcctataatcccagcactttggaaggctgaggcaggtggatcacaaggtcaggagctcaagaccatcctggctaacacggtgaaaccttgtctctactaaaaatataaaaaattagccaggcgtggtggcacgcacctgtagtctcagctactcaggaggccaaggcaggagaatcacttgaacctggaggcggaggttgcagtaagccaagatcgcgccactgcactccagcctgggtgacagagcgagactccatctcaaaaaaaaaaaaaatacacacacacgcacacacagtagcatgcgcctgtaatcccagctactcagcaggctgaggcaggagaatcgcttgaatccaggaggcagagattgcagtgagctgagatcatgccagtgcactccagcctgggtgactgagtgagactccgtctcaaaaagaaaataataataataataattgtgttctagactaagtacccaccagcatgtactaataacgataatgaaatcatctttagaagctgggtgtagtggcacatgcctggtagtctcagctactcaggaggctgagccaggaggattgcttgaatccaggagttcaaggctgaatgtgccatgggcgtgtctgtgaatagccactgcactccagcctgggcattgtagtgagaaagaagtcgtagcttgagtgctaagcagggtggccaccagaggacgctggttccatgcagcaaagcataacaaagaaatgcatgtggaggccaactgtggcccctgcgtaggatgtcactcctgattgtcccagggtttcatctgttgccgagacttctgctaaagcctcacaagagaagaataattagcaacataatgtatcaatttttttaaattgtgaaaaatagtcacaagtatttatataaaaacagtatgttttccaggtacagtggtaggtctcatattaaacagtgaaaagattttgtagactttgaggtagggaggcaaaggttttagaaagcaattaatgatgggtgcaattttctcttccttatatatcctttcttatgtagccagggactggacttgagtcaagatgtatgcatcaatttatgcctctctagtagaccagaagacatggtccatgaaaatttaaagtatctgagtgattaggtacctaataatagcatcagttacctgagcaggcacagacatggggaatttttcatctttgttaaagtgtgtttgtctactgcattattaggccagtgtttcattagttaagccatctcttcagtgcaggtggaagtaatttagacatggtgcacatgattcttaccaagtgaaaacttcaaaactgagtattctctgtgaattttcttcatctttctggaatatatgaagaattcaagattgggatgacttttcaaattcaaaggctgaaattaagagtgttttctaactcttagtaattccttcaacttatgaatctaattatttacttcataataaagaaccagtttgaattaaatattttatttacctaattttaatggtatcaggtatatgtactattttatgttcaaaaatagtaatttttttgttgtgctttaaatacctcaaatttttactgtcaaactattccttgtttgagttagggaggtttgactgcttcgtatgattggcagtgttctttcaataatgttaatatcttaatattgactaacgaatggggagttaatgtcatattatttctttgaataatgtactacttttgcaaggagaacacagaatataaataggcttcattcaggataagagattgaaaagtcacctgtaaagttttgagaaaacagatggcttaggtggtaaggaagccgaaatgcaagtgaacgtcttggttctctggggtgatataggttcttggcagctatcaaggattttcctcattgttactaagcataaaacgaatatttttcttagattgagttacctggaatcttccatgtaaactgtgatccacgatattggttaaataagtaaatgtccagacttcagttaatattatagttgcttcattctttttaaattttttgcatgttttattatgtaacacagttatatatttacaaatatattggggatgcagtcttaaatggttttttgtttcttttttgagatggagtctcgctcttttgctaggctggagtgcagtggtgcaatctcggctcactgcaacctctgcctcccgggttcaagcgattttcctgcctcagtcttctgagtagctgggactataggcgtgtgccaccacgccccgctaatttttatatttttagtagagaaggggtttcaccatgttggccaggctggtctcgatctcttgacctcgtgatctgcccgccttggcctcccaaagtgctgggattacaggtgtgagccaccgcacccagcttaaatgttttttttactgatggattacatgattaaaacatttggaaaccactgcttccgtgaaaacaacagttataaagtcaccttttgtgtcacatggaataatgtgcaggttaaagggcatttctcctggggttggattctggtgtctggaatgatgagaaaggtttttagatccagtgagagccccatggaatactggacatagatgctgtttgagaacatccttccccagattcctgacccctacatcctgctccagtgggaaccgtggaagagcaataactcagtgctgacgtgatcccgaagggttctaagagagcagcagtgagtgaggggagaagtgaggagacaggtgggaccctggagggggacctgtggaggtcatgactgtccagagactcggttctgaggggagccaccctttgagcactggcctgtgtctcctcccagtttaaactctgggacctgggctctgacggcgcatactggctgtacacaatgattactcttccactattaagttatgggatgtgtctttcaattaaaaaatttccccttaatttataatggaaatttaaaaattatttgagaaaagatagacatgcagaaagaaatcaaaagtaccaaaacttttggcttatttcttttggttctctggtatcctgtctatcgtggtgacttatttatttatacatacatatatatatacacatatgtgtgtaaaaatacgtatatatgtattttttctttttcttttttttttttttttttgagatggagcctcgctctgtcacccaggctgcagtgcagtggcacgatctcaggtcactgcaacctctgcctcccgggttcaagtgattttcctgcttaagcctccacagcagctgggattacaggcatgtgtcgccatgcccagctaatttttttgtatttttagtagaaacagggtcttgccatgttggccaggctggcctcaaactgagctcaagtgatccgcccaccttggcctcccaaagtgctgggattacaggtgggaaccaccacatctggccttatttttatattttaaatttatatacttgatttgcagtctgctttttaaaaacttgacagtaggctgggcgctgtggctcatgcctgtaatcccaacacttggggaggctgaggcgggcagatcacgaggtcaggagatcgagaccatcctggctaacacagcaaaaccaatctctactaaaaatacaaaaaattagccaggtgtggtggcaggcgcctgtagtcccagctactcgggaggctgaggcaggagaatggcataaacctgggaggcggagttcgtagtgagccgagatcaccgcactgcactccagcctgggagacagagtgagactgtctcaaaaaaaaaaaaaacttgacagtaaatttttgggttttgtactatagtggattaggtagtttgaaaacctgatcactataagtaacaaacttattttttcagtgtatagttgagctaataaaaaggtaagagaattgccagaaaggaagcaggtgggaggactaaaacttagggtggcaagcgtggtggcatcactgaggccaccatggggggctgctctcaccttagttgtctagaggcttggattttatcactcatgtgaaggagtgtagagcctgttaagggtggagaattagaatggagatctcctacccgttgccccggggagatgacacataccttgtttattttaaccttgactctgacaggttgttggggaagtgtaggttgagaatgttaaatagtcttttgagcctccatgggcttagggactcattctgtatgaaatctagacccagggccacatgagatggctcaagtctgtaatcccaacatgttgagaggctgaggcaggaggatttcttgaggccaggagttccagaccagcctgggcaatatggggagtccccagggaaaaaacaaaaaagaaaactagacccagtcgtcgatacccttggactgtttgacaaaataaaaccaaaaatctgttataaggagaaattactctcagcagaggaagttcccacttaagaaaaagagaaatttcttcacctcaggtcacataggacacgcacaggtaaagcctcattgaagatgagcttgaaatgtaaagtcaacagtcagccaccaagaaaacagctgatcatgagcaggagtgaacacatataacaaacaggttatagttctccaaggatttcaaataataaagccattagatagactataaaacaagtaggcttaaaattagtaacctgaaaacataaaaaagcaacaaatcactccaaaaagaacaaacagattggaaagccctaaatggaactattgaaaatgagaatcatagttattaaatttcagtgaaatgggataaaaagatcagacttaggtgaaaagaaaaggaagtagaagataaatttaaagacacttcttccccatctttctttgtgaggcgtccacccctccctgctcccctccatggagccagtgtttccaaaggcccccagcccgctttgcaggtgtcacttctccagcccatttaaaacccaagttcatggctatcttgcaggatttgctttttcattgtttggcctctgaggatttcattcattcattcattcattcattcattcattcattcattattcattgtttattcatgcatgcatgtatgtatgtgagtgagtgacagggtctcactgtcacccaggctggagtgcagtggtaccatcatagctcattgcagcctcaaactcgtgggctcaagcagcctcccatctcagcctcccaagtagctgggactacaccagatagctggcctgctgccacacgcagctaatatttttatctcttgtggagatgaggttttgctttgttgcccaggctggttttgtactcctgggctcaagcgatcttcctgccttggcctcccaaagtgctggaattaatcaccaggtaatttcatttcttattacaggctctgccctgtatttaaagagatggtttatgtatttcttcttgcatgttcaggtgttctgaggggtttttatgccattcggcctgccacattgtaatgaagctgtccctcttcatacttttttagttagacattttctaattaataataatatgactagactgtagtatggccactttcccatggctttaaatgtagttaagcatcttttttatggacagtattcaagaatgatagcccctctttgactagcccctctttgggtagtcttcaatacccaaagcccctctttgggtagtcttcaatattttgattcaaaacattgatgaaacaaacaactcggtacctacctatggctctgcaaccaagtacatactaggagtagacttactgagacagctgacactacacacgttaaggcttttggcatctgagaagcgtaggccatctcaacagaatacctgacaatgttctggagacatctggtaggcaggaggcctggggccgggctctggttcctgccatgctctgcagggatgttgcccctgaggggatcagcgtcttcaccatggacatgggagtgtgggatcggctcagctgcaagggttctgtcagtattagctgggattcccactctgtctctctctcccgtttccaggtgacctcacggtggacattccgatgcccaggatgccctcaggccctgtctcatgatgactcccacttccacgagcggcacaagtgcatcaacttcttcgtgaaggtgtacggctacatgcccctcctgtacacgcagttcagggtggattctgtgctcttcaagacacgcctgccccatgacaagaccaagtgcttcaagttcatctaggggcagcgcacggtctggggaagaggatgagcagagggaggaagatggctcccaaggttcctaggcattgcaggaccttgggcacatctgctggtgggtggcccagagcctctgctggaaggggcagcaggaggagtggaaggaaaccgctgcctttatcttgaagtcagccacactgggcctggagccctgggcggagtccccggggttccccacacagggcactgactgatagcttacactgaggactgtggcgactctgcagagtcactcacaccgttcgtacgcccaggacagctggttcgtggtttttacattcaataacaactattatgattatttaaaaagagaaagtttcagatttgccattcaaggcttatttatatatatgtgtgtgtatataaatacatgcacacacttgcatacatatatatttttggctgggggagtgtgagttttgcctttctaagggagggaccgcgcaggctcctttgttctgtattctggcggagatgggtcctggccttgtgtcactggcttatccttaaagatcatctcccatcctccccagcgccatctgtgtgcagcaaccagaaagggatgaacttggccctcttgcgggcctggacaaggtctcttccttaccctttctgttgccagtcagcaacctgtaactcacattctcttcccagtgaatccctgggagcgcctgaccctggtgggctgttcagcttcctgctgctggggccagcgatttttgaggatttatctttaggccaggcttgcctccgtacttatccctgctctcccatttctctcttgtttgagagagaatgaggaagcaaagagtgagaaagaataggggctgaagacgccactcccagatggctctttctatcctgctcttctgttgaaacacacgtgctgtgggcctcaggcgtttctgaagtgctctttcttggattggacaggagatcagcagcgtgcacatctgctgtggtctgaagtggtttgcaggtcagcctcctctccctagtgtagagcaagccagtgtccttcgaggaacccacccggctggccgggaagttttacagcaaggcgcctgccttgggataattccttggtgaaattcaccttccccccgcctctgtctggagccccatcctgtgttatctgtggtttttggacccctaatgtcagcttggctgtaggactccccgaggtttggtatgtgctagaacaatgggaggctgtgatttgctgtgtaagctcacatccagccttggaatctaacgggcattcacaacccgagttaccactttccactccctgcttaggattctgttccctgggctgaaactgaaataagctaattttttgggtcacggtggcagtaggggaacctaggagggtgtgagtggcatttgtcagggatttagcccatgacgtgtttcttgaaccctactttctggaagtggagttgactctggaagttttctagcaactgaacaaaagctcaggtttgtcctggtcatgcacatgccttaagccagttccgtcttccctagaccttggcatcctgtgcttctatttcttggaatacgttctcctctgacctgcctgtaccacgtgggtcctcttcaagtactgttttgaagctgggctcttttgtgtagctcccacccacctgtagggctagctcggcttaagggaactctccccattggcaaaccggacccggccgccgccaggactgtgtttccaaaggttccccgcccccaaccccagcatcagcctgtagctcccctgctgaggcagtgtggttatgttcccagcagtgggggtcagacgcccttcctcagaactttctagttgccctctacctgactcctgacttgtattccttttagcagtagccttcttccctcggggagccaaagagtgtggtgtgtggcgctatattgtggctgctatttcatctggtttcttttaatgtgaggaactcacatactgacttcagtgggactcggtgagccggggccgtctgtgtggtgggaccccctttagcgggactcagtgagctggggccgtctgtgtggtggagccagggcctctccctttagtggagccaggttgtcgggccccgaatgtcactggtggatctaagaagggctgagtggtctgacaccaaaacatgccgcagggagggctgtggtgccggtgcttccaacaaggacagccctccttgaccctgaaaggaacactggcttgaaggactgcagacaggctctgaggggcacgccctcctcagcgagaggcagcaaggtggccacagtgtcactggtcaggtgcttctcaccacgggaaagccgccgacctgtgactcgcttgagatgggaaagcggcgccacagaccccgggtctccttggctgtctgtgggccgcccctggccaccttgtcctggctcgcagggtgcaggagcgcctcgttctctgggtggccggcttgctgctccggtttgggctgtcttaccataacaccgtcccagggctctgcaggccactgtgagcgctggctccctgggcagtgctcctccgtgtggactgtgcctcaggccagggctcaccagctggggtcctgtccggaaggatgggatctttctgggagctgcgccggacagagtggggagctcctagtttgtggggggaagctttgatatccatgccacgtccatccaccccaccccttttcgtcacgagcacaatggtcttacattggatttttgtaaaaaaataaaaataaatggagactttaactc

SEQ ID NO: 37172 - DNA, 53439 bp, Homo sapiens
tgaggagggcccggcctgcgagagcctcagtgggagccggctcagccctcggccaccatgtcggcgccgtcggaggaggaggagtacgcgcggctggtgatggaggcgcagccggagtggctgcgcgccgaggtgaagcggctgtcccacgagctggccgagaccacgcgtgagaagatccaggcggccgagtacgggctggcggtgctcgaggagaagcaccagctcaagctgcagttcgaggagctcgaggtggactatgaggctatccgcagcgagatggagcagctcaaggaggtgagccgagccgccctgccctgcgacccccgcccggcgccggggcctgtgggcgtcgtccctggcaccagggcggccaaggtcagcttgccaagcgggggccggcaggggtgggccgccggggcggagggggcacgggcagtatgtgggagtgggcccggccttggctagcaggccggtgccgcggccgttgcagacgccgctaatgcaggggtccgggcgccttgtcgcctcctgcagctgcccgcctgcttctgtgcggacctgggcggccccggcggggcggggcttcgtaagggctgatgctttgcggtggtcgctgttccgggtgtgtctgagtgtggggtggggttgggagggcagtggctgagccgggagctgaggccacggatgctggtgacccgctgggagaggccgagggtgggcctgggtctgggtggctgcggctctgtcaccttcagagaaagcacttcccctctctgggcgcagctactttcggagcgtttctgcttctttcatgagtgcctccgaggtggggaaaggtcgtggacagcggcctaagtgagtaggggctcggggttgcacgtggaggttgcccctggcatgggtcccccagtacccttgccccaggcccagcgctgtgtcctcatggccgggattgcgctcccaccagctagcatgacttccctggcccacttcctgtccagccccgcttctcgggcccttcccctcgctgtggcttgctgtgttcctcttggacggagacctcagtggtctgtgtcattcccactggggggagagtaggttagaccaccaggctggtcgagggtctccaggcggcagggcagcgggagtcttggacagtccttccccagcttctcttctcccgttccctgactccatagcgttgtttgcaggaattgctttctgggaggatacaccagggtttggatccaggctgtgccccttgctagtgatgtggctttgggtagaggccctccgtgagtcttagtttccccctctgcaaaatgggagtgcagtactgcgtgcccagaaaggattgttgtgagggtcatgtatttggaaaggactggtgtgcggtcaggagtatagcttggtggtgtgctcccttcccccacttgagtgtgtcctggtgagcccttggctcttggtttccaggcttatcacctggcacctctgctcccagtcagcccagacaggtgcctaaatcatttgcagccttccttgcctcccccgtgtctgaggagacccgtctgtggagagcagagaatgaatccaagcagatgcttggatgtctgggcagagcaggtgctcagttagtaccagtcaatggctgaccctgggccagcaggagctgggtcctcccccatcgccctcaggactcgattctgttgtctgtcagcaggtattggcaccttctgcaatgcatgctccagtggcgctggagctacaagaggggtgagatgcagctgctcttgcaagagtccccatcttagggtggggcgtgtgatagggaggcagggggctctgagaatatggagtgggagtggactcggccagtttctggtctcctgtagcggggctcaccctctccagcaggcagcactatctgttagggcgcttttccctctgcacacagtgaagcagccctcttcctcctaccaagtgcatcgtgagccgctcctgggcagcctctacagtccctgtctctgtccacagcttgggtttggcagtgtcctctgtgagaaggaattgtcgctgacttaacttgtccccgctttggtgcccttcatttgtcaggtctttgctattctgacacaaacgttttggcacagtgaagaatcttggcattttcgtggcatgtatctggagggtgagtccctagcagaatcaggaagagggtatacctgtttctgtgggtactctttaggcgtctgcttgcttgttttttgtcaccacctggcttccatgtactggccacatggccttggacaaattactgctctgttctgaatctagttctcctttgtaaggtgggataagaatgtttctgctcggtctctagcagagtctagaggaatgtgcatcagcgtttcagtttcagtagatgttgccagaaagtttgtaccagttcaccccccatcaacagcatgcgtgttcctcacacccatgccaacacaggctcttgctaacctatttaattatggccagtattatagttgaaaatattaactcttcatttaaaaaaaaccacaagatttaaggagtcaataattgtggggttttttttctcctgtagagcggtgtaccgccttaattctttagaaaactttatttcttgaactaaagtgcatttagttactaataaattgtgctccaaatggagttgcttgtacttctgccctgcatttgtagataataggatcgttgagggaaggacgctggcctgctggtcccagtgtgtgggtttctgatcagagctgaggagggtcttgtggtgatgaatgggagacagtgccagtcctgttgcctttctcatgggatgggggaagtgtctgtgtcctgctgacaacatagcacggtgctggctgagaccacaagtgaggtgggtgccccctggttgattttgcctaatcattctgctagtgatttcttgagcctgactcagttaagaccatatctgtccccgttcccactgtgccctttcccttcctctccctggaatggtggggaagagaattagatgggctttggtcagcaacctggtgttcctggtcctgcgtggccgtgagacactttgttctgtgttcttagctgtagctttaagaggacaggtgtgctgaggtggcagctcctgccttcagggcacaggcagggactgtagctaggtgggctaaggctaggtgcccatgtggtcctcatggtcaggggagggtaatgggggaggtctgagaacagtcttgactccacctgagctcaggctcagagaggaggtctggacaccctcactgccttggtgtgccaccttggtgtcatagtgtcaagctctggagcaccattgtccttgtctgagaggtgcacgtgggtggaattgggtgttggactgggcacagcacccaacacgcagcaagtgcttcgtaggtcttctgcggactgaatctcatgcctcactcaggtctctgtctccttgctgctgcacctgcagcttctccccgttcttatccttgtccctgctcagtctcaagtggcttccattgccacctcccaagggctgccctaagcattgtctcaggcccctacagcctggcttgggactgccctacctctcctgtgcccacattcaccctttgtcttagaagtcccacctgcccttcaagcttgggtgtctctaaaattcccctgcctgctgccttctggacttgctgagccctgttcccagcacctgggcagctgcaggaagtgggggcaatagggtgattggcagaggaccctccaggaggttcctctgcagagttactgggggtgaggcccagcctctttgattgtttgcttccagagcaggaaaagtcctggtcttggttaaagcaagtgtgggattctcccattcgtctgataacccctgagaacattgttgtgtccatttctgaacagaaggctgttgggagcaaggaggctctgggagacccaagggcctttcagggggctgggtggtggcagtggtctgctgttggtatgaggaagcctggcttgggtgggagctggggccctgtgaatacctgaagcacagatgggtctgacagttggggagaggcagctataggcatccaaagatgatgaccatgtggctacactgttgtcactaattgttgggcaattctctccccgctgggcctctctttccccacttttagaatatggggcagggggtcatgaaggaatctttagggacccttacacttttaaaaatgtctgaaactcccacatcgagccctggtgctgtttcttcctgtagggcctggcgactgggcacttgtgtatctcaatcatcctgggacctggccagggaatctgcccagccctaggcatgcggatggtgtgctccaggccagccctgccagcatgtggaggcgtggacctggccaccctccatgggattcaaggcaggcacagctgtgatggagcagctcgtctttggggatgccaagcgagcatgctttgtggcttagcaggtggatccagaggaaggccaggcccagtgctgggagcccctgggcccctgggggtgcctggcaccacctgagcaggaccgactgtatatgatgtctgtccctgtgaactccatactgactccacagggggagtctgggccctgcctggtctcccaggagcttgcggccctggatgagccgctgcctgtctgggccgtgataggttaatgatgatgcctgttaccttggcccagtgctctgtgagcccccaaggtcagggagtggtgtccctgtgcccttgtgtctgagcatccggcccaggtccatataggattcctgctaggtctcccctgtcacttagggaccacagtcccttcctttgagggaggagatcagtttcttctttgtcagttttgggcatcccccagtcagtcagacctgcttccccacataggtggaccagatgaaactgttacacacatcgggggtaagaaagatttggtttcttctcagacagtacaccagctgtttgaggtggtggtggctggtggccagggctggccaggactatgcaggctttgacaggtaaagcattggccttagaccctgtgttgtccagtgttcagagtgtggcctctgaagccgaactctggagcaggagagggcccaatgtggctgcctagctgcctccttgggctcaaaccctgctgtcccaagctgggctctgctctgctgtgggaggtggatggagagatggggactgagtggcaggcaggctccccttgccaccctcagagcattgcaggccagggttagggttaggaggaggtcactgggggcccagcttcttttttagaagctactgtgttttaaaaaatcatacattcactttaagaacagcagaaagtggagagaacagtgtcaataggacctgtgtagatggcgcaggacaaatgtggggagcactgggtgtttctctctgccagctcttcttcccttgtgagtgtgtgatgtgtacaagacaccatcaaacacaggggaaaggctttgtgcatctgtaatagttgttttttgttaaagttagtttgttgctactctgagatacataaaagcaggtttaattcaagtagataaagacaggaaggtttctgtggatccagaggttctgtggtacttctaacttatactgttgtgttactatatgaaataattgtcatggtttgctttttatagttggctttttactttttaatttattattattattatttatttattttggtagagtcagggtctcactgtgttgcccaggctgctcttgaactcctgggcttgagcgatcctcccgccttggcctgcaaagtgttgggattagagatgtgagctaccacgcctgatctatagtttgcttttttttttttgagacggagtttcgcttttgttgcccaggctggagtgcaatggcgcgatcttggctcaccacaacctccgcctcccaggttccagcgattctcctgcctcagcctccctagtagctgggattataggcatgtgccaccatgcccggctaattttttttgtatttttagtagagatggggtttctccatgttggtcaggctggtctcgaactcctgacctcaggtgatccgcctgccttggcctcccaaagtgctgggattacaggcatgagccaccacgcccagcctttttttttttttttttgagacggagtcttgttatgttgcccaggctggagtacagtagctcgatcttggctcactgtaacctctgcttcccgagttcaagtgattctcatgcctcagcctcctgagtagctgggattacaggtgcgcgccaccacacctggctaatttttgtatttttagtagagacgaggtttctccatgttagccaggctggtctcgaactcctgacctcgggtgatctgcctgcctcagcctcccaaagtgctgggattacaggcgtgagccactgcgcctggctgctttactcattatttacttatttatttatttattcatattattattattattattattattatttgagacagagtctagctctgttgcccagcgtggagtgcagtggcacgatctcgactcactgcaaactctgccttccaggttcaagcaattctcctgcctcagcctcccgagtagctgggattacaggagcccaccaccacgcccggctaatttttgtatttttagtagagatgaggtttcaccatgttggtcagactggtctcaaactgttgacctcagatgatccactcgcctcagcctcccaaagtgctgggattacaggcgtgagccaccgcgcccagcctttactcattttttaaagccaccttctttgttggatgtttccacataatcaaaggtggagagagtaatagagtgagtccatgtatgctcctgccctgcacctgcagtttgcagctgtggccggtcttgtttctaccgcagttcatcctgtgtagctgtgtctgtaagtatatcagttgttttgctaagaaaatagaatcttttctttttttttttgagatggagtctcactctgtcacccaggctggagtacaatggcgcgatctcggcttactgcaagctccgcctcctgggttcacaccattctcctgcctcagctcccccccgcccccccgcagtagctgggactataggcgcctgccaccatgcccagctaatagaaaatagaatcttttcttacaaaacttaaccattgttgaactttcacacctaagaaactaacaaaaattctttagtgtcatctgttgtccagtcagtgtttggatttccccagtttggctcataaatttcattttacagttactttgtttcttcagaagccaagcaggatctgcaggttgcatttggttgaaggccttctcaatttttttttttttttttttttttttttggagacagtctcgttctgtcgcccaggctggagtgcagtggcgtgatcttggctcactgcaatctctgcctcctgtgttcaagcaactctcctacctcagcctccaaagtagctgggaccataggtgcacactgccacacctggctaattttttgtattttagtagaggcggggtttcaccatgttgcccgggctggtcttgaattcctgagttcaggcaatcagtctgcctcggcccagcaaggtgctaggattacagaccttgtcattttaaagacagcgccatgtgtggcctgtcctgtcccctttcatactgcactggcattagccctggctactctatttttatgctgtggagggtgccggtaggcggagattcccactttatctgcccctgccagacaccttactcttgtctttctcttttatttcctttttttttttttgagacggagtctcactctgttgcccaggctgtagtgcagtggcgcgatgtctgctcactgcaacctctgcctcccgggttcaagcgattctcctgcctgagcctcctgagtagctgggattacaggcgtgcaccaccacgtctggctaacttttgtatttttagtagagacagggtttcatcctgttaggcaggtcttgaactcctgacctcatgatctgcctgcctcggcctcccaaagtgctgggattacaggcgtgagccactgtgcctggcctctcttttcttttttaaaatattagccaggggccgggcgcagtggctcacgcctgtaatcccagcactttgggaggctgaggcaggcggatcacgaggtcagcagatcgagaccatcctggctaacacggtgaaaccccgtctctactaaaaatacaaaaaattagccgggcttggtggcaggcacctgtagtcccagctacttgggaggctgaggcaggagaatggcatgaacccgggaggcggagcttgcagtgagccgagatcgtgccactgcactccagcctgggcaacagagcgagactccgtctcagacaaaaaaaaaaaaaaagtagccagggtgcctccttcagctgatgcatcatggcttggctcttgcattgctgcattgtcatcacctattctggttcatctgtcgccccagcctttactgtggagctctgcccacctgaggtgatgttgtcatctagtgggtgtagatgccaagcccttctaaaccagaagggaggaactagtattgtcactgtcctaccattgagggtgctgaggtcatagtgaggaccactcatactcttactagcatggcagtggactcagccattcttggcttgacttctgtgacctggagccagtctctcccctctctgggcctcagtttccttgttttaggccagtgcattcctgacgcccttggaggtggatcaatttctccctctagtgacagcatcatggcgggctcaggcccaggacgcagctgctttgcaggcatgtgttgcctgctgcctgggctccccatctgctttgctctgcccttcttcctcacacccatgttccctcagtaccaccctcacaacatgctggggtgtaagggctggttgatgacaagcatgtccataagcctaggggattccttgggtgtcctaaaatgtgacctaagataattatcggggaacatgccccgatattcacgtaagttcttttcattttccttaagtgtcggccagcttgagaaataaagggacagagtacaaaagagagaaattttaaagctgggcatccgggggagacatcacatgtcggtaggttccgtgatgccccacaagccgcaaaaaccagcaagtttttattagggagtttcaaaaggggagggagtgtgcgaataggtgtgggtcacagacatcaagtactttacaaggtaatagaatatcatgaggcaagtggaggcagggcaagatcacaggaccacaggaccgaggcgaaattaaaattgctaatgaagtttcgggcaccattgttattgataacatcttatcaggagacagggttttgagatcaactggtctgaccaaaatttattaggcgggaatttcctcttcctaataagcctgggagcgctatgggaaactggagtctatctcacctctgcaatctcgaccataagagacaggtatgccccaggggggccagttcagagacctacccctaggtgtgcattctctttctcagggacgttccatgctgagaaaaagaattcagtgatatttctcccatttgcttttgaaagaagagaaatatggctctgttctgcccggctcaccagtggtcagagtttaaggttatctctcttgttccctgaacaattgctgttatcctgttctttttttcaaggtgcccacatttcatattgctcaaacacacatgctgtacaatttgtgcagttaatgcaattattacagggtcctgaggtgacatacatccttctcagctgacaggattaagagattaaagtaaagacaggcataggaaatcacaagggtattgattggggaagtgataagtgtacatgaaatcttcacaatttatgtttagagattgcagtaaagacaggcataagaaattacaaaagtattaatttggggaactaataaatgtccatgaaatcttcacaatccacgttcttctgccatggcttcagccggtctctctgtttggggtccctgacttcccataacagataatggcatctcattgtggtttaagttgcacttccctgttcactgattggatcaggccaattttattacttctgtgaagcacagttctgctataacgtgtcttttgaaaatgtaaatttgttccagactgattgatatatgagggaacagtttgaacacgatgagaattttgtatttgcctacgtacagttttctcctcaaaaaacactagtgtacacagagccctgcacccggcctacctgagctatgtgaggatacacaggatacacgcacctacagcttcccattccatttcagaacacccaccttctaccacctcaggtagctgatgagttgccagccgtgacatcacacccactggcaaacctcagggcttcttaagataaagtgtcatgtgtattgtagcacttatgtgtctttttttttttttttgagatgtagtcttgctctctcgcccaggctggagtgcagtggcgcgatcttggcttactgcaagctccgcctcccgggttcacgccattctcctgcctcagcctcccgagtagctccgactacaggcacccgccaccatgcccggctaatttttttgtatttttagtagtgacggggtttcacggtgttagctgggatggtcttgatctcctgacctcgtgatccgcctgtctcagcctcccaaggtgctggaattacagacttatgtgtctttaagccattgaacgtgtataaaactgtgctaccggccgggcacggtggctcacgcctgtaatcccagcactttgggaggacgaggcaggcggatcatgaggtcaggagatcgagaccatcctggctaacacggtgaaaccccatctctactaaaaatacaaaaaaattagccggccttggtggcgggtgcctgtagtcccagctactcaggaggctgaggcaggagaatgatgtgaacccggaaggcggagcttgtggtgagctgagattgcgccactgcactccagcctgggcgacagagcaagactccgtctcaaaaaaaataaaataaaataaaaaactgtgctgcccttttatcattaattttaaaaaatgaactactttagaaaatttttagatttatagaaaaatttgaaaaatagtacagagttgctgtataccccacacccagctgcctccttattataacattgtacattagtgtggtatatttgttacaatggatgaaccaatatcatggcattattatgaatactttattcagattgccttagtttttacctgatgtcctttttctgtcccaagtattgtctaggatatcacattacatttagttgttgtgtctccttaggctccagttgactgtgacagtttctcagaccttccctgttcttgatgaccttgacagttttcaagaagattgatcaggtgtttagtagaatgtttttcacttggaatttgtctgatgttttttctcgtggttagattgggattatgggtttgggggaggaagatcacagaagtaaatgcccttctcatcacatatcaagagtgtgtattgtcagcatgacctgtcactgctgctgttgaccttgatcacctgaccgccactctaaagttattctttctcttcctgtccatactgtattctcgggaaggaaattactgtgcataacccatacttgagtagggagtttgctccacctctttgagggcagggtgctatctacataaattatttgcgatttttctgcatggcagacttttccctccctcccactcttgtttattatatcaatgtagactcatgaaagttcattttatttattttatttgggacagggtctcactctgtcgcccaggctggagtggagtggtgtgatcgtgactcactgcaactttgacctcctgggctcaagtgatctttccacctcagtctccccagtagcatgtgccaccacccctagctaattttttgatttttttagtaggtacatggtctcattatgttgcccaggctcgtctttaattccttggcttatgtacttctcctatcttggccttctaaagtgctgggattccaggcatgagccactgtgcccagcccatgaaagtttattttatactttgggttataatccaacattacctcattttgttgctcaaattgctccagctttggctcttgagagctctttcagatggctcttataccccctttaacataccacatcatggtgcctctttttttttttttaaagtgcttccttcctttctggcactacaagatgttgcaggcttatctgtttcctccctcagtcctagaatcagctatttaccccaagaagccctggtttctttagttgagaaagatgttagaaaccaagatctggttgctatgtgtgctcattgctattagggtgtctttgatttaaggcctgtcagcaacagaacaaggagattgttttgaacatgcagttagttagtggctgggcgcagtggctcatgcctgtaatcccagcactttgggaggccgaggcgggtggatcacgtgaggttaggagttcgagaccagcctggccaacatggggaaacctcgtctctactaaaaatacaaaaattagctgttcgtggtggtgggcgcctgtaatcccagctacccaggaggctgaggcaggagaattacttgaacccaggaggcggaggttgcagtgtgccaagatcgcatcattacactccagcctgggcgacaggagcaaaactccatctcaaaaaaaaaaaaaaatgcagttagtgtatactaacccatgtatatacatatgtcaataaatacacctgtatgtatatttagttaaccatgagttcatactgatgtaagaactgtaatccattaccacgtagatcgttcttaccaccttcccttgcttatctgtaacctcccactccaacagtgagacacctggctcccaccatccaccatccagtaacttaattgtttcattccagttcacatgtacagcagtaacagaattgttaacctgggtccccatgggaaacaattttatcaactagagttacagtgcttttgtgtaattcttttgcctttagtcttatagactctacttatttccaaagttacttaagttagggctgggctcagtggctcacacctgtaatcctagcactttgggaggccaaggaggatagatcacctgaggtcaggagccagcctggccaacatgacgaaaacccgtctctactaaaaatgcaaaaattagccgggcgtggtcccaggtgtctgcagtcccagctacttggaagactgaggcaggagaatcacttgaacccaggaagccgaggttgcagtgagccgagattgtaccactgcattccaacctgggggacagagtaagactctgtctcaaaacaacaacaacaacaacaacaacaacaacaaaaaaccaaccaccctggccaacatggtgaaacctcatctctactaaaaatacaaaaattagccaggcttggtggtgtgtgcctgtagtcccaccttcttgggaggctgaggcaggagaattgcttgaacccaagaggcagaggttgcagtgagctgagatctcgccactgcactccagcctgggcaacagagcgactctatctcaaaaaaaacaaataaaaagaaaaagttacttaagttagtactttattcccccatccccttcagtgaggttgtttgatacatttgtaatacaattagattattttgtcacattctacattccagcccaggatcccttgatctcccaaatgaatttttaaaacaattcacatactaatattaaggttcactttttgtttttataaatgcagtggcatttatctaccattacaggatcatacagaatagtttcactgccttaaaaaaaaaaccctatgcttcacctgtttaaatccacccccgtcaacctctggcaaccactgatctttttaccatcattacggttttgccttttccagaatgtcacataattggaatcatacagtatgtagcccttttcagactggcttctttcacttagcaatatgcacttaagatttatccatgttttttcatggcttgattgctctttttttttttcttaaatcacaataatatgggtgaaccacaatttatctgttcacctattgaaagacatcttagttgcttctactttttggcaaatatgaataaagctgctttaaacattcacgtacaagttctagtgcaggtaattaccatttgggtaattacctgaagagtctgatcgctggattgtatgataagactgtatttagctttgtgagaaactgccagactcttccaaatgcgaataccattttgtatttccgccagcattgaacaagagttccctctcctcaggctccaccctcatagttcatcctgtggtgggaagaactctggggattgcgaggagatggcgtaagattctcctgccacttgctgactgtgaaccttactggtgtctctttctaaaacagtgctaataaggtgaagaagtgtgatgagggtttgagatgaagtcaggagaaaacccgggctgcagccatgctctcctgtggctttcagcccagcctggcccagactgctgtgcccactgtgccatcctcccctcgtttggaacagatgccgtctggacagctgcgtggcagggcccccaagctgtcccctcttgccctgactacaagctgttgaatggagatttgtgtcagggcagccagctgccatggaagatgagggctggtccccaggccccaggactggcttctgtgtcttgggcggggtagctagggtctgtggggacctttgccagccctgggtgcagctggccagaagcctgtctgctgacactggggcaattagggtgtaatcttctctaaatggcacccaattctggctaaatccctcctgcccagggatgaattcccagttttctaaaagcagcttagcatttggacgttgcccagggcagctggggttcacggttggtgatgggatggctgcttccgattgatgtgggcctcacagaggaggggccatgggtgggcagaggctggtgacaagcaccacagccctacagtgttccctgtgtgggtgcctctcagccctgagtcctagcgatccccgcatccacaagtgtaagtcctccttggggaaatgcagttccaaagccacccagtaggaagggtgggccagtgcccctcagcctcctgtggtgtgagggacagatgggcctgcagaggggcttgggcctgggctggtcctgcagcgtacagcttgatagatataggctggcagaggtgggcgggcgctgcctcctggcctggaccccagttcccaggaggccccaccctcttttcctggcctggaccccagtcctcaagaggccccaccctgtcttgcagggactcctgcagccttcccaggctcctgcttgagtgctcctgggcctcctccctcctccctgtctacctgccaggtgaggctgtctgagttcctcagggaccaactccacctcctgccccctctcctgttacccccttgcccctccctgtaccatctcctctgggaaccaccctgctgcaaagaagaaaaatggattttggagtgagaagccttatggtcccactcagatgaatcatctcaccttgttgatcctcagtttgttcacccatgaaagggaacaataaaagtttttactttgcagggcttgtgtgaagacacatgattcacacccacctctgtccgctcctgggggccctggaccccacatcctttgttgcctgtatctgcttaggaagtaccttttgaataaagagaggagggagttggtttagtgatgctggagcatccccacccagctggggatggatgggaagagctggctgaggggatggtgaggtagggtctcccatataacacccatgggatcccactgggtgggtcattgtgtctgtgaggggcccaggtagtcaacaggtctatttctggcttcttagctgacttgggttccagtagaagcatgtggagctgactagtctgcttgtaccccagggtcactgggggactttcaaaaattctaaagctcaggggccacactcagacctattaaatcagtctcaggagtgtttacacttccagaatgatcccaggggaaagatgagtgtgggagcactatcctgtcattgcagtttacacccgggggtttgaatcctccctgctgtgcacatcgtgcgtgattcagccctggagaggggtacaaccccccaagtggagaacctgggatgcctctctgtacctctctggagtgtgcatgagctaaggggaagacccaggacaggggcaagcctgggagccattcctgctgctgagtcacgggggtgtgtcccctccactggctggagagagagggatgaaagaggagatgtcccaaaagaacctgcaatgcctgcccaccctgtacccctggagttccctgcagtcctagcctcactcagccgtattcatacatatggcatacatattcatacatatgcagccatattcatattctgcactctcagcaccccagcatctggctatgcccttgacctgccatgctgtcagcccacttcgggtgtggggcctgtcacctcccagctgtgtgcataggttccccctgtctgtcttccattcatgccacagatgcttcctgagccttgccacttgctgggcttgggctcctcactccgttcctgcactcaccaaggaggtgcagatgtgtggtggacgtgggcgtccatctgcccacaaggacaggcctgaacccttcccgtgtgagaggccttgccccacccacactgtgtgtatatctggatggtcggccctgccttctgcctgagctatttctcagcatcagtgagctaaagtgatgggggtgctggctgaagtgagggtaatgttaggctggagggaattctgctgtcctgggacagctgctggacttttccatcctgcccggtgagtctggccctccctactgactccctggtgacccccctgtcctgagccatatccctggagctgttgcctacacttgtggcgatgaaagagatgcaggtcaggacctcacccaggagcctggcggggactttggaagaaagcataccagcatgcagacctgcttcccagtgtagccaggggcctgggcaaagtgcttctccacagagctgcccagcctctcgcactaggccgagatggcaagggtcagcacctaagagggggtcaggcctgtggctgctgttgttgatggtgcagatggtggacaggtccatttaccctcttggcccccggtgacatactggctctgagatttggcctactggggacccaccagggaagtcatccagaaggtctgtgtgggagcttggtgggccaccagtttggtggcctttccctagaagctgctgggagacctctgccacccaccttccatattggtgtggttcactgtgagacagagctgagccccatttcagtccaggctgcattttttagggcggcctttgacctcaacagtcagacatttccggagcagctctggctgctgactagttgattgttttgtgcagctctcatttttaaattgaggtatgatttgcctgtaagaccacacgcagttgtgcagttgtgtgctctcgtgtggctgccccatggtgaaggttaccctgaagtgctcagactcttcctgtccacccagcagcgtactgcctgccttctacagtgattaggtttcttcatacttggtgtgtggtcttttgggtctggcttctctaagagccatcacgacggttacttgtatgaggagtgagttttcttgctgctgagcatcatccactgtgtcatcatactagagttactgccgtccacctgttgttgggtgctgggcattgtgaatgtaccatacttggcgtggacatgtggcatgtgcttccatgtttctttctttttttttttttttttggagacggagtctcactctgtcgcccaggctggagtgcagtggtgtgatcttggctcactgcaacctctgctcccgggttcaagcaatttttcttgcctcagcctcccaagtagttgagattacaggcccctgccaccatgcccagctaattttttattgtttagtagagacaggatttcgccatgttggccaggctggtcttgaactcctgacctcaggtgatctgcctgcctcagcctcccaaagtgctgggattacaggcgtgagccaccatgcccggccaatgcttccatctttcttgggtggtgcctgcagcaagcccctctccccactgtattcacatatcaacatgtccgagcaggagggccagtcctttcactcgtgctttgccaccacaggtaaccttctagggagggagggaccatgtgtcaggagggaaatgatctccataaattgtgggaagtggggcccagggaccaccatgactggctttagccagatctcagttgttaggcagtccccacattgagtccaagctttctaggttccaggccaagaccaggaagggccgagtcccagatgttcatgcacctgggaatgggagtttgcagttctccaggtgattttgaggagcaggcgtggttggggcactggtcagacaattgagcactgtgggccagggtctaggcccaggcccagccacttctggatcatcagcctctctttcttgctttctcttcagaccctcttggggaaacgtttatggagatgtgtgttctcggagttcagtttctcacctgtgagaggagctaatacctcctgtgagagaagctaatgagcttacattggtgcaaactgtgaagtgcagcgatgccttggggtaattgccctccctcccctgggcacccagagtcttcttgcttatctgttaacagctgtgttgtcctctgtcttcctccctctgggcccacatcaaagctggaggggtgctgacggcagcccaaggctgggaaaacctgggggtggagagggatcatctggacagagcaggcccagtgaagatgcctcaggacaggggacccccctcccctgtccccacccttagttaggtggatccccttctcccctcaccgcactgcctctacaccgttcttggatctgggtcattactgggctgaacagtaggcagaggttccagctcatctcacatccatctcccaactatacctccctcctggccctggaaccctcccatcccccatcccagtgtgccctgcgactctgtttctgctggtgtttgtagctactgtaagttgttttcctgaattgctagcaaggctgtacatctgtttgtggggtgatctgaagcatctggccctgtgtaaatctgaagtccatttcttgccaccatttcctgacctgaccctgtgttcttatatcaggtttttgctgaagttcatttatgaaaatttgatctttcatcttgtttctgatattatccattttatgaataacaagcaatttaactccctgtgatatgtttggtttggggttttattaatcttttaaactagaattacatatagtaaaatgtatagattttaagtgcatgtgtgtatgttggcaaatatgtcatcccttgggtacatttgctattctgcagcttttccttttttttcttttttttttctgagacggagtctcgctctgtcatccaggctggagtgcagtgacacaatcttggctcactgctacctccacctcctgggttcaagtgattctcctgcctcagcctcctgagtagctgggtctacaggcgcgtgccaccacacctggctaattttttgtatttttagtagaggaggggtttcaccatgttagccaggatggtcttcatctcttgacctcatgatccgcccgcctcggcctcccaaagtgctgggattacaggcttgagccaccacgcctggcccaatagttttcatattacactagtttttaataaaaataagcttttactggagtgtaaggtaaatatggaaactataaaaatcataattgtatagtttgataaattatcaaagtaagtacacccatgtaactaccaacagatcaagaagttgcatgtagtcagcttcccagagctgctctctgagccctgtcaaggtgtgatcattctggcttttgacaccaaagattatatcttgcctggttttgacttcttatagatggagttgcaccgtactttttttgtgtgttcactcagcatcgtgagactggtcctcattgctgcttgtatttgtaggttattggcactcgttgccacatgggattcatttgtgtggatataccacgccttcctcacccactgtcaggtagaccgaccctggggttgttttcagcttggagctgttagaacgctcatggggtggctgttgcctgtgtctgttggatggactggctagggtgacatagggcaggctttcttctagaggagcacagcagtgtgtggcgagctcctgtcctctccatcctcaccacgggcacttgatgtgttactgatttatgtactagccattctgatcagtatgtcacagtagctctttctggtgtaagttgcattccccatggaccttttcctgtgtttactggccacttggagagcctcttttataaagagccttttcaagaccttcttccaatgttcttcttgggtgtctgtctttttctcatgtacgtgtaggagatctttatatattcaggatatggagccctttgccatcaggcagtagttctgacccagcgatgcagcagaaggacccagcatggagcaggcagagatggctctcttccatctgtgcttctgccctgtcacaattttggccttttggagccttagtttcttcctccataaaatgggaacatgggttctcctgagaactttgagataggcgttaagtgaaataatatacttaaggagacttatagagtggtggctattattgttactaatacttttttaaataaaatggaaagaggctgaacacggtatcttgtgcgtataatcccagcacttttggaggccaaagtgggggctcacttgagcccaggagttcaagactagcatgggcaacatagtgagaccccatctcttaaaaaaaaaaaaaaaaaaaaaagctggcatggtggcacgtgcctgtagtcccagccactcaggaggctgaggcaggaggattgcttgggcccaggaggttaaggctgaagggagctgtgatctcaccactacactccagtctgggtgacagagtgagaccctgtcttccaaaaaaagaaagaaaatgggaagagatctcatatccactgggatggctgtaaccaaaaaatagacaataagaagtcctggagaggagtgggaaaattggaatcctcctatgttgcaagtgggaacatataaaatgggatagcccttgtggaaaatttggcagttcctcaaaaaaagttgaagataccacatgacctagcagttccacttataatagcctaaaagtggaaacaacccaagtgtctgtcaaatgatgaatggataaacaaatgtgatctgttcatacaatggaatattatttgaccatgaaagggaagggaattcttatacatactacaacatgggcgaaccttgaaaacattatgcttagtgaagaggccagtcacaaaagactgaaatgtccagaatagacacattcatagagatggaaaatagattggttttcaggatggcagtggggagagctgaagagtgactgctaatggggacagagtttctttggggggggtgatagaaatgtggaattaggccgggcacagtggctcacgcctgtaatcccagcactttgggaggtcgaggtgggcggatcacgaggtcaggagatcggaccatcctggccaacatggtgaaaccccatctctactaaacatacaaaaaattagccaggcatggtggcaggtgcctgtagtcccagctactcgggaggccgaggcaggagaatatcgtgaacctgggaggtggagcttgcagtgagccaagatcgcgccactgcactccaggctgggcaacagagcgagactccatctcaaaaaaaaagaaaaaaaaaaaaaagaaatgtggaattaatggtgatgttcacccaactctgtgaatgtactaaaaaccactgaatggtacactttaaaagggtgaatattatgacgtggattatgtctttttaacattttttggtggaggtaagcaggagagtctttttgcttgctaaatctttgagataaatttcactattattctgaagtaatccccagaagatttgaggcagcttccttccaggtctgtagctgtggtacccatatcacatgaatctacatgacaactcaaggaatcttaccttccaacttacattctgtctttctcattagtatttttataattttctcattagtatttttataattttctttggataaatcttatgtttctagttaagttaatatctgggggttaattttttaggtcaagattatgaatgtaattgctcttttttgtgttcataactcaacagtttaatttgggaggattttatgggtatcttggtatatttgaaatctctgacctttttgaggatgtttcttggtgcattttctagacaaaatcatcacctgcaaaaaataggaatttagcagtacgcttttttctcttctgatgtcttttaagtgtggtgagagtgtagtcctgccttctccttttaaggggagagtgggtaactcaaatgcatcttcatttaccaatgcttctccattatttattaatgcattccattatttgttatgtttgcttttgttttaaatctatccaggtaagatttactctattgatgctctttttatgacataaagaaaaaaaagaaaattaccacatccacttttcaagtgcttcagttgagaagagttcaggctaaattatggtgaaagcatcttagcatagatgacattttaaattcctttaaaaatattagtttgtggcagaaatattggtagtttgcctcaggcaatctatatggtttacttacttgttggcttatcttgtttcatagcagatgctgaatatagattttaaaaattgaattggtttaccctggttttatgttcctgggcaaggtcttctgatcacagtgaataactcttaaggtaaatggttacttctgtttgctgagattttgtcaggtttttgcatctgtgttgggcgtggagttggtccatgagtccctgccctttggaagggaagatctgttgaaaccagcagataagttcatgacatacctgctgaacattcccgttgagtttgtaatgtcttttcttctcccttagagaggacattacaaactcagcaaactgaacaggagtgttcaacagatacatcaggaactgatagggcatgtctttctgttttcctttctcattatttgtttgagtggatatggttgtggacagggacactttaggccgagacctgagctcaagacctgctgtgctacacagcacccagactccctcctgggcatgcactccctgggtcagttctcctgtgaggcaggcctgctggtgccgatgcccatcttgccaatggctgtggggtggaaccagcaatgcagtagctcagtcctcacgttgcctgtggggactggacaggttggtaagtgttcagttccctggttttggggtatgtactttgcacagacttgccaacctgaatacagtcattagctggttaaaaaaatacacaaacatggttgctttgttttttcttttgtttctgggtttttgttatatcacttcccctttgtgagacttctgcttgttactttattcagtttttgcaatccccgtctagagagactgtttctttttatcattatttatttttagtgcaatccaccacaacgccccccctccccgccccagcacagtactgctttggccgtgatcctgaagttttgatatgatttgtttctattttttgtttatttgatttcccgttgttttgttctgtataccttctctaatacagatatatttaagagatcatttttcaattttcacatgtttgagtgtatgctaacatttttacagcatatattttttagaacagtttcagatttacagaaaacttatgtgaaatactgtcttttactttgttccgtggtacaccaacacataaatggaatttcttccttttttagattgctctgatgtcattctgcatcctcttgtgatatcatttccttatgccctgagtcctggtatggagacttcatgtctctgccagttctgatttgctggctattgcagagccccccatctctctctctgcgtggttgacactttgatgtattttgtactaggctgtttgggtcacgataggtttgattaacctatgagtgagtttaatgtcataatgctgtaaattctttatctcataataatattgttgagcttgtatttatgtcagcttaataggcctgagaaccctggtgactgtaataaggcttgatgccacttggtctcctgcggagtcctggctatgcagggcaggaccctgaacagcacatgcagaccttcccggagtggagcaaggtgtctgaggcctccaggtcctctcctgtcctgcagaccaccccagctccttttaaggcctcggaaacacctgatttccctttgactccatcaagtgttgaaaccctgtggcttgtggcagttttgggggggcaagtctgccatttgatcagtgtttactgaccgcatgattgtgaaggaggtgggtgctggacttgaattgctgtttcctggctctgcagatttctttgcctattacccctctcaaggagtaaaatcgtggtcgggggtcgggtcttgctccaaaggctttgcctccctgcctgccaagtgtgaacttctgataggaatactgcttcaaaacagtaaagtgttgaccgagccttcacgggctcctcactgtggttgtggggaatagagagcctgggatactgacaatccgtaatcaagtgagttttatcatcctgtgattccccaggatgggaggatttgtggtctcagctgactgtctgggctacaggccctcggacttgggtcttgggaggcctgatagtctgttgtcctggtatcattggtacctaccagagaccaggcatgcagtaagcgctaataagtgctgttagtaaacattgaggggatggtaaagccagtccctgggatttttcaacaagcctgggtggaaaggtgggtgctgagcagaaggtattcacagcccgtcgagtggatgaggatcagaccttccccctgcttggaccagccctgacaaggagcccagcagtgtctccaccttagcaggtggtgggagggcccaaccgaggcagccaggctaggactagtgggattcctgggatgcccaggcccgccgttcccaggaggctgggcccaccctggggcaggcatcatggcccttcagggacaagtgtgggaccagctggctatgagtgggtggtgctggatcagcctagcagatgaaggaattgaggctcccagttttgttgtggaaactgcatcctggaacaagtcctgcctcattggaatgctgcggctggctctcctggcttggcaagtgttgttcctgttgtatcagatggccaaactggtttaggatgaaagagaattccctgggacagccctgcctggaggcctggttcccctgccctggtggtgtaggccttctccagggagccagagcccagtggaaggtcggcaagtggggttggttctcagtctcctgtgcagacctgtttcaactccctgtacaggtttgtccggagactgaaggggcaacctctactagctagggctgatggccagctcttattgtggagatatccacattctctcttgagagtggggagggaggggggtgactttcctttgtagctgaggaaactgtaattaggtagttgccacagagccaggcagccccactagctggctacagagtaaggacatcttccatatgcagaaggacagtgaggccactttggaaccagcacctagccttggggggaccatcagggaccaatcttgtggcagcaggtgggagggtgcaggcactggcctggggctgctcttcaagccctgccacttctcataaatgggctgattgtggatgaccctgacctggtgcccatgctgcctaagcatcagggtgggcttacacacgcccaaccatgggaacttggccccgtagccccattgacaggcacagtgagggcggagctcaccaagtcatagctgaccagtggcagagccaggacgtgggcccaggcagcctggcttcaggtgtgcacatacccgttggctctcctgctgtgccgccgggaagtgggcagggcagtgggtgcctcttgcacagtggggcacctcggcgaagcaggaggcctatgtggctgaggagggagggaaagagattcttgtccaggggttcagaggccctggtgtgaggacctagttctccttctggccccaccttgtcctaccttttgctttgctgttccttccacctggcgcacttccccatcctcccaggctctgatcacctgccactgtttcctcctctgcactaggcacaggtcagggtttcagcccttccagcctatatgtatagttttactttcacagaaagtaacacttgaagagttgttctaaggtggtgggtgtgcccaggtgataactgggagctttgctggtactggcgtcaggaaagaatgaaaaccgcaaaggtaactgtaacctgttgttggtcgtaatcttttactcttccttcatcgtccagcttctgtttctggatctcagcctctatttggggtgatgagggcctaagcgtctggtatgggctcattctaaagccacccagtctcccacgcgctgccccacactggggttgtcaggatctcagcatgttaacactggtccattgacaatagcctcaaccacatcctgagtcagagatatgctgactctggaggagttgcctccttcttgggcatccgaaaggcagtgggatgcctggagaggagaacaaggagtaactccctgaacctgtattttaaagctcctatcgtcagggggtgggtggagtaggaggccacataggctctggtaagtgaattatgttaactgactaaatccccatagcactaagctcagattggtgacattattaacccaggtttcacatgaggaaatcgaggcacattgtgattggcgcccaccacagtcacatagccctgcccctgcagcttatttcagaggtgctagcaggggatgttggctgtgcttccctgagatgggggtggtgggcacagatgggcccgtgctcacaggtacccctgggacctggcctgccttctctatctcctaggggtttgggtggggtggggcactgggctcatctgttggacaggatccttactgccctgttttccatcctgaggcctattctgccagccttctgtctccagccctgcaccatcccacgctacagccagactgtgcacccttggcaagcattgagctctgttgtgcctcagtttctctgtgtgtgtgtgtaaagggggaacatgttcagggctccggtcatggagctgctaaaacaatctaacacacagggtgtgctcagttcgaggcagctgaagatattactggaaagtggtgctgatccagatcccaagagagggttcttgaatctcacgcaagaaagaattcaaggcgagtccatagagtaaagcgaaagcaagtttattaagaaagtaaaggaataaagaattgctactccataggcagaacagtgacttgagctgctggcttaaggatacttatagttatttcttgattatatgctaaacaagggatggattattcacaagttttctgggaaaggggtgtacagttcccagagctgagggtccctcccattttttagaccatgtaggtaacttccagacattacacagtgggtacctcgggctgtggcatctgtaaactggggccatcacagggccatggcatctgtaaactgtcatggtcctgatgggagtgtcttttaacatgctaatgtattataattagcatataatgagcagtgaggacaaccggagatcactctccttgccatcttggttttgttgggttttggtgggtttgtagtaattactgcaacctgttttatcagcagttagtgttttatcagtaattactgcagcctgttttatgtctttatgacctgtatcttgtgccaacctcctatcacatcctgtgactaagaatgcctgtcttcctggaatgtagcccagtagatctcagcctcattttacccagtccctattcaagatggagttgttctggttcaaacgcctctgacagagtcacatgatcagttccacagctaatgggtgctgctgtcctttaaggatggagtctggatgtgggcagttcacctgagcccttacggtgaatgaagaggggccacccagagcctgcactgccctgacagggaccggcagcctcttgtccccatgggactcttagaatgagacttagggcctgagtgagcaaggtcccagtgactccagacccagtgtgctgtgtgcccgtgaacagcaggccattactgtttctgccatgctcgtggatgaggacagggagataacagagatgaggcactcgcagaggtcaggtgctgtttgcttcacaggcccccaggcctgcccctccctgccccgacttgccctcaactccccatttcgtcctctgcttgacaaagccctggggtctggttgcagctgcccttcctccccaagccctctccattgtcttcaaactccccactgacctcagggtggctcctaatgcttcacagagagtccctgggacctcctgcccccatgtcattgctcgtgctattccctcagatgaggctggccttcccaccccatgtggtttttgaaatcccttccctgagcccctgtgatttctccctcctggccagagcttaccccgcccatccccacttttgatagacccagcgtctgtcctgcagcctgtcccgaggccatgccactgtgcaggacctggcctccctaatggtgtctggtcctggctccccttaggcacagatgattgtgctatagtcacatgggtgtggacaaacctgaagacagcattcttggcggtcatgtgttggccaaaagcaaggattctccccaaggcgcctggctggtggtgacctcacacccaggctcacccagtgtgttagatcctgctgggcctaggcagcttcagagcagtgggtagagagtgagccgggagcttgtgtcaagcacagtgttcgcccatagccagggcagccccttgggggttatcaccaaggtgctgcttcctcctcaaagcccagatgagcctagtcttatgggccaggagggtaggaacttgggccttccacctgtgtgtcccttttgttccccagagcagctggagaagttgtgggcacgggtgggatggagggcacatctgggatccccttcccagactggatcctgatggtaggttgggcagagagccctcctgtgggtgggcaggggatcataccctgcagggcaccagcctaggaggcccacagtgaggcaggggaaggaagctgcaaggacaagcccacggctggcgaccccttaatcagatggtgaactccagtgctcttcttagtgcttaattgcactcctggaccagtgcttcctcctgaggagacaagatggggcaaacagcctgtgggagggggaggagggagtaactccagctgtcctgggttgggggtgggggaggtggattttgtcttctctcttttttttttttttttttgagacagggtctagctctatcacccaggctggagtacagtggtgcgatcatgactcactggaacctccgcttcccaggttcaaaggattcttgtgcatcagcctcccaagtagcttgggaattacaggtgcatgccaccacacctggctaatttttgtatttttagtagagacgggttttcaccatgttggccaggatggtctcgaactcctggcctcaagtgatctgcttgccttggcctcccacattgctgggattacaggcatgagccactgtgcccagctgccaactatgctaacttctaacagcatagattaacttcacttattcatggaagtttatatataaacagaatcgcacaacatatactcttttgtgtgtggcttttttcactcaacattgttagattcatctctgttatctgtatagcagtagtttattcatttttcatttctatatagtattatgtaaatagttacatagtcactgtttatctttctcctgatgacagatacttgggaactctggtttgagcttttttttttttaagacggagtcttgctctgttgcccaggctggagtgcagtggcacgatctcagctcactgcaagctccgcctcccgggttcacgccattctcctgcctcagcctccccagtagctgggactacgggcgcccgccgccacgcctggctaattttttgtatttttagtagagacggggtttcactgtgttagccaggatggtctcgatctcctgacctcgtgatctgcccgcctcggcctcccgaagtgctgggattacaagcatgagccaccgcacccagcctatcttctgaaagttttatagttttagttcttatatttaggtatttgattcattttgagttaatttttgtgtataatgtgaggtaggggttcagcttcattattttgcatatatgtatctacttgccccagcatcatttgttgaaaaacttttttttttttcctctgtcgtccaggttggaatacagtggcgtgatctcggttcactgcaacctctgcctcctgggttcaaaccattctcctgcctcagcctcccaagaagctgggattacaggcacccgccaccacgcccagctaatttttttttatttttagtagagacgaggtttcactatgttggccaggctggtctcgaactcctgacctcgtgatctgcccgcctcgaccttccaaagtgctgggattacaagcatgagccaccgtgcctggccgaaaaactattctttgacatcaaattatttttgtacccttgccaaaaatcaattgaccatatatatgaggttttatttctggactctattctatcccgttggtctctgtatctatctttacactagtaccacattgttttgatcactgtagctttgtattaagttttgaaattgtgagttctctcacgttgttattccctttcaatattgttttagctcttctaggccctttgcaattccatatgaatttgaaaatcaccttttccatttctgctaaaaaggctttggaattttggtagggattgcattgaatttcaagttaattatcttttaaagagatttaaataagaaaaataagtactttatatttgcctatttaattatcatttcttccatgtagataaagatttccatatggtattatttttcttctgcctgaaggattttatttagcatatctttaaataccaatgcatatctgctgttgataaattctttcagcttttgtatctctaaagtatttcacctctatttgtgaacagttttcagtgagtatagcattctagttaagtttttttgttttgttgtttaaaagatgttgttccactatctcctggcttgttagagaaatcagctgtcatttatctttgctcctcttgagtcatgtatcctttttcttctggctgatttaaatatttttattatataattggttttaaacaattttatattatgccttggtgtagtttgcttcatatttcttgtgcttggtgttgacaagctgctgatatctgtgggtttataattttcatcaaatttggaaaattttcagctatgatttatttcttcaattactttttctattttcccctttttctcctttgggtactccaattactccttacataaggcttcttgaaattgtgtcatacttcatacttcaccaatgctctgtttgagtcttgcttttgtcttttagcctttttttctctgtgtttcattttggatagtttgctgtggtttttcaagttgactgatcttttcttctgcattgttttatctgctgtgaatcccatccactgtacttttcgtctctagaagttctatctggatctttttctgtcttcctcatttgtgcgcctttgcctgctcagtggtaagtgacgggatgccagccagtggacctcacctgttgggagatggatgtttttgtattccttcatgtgttcttgagctttgttctgggatgtagttaagtgacttggaatcagattgatcctttcaggttttgtctttatgctttgctctgtggtatcagagcagatttaatccagactaattttttcaggccctgggagtgctccccagctgcctgtgcatcaggagggctctcctctgctgttgggagcaggtactgtttttggctggtataaatggtggggattgctttctctgccccctcagtggtccttcagtgacttcttcagctctgtgctccctggtcctcagtggagattctggccctgtgtgcaggtctgcctagcttggctgccctgctgccatcttccgccatcttccagtccctccttgacagggtctgccacgccttgcctcagtctcccatttttccatggctgggaagttcttttggtggagggggctcctggaactcccctcctcctgtctctcactatctagtgcccatgatgtgaaaaccactgcttattatttatttatattctatcattgcctggtttttttctttttcttttttttttttaagttttcacacagaaggtagttctaatttctgcaacaatctcatcttggctgtacgcggaagtctgtatctcagtgtgtttgaaaagctgcccaggagtgttttgggccccaggctgggagcttaagcagaggaaaagatccagggctcaggccaggaggctaggacttgaatgtcgtgtcatggcatttagctgtcatacctggaggaagcttctgaggtgatgtctgcatccccagctccaggctcgtgggtgtgttctgagcagccatgtgtgctggacccttcatttgggtccctcctgcttgtcaggaggcccagatggtctggcgctgcccatgccgcctgcagccggcgggcccttcacccaatgagggacttggggcctggctgccacttgggtggggagcctgcagctggggccaattccatgtccggtttcccttcttgtggcccggggtggctggccagggtggatgaggtgctgtgtagacattatgatttggaccttccttgggactaggataaggaagaacagagcagaaatcacagagctgacccgattgccttgaagaaaagcggacatcttccacgtagtgggtgttgtgttgatgggtgggggcaggtgagcaagacccagcctcctcaggagtgtgggtgccatagacatctgtgcatccgcagcaggagtgtccatgtcaatcccgagtccccccgtgcagtcccattgccagcaccagtcttcctgctgggctgtgttgtcctgttagccttgtttaggggtgtcccccgcaacaccacgagacacacacacacaacacatacatcacagcacatgtcaccacacctgccatagcacatgtgtgctcttccaggcaggatcctgtgatcctcacagtgctgtaagatcaatcagtctgtcttccccttgagtcccctgttggtcccatgagagtctatactcagactagaccctggtttcttttaccagtctcctgttgggacgaaatgagttactctttgttttgatttcttgaaattagaaactgtcctgctcagtaacatccttattcatggttttttacattttccctattttcttggactgaattcttagatttaatattaaatagtaaatgagtgaaaaatgctcctttttctcttttaggaaaacaaagccatccgctttcagtcacctctctcttgatcttgttttctgccatgagccaggattaatgtaaaaagataaggtcttctgcaagagctctgtggtggagtggccagtgagacgggctgctgggggtgacacactgcggcccgtctgccctctacccatggaagccctgtcctgccacgccagctatgtgggggtagtgggcagtgggagggaaggagagggatggcacctgcttggaggctgggccactcgcctggggtgtacacgatgggaggctggctggcctggattttggggcatggacatgacacagctgtcgactctcaggtgcgtgggcaggtgggcgtcctgggctaggtgagcacccctttctggttgatctcacccataaggtctcctccctgagccccaaggccctgcacttctttgccacgtgcagcccccgcgccccttgttcctcacccctctggaacatgctggtatcttggcttctgagccaggaactgggcagagtgggtggtacactgtgctggcctctgtctagttcttaccatcactgccatcctcgggcctggggctctgactgctcagcccaggtctctcccagaaggagtgaaggatgagccagcatcaggcagcaggatggacagactccctctgcctttcatatgtggtggccggcgtgccatctggagtggggagaaggtgggggctgtgtgggagctccctctgccggcccccagctgctgtcacacatgcccactgtagctccctgactccagcacttgtcttgccagtgcagacactgttcctcagagaccaggctttctcttattttggtgaagcagatgaaccttgggtgcagcttgttgcatttgcatatgtgcacaccacagtgcacgccacagatgcacctcccaggtcagggggcctcccttcaggcccacagtccccgttgttgttgctgttgttctgcagcatgaatgtcgcctgtgagctgggtctctatccttcggcgcccctgggaggcccacctcacgagtgtcttgtcttctgatgcaggcctttggacaagcacacacaaaccacaagaaggtggctgctgacggagagagccgggaggagagcctgatccaggagtcggcctccaaggagcagtactacgtgcggaaggtgctagagctgcagacggagctgaagcagttgcgcaatgtcctcaccaacacgcagtcggagaatgagcgcctggcctctgtggcccaggagctgaaggaggtgagggggtgaggaggggcctagtctgtggctgcagcagtgccaccagtgtcacatagcaggtgtgcctggtgggtggctgggctgggctggcctctggggacgctgcagctggctggtctgtcttgctttcctggtctcatcctccactgcactccactgccactgtcctccacgtggcagaagggagagagatggacccacaagttccactgcctctggcttgcttctgtctcactcatgaagcgagtcccatgagcaagtccagagcagaggagtggtcagtcagggaggggtgcagttagccccttgtggaggctaagggctgatgcccatggggcactcctcgtcattggactcccccctgccctgggaatgttttgtgtcactcagggcctgcactgtgcccagctgtaataagaacacaaaccccaaatattccatggagactcgaggtagggtgtgcgtgtctgagaattaggggtggagaccaccgccagtagccccagctgccacacccctgccttgttcacagcagagtgcccgcagggagggtctgggtgggtggtccctggcaccagagcctgttggagtcctgggtacccatggacagccattggtacatggcacaggctctacatctggaaatgggactgtggtgtccgtccatgaatccgtccaagtccgtgcatgacttgtgaacatgaagtcagaggaaccagcttggctcttgggccctgataggggcaaaggccacaggaccagctgctcatggccctgacactaaggccctggagttgtggaggactggggagcccaggggaacgatgtggccaaagcaggatttgggaaggttgctgtggtgcctggaacctgtgtagtttgagcccagcaggaggaggagagccaggagtctccatccactggggcaggtgggaggagagtctcgctggcttgaacaggaggctcagggaaggttgagtgagcacctgagtgtcttttctcactgactggcacatattttaattgagccctgccagggcctcggtgtctgtggaacctgaggaaacagtgtgagcaaagcctcattctcctagaaggcatgtggcagatatcaggggagagcagtaccccgtgcctgtccctggggcaggggcatgttcactgtggtgctgagccaagggcaggaggagtgtcaggagagtcctgcaggcctgggtggggccctgaaggaggcagggtccagcttgggtttggtggctacacggggagtgggctgtggggacaaaagtgaggctgagacgactgtcttgggggcaagaggggccagtgccttctgaggaaggatgaggccccatcaccaagatggaggtgggatggtccctggggactgcaagtggagctggaagttggcacgtgagctgcagtcctcctggccgtggcctttgagggtcagccccaggttctcattgggaatggctggaggagtggagcatgggtcggttgagaatgggctgatactggctttgcctttcactgagccttggggcctgggcaaggccttatctttagtcctggcctcagtttccccatctgtaaaccggcagtctctgaagcccgttgtagaggatgccccacaggtctttcaccccacattgtgggagcacttatggacccttgttcctgacacaggagcaccaccctctgcagcagataatcttacgggaggtcagcagggcataggccctgagggtatgcagtgattagggctgctgctgttggcttagcattccagtactgaaggatgctgccctcggggtcagcagcggagtgaggggtcagagatcgctgaggccctaggggcccagggaggagcttggcttagactcagggtggggagtctcagatcctgaagcggcagtacatgatctcatttcctctcacaaggagccctctggtcggtgggaggaggggctgtgtgtatggagagatgtatccttggctgccccagctgccatctgtctggcccgtctattcctgaaaagcgtgtgcaggtgctgtctccccagcccagcacattctgccccttctctcttccaagaggcctatctctggtggcagaggccaaagagggctgggtgaccctgctggcttcaggtaagactggaaatgagcacagcaagttaaagatgctgcaggtcttgtggggaagagaggatttctgtggttcctgtttgtgcttcaggaggaaatcctgagactccctgcacacccctcagccttccctgtctctcctgagggtccccaccttggtccctgggtctgctgtgtcccccatgactgtgtccctgccctgggttgctgcagagctgtgggaaccatcccaggtcttcgccttgggtacctggttcgggtggagcatctctaggactgaccttgtctcaccaccaccagtcccagtcatgcatagctcttgtcttctgctgcctgctgttctgctggtctgagccactgtgccaagcttctctgtgcccacccccagcgtggctttccccagtcactgcccaaggctcacaccccatgggtcagaaagggtacatttgacgataaaacagccttcattgtatcctttgacccaccaccctgctacccacaacagcccctccccttttttcctcccttgggtcaactggttgtctgtccccctccacaccccaacacaccatgaggacctgtgaagctttacagtaacaaacatatttggcatgtgttggacagttctgattgcctcagacctggtccttctggtgaccctactggtatctcgtcagatgtgaagaaacagaggtttgcaaggttccatcatgtgcctaaggtgtcctggctggtagggggtgaggtgcttctcagatcctgactctaaccgctgtgtatgtgtgggccctacatgtgggcagcccctccagcttctctcctgctagtgagagcatctttcctgcctgggcccctgggaggtgggtaagcttctgaggactggcctggattgggccttggtggggatgtggctccatttcccagatggggaatcagaggcccagagagccacaggaggcctggggtcagagctgggtctcatacacacaccaagatctttcttcatatttgccccaagaaggagtagggtgaaggggctggcctaggccatcaaggcagagatgagagtttcctggtgttgaggttgtctggtggggacaggagagagggcagccgaccccctgcacagtggctccttgaaacaggcaattgtcacaccctgcttgctgatgagcagtctgaggtgtggggatcccacaaaggggagttgagatgggaccctggtggtcagctacaggcctgtgctcccacctccttcatttgggctgcccagtcacacgcagcagagcttgtcccctgtacttctttgggctgacatcagacaggctcactgggagaaggtgcttacttgagggaaaactaaaccccatggcgaccagtcagcctgtttgagcccttggcaattggccgtgtgctggatggaggtgctaggtggcaggccacatgagcctggctgcctacgcccagtagtgtgggcatggaagcacagtgtttgcgtcctactacagcatcagcagagatggtgccatcatcacccatgacatggtatggccaggccagcatttgacctgggtgtgcctctgtgttctgggtttggcagtggtgcaaggacagaactcctagtacaccttgcctgggccaggtgatgaaggaccctgaggactcacatgagcactgccaagggaacagcagtctcgtgtgtgcctctgggggaccctaatggtatgaggcatctggccaggctctctgcttcagtctttagttgggcatgtcactatctccctgcccaggcacatggaagcttctgggctctcacttcccactgcctggagcaccttctaggtttgttgatcttgactggcaggcctgggagagttggtgggactcagaccttcccctcagcttccactccgcctgaggagccggctgggtggccgcgttgaatcaagtggcacatgtttgcacacctgctgcagaccacttgcttgccagttagcaaggaaaaagcaggaactgggcaaacctttctggcagagaggtacccaagtctccagctggggtgtggagagcctgggtgtgacttggcttgtgcagctcccctaagcacactcctggggggtgctgcactctcactagcaggagagaggctggagagcctgcccactccctatccaccccccgtgtagccactgtggggcccggccctggtgatggctgtgctggtgctgctttctcccgcttcgtcccagcatgcacctcgctcactttctcctctggtacaaggctttgccaggccttctcttcctccctgtgtggtatctctgtttcttttggtgtcagctttctgtcacttccttgggtcacttataatgagagggccatgtctgcgtccatttgctgtaggttttaaatgtaatcttcattgtaaatagtaagcatttgtcagtagtacttgctgtatattgttgactctcctcccctctctgttgcattccttttttcctttgttttgggagggatgtcctatttcattttgccagtatgatcgttttgtgtgtacttgcatgggatcttggaatcttgtctataaagtatgttccattcagatgagtgcacacatgtgaccaggagaaaccatagcataagccaagagaacagtgtgagaggtgggcgaagctatggggcccgcaagatggacagggcttctggccgagagtccaagagggctttggagcaggggtggtgatggtctggggagccaggcctttgcagatacacagggaggcagctgggtcagcagagtacagggaggggatagagagtttgtcaaggggatgattttgcccctgggggacattggcaacgtctggagagatttttcagttgtcacaatggaggaggcagccgtgtctggtggccagaggtcagggagctgctagacatatgatgtacaggccggctcccaccacaaagaagaaacgtccctgaatgttgctagggctgcggctgaggggcccaggtccctggcacatggcagcaagttggaaattctgtcttgattgcatcctgtttgccccaaccctgcactagcctctcccatgacatctcttggctccttatgggcaacttagagcctgaactaatttttaacagctttattcaggtgatttacatctcatatagttcacccacataaggtgtacaactcagtgtattttatgatagtcacatatatgtgccccattccacaatcttagaacagttcattgctccaaaaagaaaacccatttcagtcactccccatccccctccccagctcctggcagccactaacctactttgtgtctctatgaatttgcctattctggatatttcatggaaatggaatcatataatgcatggcctctcgtgacaggccttctttcactcagcagaatgtgttcacgggtcattcatgttgtagcatgtgtcagtacgtcattccttattgtggctgaacaacattccattgtgtggagagaccacattttgtttattcattcatcagtcaatgggcacttgggctgcttccaccttttggcaaaatgaacgctgctgctgtgaacatgtgtggaccggtttctgtgtgggcatgtgtacatttctctggggtagaccctctgtgtttaacagttgcagcacctgcaggctgtttgccagagcactataccatttatatgcccacctgcgcactactgtgtacatgcccaataatagaaggcaggaactacttttaaccccattttaatttaaagatgaagaaaccaagggtcggagcaggcagtcacgggttcccaggtgagaagggctgagggaatttactctggaacctctgcagtccgctgtgcactctggcatactgctctgggctccctctcctctccaggcagtcacactggcacctgcaggccagggctcttgagttctggctgtatggctggccatggcgtgcctggctgcactgagcccctctcgtgccctgtggaggctgctcatacctgcctttccctctcccccaacagatcaaccagaatgtggagatccagcgtggccgcctgcgggatgacatcaaggagtacaaattccgggaagctcgtctgctgcaggactactcggaactggaggaggagaacatcagcctgcagaagcaagtgtctgtgctcagacagaaccaggtgagtcttgggcctgtggggtggaggtggcacgtgggttaactgggccttgaggacctcttgctcagcccctctccctgttgggaaggggttcctgtcttattccacacacccgaggcccagggccagctttaccactgtggaggcaggggtatacttggtgggacccagactctccaaaagatgaaactctggctgcagtgtttgctgacattggccaggctgaggtgtcccagccaacaaaaatgaaaacaaaaatctgagaggtaatgaagaggttacaccagaaaaccccagattggactttgagactcccccatcaggtgctgaccatgaggcctgcaatattcctgtgtctctgcctgtgacagggacaaggaaggtcctctctgtctgtgacggggatgaacaggaacccctctgtctctaatggggtctcagagggacccctgacagggacgagtagggtctctgcctgtgacagagatgaataaggagggtcccttctctttgtgatgtgactaaattgtcatgtgctctgctgttctgccactcaaggcctgaacttgctcttctctctgcaagagccacactcctgcatggtggggaatgggagtcttttctctcccaaaactttccccagaatgccatggatgtcttccttgctttcctcaaatcctctaccaccaaaatcctctgagtctcaccatcagggaatgtggtatttatgcccggaggaggaagctcatgtgtttatgcagagctcctagcctggtccttctgtgacagctcgagctcattaacagtcttagccactgtctacattgtaagtaccatttggtcattggtgctgctgttggcagagcccagcgcatggtggccttaggagaagggaaactgaggcttgaggcgaccctgtcctcaggttggcgcttagtggagtctgactctctctccctctctgggattcctcacctccgcatttgtggtgctgggactgagggctccatgcccacctcctgtgagcacaccttggatgtggtaatgggtgtcccttccgacccaagacccacagagatgtgctcagcacttcctgttactggtttgtttcttatttttttctccaaatattacagaaaaataagaaatagttttagcaattgcccacaaattctgagcctccacatcaggcatcagtttctatctgctttttccttgcccacctgcagatacaattttcatgtagacaagactttgatgttgcttttcccacctaccttcgagctcctccaggtctgggtgtcatgtgcatgtggaggtttagtggttgagatgttctgccttgcggggagtttctgttccttcattttgaactatgattagaagtcatgatcatagcacacattgaaatatatttttatgtatcttaagatatttagttaactgttaatgttaattaaataactttatagaatttttaatcagcatgcacttggtaatatttgtgaatgacttaatacaaggttggcagccttctatggatggatgtgtgttgttcttggtgcatctccacacgtacagtcctggcttggggccacctcagacatttgtgctccccttgctgtgtctgctggtcccagcggtgggtgggctgggctgagcatttcattgcattcgcatctcatgccctggaaccttcttagcatccacatctctgagcagaggaagcagtcttggcctggacgggctgccacccttcccaggatggcacctcacctggcgcttcatcttttgcttcatagtggccggagttggtgtgctggtgtgttttcttcatttatggggcctgaaaggagcttccacattgcattgatgcaagagcgttgacttctcttcccaggtggagtttgagggcctcaagcatgagatcaagcgtctggaggaggagaccgagtacctcaacagccagctggaggatgccatccgcctcaaggagatctcagagcggcagctggaggaggcgctggagaccctgaagacggagcgcgaacagaagaacagcctgcgcaaggagctgtcacactacatgagcatcaatgactccttctacaccagccacctgcatgtctcgctggatggcctcaagttcagtgacgatgctgccgagcccaacaacgatgccgaggccctggtcaatggctttgagcacggcggcctggccaagctgccactggacaacaagacctccacgcccaagaaggagggcctcgcaccgccctcccccagcctcgtctccgacctactcagtgagctcaacatctctgagatccagaagctgaagcagcagctgatgcaggtgagcaggcagtggggccttcggcacgctgtccccactccaggtctgcagggctccccgagcagtgcttacctgacactctgctgatgttaactttcccttttccttacgttgattttatctcctgcatcattacggtaaatggaactccaggagcacacatagaggagtctcagagaagtggtttcctggcactgcagcacccacattgctcccctgttaactacgtggtgtcagggtgaagtgatgagacactggcccacatgtgatccctgcacgcaggccaggtgtcaggggcccaccatggtcatgcttgggctcatcccctgggacatggatccctgttgatccaaggcaacagagtcctgtcctccgaagcagagggctagggtgctaatattcccgactacacacccagccagcctagagctccactttcttagcccagatcccctgtagcatggttggggaaagagcctgcgttgagggtgaccaccattactggtgacggttagtgttctgagggcccagcatgaattccattctttccacaccctgtgtgtctttgtccacctcactgacagcatggccaaggaacctggggctgacagcctgccctgacatggggtgggatgtcactaggccatcttgggggtcctccaagctctcggggtccatagcaactgacatggtgtcctgctgcctgtgcctttgcagatggagcgggaaaaggcgggcctgctggcaacgctgcaggacacacagaagcagctggagcacacgcggggctccctgtcagaacagcaggagaaggtgacccgcctcacagagaatctgagtgccctgcggcgcctgcaggccagcaaggagcggcagacagccctggacaacgagaaggaccgtgacagccatgaggatggggactactacgaggtggacatcaacgggcctgagatcttggcctgcaagtaccatgtggctgtggctgaggctggcgagctccgcgagcagctcaaggcactgcgcagcacgcacgaggctcgtgaggcccagcacgccgaggagaagggccgctatgaggctgagggccaggcactcacggagaaggtctccctgctagagaaggccagccgccaggaccgcgagctgctggcccggctggagaaggagctaaagaaggtgagcgacgtcgccggcgagacacagggcagcctgagtgtggcccaggatgagctggtgaccttcagtgaggagctggccaatctctaccaccacgtgtgcatgtgcaacaatgagacacccaaccgtgtcatgctggactactaccgcgagggccagggcggggccggccgcaccagtcccgggggccgcaccagccccgaggcgcgtggccggcgctcacccatcctcctacccaaggggctgctggctcctgaggcgggccgagcagatggtgggacgggggacagcagcccctcgcctggctcctcactgccatcacccctgagtgacccacgccgggagcccatgaacatctacaacctgatcgctatcatccgtgaccagatcaagcacctgcaggcagccgtggaccgcaccacggagctgtcacgccagcgcattgcctctcaggagctgggccccgccgtggacaaggacaaggaagcgcttatggaggagatcctcaagctgaagtcgctgctcagcaccaagcgggagcagatcaccacgctgcgcactgtgctcaaggccaacaagcaggtgaggtgccaggcagcaggggcacatgtcacctactactggcctaagggtgtttcccccttggcctccttcctccccctgccacggggcccccccaggcctgcgtcaccaccagacagagccagccccatagtagctcgactgcctaccctcccctgctcagggcccccagctgggagggtggagcaggcaggtgggtgtgagggcccctcagcagagctgctcagccagtgagaaatgccgctgcccttgactcactgtgactgcctcgtagtgcttcctgatactggagggaaaacatgtgagagccatagtctgagctgtggagagcaattgtggggcttcgtggaggtcctgttggcaggtttaggggcagtccctcctctgccagtcagaatcagcaggtgggactccccatggcgtagctgctggagtccatccccagggtttgtcacagggaggggcctcccaggagctttcttcccaggcactgccaccacttcagaccggggctcccgatcctgctcccagagcacctctaggctgacttcacgcctttcacttttccaccctacacatctgtcccccagacggccgaggtggcccttgccaacctgaagagcaagtatgagaatgagaaggccatggttaccgagaccatgatgaagctgcgcaatgagctcaaggccctcaaggaggacgcagccaccttctcctcgctgcgtgctatgtttgccaccaggtaaccgtgctgctgtcgggccctccccttccacaaggccagctgtcctcagcacttgcctctggaacccttagcctctcactgcctcatgctgaggcctgcagccctgactagtcagtggctgtgcccagctccatcagggccagcatggtacgaggttggggaagcatggcccctggcacatctctggcacactggtgctcaagttggtgacaagaaagggtgaggcgatatgggggccacatggggttgggggcccctagctgctgcacctcagcttcctccgaggtcacgcaagcagttgctggagcatagggcatgcctggcaggtgcccacatgtggccggggatagcagagcgtgtgtgatccttttaatgttccttttgcacctagcccagcccccaggagcctggttctgtggcgccggttccattttgctgtgaatgaaaccgcagcaggcccaggcttgtctctgctttgcatatatggagactgagggcagaagggctgaggagagcagatcctggagtggatgggccagagttgcatagcttcaggggatgcttgggctcccaccccttgaatccaacatttacagggacttaacttggggccaacaggtgacagaggagtcctggcctttcctctcatgaggtatttgcccccaagaacttggccatatggcacaagtgtgtatttatgtttgtagattcagaaggaagattatcctcctggctggagcaggtcactgctggggtccacagttcgggtcccacctctgtgcatagccctgtacctctgcgtcattgtgaccgctgggtactcacctcccatcctctactttgccaatctggggagggtgaggagagggccggggcttggaggagaccagctttctttcttcctctgtggagggctcttagtaatgggctctgaggtgggctgcccctggtgggtgcacacccctccctggctgggactcagaccccaaggctgggaatcgaggctccctaagtgttcacaggcctctgtggggcaggtcctggtttcagcatcttcccaggtgccccctgacaggtaccgctgtctttcactttccaaagatgggtagcgccacctgctgggtcatgttgggatagcaccatggggtcagccctgcatgggggacagccaggcccaccatgggcccagcagataacctagatgtttcctttttatgggtgagcaagctgaggatctgagctggacagggtgggaactgcatgcacatagggcctgcttctctcaagcctggtgccgtgcactcccagtttctcagtatccctgcaggacgtgccagagcagggtacagacaaggaagagtcccaggatttctctggaagcgtcctgtcttcctggggcttggggaaaaaatcccacagtttctcagtatctggcatgtaaaccctaccttttaaaatttgttttatttaaaaacttttcagatggagccaagattttgaatctgcagggatcacagctctgtgtgccctcaaaagggtgggcagcagagtccttggagagggtgctatccaagggccggctcctggcaggtggggacaggcagagtagggtgcgtgtgggcagggtggggctgtgctcagtgcctgcacagcctcaccgccctgggagccctgggatttaacccgccctttgtctctaccaagccccacccatatgggacatgtggaagaagggcatccagggacagaccacaccctcccacagctccgcacccgggtttcaggatgaagctgttgatggcgtccacacacgtggttccttggctctggtcagtgctcagcacagactgacgaagcatcgaccttgggaacaagcccagtcctgcttagatttacatccacaccctagaagccatggcttctccatgtcttgatgccccaggccacctcgaggcctttaagcggggagagcgcctcctagaagaagcccagtcgctgaggggcatagcctgtttgtaagcactacatgcagctgaaagagcaaagcagcccctcccccacaaaaccacaaaactcaagccagcctcatagggctgccctgcctgggcccaagcctccctctcacccttatcagggatttgtccaagcaaagcctgtgctaaaataagccagaataattcttccccagccacaccctccagtccagaggccacattgaaggatggctctggtatagggctgtcagagggccgtgcagcttagccctgccctgccctgccctcctctgctcggctctgcccgcccctcagtcatgtttttggtacccacaggtgtgacgagtacattacacagctggatgagatgcagcggcagctggcggctgctgaggacgagaagaagacgctgaactcgctgctgcgcatggccatccagcagaagctggcgctgacccagcggctggagctgctcgagctggaccatgagcagacccggcgtggccgtgccaaagccgccccgaagaccaagccagccacaccgagcgtaagtcacacctgtgcctgtgccagcgacagggccgagggcaccgggctggccaaccaggtgttctgcagcgagaagcacagcatttactgtgattaggggctgtggggcgccgcacgctgcagctaacatctgcttcacctcaactaacccagcagcagcgggacggcggtgctaggtcaatcttaacgtgactaatgcacagagggtaggagtctagccgaggcgccatggggcgttgcatcagcaggacacttgtgagagctttgtgtcgcttctcactcctcaaagccccctcaggagcacccagtcctcagctgctctcttaggtgggggtcagaggtggggatagagctgcacattcttgcagcagatgtgtgatgaaagcatcttctaagccctgcgcacccgtggggaaacccaagggaggagtcctggtcctgctccctcagcacccaaaaggggcagaacctgagttgagacttgcatgttcctcgcatgtgtctaatgtcagcactagaaagcagttttaggaggttccagcctgcagcataggtacgacctcagaggatggctttgcacttggcatagtttcatggaaaggagtacgttgtagtttatgcagtatctgactgcaaatcatattcaggaaagaagtgcagaatttcttccccaagcccagagaagagcagccctgagcccctgtattctgctggccagacacacatggcacagacacagctgaccataacccaggaatccagagctcggtttctcatttctgagatcaggatgcttgtatagtggcctgtgaggtgacagattggcagggcccaaggccccaggttttcatttttcatgagaaaagctttccaagtgcctggccagaccttggtccttagtgcagagcccgtccttttgtacttggggtgaccccagcagccaattatccggccttccatagggggttcagtcccaaagacatggggctttgaaaaccctagcctgaagtctgagccaccaagggcttggctgggttggacacccacaggtgtatccagagcccagcccggtgctgggaaagctttgcatagggccagggccacttgtcaggattcacaggtaggagatgtttaggtctctttatttagtgcaatctgggggatggcaacagagaaagaggaaaggtagctgtagggttctcccatttccagaggctccatccacacctgccttcccacattctgagcagaacttttctcagtacttttttcccgatcaccctgtgggaccagctggacctgaggctgcagtcttctctcctgcaggctgcttgccttgtctctcatgcggaagaggcattcgagttacctggtgagagaccgtgttgccccctcccacagctctctgccctgcgcgttcttccctttggtgccgagtatgtttcggtcccctccagactccaggacacgcccatgtatgtcccctgcgtgttcatcctgggcccagatccccctgccccagcaagactcgcagtgggatggctgctggcatgcccaccctgcatgcgctttgccctctccttgcaagcctggcacatagcttctctccatactcctaagggactttgcagacacccaagccactgggacccctgctaacacatgcaggtcttctcttctgccaactaacgtgctcgcgccctcccagcacgtggagagcttcaattgtcagataaacaggaagcgacagatgaccgctttctaacgctctcttttctcccgttttcagctgtagagtagctgccaggaggacttggccacccggccctgtcacactgcagccccttccccttccctctcgtggcccacaaggaggaaggaagggcaacctaaaagcccacttagaaactttttggatatgccactgcaattcttttcaaaatagcattccccaggtttttaatgggaggaaaaaaagctttaatgttgagcatgctgcgagctgctgcgtggaaaggcctctgtatgggccgaagacccttcttccctggctgccaggctcgccaggagcccactggaaacgcccaccacgggggctccttgttacacatgttctttttttatccgatcaacctgtgcacttttgatattttgatattatatttgcttccttaattcctcgcgtagagacggtctcaggtgccgtggtctatgctcgtggtcctgtagctgtccgcctcagctcccaccgtgtttgtctggtgtcagcacgaggcagagctgtgtgctccatagcgtgtagctttagactcggagatgagtgctttgacccagcgaggagctcagctaagtgtatccacgctgtggttcagcagcctttagatcatacggcattgtggttcatgtttgaaattacagattttaaatgccatgttcattaagaaatccagggtattcagattctggggtttttcatattgtattattattattcttaggaatagttcaatgtaacaagaagaaaacttgacctttgctctggttaaaacagtaataggcacttgaaaaaaaaagataaattattgaatgagtagtattacctacaaattccagaattttctgggttttaggacgttgtgaagcatgactgattaacagaattttatacaactgtaccaataaaattccaaattggaattgttttgttactctggttgttgtgccaaattgtggtacacttagaaaattctacagtcgtcgatttttagggtgttctctttcaacacctttttgttagtaatcattgccagtagtgccttcatcagttaagggaggtgtcccagcacagatcattctcaaaagcgagcagggaagagctagtgggcatgctgaaggccagcgtggacagcaggtgaggcaggtgctcctcacacccagacctgggcatcttcattgagggaaagaaaacagtcattgtgcaaaattctgttagtcagtgattctttacttgcaaattcaggggcttagaaaatgaaagcaaacacaaaaccttgagtgtgctttgggaaccaaatggaccttctgggacaagctgagcaagctgtatgaacgccacgtttgtgaagagctgagggtatcaggagggccgacgctgtgttggcatgcgcagtaggggatgagggttagccatagtattctttgcaaatgtgaaagcgagacattatatcttctcttgcttggtgtaactaatcactgttaatttcaggaaacagaactcattaaaactccttagcaaaccaggtctacatcctgttttgtttgctgagtgaggttagtgggagtggtcaaattggtactcttggaggaagaaaaactgtccttccttctccaaaaaaggaaaaattataataatataaatgacaaaaataaaagaattctgtttcctggaataagcatttcttattcctagttgtagggactcctatttttaccttccgttacagtgttgattcataagaaatattgttacatttgagataacttcatctgtatggggtatttatttgcaatgatgtctgagtactgtattttttctgtgcattaccttagtgtcagaatgttggtctttattttaaagtcatatgcatgttctcctgccaaggaacctttacacagacccaaacaaaaaaataataatcaaatgccttcaatttctgagaaaatgaggcagagcatggaaaaggaataggaaggagaaattaattgagattttcaggacacagacatatgatgtgaatgcctacaaagccagtgcgcataggaacagtgggcctgggtaaagagtcacattggtaggaccaataaagaataataaaaagacaaagcaca
